United States Patent 7,750,207 (ZEA MAYS RIBULOSE BISPHOSPHATE CARBOXYLASE ACTIVASE PROMOTER) - sequence listing, part 13

SEQ ID NO: 17613 - DNA, 1622 bp, Zea mays
ggggaggtccagctcactagtcccccccccccgcccttcttcgtcttcttcagcttcactgagtcttacgaacatagcaaaatccaaatcaaattcctgaagaaacctctttcgcactcgtcttcgttttcagatcaacaagaaatggcaacagcaacatcagcttctctgttttcaactgtttcttcatcttactccaaagctagctccataccacattcaagactccaatctgtgaaatttaactcagtccctagcttcaccggtctcaaatcaacctctctcatctccggatctgattcctcttccttaaccaagactctccgcggttccgtaacgaatgcacaaacatctgacaagaagccttacggattcaaaatcaacgcttcgtacaaagtagctgttcttggtgctgctggtggtataggtcagcctttatcacttctcatcaagatgtctccgttagtctctacgcttcatctttacgatatcgccaatgttaaaggagttgctgctgatctaagtcattgtaacactccttctcaagttcgtgatttcactggtccttctgagttagctgattgtttgaaagatgttaacgttgttgtcatccctgctggtgtgccgaggaaacccggtatgactcgtgacgatcttttcaacatcaatgccaatattgtcaagactcttgttgaagctgttgctgagaattgccctaatgctttcattcatattattagtaacccggttaactctacggtacctattgctgctgaagtgttgaagaagaaaggtgtttatgatcctaagaagctgtttggtgtcactactttggatgttgtgagggctaacacttttgtttctcagaagaagaatcttaagcttattgatgttgatgttccggttattggtggacatgctggaatcaccattttgcctctcctctcgaagacaaaaccgtctgttaactttactgatgaagagatccaagagctcactgttaggattcagaacgctggtactgaggttgttgatgctaaggcaggtgcaggttcagctactttgtcaatggcttatgctgctgctagatttgtggagtcatctcttcgtgctcttgatggagacggagatgtctacgagtgctcgtttgtggagtcgactctgactgatcttcctttctttgcatcacgggttaagatagggaagaacggtcttgaagctgtgattgagtcagaccttcagggattgactgagtatgagcagaaagcactagaagctcttaaggtagaattgaaagctagcattgacaagggtgtcgcatttgcaaacaaaccagctgctgcagcagctaactagatcgcaagctgataacatttttcttctgatcatttcgagttttgttttatttttcatatttgttgcatcggcgagacattttcgtgttgtagaataaagaatgtatttgcttcagtttgaagattttggaacatggcattgaagcagaatttataaatcatcaccaaaaaaaaaaaagaaaaaaaaaaaaaaaaaaactcgagggggggcccggtacccaatcgcgtgttaaacacaataaagttggaacgggaggggggaaagta

SEQ ID NO: 17614 - DNA, 1660 bp, Zea mays
ggtggcggaatctccttaaaaaacaattggcccacacacgtttttccccccggaaaaacggggccacgggaccccacccccaattaaagggggggttaggccccccccctaagggccccccccgggtttttcccctttaaattttccgggctcgtatttttggttggaaattgggaacggaaaaacaattctcccccacggaaccagttttgcccctgattccgcccaagcttggaaattaaccccccctaaaggggaacaaaaactggagcttccccccgggtgggcggcgcctttagaactagtggatccccccgggctccagaaatcggccacgagagctccgctcactagccccccccccccccccggagcaaccaatgattttttcgacgaagacaggcctagattcgttttccaatctcgtccttcttcttctcacacggcggaggaagaagaagaagctagaatccctaacaagcttttcatttcaatctccgtctcaatctccctcatcatattatctctctccttcttctacttcgaatctgaacctgccaaatcgctactattatggctttccctctctttcctcgtcggtcctttcgctcctagctcgctcaccggaggtaagattcgcgtcggttatggtcagatcttggagccagaacagattcacgatgagtcatccacggataacgaacgtgaatccaggaggaaatcggtgaataagcgatctaaaggctcgacgaagagcgataatccgccggaaaatgcttctgcggtgactgaagtttcgaggaaagtggtgattccgcagtctaaggagagtggatctgtgaatgaaactaaagattggactgctgaagagatcgagattttgaagaagcagttgattaagcatccagctggtaaacctgggagatgggagacggtggcttcagcgttcggaggaagatacaagacagagaatgtgattaagaaggcgaaagagataggtgagaagaaaatctatgagagtgatgattacgctcagtttttaaagaataggaaagcttcagatcctagattggttgatgaaaacgaagagaattctggagctggtggagatgcggaaggtactaaggagatttggagtaatggagaagacattgcattgctcaatgctttaaaagcttttcctaaggaggcagctatgagatgggagaagattgcagctgcagtacctgggaagtcgaaagcagcttgtatgaagagagttactgagcttaaaaaagggtttcggagctcgaaaactccagctaattaactagaggacatctgtacgggattaaggcaaataccaggagaggaaaaacaattttgtgtttgctgcttgagattattgctacaacgcccaaagtagtgaatagagttctgcaggaagtttcttttagagagaagaaaagaaagcatctcaatatgccaaagaatttaacataaagttatgagttcttctttacttcaagctttgattcgaattacaagacttgagcatctgtgtatcccctccccaaagagcacctattttattactagggaaatatataaaaagactatatatattcttaatccaaaaaaaaaaaaaaaaaaactcgagggggggcccggtacccaatcg

SEQ ID NO: 17615 - DNA, 748 bp, Zea mays
  misc_feature (11)..(11): n is a, c, g, or t
  misc_feature (21)..(21): n is a, c, g, or t
cccgcggtggnggcgctctanaactagtggatcccccgggctgcaggaattcggcacgagtcactagtcccccccccccccccaatgttaaataatattggcttgtaaacttcatttttgttgttatataagatattatcataattgttagagtccaaacaaagaaagttgaggtttgggtaatgtttgaagttcctttcaaagttatttcaagtttcaaatcttggcctcatatcttgcctgcccaatacaacaggatttgctctcctgaaagtaagagccagaatgtaagtgcgatgcagtaaaaaaagttcgcacgcagcccgcaggtcgagaaaaatttcgaacccctgtcccatccatacacagccgcaccgtagcccatgtgagaaacaaccgcgaccgggaccgggccttagacatgtgctttgtcttgggacagacgaggaagtttttttaaccatagtctgaaatttgctcccacagtgagtcgaactcaggacctaaggagggctactcagaccatctaaccaactcagctagaggtcttttcgcacgtgcaatgcacagggttagatgttttgaacaaatggaaggggtgtaaattgcaattttatacggcagagatgaattttaagagctatttgaatcatggatatgtattctgataaataattttccttgagggatggaaccagaagtgtatgaggcttccagctctgtgccaaagtcccttcatgcctttaag

SEQ ID NO: 17616 - DNA, 740 bp, Zea mays
  misc_feature (667)..(667): n is a, c, g, or t
  misc_feature (705)..(705): n is a, c, g, or t
cattgggtacctcgaggccggccgatttcggcccgacccgtttcgtagtttttttttctcggtaatccagccgttttccctttccccagagattcgcatattctcgcgatgggagcggaggaagcagagggtactcccccgccgctgcccgccaccggcgagcccgcaaccacggcaagggcgcagccaatatctgcagcacaattcctctcctggaagcagcgcaaggatgcagaggtagccgcaaggaaagctgaagcagctgagaagcgagctgatgatatcgcttcgggagcggcgcagatgaacggccgcgagctgttccaacatgagccctgggtgttcgacaacaacatttactgagatcgtgtcgggctactgttcctgcattagtccaagctccagcggtggtttcattttgtactgctatatcagctttgcgaaactgtggattttatttcaccgtttctaagattattctctcaataggtaattgaacttgtttcaaatacgttttgccaaatctttgtgcagtcaccgaatggtatctagtgtcgctattctttttctaaaactcttacaaacaaagagtattggtcggaagagaattctcgatcttcagaaaaaaaaaaaaaaaaaaaaagacaccaggacccggaaaaaaaanaaaaaaaaaaaaaaaaaaaaggaaaaaaaaaaaaaaangggggccccccaacctcaagttttggtccccttaa

SEQ ID NO: 17617 - DNA, 669 bp, Zea mays
ggccgggaagcgcccccacaagaaggctttcccctccgagccggcccggatccgtttcgtagtttctgttctcggtaatccagccgttttccctttccccagagattcgcatattctcgcgatgggagcggaggaagcagagggtactcccccgccgctgcccgccaccggcgagcccgcaaccacggcaagggcgcagccaatatctgcagcacaattcctctcctggaagcagcgcaaggatgcagaggtagccgcaaggaaagctgaagcagctgagaagcgagctgatgatatcgcttcgggagcggcgcagatgaacggccgcgagctgttccaacatgagccctgggtgttcgacaacaacatttactgagatggtgtcgggctactgttcctgcattagtccagctccagcggtggtttcatttcgtactgctatatgagctttgcgaaactgtgtctctcaatagggattttatttcaccgtttctaagattattctctcattaggtatttgaacttgtttcaaatacgttttgccaaatctttgtgcagtcaccgaatgatatctagtgttgctattctttttctaaaactcttacaaacaaagagtattggtcggaagagaattcttgatcttcaaaaaaaaaaaaaaaaaaaaaaaag

SEQ ID NO: 17618 - DNA, 2530 bp, Zea mays
  misc_feature (2374)..(2377): n is a, c, g, or t
  misc_feature (2386)..(2388): n is a, c, g, or t
  misc_feature (2398)..(2399): n is a, c, g, or t
  misc_feature (2411)..(2416): n is a, c, g, or t
  misc_feature (2429)..(2429): n is a, c, g, or t
  misc_feature (2432)..(2436): n is a, c, g, or t
  misc_feature (2444)..(2444): n is a, c, g, or t
  misc_feature (2446)..(2447): n is a, c, g, or t
  misc_feature (2449)..(2455): n is a, c, g, or t
  misc_feature (2462)..(2462): n is a, c, g, or t
  misc_feature (2469)..(2470): n is a, c, g, or t
  misc_feature (2487)..(2490): n is a, c, g, or t
  misc_feature (2494)..(2497): n is a, c, g, or t
  misc_feature (2501)..(2505): n is a, c, g, or t
  misc_feature (2511)..(2512): n is a, c, g, or t
  misc_feature (2515)..(2517): n is a, c, g, or t
  misc_feature (2519)..(2520): n is a, c, g, or t
tcgagaccccaccaggtccagggctgcggtgcggctgcatgctgcacagtcacaggctgcagtattagcgaacaaacaaacacagggcgcgcgggcccagaggaaagaaaaagaaaacaatcatccctggcctcactcagatcgactgggctcagttcgatctcccgtgaccgcgtcgcgcgcgcaggagtactagtaggaccgaccgactgcgtacactgcacgtccggacacacacaccgcgcaggcgcagacgagagaccacgacacagcccggatctccactcggatctcctcctcgctcgcactgtgcgcagagcagcatctgcatgcatgtcgtcaggtcgattgatagcaagcggacaagcaggcacgcattatgcagatcgtggatagatatgcagcatcaatcagatcgaaacacaccgatcgatcgaatccaacagaggcgcgtggagcccggctgccggcaggccggccggcggggctgcgcgcttgcgcctgcgcgcgctggttgttggggtgggccgggttggtccctcgctcgtcacgtccggggtccggggtccggccgtgtccccggcccgtgctggccagccggccgccggacacctgccacacgtacgtatatattctgcccgcccgtccgtccttagcatgcatggtgctgtcctgctgccggcttctgaacgtacgtatgcgggtggcgggtgggtcaccacgtatttgatcagaatgatttctatctattatattaaagctggttcaaaatgtggacggagacggtgtccacgtcggtctttattttttcagccgctggatctgcaatcaaaggacacgcacatgatacagttttccagcctccacaaggggacgcgatgtttccagatagcgcttcttccttcagtcctatcgctcctagggcaatggcttccacaggaaaattgattggcgacgacggcgacggcggccctgacctcacccgtcttcccacgcccgagctggtaacaacctttcttctccacaacatcatcttccattctgtggcttccaatcgtctcttccccttcctttgcgagtttcatacccgtcgacctgcacgccgccagacaccactagcttaaccccctgctgggcctgctacctcccctccctgtcacccgccgctccacaaggataccatcatcacttcccgtcaacctggtgccatgcattgctccctccgccctccccctcttcctcaaatgtcatcaaactactaacaaaggtagtatctgatttcagaattacttcattgaagtatatgcttcagtactcggtatgtggtatgcatgtcttgaaggaatattactggcaatggtaataccattcaaaccgcacctaaaaaatgtaattcattgcatcatggcttctgaggagctcagcaagacttaagccaagtagccaactgtgcagcggtaaaatctcttttctttttcttttttgttattttgcggagtgaagaagcaagcttcctgttaagaaggaataaagtgcaaataggtgacgtacactatgactgattcgtgtgaggaaatgcctttttcacttttttctatcgaggtttccaatatcgccagtgttataattgttggcatttgatgtattatttacagattgttctgcatgttgttatctttcaagggcacaacaacttaaacaaacccaagtcgaatatagttatgtattctctcttgttgctctatattagattacttcatagttgttgaatgatacttcaatggtattctggcactatacaataccaggtttttattatcttgcaaagaagtagctaaatgttactggcaaatttcccatcacagtctcttttttatcccttttttcctttctttgattgtgtgcctgaagaagtgccatatttcaccattaggctttacattttctaatggtgacaaactgaaaatccatctcaggccagtgtcatcattatctacgcaatgtcatcatgttagaatctgtttaaattctaaaatttcattgactttacatgacatataacttaacaaaaaatgttaagtaccaacttcaggaagaaagactatctgatttttctaaaatctgtttttttctcctacatgttcttgttgaccaaattgcaacgcacctcccctccatacacctctcaaatggcgttgtgatgccaatccacaccatatttttccttcgcatgtttgttcacatagtttgctgatcactatattttttccatcgcatatttatttatatactttgctggtcgtttattggcctaattgggggggggggggggggggggactatgagctctctccctgcagcccgggggcccccnnnnccccccccnnnctcccccccnncccccccccccnnnnnnccccccccccccnttnnnnnccccctcncnncnnnnnnncctcccnttccccnnctggcccccccctcccnnnncccnnnncccnnnnncccctnnccnnncnncctttttttc

SEQ ID NO: 17619 - DNA, 1070 bp, Zea mays
  misc_feature (10)..(10): n is a, c, g, or t
  misc_feature (12)..(12): n is a, c, g, or t
  misc_feature (14)..(14): n is a, c, g, or t
gcaccagaanananagatacattaacacacccactagcccccccccccactttcataacttaatcacacacaaggagagaagagagaaagagagaaagagagacagagataatggcgtacagtgcgtgtttcctacaccagagcgcattggcttcatcagccgcacgatcatcatcttcctcctcatcccagcgtcacgtgtcgctctccaaacctgttcagatcatctgtaaagctcaacagtctcatgaagacgataactccgccgtctcccgccgtcttgctctcactctcctcgtcggcgccgctgctgttggttccaaagtatctcctgctgatgccgcctacggtgaagctgcaaacgtgtttgggaagccaaagacgaacacagacttcttgccatacaatggagatgggttcaaagtgcaggttccagcaaaatggaacccaagcaaagagattgagtatccaggacaagtccttaggttcgaagacaacttcgatgctactagcaatctcaatgtcatggtcactcctaccgacaagaagtccatcactgattacggttctcccgaagagttcctctctcaggttaattacctcctagggaaacaagcttacttcggtgagactgcctctgagggaggctttgacaacaatgcagtggcaacagcaaacattctggagtcatcatctcaggaagttggtgggaaaccctactattacttgtctgtgttgacaagaacggctgatggagacgaaggtgggaagcatcagctgatcacagcaaccgtgaatggagggaagctttacatctgcaaagcacaagctggagacaagaggtggttcaagggagccaggaaatttgtcgagagcgcagccacttctttcagtgttgcttgagtgaaagcaacacaacgtaacaatgctctgcttgctttcttcatttgtctcttgtaaaaaatggaaaatgaaactgagcttttgagaactatcaagatgatgttaccttttcggcatcacttgtgtacctatgataccagactcgtttccaagttttcttaaaaaac

SEQ ID NO: 17620 - DNA, 1214 bp, Zea mays
  misc_feature (11)..(11): n is a, c, g, or t
gaccggttgtncctgatccccaagcttgaaataacctccctaaagggaccaaaaattgagctccacggcgtggcgggcgctttagactaagtgatcccccgggttgcaggcacccggcacccgctcactagtcccccccccccccgagagtaaagaagataaaaaacacaattgaagcttttataatattttctcagaaactttcaaagagcttagaaaatgagtacagctactttcgttgatattattatcgccatcctcttgcctccactcggtgtctttctcagatttggttgcggggtatttatctttcctctcatatttagactgagttttattttggttaattaatcttatactttagtcaaatatggttctttttttacatttatccacactagaaattaaaagttgaaattatgaattttgttgcaggttgagttttggatatgtttggttttgacgctacttgggtatattcctgggatcatatacgccatttatgtcctcaccaaatgatttaccatctatcatcatctccttgtaagctctctctctctctctctctctttactctttggctcactctcagagtcatttttgatatagtttttttgtatgaagctttttcattgggaaagtttaagtaaatgtttggtaaacctacacatttcagatcatgttaattcggataatttggtttaaagcaaacgaaaattatgctatgaaaaccatggtttcaagttataaatattattatgataataaattaagatattgttcaaaccacataattaatgtgtacagatagagataaatatctagttattaataagataagattatgagaaatttctgacacaaaagagagtaataagactctaatgtggatagagataaatatctagttaatgaccaaactttttaactttacttacatttgttgtttattgtgcaggaacagctgttccgtcgtgttctcctatctttgtgactgattcagcgtttctttttctttcatcagagtttttatgtttcaagtaatttaattaatcatcactgttgtgtttgcattgttatataaatgttgtgttgatataaaagaagagagcgttggtttgtactttgtgtgaacattttttaaaaatatagttggtttattacaataaaaaaaaaaaaaaaaaaaactcgagggggggcccggtacccaatcg

SEQ ID NO: 17621 - DNA, 1388 bp, Zea mays
  misc_feature (1339)..(1343): n is a, c, g, or t
  misc_feature (1345)..(1368): n is a, c, g, or t
  misc_feature (1370)..(1375): n is a, c, g, or t
  misc_feature (1378)..(1388): n is a, c, g, or t
ttgaaaacgacggccaggaattgtaatccgactcctatagggccgattgggtaccgggccccccctcgagtttttttttttttttttttctttttaatttacagtacaatgtttatttatttcaataatttcgtggagtagtaatactgaaaatctgaaagtcccttaatgtcgtctctttctaccttcccaagctctatatttccattaagaacaaacaaagctttgatacttatttatttttccaaccagagcaaaagctttgtaatagactacctcaaattgcttgcttatattcatctatatatttatttatatagaccattatatatagaaatggctcactgagtcagtaaggtggtcttgcgtggacccatgtatatggttcgtgccctagctgaccagccccatttggaatcagatgcggcggcatattgtagcctggcccggccatccctgatagatcaggcaggttactaccgattctgggcggtgagtcaccgcctccgtgaatctgtcttgagccgccaccgtcttcctcttcttccatgggcaatctctcataagtagcgttagaaaaagtagcagcaatcaccatgaccgaccctatggctaagagtgggcctacaacgctacctccaacgacctgaccctggaccccggctaagtaaaccgttaaaccggttgacccgggtggggaaggtccagggaggaaagcaccggttaaagataagatttcaaacctgccttggagagagaccacacctcctggtgcggcggcttggcggagggtgacgttagcgactgagcctgtcccgctgagaacgcaaacgccgcgttgcctgcgtcttgagaagtgagcgattgtgtcggcgacgtcactgccgtcggagatctccaagacatggctacggagtgcgttggggctgtctcttgtcacaaagattggagctttgggtttgtttttggatcctggtggtctacctcttggtctacggttgaccacctcaacggctccttctctaggatcatcttcttcgtcttggtcgttgtcttggctctgattcatggctattccaagatctcctttggtaagaagactttggtggtgatggttttggtgatggcctgaggagaccgaatggtccaccatgcccgctaaaccactctggttcgtccaccaagggtttgccatgattgaccaaaaactggaaattcgctaaaaagaaagatcaagaaattgttaccctgatgatttgcttgaaaggcctctagggttcccggggggggggggggggactagtgagcttctctctctctctctctctctcctcgtgcnnnnngnnnnnnnnnnnnnnnnnnnnnnnngnnnnnnggnnnnnnnnnnn

SEQ ID NO: 17622 - DNA, 917 bp, Zea mays
agctatgtctcattcgttgaggtagctgtgtcattcactcacgcgatcaaagcacttgagacattgtgcaatgcggctgctatacaattcatgatgggacaatccatcgccataacagtatggcagtctctagctcctgttgttctaggtgtcgcaatggcttcactaactgagctatcattcacctgcctcggtttcatcagtgctatgatatcaaacatgtcattcacttaccgaagcatcttctccaagaaagccatgactgatatggacagtacaaatgtctacgcttacatctccatcatcgcactcttagtctgcattcctcctgccatcatcgttgaaggtcctaaactacttaaccatggtttcgccgacgcgattgctaaagttggaatgactaaattcatctctgatctcttctgggtgggaatgttttaccatctctgcaatcagctggctaccaataccttggagagggttgcaccgctgactcacgcggttggaaacgttctgaaacgtgtgttcgtgatcggtttctccatcgttatcttcggaaacaagatatcgacacaggcaggtataggaacaggaatagccattgctggagttgcaatgtactctatcattaaggccaagatcgaagaagagaaacggcaaggaaagaaagcatagaaagcagctgaagacggcggtcgacagttgcataaacaagttctccgatggatatatatatctatataataaataaccaaatgcaatagtatgttgtattgtaccatcaaccattgttttcgagtttttcctttctttgttttttttttgctttctgaaaagttatatataaattttttattttgcttcaaaaaaaaaaaaaaaaaaaaaaaaaaaggaaaaaaaaaaaaaaaaaaacccca

SEQ ID NO: 17623 - DNA, 6302 bp, Zea mays
gccggccgggcctggatacagagcccacactgcagagagccccctcttgttcgcgtccgaaccggattccccgtcccgtctagggttacgcccactctcccccgccgctccagcgatgtcgtcggagcctctacccgcggagtcccccgaggcgcccgcttcctcctctggctccccttcgaaggacgccgtcggcactgaggtcggcgccgctgcgggggccccggaaacgaacacgctctgggtgggcaacctgccctcgcacgtgaccgagggcgatttgttggcgctgttcgggccgcacggcgccctcgattgcgcccttgcacgagccggatctcgcagctacgcgttcgtcctcttccgttccccagccgaggctcgcgcagccgtcgaggccacccggggtgaaaaggtcaagggggccgccatgcgcaccgagttcgcgcggccggctagggctgttagaaatctggtgggttggtggcattagcccatccatttcaaaggaggagcttgagggggagtttctaaagttcggaaaagttgaaggtgttgcgttctcccaagatcagacttcagcatacatagattttgagaagcttgaagacgcaatttctgctcacagatccttgaatggaaaaatgctaggtggcaaggaattgtcccggctcgtcccgcgggcccggggaagagcggaatggtcagaagctagcagcttcaatggtagagtaccagggccagtgggtgataagagaggcagtggccctctgaagagttctgctggagtgcggatgcgagaggcacagcctaccaatgttctctgggttggttttccaggttcttatagagtcattgatgaggaggcacttaagcatgccatgtcagtattcggtgtcgttacgaagataaaagttttccagacaaggcagtatgcttttgttgagtttgcaaatgttgcggaagcttgtaatgctaagatgaatctagatggtcatcttttcaatgatcccaggattcagattcttttctcaaacagtgggcttgcaccaaacaaattggacaacccaacatcggttgctggatttcctagttcagatatctattccagtgatggtcgtctaggccctggtattggcagtggaactttgcaagggtatgatccaccaagaggaggaagaacaagatattacgattatgcgggtatgcctactccaggtggtatcctttcgcaacctgaaccatttgatccaagagaagcaaaaagaatgaggcttgctgctggtgctgtcccttacgatgtaagggcaggcagcacaggtctttattctgctggataccgtcatcagggcagttctgtgcacgctgagggaagctcaagtcctgttattcgagtccggggcacagtgcatcgtacatcatacattgagcactgttggcgtggcagtattgccaaaggtggatcccctgtttgtcgtgctcgttgtttgcctataacaaagggcagtgacatacctttaccggatgttatgaattgctcagctcggactggattggatatgctggcgaagcactacgcggatgccactggatttgacattgtctttttcttgccagatagtgaagatgactttgtttcttatactgagttcttgcgttacctgggctcaaaaagtcgggcaggggttgtaaaagttgatgcagggactacattatttttggttccaccatcagatttcctaacaaatgtgttacaagttgatggtccagagcgcctttatggtgtggtattacacattccacaaatctctgctgctgctgcactgaggccacagttaactgggaccgaacaacaaccttactatgatgaaaggggaactctgcctacttcacaaagaaagtatagtatcatttctcctaatgacagtggccaccttgatgctgattatcggacatctttgcatgaggattcaatgcatcggttggggcatattcctggaaggcctcgggtggatgaaggacaagcagttcaaccagctcttgcaggttttcctgctaatcaagcagctgggctgcaagtacaatcttcactcaagcctgacattatggctacattagcaaaacttctgcctagtgtgcaatcgtcaccgctggtaagtggtcagatgaatgccatagacagaacatcgcagatacaggatccatccatgctttcaaaagtatggaatcctgaaaaccaagttactgcttcaaattcatcctttgggcaaatggctaatgttcagcatccaggacagcagtttagtggccaagcttcagctgctcatttgacaaactatgggaacatggtgagtgctcaggagcgctcaatacaacatactgcttacaaccctgaagttactttgaacttgccaccaccacctccacttccaacaataccacacagttctgctacattacagtctcaaggtggccacagtttgccctcacagacaaaccagcaactgtatcagccagagcagtattatgtgccccaaaacaactatggtccattagttccagttagccattctaaccttcaaatcagcaacactaacaaccccacccttaccatcccacaagtgaaccctggacctccaacaaataatcagattgggaatttggcccagccacagcattctatgccactgcatgttgatagagcaagtcaggatttctcttctcaggggcaacaacaaaatcgtggtcctggtgctgcacaagctcccgaggaggataaaagcaagaagtaccaggcgacactccagttagctcaaaacctactgcttcagttacagcagcgtggatctggaaatcaatcctgagacctaattattgcttcaggtaagtgcacctcgtcatttaatattttctgtttgctacattttatctgcttgcgcaatcttcatctaattattttcaacctaatcctagcgtagcttgcatttcaaaatgtaatttaatgaaatgagttgttttaaacaatgctagcaacagagggctactgcaaatgaccaatgtttgccatctcaagattgtgctaggttggcttagaatttgcacgccacacacaattaacactgaaacactagagaaacgtttaatcttagagattcatctcctagcaagtaaggccaggttgaacacttgatcttagttttattttgcgtgcataatacatctcttgccagtttgcttgcattgatatgttgttatctgtgtattctagcttgactgtcttgctagatctgatctgcacagttccttgatagtctagtgagagtttcagcattacagtaaaacagtagataaagtcgttgctaaaacaccacgttgcttacatgaggcaatattagatctttaattgattaatgtatggacatctttaatgtaatggttttatgatatctatacttgagaagcagtggggataccttgaaacaaaaagcttctctttcaccagctttaacgcagttcttggttctcgtggtaaagtgtgagtacccatttctcacaatacgatgagaaaccatgcttcagtatggtgattcgtctacctctgcgaaccctgctgccttctgcgtgactcggttacccccctgccgctttcttctatgtagtatcggacaatctttcgtagacaataatgcagtcaacgccttatccaaagcaccatgaccccgtagtatattcatccttggcatgcaaccaacctcgtttcggtcgaacaaaaaaaaatttggcatgccttagattcaattatatcgacttcgtctcatagaccaaacgacgaaacgacaaacggtgaacatcgtgattaaacatacctttttgcttggtacatacatgcaaactggcatttgatggcagccggcagcgtcagctgcaatcacttgcctgcctctgttttcacgtagctagttcatttgagcatcgatggcatgtaggaggacgagtgcattaaacggggtataatgggtgcgtctggggacatcactggtctaaatcgttggatccaaatgagcttgtcaatacaaacatattaatcgttggcctaaatcgtattagtttcagcgtcgcgtcgatgttgtttgcgacttgtgcctgtagcgtttgacgctttcgggtcgacgccaccgcgaatgctttattcgctagcttcactggtccccctatatgtttgttaattaaatcgcgctggcaatatggaacagggtgaacttactacgcaccagtgatagaaaatcttcgaagatatcgcctgcgtataaacaatgcggcaggagtcgctccgggtgattcgagggttcacggctatcaacagtactcaacaacgtttcttttacgtcaggagtacgagggaatactctctctcaacacattcttgcacgttctacaagcgggcggtcactggcatgtctcgcttacgggaaaaacaatcttttcatcccggatgcaaataatctcttttacagcctctcatatccaccaggagaaaaacaaattactaaaaaattaagaggtaaattttaatctgttttagtgggtctctaagtggtggattagtggatgtgaggggctgtaaaagagggtgtttatatccaagatgtacagaatttttttctcgcttagaacttgttcggttatttttatcttatatggattgaataggattaaaaaaaatataaaagattttaaatttattaagaattaaaactcactcaattccaatccatatagactgagaaaaaaaaaacaagccgactcgaacatctccgctcacatgtggagacacgaacacatttactgtttggtcgatggccaatgatcccatgacacgtcgttttattcaacgcacttggtcgatatacacgcttggtcggcgtctgggtggtcgaggacgacgacaagttgacaccgcacccggtcgggcttgtgtccattgttatctcgctttcttttatttgctttatgtttattagttattaaagcagtattagtatatagagtgtgaaagtacagagggcacagttaagatggtaggttcgttttcttttaatatcttggttaaaagtggaggaagtatctattctctataaatcgctttcgttctctctccttatcgcttaatttctctctctctccgaggtgttagtggcccttttcggaccaaagtgaagctgggctgaatattggggcgcttgacacatacggtcaggaaatattttgttcccgatctctaacattttcgcccaaatttcttcaatttctcgttcacgcttatcctctaaacctatatgaattaaaatgacagaggcttcggtcttgctgcagtggaacttttctgatgcgtttatgcacttaattaatatgaaactcctatatcggttgaatagtcgtttagttatttatattattatcaatctgcaagttagattcttcggcgtcatattcctgacaagaacacttgtgtaggtaccctcgtctcgtctcagctggtcgcaaacaactgaaaatatatatcccaactcgacggcttcgcctccactctacaatcgaagcggcccatggtgtgtcagctcgttggcctacacctacttgccccagttctcccttttcaaggacatacattaccagaaaacgatttctttttctcctttttattttatcgtgtatttgatatggataatccggcctgaattttgtactcgtttgttagtatggcctcgtgttatgttgttatttactctgaaaccatatgttattgtgtacggtgccgtggttccaacacaagggaagcttgttcagagacccgtttcacatgaagaatcgtatgctcgaaagagatcccacataccacaacatttcctgaggctatctctcatttcaatctctactctataaacactatatacatcgcaaaattgtgttttacacggttaatatatgcacgagctactggtcatagcctaacaattctaaagatgcaaagcatattctatggcttagctcactcaaaaggcttctctcccacatgtacagcttctgtagcgtagaggagaggttgctggatccgatcgccttgtcctcttcaaaacgcagaaactcctcttccattgtcggtataccactaaccatcatcgcagagactaataagtgatcgattgtgtcagattagaattcatactgctaaggctgagaattcttattgcaaatgtgaataagctttaccaacctttgaaacctgaactcttctggcagag

SEQ ID NO: 17624 - DNA, 645 bp, Zea mays
gcagcaacacttaacaaccccacccttaccatcccacaagtgaaccctggacctccaacaaataatcagattggggcccagccacagcattctatgccactgcatgttgatagagcaagtcaggatttctcttctcaggggcaacaacaaaatcgtggtcctggtgctgcacaagctcccgaggaggataaaagcaagaagtatcaggcgacactccagttagctcaaaacctactgcttcagttacagcagcgtggatctggaaatcaatcctgagacctaattattgcttcaggtaccctcgtctcgtctggtcgcaaacaactgaaaatatatatcccaactcgacggcttcgcctccactctacaatcgaagcggcccatggtgtgtcgtgtcagctcgttggcctacacctacctgccccagttctcccttttcaaggacagacattaccagaaaacgatttatttttctccttttttatcggttgtttgatatggataacccggcctgaattttgtactcgtttgttagtatggcctcgtgttatgttgttatttaatctgaaaccatatgttattgtgtacggtgccgtggttccaacccaaggtgaagcttgttcagagactggcctgttcgtttcc

SEQ ID NO: 17625 - DNA, 1306 bp, Zea mays
gaggagagaaaggtcttcttcggaagcaagctaagtcatggcaacgatttcgtcaactctactcttaaattcttctagatcagctttaccactaagattcccaaaattctcgggattttcttcttcctctccattccctagatcttacagatttggacgacgtaatttggaaccactttccaacggaatgctttcgtcgggaagtagagccgacggtgctacggcggcggctgcatcgatggaaggagtgatgacggaggcgatgaaactgattcaatcggcgtcaccaacttggaaatcagctgtggctaacaatttattgatttttgttctcggttcaccgcttcttgttaccggattgtccgcttctgggatcgccgccgcgtttttgcttggtactttaacttggagagcttatggctctgctggtttcctcttagtcgctgcttacttcgtcataatgatttacaatatcacagggaacagcggcaacgaaggttaaaatgacgcaaaaggaagcacaaggtgtggccgaaaagagaaagggtagaagaggaccacgcagtgtgattggttcaagtgctgctggttgtgtctgtgcttttctttcaatatatcaagtgggaggagcagctttttcccagcttttccggcttggttttgtttccagtttctgcactaaagtatctgacactgtctcgagcgagataggcaaagcttatggaaaaacaacgtatttagctacgacatttaagattgtaccaagaggaacagagggagctatgagtcttgaaggaacattggctggacttttagcatcattttttcttgcatctgttggctgcttcctgggtcagataactcctccagaagcagctgtatgtgtactagcttcccagattgccaatcttggagagagcataataggtgcttcttttcaagacaaagaaggattcaaatggctaaacaatgatgtagtcaacgtgatcaacataagcttgggaagcattgtggcgattttgatgcaacagtttatactccagaactgggtcaagtaaaacctgccacgaaggtcatgtattctcagtgaggttagattctttttttatattgttaaacacagccttacgtattcagtggtgttgtaaattatactctgttgtgtacaactagtagtccaacatcaatgaggggaaaaaacttctgggaccattgtctagcaattattggatgatatttatgtgaattaagtttgccttaaagaaaaaaaaaaaaaaaaaaaactcgagggggggcccggtacccc

SEQ ID NO: 17626 - DNA, 1859 bp, Zea mays
cgattgggtaccgggccccccctcgagttttttttttttttttttttggtttggtcggccaatatttctaacgaaattgggtcttactctagtgttcacctttttcacaacacaacgtcaaagtaaacactctcgcgggctccaaaggcccgctagtggtagtatcgtaataaatgtaaagattatatcttaattctaccaagacgtttttcaacagttgatgtaagttattgtctcctagttccggttttaccctcgcaaacctcaacgtcgacgacaaacacggagcaaaccggccggtgatcggagaaacgtgactcgccgtgcacgtacgagagctgccggattccatcaccgtgccaaagaatcctatcgcaccaggccggagttcttctcttgttcttcttttctttgctagtgtctcccgcgtaagcatcagagttataagagtacttataagttggtgcaaagaagatttttccttcatgccatcctttgaacactcgacctgcgtctctttcaatcttgagctgatctttgttgagaagagtgtcccaagcgtttttatccaagagggtctttgtttctgagtaactcaaagctattctgtagttcaaatctccaagccatatgacccgatcgtgctttgtgattcgatcagggacacgagtaaaagaggttctgcatattctagggaaacttgtgttcttgagaatctcgatcacatctaagtttctgcggcgttcgtctccttctctctcaccagaagctagatgactgcagatgaagcagaagctcgtcttgtagagctgcaaactcacagctatgcatcccttgtttcctaagcaacccatgattccgcgggtgacggaggagattctgagatgagaaacgtgttgaataagttcctttctcatccacacagtaaggaatatacccaccatttgctttgatgctactaagccatacttcatcgtcatttggttgcttacaagagaagcaacttttcctcctccttcatcctcgtcttcatcatcatcgtcatcatcttcatcttcttcgtcatcagaaagtacaccggattggttaactagaccttcaggacatctgaaacaagattctctcccatactttcttacaatatcttcagagaaagtgctgcagttacagatcttcagctttctcctgcactctgttctgaaactctcactaatcttcttcaaagaaggtttcgcaaagaacatcgatccagcgccaaaagatggagtttttgggctaagtcttcctccagaagatgatgatgatttgtttaaggattgattgatcatcgctaaccatttcgcagcaggctcgttgtctccaagaacaaggacatttccagcattcaatggaacaatctcctgaaaacctaaaacgtatacatcgaattcactatgcacgtgaagcaaagcatcaagattaagaccagagtgtggagattttcctcccacgttccatgtcgccacaaagactcttaaggattggatttgctgagtaggcattgaagatctgagattgcttgaagctaaaagagattcaactactatctcggattgagacccttatgcaatgcttcggtcttctcttcgtttttcttatattttttttttttaaaagaagagatctttatgagtttaggaagcaaagatccggggggggggggggggggggctaagggacctccccccccctccctccccgggggggaatttccggcccccggggggaccctaattttaaagcggccgccacccgggggagcccccctttttgtccccttaaggggggaaattcaagcttggggaaacagggcaaaagtg

SEQ ID NO: 17627 - DNA, 1006 bp, Zea mays
atcttcttgaccatatcgacaccctttgcttcgacctgagcagtgccaatctcgccgcgggcttccactgctttgccctatgcactatacgccgccccccggactggaaaattgcttccccgcggacctccactccaacggtgcccgtatctcctttgtcctggctggatccgtataatctcctttgtcctccccctcccctcgttcccgtctccctcgcggtcctctcaaccgtacgccgccgccttgctcgcaccgtcgacagtgcctcagtccagatcgaccctccctctacccagatcgggttccagttggcctaccgcccccgccgccctactacaggtgccgaggccttcaccggcgaagagcgcccgccagacaaatggaactgggtgataaggcggtcggttttctgctgactctgacaagcttaaccttatttacatactacacattctgggtcatcattttgccatttgtcgacagcgaccactttgtgcacaagtacttcctgcctcaagagtatgcgattttgataccagtactggccggcgtggttctcctttcgttcttgagcatgtttgtgggccttgtgatgctcaaatcgaagaagaagaagaagacggcttgatcgggtttgccatgtacactgctgtgtcattcacttagtgtgatgaaatgcatgagttcgcagtatctaattgctagaagctcggttctgtaatcagttccgtcatactttaaaggtctttactttgtcatctggatgtgtgttttttttattctggtggtcaattaaaagcagtgttcatcaaaactctagttagaggtcacatatcgttagccattattcggaccgaacagcattttgaagagtgaacgattgacagtggctaaaagacgaccgctcactcatcctcttcacagctgtcgggttggtatccaagcgctgatgatgcagaggcaagattctggcgtgcaaaaaaaaactgagagttgttctgtt

SEQ ID NO: 17628 - DNA, 3151 bp, Zea mays
taccattagctaaaaaaaggtctttgactttcatcaatccagaccaaaaatgtgaatctcatggtttcctaactacatgcccaaaggttttgttagccagcctgcattttaatctgaattctcgtctcgtgatcgtgatacgatgacatgcacgtgacagatgaagttggcaattggcatgcgtcaacctggcgaaagagtacatcaagagagtcgtctcgtgtctgaggtcgaaggcctcatcagtgacaacagccaacagcttgggcagaacaaggaagacgacgtttttcaaacgtctgaaagagcagaacgggaaagtcttgctccatcatggctgaagttcgccttccgtgttctcccatatgttgggtttatttttcttttcttggttgacagttttagattagttttcatggatccttttgctgatggaacaaactgacaacctgtacattattttttttttttttttcggagctcaataaaatgaccaatgttcgatttgaactttagttacaactgtagatttcccaggacataggcctctgaaatcgtgtgtaataatattcagcgccggcccagctggaaggggtccagcagtgctgtctgctttcgtttacctctttcatttcacaaaagctctgtgcgttgcttaatccctctacttcagcgcggaccgcgcaacgctgccacagctgtactgtgccattcgtcgccacatgtcgccgcgcatgccacgcgcccgtgcagcactgcgcgcgccgccacacgtcgctccgacccggagccctcgcactttaaccccctggatcccccgccggccatcgcccagcggccaacgaactctccccttccacccgccagtcgccacctcgcctcgccatggcagaccggccaccgccggggccacgcgcagcagccctgctgcccaacccggtcacccggcgcggccacgcggcgtcgtcgacggatcgccagcactcgctgctcgggcgcgccgtccagacgctccacgcccacggctccacccagctcctgcgcttcctcgcgcttgccgtcaccctgaccgcgctcctcgtcctggccagcgtcacgctcacggccgcgctcgccgcgctggtcctgctcagcccgctcgtgctcctcaccgtcccgctctgggcgcccgtagcggtactggcgctgctgacgggggtcgcctcgctcgtcgcctgctgcgccggcctggccgcggtcgccgcgggcacgtgggcgcaccggtacttcacggggcgctactccgtcggcgcgcaccgggtgcagtccgccgatcagtacgcccgcgggggcacggtcgcggacgtggccagccgagtgagggggtactacgacgcctacgcgcgagagtacggcgggtacccgccgcgcccgcactctcgggtcaaggacgccgcgcccggggcgtagcttgtgtgtgccggcacggcatggttgatgaattctctctccctctctttgctccctcgtgctcacgtgctgtacatatgtttcgtcgttctagcagtcgtgtttcgctagaagcggtatatggccactgatacgcagagtaaaaacttcacaaactcgacgccagaagccactggctgtaaaaacttcacaaactcatcatcactcgacaactgtactatactccgcactgtaaaacttcacgacgaacccaacatcactcctcgaactcgacaacaatacggaggagtcgaagacgtacgttgacatcactcaacaacaatacggagctgaagacatacacagtgaaacttaaactaaacaccataattcggtggccaacactgttgtatacattttgaatgcacttcaacacccgggttaatcaaaccattagggccagtttgatagcagggattgaggagactaaaatctccttcctatttacttctctcaaactagtccttaacttcggtagaacaaaaaactgatgaagatggacgctcctcgtgtcccaatgggtgatctgcgcgacgaccctggtggccctcggtcgtgctccaactctaaccctctcaagtcagctcccccttggttcgaagggtgtgtgcttgcctccagcgaacaactctgacctcatcgagcatactagggtcacctccaaactaaagagaaagcgtcgggtgaattctgagcttccccaacgcgtcaatgaaggtccggtagcatcttctccacccttccttctatccttactatcttctccacccttccttcgatccttactagggcagcccaaatattgagtgggggtctaaacaaaggattactaacgaataagcctttgtaactacaataaataaggtaaaaagtctactaaaccaaggaaattgagtgggggcctatgtctccacttagtccaacgtcggtcgccctcttgaaccttaggtttgaaacgcccggtaccttgatgcaacgtagtttttttgaaagtttccaatatgtcgttcacccacactctattgtcgctaggctgacatcatccgtctggttctcactagctcacctctcccctcactactctcccaagtttgtatgtgacatgttgaatttcctgttgtccatgccctcggattgtcttagtgtgtcttgcatcgctaagtttgtgtttagactaagggttgttaactagaacgtcgcaaacaatttggtcatcattggtcccccgcgtctttgaagatcgggcctcacccctcaccctcatttggaagacaccatggctgttgcccgaaggttgaaggaactcccagaatgcgccctgttccaacgcacgagtggaaaatctatcctcgatgtcgcttcgacgttgaatgttgatgccgcactctcgtcacaccagtgtgtgtggctcaaaaattgattgccacaatggagatttttgccagatataaattatcgcaccgcatacaaccctatccaatgctctgcaaccctctctaatgcacgtcccgtcatcaccacccccaccgctcgcccagcattactccatctacagccttaaacgcacctataacctcaccaatgcccctcacccttctctccccatccaagtcgcctctcgttgtaaaattggtaaagacatgcccattgttggcccttcaag

SEQ ID NO: 17629 - DNA, 2354 bp, Zea mays
  misc_feature (3)..(4): n is a, c, g, or t
  misc_feature (7)..(7): n is a, c, g, or t
  misc_feature (22)..(22): n is a, c, g, or t
  misc_feature (24)..(24): n is a, c, g, or t
  misc_feature (33)..(33): n is a, c, g, or t
  misc_feature (37)..(39): n is a, c, g, or t
  misc_feature (44)..(44): n is a, c, g, or t
  misc_feature (46)..(46): n is a, c, g, or t
  misc_feature (53)..(53): n is a, c, g, or t
  misc_feature (58)..(58): n is a, c, g, or t
  misc_feature (65)..(65): n is a, c, g, or t
  misc_feature (77)..(77): n is a, c, g, or t
  misc_feature (111)..(113): n is a, c, g, or t
  misc_feature (132)..(132): n is a, c, g, or t
  misc_feature (142)..(146): n is a, c, g, or t
  misc_feature (154)..(155): n is a, c, g, or t
  misc_feature (162)..(162): n is a, c, g, or t
  misc_feature (172)..(172): n is a, c, g, or t
  misc_feature (184)..(185): n is a, c, g, or t
  misc_feature (190)..(191): n is a, c, g, or t
  misc_feature (193)..(193): n is a, c, g, or t
  misc_feature (203)..(203): n is a, c, g, or t
  misc_feature (205)..(206): n is a, c, g, or t
  misc_feature (208)..(208): n is a, c, g, or t
  misc_feature (214)..(215): n is a, c, g, or t
  misc_feature (217)..(220): n is a, c, g, or t
  misc_feature (224)..(226): n is a, c, g, or t
  misc_feature (229)..(229): n is a, c, g, or t
  misc_feature (231)..(232): n is a, c, g, or t
  misc_feature (235)..(236): n is a, c, g, or t
  misc_feature (238)..(238): n is a, c, g, or t
  misc_feature (241)..(241): n is a, c, g, or t
  misc_feature (243)..(252): n is a, c, g, or t
  misc_feature (255)..(259): n is a, c, g, or t
  misc_feature (263)..(267): n is a, c, g, or t
  misc_feature (270)..(273): n is a, c, g, or t
  misc_feature (280)..(283): n is a, c, g, or t
  misc_feature (289)..(293): n is a, c, g, or t
  misc_feature (298)..(302): n is a, c, g, or t
  misc_feature (305)..(305): n is a, c, g, or t
  misc_feature (309)..(309): n is a, c, g, or t
  misc_feature (311)..(311): n is a, c, g, or t
  misc_feature (313)..(319): n is a, c, g, or t
  misc_feature (324)..(324): n is a, c, g, or t
  misc_feature (326)..(326): n is a, c, g, or t
  misc_feature (328)..(328): n is a, c, g, or t
  misc_feature (330)..(336): n is a, c, g, or t
  misc_feature (338)..(340): n is a, c, g, or t
  misc_feature (342)..(342): n is a, c, g, or t
  misc_feature (345)..(348): n is a, c, g, or t
  misc_feature (350)..(350): n is a, c, g, or t
  misc_feature (356)..(356): n is a, c, g, or t
  misc_feature (359)..(362): n is a, c, g, or t
  misc_feature (364)..(365): n is a, c, g, or t
  misc_feature (368)..(368): n is a, c, g, or t
  misc_feature (370)..(382): n is a, c, g, or t
  misc_feature (384)..(387): n is a, c, g, or t
  misc_feature (390)..(396): n is a, c, g, or t
  misc_feature (398)..(411): n is a, c, g, or t
  misc_feature (413)..(416): n is a, c, g, or t
  misc_feature (436)..(437): n is a, c, g, or t
acnnaanccaccccaacccccncnccccaaccnaacnnnccaancncaacaanccaanaaccaancaaaccaaaaancccccaaaccacacacccccccacaccacacaannnccccaccaaaaacccaacncccaccacannnnncccaacannaaaacanccaacaaccncaacccaacaannccaannancccacccaananncnccccanncnnnncccnnnaancnnccnncnccnannnnnnnnnnaannnnnaccnnnnnccnnnnccccccnnnnccaacnnnnnccccnnnnnccnccancncnnnnnnnccccncncncnnnnnnncnnnanccnnnncncccccnccnnnncnnccncnnnnnnnnnnnnncnnnnccnnnnnnncnnnnnnnnnnnnnncnnnngagggccggtccattggtgnnaaaaaaccccccatgcatctccaaagagtcatctaccatcgtgcgttctaggtgccgttttctcctctcttcgtactcatcgtcactctcgccccgtttccttggaggatcttgctcctcaccgccaacgaacatcataagagatggcttagatgtcaactgttgaccatgtctcctaaactcctcctcctcctgaagtaggaatctgtcattccaccagatgctaggactgctagcaatgaagtagtcgaaagcgccggggttttgaaataaagtgtgtaatgtgaacaaccctccgaacgagtgtccataaagggcttcctttccgggaagagcactgcgaatctcgtgtaagcgtccatggacaaacggacgtaccctatgctggatgaaatctgcgaactcgtcggctccgccttcttctggcgcgcagcctttcgaagggggtgttaggtcacgcctcctccgagagctgaacaaaaaatcggaatccgaagagatggggtaaccgatggcaactataaggccagctggcacagatgcaacagcgatgtgtctatgcagagcctccagcgctgagaagaacagggcgttgccatctgtgagatacctattttggcctcagttgagctaaatggggcaaaagcacatgcccaaaaaggagatcatacaagataggaactcttaagtcatgctctttcttcgattcttggctcgtccagacgcgtggaaagccaatttggacaatgtacggctggcccgacgaatctttgagtgtccaggactcagccgagggaatcgtaaccggggaactttgggccagcatcatcctgtatgagggtcatagggagggaagttgtgaatacagaatggctttggacggctaaatcgacgcaagtcgatgttatatcagtcgatcagtaagttctggagcatcaagttcttgaagagaaaggcgcagctcgaccgatctcggcgcagttgatcagtccatcagtagccaaggacactcggtggggctgatcataatccaaggcccatccgcggaaatcaccccgtcctcactcttcatgatgccctgataaaatgtacgatagcgtacggattttctgagtcgaccttgtacacaaagggaatctggtgtgaggctggcctgcgcgatacagtccaccggatcttgctgcgtggaccagccaacttacaagcagctggttgcactggcgcctccacttccttcactttgggcaagctatgtcgatccaagtgacctatttgtgaacgcttcaatagactggcttgaaaatcgcaaaagtaaatagtctcatccaccctagtttccgcctcataacataatacctgtatgggtactccatattgtggaagggcaaaaaggcagagaatgactggccacattcagccacagtatcccaagcggaagcgcaagccacaaggacccgcagcgaaaagcctcccttcaaatttcctttcctcattggccgcctcctgatcgacgaaaatggcagtggcagtctccctctgacgctggtggtggggacccttgcttaacaggtacccaggttgcgaccatccacatcgacacgagacaaagcaacgtgtaaccttttcgtcgtacccttccttaacccccttggcctgggcctccttgactgccttctcactcttctccccttcatgatgagccattgaagagtctcttcgcttcgatacgacacaacttcgacgagttcaactccttgtgaacggaccaaacaaaccacccccacgaacatccgcccctcgttgcgaaaggggacccctccataatcaccatgtccctcccaacggcagcacatcgacaatcgtccatccgatccttcttccaacctaagcctggcgtcgtagggggggcccggtacc

SEQ ID NO: 17630 - DNA, 1383 bp, Zea mays
  misc_feature (15)..(15): n is a, c, g, or t
cgccccgggagaganagagagagagagttctgtcagtttagcccccttggccccccctccccgacacataaactcactctcactctctcactgtcggcaaactatcttattcacttttccggcactgattctgctcgggaaaaacaactccggcacaaaatgcagctttttccagtcatgttagccacactctgcattgtcctgcagcttctcattggctcgtcagctttggctacgacaaatcgccacgtgtcaaactctcattggcttcccgcagtagctacatggtacggaagccccaacggtgacggcagcgacggaggagcgtgtggttacggtacgttggtggatgtgaagccgttacatgcgagggttggagcggtgaatccaattctcttcaaaaatggtgaaggttgcggagcttgttacaaggttcgatgcttggacaagagcatttgttcccggagagccgttaccgtcataattaccgatgagtgtcccggctgctctaaaaccagcactcactttgacctcagtggtgccgtctttggccggttagctattgccggagagtcagggcctctccgtaaccgtggactaatcccagtcatttatcgccggactgcatgcaaatatagagggaagaacatagcattccatgtgaacgaaggatcaactgatttttggctatctctgctggtcgagtttgaagatggagaaggagacattggctccatgcacattcgccaagcaggagccagggaatggttagagatgaagcatgtatggggagccaactggtgcatcattggggggccactcaagggaccattctccatcaagctcaccactttgtctgccggtaaaacactctctgccaccgacgttgtccctagaaactgggctcccaaagcaacttacagttcccgcctcaacttctcccctgtcctttgaaccatctcttctacatagtcaaagactattattgttctattactactactactcgtgtgatcgtttttttttgaagagagaaacagagtgactgctggccgtaggatggaaacagtaagaaaagtacatccgaatcaacggctattgcgttctctcctcttccttcttgtgctgtggatttgtgtgtgtgtgatgtgtcggtgagtgtgttagaagtcactatagccatcttcaaaggggagatagagctaggagtagtatttggtggtgtcacgtcgtttgttttttctatataatttttgtcactatgtcattctattatgggacatgacataatatatcatatgaataatttatcaaaaaaaaaaaaaaaaaaaactcgagggggggcccggtacccattcgcctaaagggagccgaatacattcc

SEQ ID NO: 17631 - DNA, 583 bp, Zea mays
acaagtaagagaaaagagaaaaagaagtagtaatggcttcctctatgctctcctccgccgctgtggctacctcaccggctcaagccaccatggttgctccattcaccggcttgaagtcatccgctgcattcccagtcacccgcaaaagcaacactgatattacttccattgcaagcaacggaggaagagttagctgcatgaaggtgtggccaccagtcggaaagaagaagtttgagactctctcttatcttcctgaccttactgacgttgaattggccaaagaagttgactaccttctccgcaacaagtggattccttgtgttgaatttgagttggagcacggatttgtgtaccgtgagcatggaagcacacctggatactacgatggccgttattggacaatgtggaagcttcctttgttcggatgcactgactctgctcaagtgttgaaggaagtgcaagagtgcaagacggagtaccctaacgcctttattagaatcattggattcgacaacaaccgtcaggtccagtgcatcagtttcatcgcctacaagccaccaagcttcaccgggtgcttaatttc

SEQ ID NO: 17632 - DNA, 828 bp, Zea mays
gagagctcactagtcccccccccagtcacacaaagagtaaagaagaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaattggctaaggaagttgactaccttatccgcaacaagtggattccttgtgttgaattcgagttggagcacggatttgtgtaccgtgagcacggtaactcacccggatactatgatggacggtactggacaatgtggaagcttcccttgttcggttgcaccgactccgctcaagtgttgaaggaagtggaagagtgcaagaaggagtaccccaatgccttcattaggatcatcggattcgacaacacccgtcaagtccagtgcatcagtttcattgcctacaagccaccaagcttcaccggttaatttccctttgcttttgtgtaaacctcaaaactttatcccccatctttgattttatcccttgtttttctgctttttccttctttcttgggttttaatttccggacttaacgtttgttttccggtttgcgagacatattctatcggattctcaactgtctgatgaaataaatatgtaatgttctataagtctttcaatttgatatgcatatcaacaaaaaaaaaaaaaaaaagcggcc

SEQ ID NO: 17633 - DNA, 658 bp, Zea mays
aaaacaagtaagttaagagaaaagaagaagaagaagaagtagtaatggcttcctctatgctttcctccgctgctgtggttacctccccggctcaagccaccatggtcgctccattcaccggcttgaagtcatccgctgcattcccagtcacccgcaaagcaaacaacgacattacttccattgcaagcaacggaggaagagttagctgcatgaaggtgtggccaccagttggaaagaagaagtttgagaccctctcttaccttcctgaccttaccgaagttgaattgggtaaggaagtcgactaccttctccgcaacaagtggattccttgtgttgaattcgagttggagcacggatttgtgtaccgtgagcacggaagcacccccggatactacgatggccgttactggacaatgtggaagcttcccttgttcggatgcactgactctgctcaagtgttgaaggaagtccaagaatgcaaaacggagtaccctaacgctttcatcaggatcatcggattcgacaacaaccgtcaagtccagtgcatcagtttcatcgcctacaagccaccaagcttcaccggtgcttaatttgctatgacattcacataataatctctgctcatttcatttccaattggctgtttcttttccctttg

SEQ ID NO: 17634 - DNA, 640 bp, Zea mays
  misc_feature (640)..(640): n is a, c, g, or t
gtaagagttaagagaaggaagaagaagtagtcatggcttactctatgctctcctccgccgctgttgttacctccccggctcaagccaccatggtcgctccattcaccggcttgaagtcttcctctgcattcccagtcacccgcaaggccaacaacgacattacctccatcgttagcaacggaggaagagttagctgcatgcaggtgtggccaccaattggaaagaagaagtttgagaccctctcttaccttcctgaccttaccgaagttgaattgggtaaggaagttgactaccttctccgcaacaagtggattccttgtgttgaattcgagttggagcacggatttgtgtaccgtgagcacggaagcacccccggatactacgatggccgttactggacaatgtggaagcttcccttgttcggatgcactgactctgctcaagtgttgaaggaagtccaagaatgcaaaactgagtaccctaatgccttcatcaggatcatcggattcgacaacaaccgtcaagtccagtgcatcagtttcatcgcgtacaagccaccaagcttcaccggtgcttaattcgctttcatataataatatcttctcatttcatttccaataagccgttccttttttttttn

SEQ ID NO: 17635 - DNA, 1325 bp, Zea mays
cggcacgaggagagagagagagagagagagagagagagctcactagtcccccccccccccccggggaacgtgcaacagaaaaatagttcacccaactttctcctattaatacttctctcttctctcttcctacttctaaccttctttttctccttcatcacacacatatacacacgctttcgtttaaactctctctgtttcaatcattaatcagaaagaagcaacacaaatatggatcacgacaagtctacttcttgttgctgcgttcttgatgcttccacttatgttggtttctggattctcaagaaattgcttagcagaggatactctgttcacgcagcgattcgtagaaacggggagagtgaaattgaggagatgatcagagagatggaaacaacagaagagagattagtggtgtacgatgtagatgtgttggattatcaaagcatacttgtctctctcaagacatgtaacgttgtcttctgttgcttagacagccctgaagggtacgatgagaaggaggtggatttggaagtgagaggagtgatcaatgtggtggaagcgtgtggaagaacagagagtatagagaagattgtgttttcttcttcattaacagcttcaatttggagagacaacattggaactcaaaaggatgttgatgagaagtgttggagtgaccaagacttctgtcgcagcaagaagttgtggcatgcactggaaagatgttgtcggagaaagcagcttgggcattagccatggaccgtaggctcaacatggtctctatcaaccctggtcttgtcgtcggaccatctgtcgcacaacacaacgctaggcccaccatgtcataccttaaaggagctgcacaaatgtatgagaatggtgtgttagcttatgtagacgttaagtttctagcggacgttcatattagagcattcgaggatgtttcagcttgcggtcgatacttctgcttcaaccaaatcgtcaacacagaagaagaagctctcaagctagtggagagtttgtctcctttgattcctatgccaccgaggtatgagaatgagatgcacggaagtgaagtttacgaagaaagattaaggaacaacaaattaagcaagctggtagaagctggctctgcttgttaaagaaagatttcacaatttaaattgaaagagacgagattatacaaaaaaaagttgtaatttgtatattgatcttctcatagatgcatgtgttgcttgtgaactattaaaaagaaagaaaaaaaacacatttcatctcaaaaaaaaaaaaaaaaaaaactcgagggggggcccggtacccaattg

SEQ ID NO: 17636 - DNA, 637 bp, Zea mays
atacagaccaatcactactctcaatacgttttaacctcgaaccaattaattctctccgatcatgccgaccagaaacatcgccatcggcggagtccaagaagaagtgactcaccccagcgcacttagggcggccctcgctgagtttatctcgactttgatcttcgtcttcgccggctcaggctcaggaatcgctttcaacaagctcactgacaatggagccaccactccttcaggccttgtcgccgctgccttagctcatgctttcggtctcttcgtcgctgtttctgtcggtgccaacatctccggtggacacgttaaccctgccgttaccttcggtgccttcctcggtggaaacatcactctcctccgtggtctcctctactggattgctcagcttcttggctcagtcgtcgcttgcttcctccttcagttcgccaccggtggcttggcagttccagcgttcggtctctcggcaggagttggaaccttaaacggtctcgtcttcgagatcgtgatgaccttcgggcttgtctacaccgtctacgccacagccatcgaccccaaaaacggtagcctcggaactatcgcacccatcgccattggtttcatcgtcggagtaacatcctcgcctggtgca

SEQ ID NO: 17637 - DNA, 1577 bp, Zea mays
  misc_feature (1)..(424): n is a, c, g, or t
  misc_feature (509)..(509): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctggaaggctcccccccgccggggggcgggcgccttcttaaaaattaattgatttccccccggccttccaagaattttanccccccccacaaaaaaaatggccccaggagagagagagagagagagagagcctcccttgtccccccccccccccccccatcaaatccatctcccactcttctagcatcttgaagcttaaatctcagccgtccgatcatgccgatcagaaacatcgccattggccgtccagatgaagcaacccgtcccgatgccttaaaggcggcgttggctgagttcatttcaactttgatctttgtcgtcgccggttcaggctctggcatggctttcaacaagctcactgaaaacggagccaccactccttctggtctcgtagctgctgcactggctcatgcctttggactcttcgtcgctgtctcagttggtgccaacatctctggtggacacgttaaccctgccgtcactttcggtgctttcattggtggtaacatcactctcctccgtggtatcctctactggattgctcagcttctcggctccgtcgtcgcttgcctcatccttaaattcgccaccggtggcttggctgtgccggcttttggtctctctgctggagtaggagtgttgaacgctttcgttttcgagatcgtgatgacattcgggcttgtttacaccgtctacgctacagccattgaccccaaaaacgggagtcttggaacaattgctcccatcgcaatcggtttcattgttggagccaacatcttagctggaggagctttctctggagcctccatgaatcccgccgtggctttcggaccagcggtggtgagctggacatggaccaaccactgggtctactgggccggacctctcgtcggcggtggaatcgctggactcatctacgaagttttcttcatcaacaccacgcacgagcagctcccaaccacagactactgaattaatctctctttttctctcttgtgtaattttattcgactttgaatttgaattttaatgtctttttaatttccgtttgtgtaatttcgaatcatcaaggggtttatgatcgttcgatcttttagatgaaaaaaaaaaaaaaaaaaaactcgagggggggcccggtaccccaatcg

SEQ ID NO: 17638 - DNA, 2108 bp, Zea mays
cgggctgaacaacatactcgaacggcacgaccggacgcggccgttcctacctgttgccacatctagtggttcggcctttccatctgccgttcgcccagcgtgttctccctctagtgcggcaactgggcgaccgccgccgccgctctactccaggtgcccaggcgttcgtccgtaccttctcaggccttcatcgcgtccttcgccggcgacgatcaccgacaaggatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccagaagtctgtaccaagtatatcagtgattggactgaatggagttctgctgtggaatcatgatggatatatcaactctgaaaatctgaaagaaagcattgagaaagcgtgggctgctcttcatctacaggagacagcagcgaccttgttgacagcatcacttgctacaagaaattctgaacctgtgaattctgctactactgttttgccagctcaagggggctcttctactttagaaaatccttctgatttatccagtcaatcaccagatgtttctggtgccagtgaagttgctcattcaactgatctggtatcacaaattcctaatagcactgccctttatgaacctcttgagataaatgaagaagaagggtcaaaatcaaactcggatgataaaactgttgagaagctaggttcaacaagtactgaatttgattgtgatttgcttgatatttcaaggaagtcaaatacggtcagttctgcagattcgaagggagaagacattacaccatcagcaaaaagaaagaacaaagatgatggaagtcacacttctattcccttggaggatactcctagtacactcactaataaaggagtttcttcccagtcacgcgtggaacaagacaaggcaacttcttttgtttctgtgaagtcagatgatattcagcttagtattcgtatgcccagtggaaatagactggagatcaaactaacaaaacaagatgttttaaggaaagtgaagaatttcgtggatgaaaaccaaggcaatgggcttggctcatatgacctttctctggtttatcctaaaagagttttctctgaacaagatatggaagcaacactatccgagctgggtattcaaaaccgtcatgcaatgattgttgttccacatcggcagtctggtcaggtatcaaggcgtcactcctcggcatcttatgatatgggtgtcaattcaggtgcggatgatgttggtggcaattcaggtgcggggggatactttggttacctgagaaccgtcctgtcttatgtgaatccactctcctacctgaggggaaataccaactcatcaaatacagagctacagtcaaatgaaggcctgcggcagcttagacatggatctggtccatggagtgagccacggcctcttggcaataggggccatgaagtgactgatgcagactctgcaaacacgctgcgaaggcggcctagaccatttggtgccaatatccacactctggggagcgaggatcatggtccgtctgatgaaagaaatgttttctggaacgggaactcgacagagtttggaggcgacgacagaaaataggttgtggcgtggctggcagggcctgggacgacactatcagacagaatcaaagttgcgaatagacagctgaaacaaatgcctcgacaggcttattgaggaataagtattgagattatagtgctgaaataatcgctgaattgtgatgtttacatttgtggaaacatacggtcgctggatccgtatactcgttgtatagtacatagccacagatatattaaatccgagaactgcttggtgctttctactgtctgatcgaacgacatttgttttggcgttggctacgaagaaaatttgccgctaccaaaaaaaaaaaaaaaaaaa

SEQ ID NO: 17639 - DNA, 3677 bp, Zea mays
  misc_feature (99)..(99): n is a, c, g, or t
  misc_feature (1453)..(1453): n is a, c, g, or t
gctggacaaatatactcgaacttcacccctgcacattgccattcctacctgttgccacatctagtggttcggcctttccatctgccgttcgcccagcgngttctccctctagtgcggcaactgggcgaccgccgccgccgctctactccaggtgcccaggcgttcgtccgtaccttctcaggccttcatcgcgtccttcgccggcgacgctcaccgacaaggaccatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccagaagtctgtaccaagtatatcagtgattggactgaatggagttctgctgtggaatcatgatggatatatcaactctgaaaatctgaaagaaagcattgagaaagcgtgggctgatcttcatctacaggagacagcagcgaccttgttgacagcatcacttgctacaagaaattctgaacctgtgaattctgctactactgttttgccagctcaagggggctcttctacttcgggaaatccttctgctttatccagtcaatcaccagatgtttctggtgccagtgaagttgctcattcaactgatctggtatcacaagttcctaatagcaccgccctttatgaacctcttgagataaatgaaaaagaagggtcaaaatcaaactcggatgataaaactgttgagaagctaggttcaacaagtactgaatttgattgtgatttgcttgatagttcaaggaagtcaaatacggtcagttctgcagattcgaagggagaagacattacaccatcagcaaaaagaaagaacaaagatgatggaagtcacacttctattcccttggaggatactcctagtacactcactaataaaggagtttcttcccagtcacgcgtggaacaagacaaggcaacttcttttgtttctgtgaagtcagatgatattcagcttagtattcgtatgcccagtggaaatagactggagatcaaactaacaaaacaagatgttttaaggaaagtgaagaatttcgtggatgaaaaccaaggcaatgggcttggctcatatgacctttctctggtttatcctaaaagagttttctctgaacaagatatggaagcaacactatccgagctgggtattcaaaaccgtcatgcaatgattgttgttccacatcggcagtctggtcaggtatcaaggcgtcactcctcggcatcttatgatatgggtgtcaattcaggtgcggatgatgttggtggcaattcaggtgcgngggggatacttttggttacctgagaaccgtcctgtcttatgtgaatccactctcctacctgaggggaaataccaactcatcaaatacagagctacagtcaaatgaaggcctgcggcagcttagacatggatctggtccatggagtgagccacggcctcttggcaataggggccatgaagtgactgatgcagactctgcaaacacgctgcgaaggcggcctagaccatttggtgccaatatccacactctggggagcgaggatcatggtccgtctgatgaaagaaatgttttctggaacgggaactcgacagagtttggaggcgacgacagaaaatagctcgagacccagctttcttgtacaaaaaaaaagcaggctcctgcaggaccatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccagaagtctgtaccaagtatatcagtgattggactgaatggagttctgctgtggaatcatgatggatatatcaactctgaaaatctgaaagaaagcattgagaaagcgtgggctgctcttcatctacaggagacagcagcgaccttgttgacagcatcacttgctacaagaaattctgaacctgtgaattctgctactactgttttgccagctcaagggggctcttctactttagaaaatccttctgatttatccagtcaatcaccagatgtttctggtgccagtgaagttgctcattcaactgatctgatatcacaagttcctaatagcaccgccctttatgaacctcttgagataaatgaaaaagaagggtcaaaatcaaactcggatgataaaactgttgagaagctaggttcaacaagtactgaatttgattgtgatttgcttgatagttcaaggaagtcaaatacggtcagttctgcagattcgaagggagaagacattacaccatcagcaaaaagaaagaacaaagatgatggaagtcacacttctattcccttggaggatactcctagtacactcactaataaaggagtttcttcccagtcacgcgtggaacaagacaaggcaacttcttttgtttctgtgaagtcagatgatattcagcttagtattcgtatgcccagtggaaatagactggagatcaaactaacaaaacaagatgttttaaggaaagtgaagaatttcgtggatgaaaaccaaggcaatgggcttggctcatatgacctttctctggtttatcctaaaagagttttctctgaacaagatatggaagcaacactatccgagctgggtattcaaaaccgtcatgcaatgattgttgttccacatcggcagtctggtcaggtatcaaggcgtcactcctcggcatcttatgatatgggtgtcaattcaggtgcggatgatgttggtggcaattcaggtgcggggggatactttggttacctgagaaccgtcctgtcttatgtgaatccactctcctacctgaggggaaataccaactcatcaaatacagagctacagtcaaatgaaggcctgcggcagcttagacatggatctggtccatggagtgagccacggcctcttggcaataggggccatgaagtgactgatgcagactctgcaaacacgctgcgaaggcggcctagaccatttggtgccaatatccacactctggggagcgaggatcatggtccgtctgatgaaagaaatgttttctggaacgggaactcgacagagtttggaggcgacgacagaaaataggttgtggcgtggctggcagggcctgggacgacactatcagacagaatcaaagttgcgaatagacagctgaaacaaatgcctcgacaggcttattgaggaataagtattgagattatagtgctgaaataatcgctgaattgtgatgtttacatttgtggaaacatacggtcgctggatccgtatactcgttgtatagtacatagccacagatatattaaatccgaactgcttggttctaaaaaaaaaaaaaaaaaaaaaaaaaaaaaaaaagtgc

SEQ ID NO: 17640 - DNA, 1528 bp, Zea mays
taagagagaaaaggaagagagatggagatgacgatgccatggatgtttcagaaaatggccatggcgattcttcattctgcaagaagccgaaggaaggtgatgttcatgtctcttccagttcaactgaagtggtaggaaccattccagagatgaatggaggcgatcatcatatacctggaagctccttttcatgtctagtgaagatctatgacatgcctgatagtcaagtgaaattaaatgatgttattgagtttattggcgtatatacatttgacccagaacttgctgctcctagtgacaacccagatgatataatgttagacctcatcgaagatgtaacagttcagttgcctccgagcaaggtgccacgtcttcactgtttggtatggagaaaattatcattccatgattttatttcaaggcctgttgttgagccttcacccagcctgttaagaggcattcggcaatctttgctctcacacctcacccttgtattaggcaatgacgagcttgcagcccagtgcttgctgttgcatcttctatccagacttcgtaatagggtggatgtggtcaccgttggcagactctccttgaatttcactggcttcaacagggaaagtgcttccatatttgggaatcagctgtattctttgatccagaaattggtgccgtattcacaagccatacctctgtcaattgagtatctcaacacagctacacttcaacctagaaaggacaacaagtcaggaaggttggtcacaggagttctgcagctacctcaaggcactcatctgatctttgatgagactcttctgcagacaggatcattgacatccaaaggtgtggagaataccatgctgctcaagaacctgatggagtcgcagaaggttgactacgattttgagtactacaagctggaaatggcagctgatgtgcagctactcactctctctgaggggaaatcaaacatccttccttcagatttggtagtgcctttccggccatcctctgttcccacaattaatgcaggtgctgaggaaactgagagctggaggtggtttttgaccacagtaaggtctcttcctcagtccactgaacctgaaacttaccagatgattcaggatgaaatggtcagtgccatgcgtgatgataggagcttgggttgttctgaacttagcagatggctaacaatggcacaaataatggcctccagctttggcgagaagagtctttctttggagcactggcagatggtgaaggagcttgagaggcttagaaagcagaggatgcaatgagatgacttaccattagcatgtgtttttgcactctaattgtttatgttggtatgctgttatgtgtatagtactagacgtttgaatcaagacatggatccaagtcatttctgtaacaactgacaacttctatgatcgtatgcatgtgtatctgctgcgcattttctttgctcaaatttgagatttactctgggagctatggaatgccaaaaaaaaaaaaaaaatttcagggttgt

SEQ ID NO: 17641 - DNA, 1744 bp, Zea mays
  misc_feature (3)..(3): n is a, c, g, or t
cgnaatgggtaccgggccccccctcgagtttttttttttttttttttcaagaaatatatgacattttgatttcaagttcttatggaaaatggcacaaaaataaataaaaaaaggtaaaaactcaaagagtttgagaatcaagagtgaaacaaaaagaaagcaagtagagatgctcactatatgaaactctctaaaaccttataatcattcgaggatcgtcccaataactccagcaccaacagtctttcctccttctctgatagcaaacctcatcccttgttcacaagccaccggcacaataagctcaacaacaatcttcactcgatcaccgggcataaccatcttcgactcttcatctttgtcgttcatgatcttcgtcactttacccgtaacatcagtcgtcctcatgtagaactgaggcctgtaacctgcaaagaatggagaatgccttccaccttcctctttcttcaacacatagataattgcttcaaacttggtatgtggagtaatcgatcccggcttagctaaaaccatacctctctgaatatcagccttttgaatacccctaagcaacaaccctacattgtcaccagctaaagcctcatcaagaatcttctgaaacatttcaaccccagtgacagtgtaactcctagtctccctcaaacccactaaatctacagtctctcctaccttaaccgtacctctctcgacacgccctgtagccaccgtaccacgtccagtgatagagaacacatcctcaacagctaacaagaatggcaattcagtttgtctctgagggatagggatgtaatcatcaacagcatccataagttcataaatcttatctacccatttgttatcacctctcttaaccttaggattctcagtaagagtctcaacggctaaaagagcagaaccagagataatcggaatatcatcaccgttaaattcataagacgagagaagctcacgaacctcaagctcaacgagctctagcaactctgcatcatctacttgatcctctttgttaagaaacacaaccatatcaggaacaccaacctgcttagccaaaaggatatgctctttagtctgaggcataggaccatcggcgccggaaacaacgaggatagctccgtccatctgtgcagctccggtaatcatattcttaacgtaatcagcgtgaccaggacaatcaacgtgagcgtagtgacgattctcagtctcgtactcaacagtagcagtgttgattgtgataccacgagctctctcctccggcgcagcgtcaatctcgtcgtactttttagcgacgctggaaccaatggaagcgagagccatggttagagctgcggttaaattagttttcccatggtcaacatgaccgatggttccgatgttgacatgaggcttcttcctctcgaactttccacgagcggcgcggacggtgaaggagcgacgagtggattgagaagcggaggtggtggttaatgagtaagaagggaggaaggaggaagagagagttagggttttgagtttaccagaggtggaaatggcgggacagagagaaggagaaggagaggagtaggaacagagaattctagaggaggaagaacaagcggctggagccgaaatcgccatgggaagatggaattggagagcagaggagagaaatcgagaagctagggtttgaaatttttttggagaacaggggggggggctactgagctctcccctctctctctctctc

SEQ ID NO: 17642 - DNA, 1176 bp, Zea mays
  misc_feature (30)..(30): n is a, c, g, or t
gcccgaggagagagagagagagagagaganctccctagtcccccccccccccaaacgaataaagaagtaactgtgaaagagcgaagaagagtcacacaaaaaaaacaatggcggaatcttcagagcctccggttgttctccttcaccgaccaccgtctctaactttcatggacgagattctgactcgtgaattccgtactctcatcaccgacacttcatcatcggaatcactcccgagcttcctcccccgtcacgcctcctccgccagagccttcgttatcaccggcagacttccggtaaccgaagaactcctttctcatctcccttctctccagatactcgtctgcactagcgtcggcatcgatcacatcgatctcgccgcatgcaagcgtcgcggcatcgttatcaccaacgctggcaacgcgttttccgatgacgttgctgattgtgccgtcggtttgcttattagtgttctccgtcgtattcctgcagccgatcgttacgtccgggctggtaattgggcgaaatttggggattttcaattagggtccaaggtaagtgggaagagagttgggatagttggattggggagcattggatcatttgttgctaaaagacttgaatcatttggctgtgttatctcttacaattcaaggagtcagaaacagagtagtccataccggttttactctgacattctctcgttagcagagaacaacgatgtacttgtcctctgctgctctttgacagacgaaacgcaccatattgtgaatagagaagtgatggagttgcttggtaaggatggggttgtgatcaatgtgggacgaggaaagttgattgatgagaaggagatggtcaagtgtttggttgacggtgtgattggtggtgctggtttagatgtgtttgagaatgaaccggcagttcctcaggagttgtttggtttggataatgtagtgttgtctcctcattttgctgtggctacaccagggtctttggacaatgttgcacagattgctttagctaacttgaaggcgtttttctcgaaccggcctttgctttctccggttcaattggatttagagagaactagtctcgagggggggcccggtaccccatttggtcttaaactgaagccacatagaatgaactatgacaataaagtataaactgacagaa

SEQ ID NO: 17643 - DNA, 1015 bp, Zea mays
gaatcacacgcttcttccttcctcttccatcttcttcatatctcccttagtcacctctactctactctgcaggcaaaaatagttatggcgacttcttcgatcactatcccgaccattagaactccgattcatcgatcaaaatttctaggccaaacacatcaattttcaactgtaaaccggtcggttttcccgcctccaaaacagcaatcaaaactgtatcaagtaaaggccatgggtaaattcaatctatgggaagtgatgggaggaagaggattatgcaacggagagaaaggtattgagaaggagctccagaggaacattgaagacgagcaagagacatcaaaggctgagaacaacgagacagagagagagagcgatgacagtaacttgtcttttaaagtacctgaagatggtttcgagaaagagatgatgggtctcacaggaggatttcccggtggcgaaaagggtttaaaaacgtttatcgaaaaaaatccaccacctcctccaccaccaccacctgcaaaacaaggaagcgatgcatccgcggttgctacagataagaagccgaaagcgcccaagctaccccttctcatgccggggatgattgctatagtcaagaaccagaacagtccgtatcacatgtattgtggaattgtgcagaggatcactgatggaaaagctggtgtcttgttcgaaggaggaaactgggaccgtctcattactttcaggcttgaagagcttgaacgaagagaaaaaggtccaccgggtaagaatccaaagtcttgtattctcgagcctcttatcgaacagatgcaaaaggaagaggcagcaccataagtgatcttctcttctctgtatgcaagttcctgtgaatgtatatgtaacgtacctttgcgttttaggctacaatatttctgactggttctaaaagagcttcatcatgtgatataaaaaaaagaataaacgatgaatttcaaaaaaaaaaaaaaaaaaaactcgagggggggcccggtac

SEQ ID NO: 17644 - DNA, 2491 bp, Zea mays
cgacacaagacacggcgacccgacgtcaccgaacgcacaagtgtcgccggcgaccgagccgcggcctggtctagtacagtagtccagtccaccacctctcccgcgccacgccgcgccgccgaccccgtccgcgtcccgcgggttcggcatctcggccccacctccacaacccgatcccccagtcctcggctcgcgcacctccgcaccgcaccgcgcacgcgcttgcgcctttggcttcttgctccagcgaccccgccgtccccgtcgggcaccaacccaacccaacgctctcctcctcgcttcccttccgcccccccggcccaccaatccatcgctcccctcacctcacctcacctcacctccgcacccgctgtttcgtgcaccgcacttcacaccccaccaaccttctccccccctgaaaaactatctaccccaccccaaaccacccctacccgccgacgagcgcgatcgattgattcgtttcgcgccgggcggcggcggagggagcccaccagatccggctaccgccgcggctacgatgaagtcgctgctgccgcggagcgagctgcggcgctcgtcggcggcggccgtgcggtcgtcggccggcggcgccgcggggggagacggtgctgtggccgacggcggcggggctgggccgcgagcgcccgcctcctccaccttctggttcctgctgcacgcgctctgctgcctcatctcgctcttcctcggcttccgcttctcgcggctcctcttcttcatgctcttctccaccaccgcgctctaccactccacatcctcctcctcctcggccgcggtcctgcgcgccaccaccacgacgaccacaaccaccaccaccaccaccacgaccaccaacaccttcacgctctccttcgcgggcgccaacactcccccctccggcccggctaaccgcacggcgctggaggcggcagcggaggccgacaaggcggcggcggcgtctgggaacccgcagagccacgtcgtggtcgggaggcacgggattcggatccggccgtggccgcacccggaccccgtcgaggtgatgcgggcgcaccggatcatggagcgcgtgcaggaggagcagcgccgctggtacggcgtcaaggagccgaggcaggtgctcgccgtcaccccgacctactcccgcgcgttccaggcgctccacctcaccggcctcctccactcgctccgcaacgtgccgtacccgctcacctggatcgtcgtcgaggcaggcggcaccaccaacgccaccgcgtcaatgcttgcgcgctctggcctcactgtcgtccacatccccttccctgaccgcatgcccaccgagtgggccgaccgccacgctactgagaaccggatgcgcctccacgccctacgcgtgatccgtgagaggaagatggatggtgtagttgttttcgcggacgacagcaatgttcataccatggagctgttcgatgaggtgcagaaggtccagtggatgggtgctgtgtccattggaatccttgcgcatactggaacccccgacccccgccggcgcaccgtgcaggacaagcagatatgcctctcccagtccagggccctgcttgcaactcctcagggcatctggctggatggcacacgttcaacgcattgcccttctctgggaagaccgccaccgtggttggtgaggcggcccctgttctccccaagggtttggagtgggctggctttgtgttgaactcgagaatgctgtggaaggaggctgaaggcaagcccgactgggtgaaggatcttgatgctgttggcgagaatggagaggagattgagaatccacttactctgttgaatgatccatcctctgttgagccactggggaactgtgggaagaaggtcctactgtggtggcttcgtgttgaagcacgggcggatagcaagtttcctcaagggtgggtaattgagccacctttggaagtcgtcgtccccgcaaagcgcactccatggcctgaaaccaccaccgagcttccatccgagttgttggatgacaagcaaaagccggaggataggcacttgtcaagaggcaacaaatcgtctcagcccagaggcaccacgaaacggaagggcgaccctcaagggcaagataactgatggagaacgcactggcattgtaatgtatatctcttgcaccctgcaagaacacggtaggaagcatatcgggttactctggcggtggcggtgtttaatttttctttctgatgtttttgctcttgtggcgatggtccacgcttgggtgtgttatctgtagagtgcacatttctaaagtagctgcacctgttgtgttgtaatgtaactgtattgggaactaaaaaaatgggggctggattctggaagcctatctatgcttgtgaaggaggactgaactcttgggtgctgcagcatgggctgatggctggttgagcatatgaatcttctctcaggaagatattccttcctttctttcttt

SEQ ID NO: 17645 - DNA, 1711 bp, Zea mays
cgggcgcccgcctcctccccttctggttcctgctcccgcgctctgctgcctcatctcgctcttcctcggcttccgcttctcgcgtctcctcttcttcctgctcttctccaccaccgcgctctaccgctccagcacctcctcctcctcggccgcggtccttcgcgccaccaccacgaccaccaccaccacgaccaccaccacgacgacgaccaacaccttcacgctctccttcgccgccgccaacactcccccttccacccccgctaaccgcaccgcgctggatgcggccgacaagggggcggcgtccgggaacccacagagtcacgtcgtggtggggaggcacgggattcggatccggccgtggccgcacccggaccccgtcgaggtgatgcgggcgcaccggatcatggagcgcgtgcaggaggaacagcgccgctggtacggcgtcaaggagccgaggcaggtgctcgccgtcaccccgacctactcacgcgcgttccaggcgctccacctcaccggcctcctccactcactccgcaacgtgccgtacccgctcacctggatcgtcgtcgaggcaggcggcaccaccaacgccacggcgtcaatgcttgcgcgctctggcctcactttcgttcacatccccttctctgaccgcatgccccacgactgggccgaccgccacgccactgagaaccggatgcgcctccacgccctacgcgtgatccgcgagaggaagatggatggcgtagttgttttcaccgacgacagcaatgttcatagcatggagctgttcgatgaggtgcagaaggtccagtggatgggtgctgtatccgtcggaatccttgcgcatactggcacggcagaccaactacggctcaccgaggaggacaagcagaatatgcctcttccagtccagggccctgcttgcaactcctcagggcatctgattggatggcacacgttcaactcattgcccttctctgggaagacggccacagttgttggtgaagcagcccctgttctgcccaggggtttggagtgggctggttttgtgttgaactcaaggatgctgtggaaggaggctgacggcaagcctgactgggtgaaggatcttgatgctgtgggcgagaatggcgaggagattgagaacccacttactctgttgaatgatccgtcctctgttgagccactgggcaactgtgggaagaaggtcctactgtggtggcttcgtgttgaagcacgggctgatagcaagtttcctgaagggtgggtaattgagccacctttggaagtcgtcgtccctgcaaagcgcactccatggcctgaaacaaccaccgagctgccagccgagttattggatgacaagcaagagcaggaggataggcgcttgtcaagagccaacaaatcatctcggccccgaggcaccacgaagcggaagggcgaccctcaaggacaagataactgatgcagaacgtactagccttgtgatgtatatcttacaccctgcaaaaacacagtagcaagcatatcctgttaatctggcggtgtctgtttaatttttcttttcttttctgatgtttttgctcctgtggcgatggtccacgcttgggtatgttatctgtagagggcacatttttaaagtagtggttgtatcttttgtgttgaaatgtacaatgcattgggagctaaaaaaatggtggatgaatactgg

SEQ ID NO: 17646 - DNA, 1165 bp, Zea mays
ccccgcgtccgcccacgcgtccgcgcacccggaccccgtcgaggtgatgcgggcgcaccggatcatggagcgcgtgcaggaggagcagcgccgctggtacggcgtcaaggagccgaggcaggtgctcgccgtcaccccgacctactcccgcgcgttccaggcgctccacctcaccggcctcctccactcgctccgcaacgtgccgtacccgctcacctggatcgtcgtcgaggcaggcggcaccaccaacgccaccgcgtcaatgcttgcgcgctctggcctcactgtcgtccacatccccttccctgaccgcatgcccaccgagtgggccgaccgccacgctactgagaaccggatgcgcctccacgccctacgcgtgatccgtgagaggaagatggatggtgtagttgttttcgcggacgacagcaatgttcataccatggagctgttcgatgaggtgcagaaggtccagtggatgggtgctgtgtccattggaatccttgcgcatactggaacggcagaccaacttcggctcagcgaggaggacaagcagaatatgcctctcccagtccagggccctgcttgcaactcctcagggcatctggctggatggcacacgttcaacgcattgcccttctctgggaagaccgccaccgtggttggtgaggcggcccctgttctccccaagggtttggagtgggctggctttgtgttgaactcgagaatgctgtggaaggaggctgaaggcaagcccgactgggtgaaggatcttgatgctgttggcgagaatggagaggagattgagaatccacttactctgttgaatgatccatcctctgttgagccactggggaactgtgggaagaaggtcctactgtggtggcttcgtgttgaagcacgggcggatagcaagtttcctcaagggtgggtaattgagccacctttggaagtcgtcgtccccgcaaagcgcactccatggcctgaaaccaccaccgagcttccatccgagttgttggatgacaagcaaaagccggaggataggctcttgtcaagaggcaacaaatcgtttcagcccagtagcaccacgatttgtttgggcgaccctcaagggcacgataactgatggagaacgcactggctttgtaatgtatatctcttgcaccct

SEQ ID NO: 17647 - DNA, 2594 bp, Zea mays
cccctgcctatctcaatcattgaaaacgtgagaaacacaaaccactaccacacctctcaagcaatttatgttttttttatatcttcataaaataaaaacacaaaatgacgacacgcgacacggcaacacgccgtcacgaacgcgcgagtgtgtccggcgaccgacccgcggcctgctcccgtactccagcccaatcccaatcccaatcccaaccccaatcccaacctgtcccgcctcccgcgcatgccgcgccgccgaccccgtccgcggcctgcgggttcggcatcccgcccccacctcctcaccaaactcccccaacccgatccccccggaccgcgccgcgcagacgcgcacgccttgcatttggcttcttcgcggcttcagcagcgaccgcgtccccgcccccgtcgggcaccaacccagcccaacgctctcccccctgctcctccccttttcctctgcccaccaattgatagctcacctcacctccgcgcccgttgtttcgtgcaccgtacttcacctcccaccaacctctccccctcaaaaactatccacccctccacggctccacccctacccgccgacgagcgcgatcgattgattcggttcgagccgggcggaggaggagggagcgccgcggggcggggtgagcccaccagatccgactaccgcagcggctatgatgaagtcgctgctgccgcagagccagcggcgccgcgcggcggcggcgcgcggcgcggtcgtcggcgggcggcgccgcgggggcagacggggctatgtccgacggcggcggcgcggggccgcgggcgcccgcctcctccaccttctggttcctgctccacgcgctctgctgcctcatctcgctcttcctcggcttccgcttctcgcgtctcctcttcttcctgctcttctccaccaccgcgctctaccgctccagcacctcctcctcctcggccgcggtccttcgcgccaccaccacgacaaccaccaccacgaccaccacgacgacgacgaccaacaccttcacgctctccttcgccgccgccaacactcccccttccacccccgctaaccgcaccgcgctggatgtggccgacaagggggcggcgtccgggaacccacagagtcacgtcgtggtggggaggcacgggattcggatccggccgtggccgcacccggaccccgtcgaggtgatgcgggcgcaccggatcatggagcgcgtgcaggaggaacagcgccgctggtacggcgtcaaggagccgaggcaggtgctcgccgtcaccccgacctactcacgcgcgttccaggcgctccacctcaccggcctcctccactcactccgcaacgtgccgtacccgctcacctggatcgtcgtcgaggcaggcggcaccaccaacgccacggcgtcaatgcttgcgcgctctggcctcactttcgttcacatccccttccctgaccgcatgccccacgactgggccgaccgccacgccactgagaaccggatgcgcctccacgccctacggtttccttgcgcagcgtgatccgcgagaggaagatggatggcgtagttgttttcaccgacgacagcaatgttcatagcatggagctgttcgatgaggtgcagaaggtccagtggatgggtgctgtatccgtcggaatccttgcgcatactggcacggcagaccttctccgcccccgcgtcgtggacaagcagaatatgcctcttccagtccagggccctgcttgcaactcctcagggcatctgattggatggcacacgttcaactcattgcccttctctgggaagacggccacagttgttggtgaagcagcccctgttctgcccaggggtttggagtgggctggttttgtgttgaactcaaggatgctgtggaaggaggctgacggcaagcctgactgggtgaaggatcttgatgctgtgggcgagaatggcgaggagattgagaacccacttactctgttgaatgatccgtcctctgttgagccactgggcaactgtgggaagaaggtcctactgtggtggcttcgtgttgaagcacgggctgatagcaagtttcctgaagggtgggtaattgagccacctttggaagtcgtcgtccctgcaaagcgcactccatggcctgaaacaaccaccgagctgccagccgagttattggatgacaagcaagagcaggaggataggcgcttgtcaagagccaacaaatcatctcggccccgaggcaccacgaagcggaagggcgaccctcaaggacaagataactgatgcagaacgtactggccttgtgatgtatatcttacaccctgcaaaaacacagtagcaagcatatcctgttaatctggcggtgtctgtttaatttttcttttcttttctgatgtttttgctcctgtggcgatggtccacgcttgggtatgtcatctgtagagggcacatttttaaagtagtggttgtatcttttgtgttgaaatgtacaatgcattgggagctaaaaaaatggtggatgagtactggaagtctgtctatggttctgaagaaagtactcaactcttgcatgccggctgatggctgggtgcgc

SEQ ID NO: 17648 - DNA, 2054 bp, Zea mays
ggtacccctgacagtattcaaatctaaatccgagaatttgataaccatgcgtgggtagcacacttgttccctgcagacctgtgaacagtggaacaggttttgtaaggaaaatggtctagtactcactgaaggcagcagatggcaaacattgggtttccttacgaaaacattagtttcagtgaaaccaacagagtgaaaggattgggttcctttagctaagaaattggatcgtttagagtgtagttagctgtttactcatctctctctctctcgtttatttcttttgcccatttagctttccttttctttcttatccacaaccgaatattttcttttgcaggtgggtaattgagccacctttggaagtcgtcgtccccgcaaagcgcactccatggcctgaaaccacccccgagcttccatccgagttgttggatgacaagcaaaagctggaggataggcacttgtcaagaggcaacaaatcgtctcagccccgaggcaccacgaaacggaagggcgaccctcaagggcaagataactgatggagaacgcactggcattgtaatgtatatctcttgcaccctgcaagaacacggtaggaagcatatcgggttactctggcggtggcggtgtttaatttcttttttttctgatgtttttgctcttgtggcgatggtccacgcttgggtgtgttatctgtagagtgcacatttataaagtagttgtacctgttgtgttgtaatgtaattgcattgggaactaaaaaaatgggggctggattctggaagcctatctatgcttgtgaagggaggactgaactcttgggtgctgcagcacgggctgatggctggttgagcatatgaatctttctttatttatttattttattattgttgctcagggctggaagcctatctattccttctttctttatttattttattctttctttatttatttattttattattgttgctcagggctggaagcctatctattccttctttctttatttattttattattgttgctcaggactctcagaccaaatccatgtgtgttgagtgagaattgagatgggcagggattactccaaattcctttgttttggacggggacttggtttattttcaccaacaattccagcccgccttgattgcctgccttagaaatgaccgtggttgtactgttggagacttggtttgttttactggccctggcgtgaaacacagactgagaccctgtacaaggaaatataaaaaactataggttttcttgtgtgttatctcgtcgatttcaaaactagactgtgtagcaaatagcagatcatagcctaacacacaatcacacatgtacgagttgggccctagaattctagggactctgtgcagttggcccatttacgttggatcatgtaggggcctagctgtaaggccgttttcaacagaggcccaatataaatgataaaaaaagttcatatccgtaccttggcccaggccgttttcaacagaggcccaatataaatgataaaaaaagttcatatccgtaccttggcccatcaatcatgtcgtggaaaagaagtgtactttacttttaataatgcatgctctgtcaaaatgtccggttggctttaattcaaaacggttttactgtaaaattctagagtagtttgtctctgtattacaattgtcgaataactgactttaatccgaaacgaacaactgtatctttttgtctatatactaattctaagatatattcgagcagatgccacgacagtttcataaatattgtctgcaaggcactaaccgtatagataaccacacaacaaattgtctactctgttgctgcagtacataaatatgtttttggttgtaaagaaactaggctacatcacgattcacaccacgtgctgacgacgtgaagcatcaccagattttcacggcggggcaccgggcacggcctccagcaccagccgccacggcgacgcaaacgtcaagagctgcgtgcccaaacgagggacaggtcagatgggcgaggaaaagcgccctgttctt

SEQ ID NO: 17649 - DNA, 1405 bp, Zea mays
attgtaaatcagctccctatagggcgtatggggtaccgggccccccctcgagttttttttttttttttttttcttttagacaaaaatgtgtttttatcatatccagtttctgttgctgcagagttttaacaaaacaaaatcaccttaataaaatattagcgtatagaaaacattcagttatagattctaatggaaaaataaaagccaagctcattacactacaaaatcatttcatcttccacatattgaaagctgttgatgcagagccaagagtggtctgttgagtcactcagaagacaccttcatctttttggcaacagtctcttccttatgcttaagcttagcgtctttccgctctctcttcgatcccttagatttatcgaacagtttcatttctttcagcttctgatcaggcatataaatcttcccagtcttccctagtactgcatcttgatcaacgtttttctccttcttcttaggcttatccttggatgttctcattgcttctttcattaagctatcgttaggaagacgattacgcctgataaccaagtccatggatggaccgacttcaacaagctccattctcggaacaatggatcctgactttttaagcttcaatgcgcaatgagtaaggaaaacctttgttggggatatagctgaacatacgtaagcgcggtctaaaccagtaagatttagattatccacaacctcgccacgaaaaagatcagtgaggacttctttgagatgcttaagctctgatacattctcaaaaccttcaccaataaagcaaatgaaaggctttgttccttcatgaggtgcgaatttcttgtcatacgaaaacgcccgcaaggatttaaagttctcaatcccaacttctataagatcatagacttggtgatcatacattctcccaagtacaagattgtcaggtcgtttcttcgtgtgagaaccatacacaaaaatgctacaatctgttttctgagagaagaactctaatgaagtttcacctccactctcgaaaggcctaatattctcattcctccttgaatatctgatggcacctcccttcttcaaacggtagagttccgtcattacagagctaagtgtagcactcgtctttgttccatgaagtatcaacgtcttcttcccagtttcaaccaacttaggagctcggctttcgagaacacgcttggctttgccagtcttcggagttcgtatttccatcatgactctgttaaatcgccggaaagtttcacaagcgacggctccgaaagaagagagaaaggtttttcgattgattgatcgggggggggggggggggactagggagctctctctctctctctctctctcctggggccaatttcgtgagcccggggatccatatttccaagcggcgcac

SEQ ID NO: 17650 - DNA, 642 bp, Zea mays
ggagacttgtctctgctttgattgaagaagacgcttgatcgaaaattcccttagatttcgtaaatagggttttacagaaggtgagattacacagagatcggatttgcgaaaaaaaaaaatgggaagtccaaagaagaacgagaacaaaggcttcttcgccgccatgacttctggcttctccatgttcggtaccgccgtgtcgagatccgttaacggcgtgcaaggtaatgaaggagttgaggtcataaatccagaaggtggcaaggaagatgctgaagaggaagctcagaaaggaaggtggaaggacgaggaacgagatagttactggaagatgatgcagaaatatataggttcggatattacgtcaatggtgactcttcctgttgttatatttgagcctatgactatgctccagaagatggctgagataatggagtattctcatttgttggatcaagcagatgaatgcgaagatccatacttgcgtttagtatatgcttcatcatgggctatatctgtttactatgccttcccaacgaacttggaagcctttcaatcctattctgggggagacatatgagatgggcaaccatggggggatttcttttatttctgagcagttaacccttctcccccaaggag

SEQ ID NO: 17651 - DNA, 2616 bp, Zea mays
cccacgcgtccgcggacgcgtggggtccgcctcctcccctactccggccgcagccgccgacgtcgccattctgccgcgccaatcgatagggttcgctcgctcccccctcaggcctcagggacccaatcccgctccctcctcgcgcacccattgcatctcgtcctcgtctcgtcccgctagtgtcgtttttgatctgattgatccgtggtgggtggactgcgtggcaaggtccgcgagtggctgggatggcgctcgtcggcgtccgcgccagcgtccacgggcccgcgctacgcgccgccggatccgacgctgcccaagccgtggagggggctaatcgacggcaacacggggtacctctacttctggaacccggagacaaaggttacgcagtacgagcgtcccgtcgctgctgtgcccgccccccaatcgcagccgcctgtctactccaggcccgatgacgggccgagaagcagcgcacctgccgagcagcgctcggaagctgcggtgagccgcccgcaatatgtgcctccctccgataacaggacaaggaatgatcacccagagtcaagctctgcatctggagtgaacctttcacaaagtgctctgtccaccaatcaagtttctcagtatgccaatgggagccaaatgtcgacagaagcatatcgtgccaagcatgagattactatcgtcggcaatgaggcacctgcaccattcatgacatttcagtccacaggcttcccatcagagattctaagggaggttctgcaagcaggattctctgcaccaactcctatccaagctcaatcatggccaattgctctaaggggtcgtgatatagtagctgtggcgaagacaggttcaggaaaaacactgggctatcttctcccagggtttattcttttgaagcgcctgcagcataattcaagggaaggtccaacagtattagttttgtctccaaccagggaattggcgacacaaattcaagatgaagcaatcaagtttggcagatcttcaagaatatcttctacttgcttatatggaggtgctccaaaaggccctcagctaagagagttggagcgtggtgctgacattgttgtcgcaactcctgggagattaaatgacattttggaaatgaatagagtgagcctgcaccaagtatcatatcttgtccttgatgaagccgaccgtatgcttgatatgggatttgagccacaaataaggaaaattgtgaaacaaataccaccgaaacggcaaactcttatgtatactgccacatggccaagagaggttagaaaaatagcgtctgatttactggctaacccagttcaagttaacattggaaacactgatcagctggttgcaaataagtcaattacacagcatgtggaagttatcccacatatggagaaatcaagacgacttgatcagatcttgcgctcacaagatcctggatcaaaaagcataatattttgctccactaagaggatgtgtgatcagttagctcgaaacctatcacggcagtatcgtgcttctgctattcatggtgataaatcacaggctgagagggattctgtgttgaatgactttcgaagcggcaggtgtccagtacttgtagccactgatgtggccgctcgaggcttggacataaaggacatcagggtcgtggttaactatgatttcccaactggtgtggaggactatgtccatagaattgggaggacaggtagggctggtgcaacaggatctgcctacacattcttcggtgaccaggattcaaagtacgcttcagaccttgtgaagattttggagggtgcaaaccaatctgtgccgccacagttgaaagaaatggctcttcgtggaggatatggtggaagatcacgtcggtgggcatcttctgatgactcttatggtggtcagggatatggtgctaaaagatcaactgatagcttcaataataacagcttcggcgaccaggctggaggtggttcaagctttcactcgagctccagtggcggtcagtttggtgatactacgagcttccatggcagcttcgataacagtgtccgcaacaatcagacgggggacaatgcgagctttccacccagctccagcaacaatcagtctggcgatggtctcagttttcatgaaaggttctatggatcacgtggaagggaccagagcagaacaagcaatgatggattccgtgccaggagcagaagtcctcctggcaagcccgtggaagtttccaactggtgattgcatccactaggtgcaatccaatttttgcgatggtgacgaaaccaagtagaagatggcaccctaacaagttatattatttccttttcttatcctgcttagatccaaggatgtgatggtctgaaccctaacggtctcctgctatcttgatttgacgtctgggagacgcttgattccgtgcctgtgggttgtaaagcgttaaaacttgactttgctagtgtactcccaatgatataacccaatcctgggtaaacaaacgcatggggatgaattttggacgaaaccatggacaactgatgtgtgtttaatgtcatgtacaatctatgtcgaaggctgttgtaaatcccgcccgcatagttt

SEQ ID NO: 17652 - DNA, 2726 bp, Zea mays
gtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagtgctaagcatgagattaccatcatcgtatgtgataaactaatccattcattttattttttaatttaaatgttaccctcaaccactcgtcttttatttaagcgttacttaaattttttttcccgtgttttccttcctcggcaacgagtcacctgcaccattcatgacatttcagtccacatgcttcccatcagatattctaagggaggtaagtctacgcaatgcgtagcaatatcaatgtgcttttttggatacctttctgatggaaccaggtggccatcgtgcatccattgtatgtatgcatgattaaaccgagttttctttgcagcaggctcttcaagtcaacaatccaagtcgtggttcgacctgtttgttgtcttgtacagcctcctgcggtttgaaacagctccctattttgttcagttcccagctgcatgatgtttggcttggctttcgtgtaactaaaaatttgacatcatgagaagccttttctcgttgctatagactatagtatgaattttgttctaaacacagatataatattcagataatactcatctctgaaggatatctaccttttccaggttctgcaagcaggattctctgcaccaactcctatccaagctcagtcatggccaattgctatgaagggtagggatatagtagctgtggcaaagacaggttcaggaaaaacactgggctatctcctcccagggtttattcttctgaagcgcctgcatcataattcaagggaaggtccaacagtattagttttgtccccaaccagggaattggcaacacaaattcaagatgaagcaatcaagtttggcagatcttcaagaatatcttctacttgcttatatggaggtgctccaaaaggtcctcagctaagggagttggagcgtggtgccgatgttgttgttgcaactcctgggagattgaacgacattttggaaatgaataaagtgagcctgcgccaagtatcatatcttgtccttgatgaagctgaccgtatgcttgatatgggatttgagccacaaataagaaaaattgtgaaacaaataccacctagacggcaaactcttatgtacactgccacatggccaaaagaggttagaaaaatagcgtcggatttactgaataacccagttcaagttaacattggaaacactgatcagctggttgcaaataaatcaattactcagcatgtggaagttatcccacatatggagaaatcaagacgacttgatcagatcttgcgttcacaagatcctggatcaaaaatcataatattttgctccaccaagaggatgtgtgatcagttggctagaaacctatcacggcagtatggtgcttctgctattcatggtgataaatcacaggctgagagggattctgtgttgaatgacttccgaagcggcaggtgtccagtactcgtagccactgatgtggccgctcgaggcttggacataaaggacatcaggatcgtggttaattatgatttcccaactggtgtggaggactatgtccatcgaattgggagaacaggtagggctggcgcaacaggatctgcctacacattctttggtgaccaggattcaaagtacgcttcagaacttgtgaagattttggagggtgcaaaccagtctgtgccaccacaattaaaagaaatggcccttcgtggaggatatggtggaagatcacgtcgatgggcatcttctgatgactcttatggtagtcagggatatggtgctaaaagatcaactgatagtttcaagaacagcagcttcggcaaccaggccgggggtggttcaagctttcactcgagcttccataacagctctagtggcaatcagttcggtgatactacaagctttcatgccagctatggtaacagcagccagaacaatcagacgggtgacaatccgagcttcccacccagctccagcaacaatcagtccggggatggtctcagttttcatgaaaggttctatggatcacgcggaagggacgagagcagatcaaacaatgatggattccgtgctaggagcagaagtcctggcaagcctgtggaagtttccaactggtgattgcatccactaggtgcaatccaatttttgcgatggtgacgaaaccaagtaaaagatggtacctcgacaagttatattttcctcttatcctgcttaaatctaaggatgtcctggaacatcactaacttaggatatgggtgatggtctgatcccaatggacaatggtctcctactttcttgatttgacgcctgagagacgcctgattccataccatatgcctgtggttgtagtttgtaaaatgttaaaaacttgactttgctagtatatttcctaatgctataacccaatcctgggtaaacagacgcatggggatgaattttggacggaaccatggacatttgatgtatgtgtttaatgttgtgtacaatctatgtcgaattctgttgtaagtgccgtccgcatcgttttatatctttgtgcccgttattacaggtcttaaagaatcatgctccccgctctctctctcctcgtgc

SEQ ID NO: 17653 - DNA, 1317 bp, Zea mays
  misc_feature (22)..(22): n is a, c, g, or t
  misc_feature (32)..(32): n is a, c, g, or t
  misc_feature (88)..(88): n is a, c, g, or t
  misc_feature (99)..(101): n is a, c, g, or t
  misc_feature (113)..(114): n is a, c, g, or t
  misc_feature (147)..(148): n is a, c, g, or t
  misc_feature (181)..(181): n is a, c, g, or t
  misc_feature (185)..(186): n is a, c, g, or t
  misc_feature (233)..(233): n is a, c, g, or t
tctgtttgccacatggcccaanaaaggttagngagaatagcgtggtggatttactaggctttaacccagttcaaagtgtaacattggnaaaccactgannncagctggttgcnnaaataagtcaattacctcagcatgggtggaagnnttatcccacatatggagaaatcaagacgacttngatnncagatcttgcgttcacaaggaggggtgggtcaaaaagcataatattnttgctccactaagaggatgtgtgatcagttagctcgaaacctatcacggcagtatcgtgcttctgctattcatggtgataaatcacaggctgagagggattctgtgttgaatgactttcgaagcggcaggtgtccagtacttgtagccactgatgtggccgctcgaggcttggacataaaggacatcagggtcgtggttaactatgatttcccaactggtgtggaggactatgtccatagaattgggaggacaggtagggctggtgcaacaggatctgcctacacattcttcggtgaccaggattcaaagtacgcttcagaccttgtgaagattttggagggtgcaaaccaatctgtgccgccacagttgaaagaaatggctcttcgtggaggatatggtggaagatcacgtcggtgggcatcttctgatgactcttatggtggtcagggatatggtgctaaaagatcaactgatagcttcaataataacagcttcggcgaccaggctggaggtggttcaagctttcactcgagctccagtggcggtcagtttggtgatactacgagcttccatggcagtgtccgcaacaatcagacgggggacaatgcgagctttccacccagctccagcaacaatcagtctggggatggtctcagttttcatgaaaggttctatggatcacgtggaagggaccagagcagaacaagcaatgatggattccgtgccaggagcagaagtcctcctggcaagcccgtggaagtttccaactggtgattgcatccattaggtgcaatccaatttttgcgatggtgacgaaaccaagtagaagatggtaccctaacaagttatattatttccttttcttatcctgcttagatccaaggatgtgatggtctgaaccctaacggtctcctgctatcttgatttgacgtctgggagacgcttgattccgtaccatatgcctgtgggttcaaagcgttaaaacttgactttgctagtgtgctcccaatgatataacccaatcctgggtaaacaaacgcatggggatgaattttggatgaaaaaaaaaaaaaaaaatgtgtg

SEQ ID NO: 17654 - DNA, 2187 bp, Zea mays
ttttttttttttttttttttttttttttcaaaagatcgtcataaaaaagttgaaagtattaaaaagacagtccaggtattcatgcttttaaaaaaatattgctcaaccaagaaaccagccctctcacaccggggcgtatcgtatgcctgtgctaccactcttggtcatgaccttgaagctatccgcggtaaaggtaaagcccccatgctcatcaccaggctctgcagtcacctgcctctccagaacagagtacgcacagtactccacgtcgtagatctctagtcccatctcaaagtaggaaatggatgcaccaacgccctcaccgtgtgttactaatagcaggttttcatgaggatatttgtcagcaagagctttgattatgcttgcgtatctgcttcttgcctccatgatggattcctcccactttggtagctccgggtagattggttctgcagaatggtcgatggttccagccgggaagtcggcttcaagctctggcaagtcaggaaaccacttgctgacgttgggagccagcttgctaacagtaatgcccattgcttgggtgttcatcatctcagacaatccatactcgatagacaccagattagatgagagatcaggttgttgtcatcgtacaacttggaccacagcatgagtcctccgtacttggtggtgttcttattggcgtaggggtcgcagtggcccgcgaggttcagctgccccgagccgaagctgctgataagcgccctggggggtgcctgttttttcggttgtttttttttttttttttggtttaacgttatccgttacccattacgttacaaatatgtgaaccaaacggcacccaagtgctgaaggcgggagggagactctcttaatccccccacagcttctcagcacaggctgctcaaatacttaacaatgtcatcatcatctactactcggtacgctctcaactcaactcaactcagtctcagcaaactaaaccctcgtcatctggtccgtctggagccgccgcagctcgaccacgacgacgctgatgttgtccctgctgccgcgggacaaggccagctccgcgagcagcgcggcggcgtccgcggcggtgcggccggccacggacccggggaacctggaggccgcgcgcccgctcaggcagctcctggcgatcttgcacgccgcctcgttggagaccacgtcccacagcccgtcgctggccaggatgaggaactcgtcccgctccgtccgctccaccaccgtcacctccggctccgcgctcacgtacggcttcaggtagtagtcgccgatggacctggaggttgccaggactcccagcacgcggtagccgttccagttgacgactctgccgccggctgcttccaccctctgcatctcgtccggacggtccggcttgtgatcgctggagagcggcaccgcgacgccgccgcgtgagagcacggcgcgggagtcgccgcagttgccgacgacgatgcggcgccggcccacgacggcgacgacggcggtggacccgacggtgcggtagggcaagctgctgccggcgtcgtcatggtgcggggacgacaagccgccggtcacctcgccgtccactcgggcgaagctggccgccatggcctcctcccagcgcaggtcgtcgctgccgctgcggcggcggcgcaggccgacctcctcggccagcaccacgtgcatccgctcccggcacgcctccgccacccttgcaccgccgtggccatcgtacacggcgaagaagtccagctcctgctcctgctcgccgcccaccgcctccgaggccaggaacgagagcgcgacggcgaacgcgtcctccatctccctccgccgcccgatcaccgacacggcgccatgcgataggcgcgccggccagcagcagccgtccgtcgccgtctccagagacgagtcgtacggcgacctctgcgaccccgaccggattctcttcgtcggagcaggcccctccgtggcacgcccgagccggcggcggcggcgggcggaggcggcgcccacatccccgcccccgtccgccgcagcggccttgcacaaggcggggccctcgtccctggcggcgccgttctccctcatgtatccgtcccgtccacactcgcaaagcgacggcgaagaaactttttgattaggatgttctaggtaatggtctcgtgc

SEQ ID NO: 17655 - DNA, 1459 bp, Zea mays
  misc_feature (508)..(508): n is a, c, g, or t
tgttatagatggactcaatgctcacataaatacaaaagaagaaaaaaaaaggaaaaacacattataaatttaccatcagcttatgcataagaactaaaaacatttataagagaaaaaatagattatatattaatcacaaatcattaaaaagtaactactacgtatataaataagctgagaaattatccgcaaaaaaaaaaaaattatacagtcagcgccagcggtaggcgagcgagcgagcgcggtgtccacagggccagcaacagtaggccccagtgcccccacccgctccagatccacagccgtcggccgtcgcggcgtggtggataaaaaaccctgcgcgcgcgcatgtggacatgtggtcggggagacggggactcggggtagcgactagcgagccgaggagcgcgcgcgcgcgatggcggccgctgccgtggcgaccgtggcctccccatcccccgctgcctccaaggcgtatgctcccctccgccgcaccgtctttcctccnggctcccgaaggccgaccaagccaggctccaggcgcgccacagcaaggtcgccgcggcggggggagaggcggacgtgctgcctggtccgggggccgagggtgaggcggcggttccggggaggctggaggagcagcgggacgagccgctggcgggaagccagctcgacatcggagggctcgccttccagggcgacgtcggcgggggcttcaccggcggcggagcgggctccggggcctccggcggtggcggcgacggcaacaagatgctggaccggggcatcaatacggccatcgttctcgcggccagcacctacgcgctcaccaagctgctcaccgtcgaccaggactactggcacgtgagtctactcgctactcggtttcattcccgactgtattaggagccatgtaccgggtgtcgtattgatttgattttttggtatgcaggggtggacgatcttcgagatcctgcgctatatgccggagcacaactggtccgcgtacgaggaggccctcaaagctaacccggttctagccaagatgatgatcagtggtgtcgtctactcccttggtgactggattgcacaggtgctttcacacttcaatttccaaatccacgctacttctttaccactactcgcaagtcatatgtccggtcatgttgcagcatttagtgtgattactgattactgactgccgttgtttttgctgctgctgctgctgcttttgcagtgctacgaaggcaagccaatctttgatttcgaccgtgctcggatgttccggtctggtcttgttgggttcactcttcatgggtcactttcacattactactaccatatctgtgaggtaactattgttacatgacctgctcagatattttttgcttgtacattctagtaaaaattgtctatttcagccacaccaaaagttaagaaaattcttaagttaatgaat

SEQ ID NO: 17656 - DNA, 1136 bp, Zea mays
aagagaggcgggacgagcgtcagtgcagtgcgcgtgtggtcgggtagcgatccgaggagcgcgcagcgatggcggcggcggccgtggtgcccgggaggctggaggagcagcgggacgagcagctgggcggaagccagctcgacatcggagggctcgccttccagggcgacgtgggcgggggcttcaccggcggcggtgcgggctccggggcctccggcggtggcggcggcaacaagatgctggaccggggcatcaacacggccatcgtgctcggggccagcacctacgctctcaccaagctgctcaccgtcgaccaggactactggcatgggtggacgatcttcgagatcctgcgctatatgccggagcacaactggtccgcatacgaggaggccctcaaagccaacccggttctagccaagatgatgatcagcggtgtcgtctactcccttggtgactggattgcacagtgctacgaaggcaagccgatatttgatttcgcccgtgctaggatgttccggtctggccttgttggtttcacgcttcatgggtcactttcacattactactaccatatatgcgaggcactgttcccattcaaagacttctatgggtcgactgtgtggagcttgtctgggtcacaatactgtcgacttattcaaacgaaaagtcagaggcaaggaattctgatagtacctccacaccagcggcttcaaaggacaactccacatagcaaccccaaagatcttggaaagttgcttcgcccttccctcacttcaggggttatgtaaattgtacagttagctgcagcaactatgcaggtgtaaccttttttttttgtagctatatattcatgaaacatgaactgtgcagcatgtgctatagaataccatgaagaaattagcgtgctccgttcgtcccccaaataagtataagtatgtttctagttttcaaaatttgtaacacgacaagtgcatttctaggccatagaccaaataggacctaccttttgctattttcctcccattcctgattcctaacatgcaatttgtgacatgttattttatgtttataggaatatatatatttttatagggatataagtaatttaatatagacactgattcctttccttg

SEQ ID NO: 17657 - DNA, 5009 bp, Zea mays
  misc_feature (4740)..(4740): n is a, c, g, or t
  misc_feature (4742)..(4742): n is a, c, g, or t
ggccttcaattcacgatccgattccctccacctcacgacgaacatgcatatgcagctgcagttgcattgcattcaactgatcgctgagcgccacccggcccattgaccaggacctcctcccatccgcccagctagcgccatttctttgctagccacgccattccactctccgtctcctttccgctgctgcttcgcactgccgggtgccggcggcgggtgtgtggcacgtcggtcatgggcagctgcgtgagcaagaaagccgcccgcgccggcgccaagggtgaggtggctgccccgctgccggtcgtggagaaggagaacgcccatgccctgccaccggtgctggaggtggaggtcgaggaggaggaggtcaaggaggtggtgctgtcggagacgccggtgccgcggccgcccaggctgctgccgccgctgccggagccggcgaagaggcggcaagagcaggcggaggccgttgatgatgaggcggcggcggtgtcggcgtcagagacatgcagcgccagcgacagcgctgcgtcggctgctgcgaagggagccaaggcggccggaggggagcgggaggtggagaagagggcgctgctggacgcgccggagaaagggaagcctacggcccggaggacgacgccggagccggaggagagccgcaagcccaagggagcgggcgcgggcgcgggcgccgttaacgggcacgtgcgggcgcggtctccgtcaccctcgtcggcgcacaggaggcagcagagcggcggccagggccagggccagggccaccagcaccatccggcgcggcgggaacatccggcggtggtgtcgggcatcgggtgccgcagcggccggttctcgccgtccgcggcgaggcgcgccgccgagagcgccgtccggcggacgcactcggccagggaggccgacatggcgcttccgtcgtcgaagcggtccctttccctcagtgccttcgccatcaacggcaacggccacggccacggggcaggcgtcgcgctctccgggcgggagcgggggcgggaccctggcgagcggtccggccggcggtcggtctccccggcgacgcgtaggcgcgcgcccgcctctcccagtcccagcgcggtccaccggcccgcgagccccgtgcgcaaggcggcggcgaaggagcacggcacccccgagcgaggcagcaggccggcgcgggtcatcagagacggcgggcccgacgctgagcgggcggcgttgctgggcggaggagtaggagcggagcagaggacgaagctggcggagggcgaggaaggcgcgctgggccaccagaacccctcggtggccatggagtgcttcatcttcctctagaggctagagctggtgtggtgctgctggtggcctcagtttctcctccacgtttttgttcgtctctcgcaaattcgctagcttcgttgcttgctcagtaacgtgttggaccattcacattactatcgtgccatccgtgcatcatcgaccgagatggccgtgcagtgcatgcatggccttgtcgccgccgttctcggacgggcatttatttccggcggcggcgggtcggagctccactccgtgactgccacagtgcgttgttgttgttgtttgtagcgctgtctagttgtacgaccgttccgttctgacgtacggcaaccgaccggccgtcgagcagtaacagtactgatgtctagctatcgtccaggttggttcagggtaggtaggcgcgcgttactgcacctgcatgactggactgactggctggtgctcagtgcaacgtcgggggtagatagatctatggctgaagacgagtacaccacaacgttctcattggattttgtggcaaaactttgtagctgcattgcatatacaggctacatccaggtccaacaggctccctccggttttcatgggaccactttaacactgggccttcttgtttgggctaggcccgatgctgccggggccgccaagtctggactggattctggagcctgcttctactatctcgccccgatcgccgttgctagccctgtttttaggcttcaattttgagtgaattttgacgtggccgcgttttctaccactatttctccgtgatcgagcgagcagacaggcaggacatgacggcgtagacgtactcagcgagatgtcgtccacaagtcacgaatcggcgagcacaggacgtgtggaccacgggcagccggctcggtcgcgggtgtggtgcacggaacgggtgcggcccccgccgccgccgagtctgagccgtggccgttccagagcccgaccgctggttccggtcgatcgcgccttcaggaatcaggagtactagccttcacggttcgacgggttctgtttgtttctagtactgtatacctagtactagtctgtcgtgtgcggagatggtttttgacacgcaagggtgttccggatctgaactcgccgcgccttctccgcagtccgcatcgtggttgacgcccgtggtttggattgaaggatctctgtagaaatttctagagtatgccgttcctacggaagcgagtgcgtttgggacaggtgaaaccatattttctttcttccgacctcacgagtcggcgagaggatttctctcgctaaggacaaagttacgagtactcatgcttactagagaaaaaaatatatgtctatttgtacctattatggatattaaattgcttcatactcataacccactataggtagcaggtatccctataccaccaacattttatatgaacattttaatcacaaaagtaagttctaaatacaaaatatcgaaacaccatatctcatcaagtactaaaatagtgtattatcattgtattcaacatgttaaattcatcgaaccaatacaattttaccataagttcagcatcatcatttaaattaaatagtagcatcatgacctcatatcacacaaaatatagcctaaaaagagagttcttaactacatcatacaatattagaatatttatttttttttgaagtatacaatacttaatatctctactacctatattaagcacgtagtgcagaccacatgcgcgcacatcgttccccttgcctagccttccgccccaacatgcgctaccatgcctccaccctttgactgtcgacgccccctgcccctgcccgcgccgcacattccacgtgatgatcgtcacagtagacaccgtctcgaccgtgatcttcgccggcaatcgtgccccatagatatgtgtatgggtaagctgctataataatattaaatttgtcattttttttatcaggctaccgagattacccaacaagatgccaaaagtgtgacgtgaaacttcccattcgccatttggcattctaagacttgtgggagtataatccaatagatagttgtgctacaatctagtttgacaactctgttttctcaataagaatgaactagtttttcttaataaaataatttttttttggaaattgatgttcttaaactagccctaaacactgttattagtaaaatttgaattacgtgatgcatttaaagtaattacttagataatttttatttcctttgcaataattgtctgagtaatatttttttgtgggttgctggcatgagtaccacgagcggccgccttgttcagtggaatcttgcttactggcccacagccgcctgagacaagcggctcaaatctcaccctcccaccacatccaccggccggcaccctccccacctcgatcctcttccgcgagacggcaaaccgatcggtggaacggaacctccctcagtctcaaggcgagcgagcaagcgcggctcacgtccacagggccagcgacagtaggctgtaggccccgcccgctccagatccataggcagccgcgcgcgatcgcggcgtggtggataaaagcgtgcgcgctgcgccgctgccacgaggtaagagaggcgggacgagcgtcagtgcagtgcgcgtgtggtcgggtagcgatccgaggagcgcgcagcgatggcggcggcggccgtggcgactgtggccaccccatcccccgcctccaggcggctgttcccctccgccggcccgtctcttctccggctcccaaggccgaccacgcggctcaggcgcgccctgcggttcgccgctgcgggggatgaagcggacgtgctgcctggcccgggggccgagggggaggccgtggtgcccgggaggctggaggagcagcgggacgagcagctgggcggaagccagctcgacatcggagggctcgccttccagggcgacgtgggcgggggcttcaccggcggcggagcgggctccggggcctccggcggtggcggcggcaacaagatgctggaccggggcatcaacacggccatcgtgctcggggccagcacctacgctctcaccaagctgctcaccgtcgaccaggactactggcatgggtggacgatcttcgagatcctgcgctatatgccggagcacaactggtccgcatacgaggaggccctcaaagccaacccggttctagccaagatgatgatcagcggtgtcgtctactcccttggtgactggattgcacagtgctacgaaggcaagccgatatttgatttcgatcctgcgctaggatgttccggtctggcactactggtccgcatacgaggaggccctcaaagccaacccggttctagccaagatgatgatcagcggtgtcgtctactcccttggtgactggattgcacangngccttcacacttcaattccacagccactctaccactattcaataagacaagcattagtgtgattactgactgccgttgttttttgttgcttatgcttgcagtgctacgaaggcaagccgatatttgatttcgaccgtgctaggatgttccggtctggccttgttgggttcacgcttcatgggtcactttcacattactactaccatatatgcgaggtaaccattgctacatgatctgctcagccttgtttttgtacattcaagtcaa

SEQ ID NO: 17658 - DNA, 1417 bp, Zea mays
gcacgagaccattacctagaacatcctaatcgaaatgtggtcggggagacggggactcggggtagcgactagcgagccgaggagcgcgcgcgcgcgatggcggccgctgccgtggcgaccgtggcctccccatcccccgctgcctccaggcgtatgctcccctccgccgcaccgtctttcctccggctcccgaggccgaccagccggctccggcgcgccacgcaggtcgccgcggcggggggagaggcggacgtgctgcctggtccgggggccgagggtgaggcggcggttccggggaggctggaggagcagcgggacgagccgctggcgggaagccagctcgacatcggagggctcgccttccagggcgacgtcggcgggggcttcaccggcggcggagcgggctccggggcctccggcggtggcggcgacggcaacaagatgctggaccggggcatcaatacggccatcgttctcgcggccagcacctacgcgctcaccaagctgctcaccgtcgaccaggactactggcacgggtggacgatcttcgagatcctgcgctatatgccggagcacaactggtccgcgtacgaggaggccctcaaagctaacccggttctagccaagatgatgatcagtggtgtcgtctactcccttggtgactggattgcacagtgctacgaaggcaagccaatctttgatttcgaccgtgctcggatgttccggtctggtcttgttgggttcacgcttcatgggtcactttcacattactactaccatatctgtgaggcactattcccattcaaggattggtgggttgtccctgcaaaggttgcattcgatcagaccgtttggtctgcaatctggaacagtatctacttcgtggtcttaggtttccttcggttggaatcacctaccactatctacagtgaactcaagtctacattctggcccatgcttaccgctggatggaagttgtggccttttgcacacttaattacatatggtgtggttcctgttgagcaaagacttctatgggtcgactgtgtggagcttgtctgggtcacaatattgtcgacgtactcaaacgaaaagtcagaggcaaggaattctgatagcacctccacaccagatgcttcaaaggacaactccagatagcagccctagagaccttggagagctgattcgcccttccatcgcttcaggggttatgtaaattgtacaattagccgcagcaactctgcaggtgtaaccctttttttggtagatatgtatatattcatgaaacatcaattgtgtagtatgtgccatagaatattacgaagaaagtagcgaacttcattcgtccgttctaaaataagtatatttctagcattcaaaatcaaaaaaaaaaaaaaaactcgcgatctagaactag

SEQ ID NO: 17659 - DNA, 1541 bp, Zea mays
tcggccgggaagagtcgccgcgcgggcgtcagtgcagtgcgcgtgtggtcgggtagcgatccgaggagcgcgcagcgatggcggcggcggccgtggcgactgtggcctccccatcccccacctccaggcggctgttcccctccgccggcccgtctcttctccggctcccaaggtcgaccgcgcggctcaggcgcgccctgcggttcgccgctgcgggggatgaagcggacgtgctgcctggcccgggggccgagggggaggccgtggtgcccgggaggctggaggagcagcgggacgagcagctgggcggaagccagctcgacatcggagggctcgccttccagggcgacgtgggcgggggcttcaccggcggcggagcgggctccggggcctccggcggtggcggcggcaacaagatgctggaccggggcatcaacacggccatcgtgctcggggccagcacctacgctctcaccaagctgctcaccgtcgaccaggactactggcatgggtggacgatcttcgagatcctgcgctatatgccggagcacaactggtccgcatacgaggaggccctcaaagccaacccggttctagccaagatgatgatcagcggtgtcgtctactcccttggtgactggattgcacagtgctacgaaggcaagccgatatttgatttcgaccgtgctaggatgttccggtctggccttgttgggttcacgcttcatgggtcactttcacattactactaccatatatgcgaggcactgttcccattcaaggattggtgggttgtccctgcaaaggttgcattcgatcagaccatctggtctgcgatctggaacagtatctactttgtggtcttgggtttccttcggttggaatcacctaccactatctacaacgagctcaagtccacattctggcccatgcttaccgctggatggaagttgtggccttttgcgcacttagttacatatggtgtggttcctgttgagcaaagacttctatgggtcgactgtgtggagcttgtctgggtcacaatactgtcgacttattcaaacgaaaagtcagaggcaaggaattctgatagtacctccacaccagcggcttcaaaggacaactccacatagcaaccccaaagatcttggaaagttgcttcgcccttccctcacttcaggggttatgtaaattgtacagttagctgcagcaactatgcaggtgtaacctttttttttgtagctatatattcatgaaacatgaactgtgcagcatgtgctatagaataccatgaagaaattagcgtgctccgttcgtcccccaaataagtataagtatgtttctagttttcaaaatttgtaacacgacaagtgcatttctaggccatacaccaaatagtgaaataggaccagtaccttttgctattttcctcccattcctgattcctaacatgcaatttgtgacatgttattttatgtttataggaatatatattttttatagggatataagtaatttaatatagacactggatcctttcc

SEQ ID NO: 17660 - DNA, 2362 bp, Zea mays
gccggccgggttcgaagtcgtagccgtttcatccactttctagtttcctttctcctcctccagccctccttaaaaaatcggccacggttatttatttctctcgccccggtccggccttcccgggtaatctgcgagctggggggagatcgagaccctagaacggagggcgggtgtgcggcgctgagggccttagacgaatggcggtggaggagaccgcggagagctgcggcagccacgccgcgaccgctgcgtccggcggcggcgcggcggggcccgcgacgtcctcgtcatcggccgccgcggcggcgcaggcgcggaagcagcaacagcagcagcgccataagctcgaggtgtacacggaggttcttcggcgcctccacgacgccggcctgcccgacgcgcgggcgcccgggttcgacgacgagctctggaatcacttcaaccgcctccctgcccgctacgccatggatgtgaacgtggagagggcggaggacgtgctcacgcacaagcggctcctggagcaggccaaggatccggctcatcgcccggctttcgcggtgcggtccgtgcaggtatctccaattcttgatgggaatcagactgattctgattcgaacactgcaggggaggaagtcgcttcaagactgttgaacaggcagcaaagcatatatcctcctcctgccttcggttcttctacaaatcttgaggcccttgctcttgaagctagcaagtctcatgatcacgatagcacttctgataatggccgatctctatacaggcccatgcatgaaatcaccttttcaaccattgacaagccaaaacttctcagtgagctgacatctctgcttggtgagcttggtctaaacattcaagaagcacatgcattttcaacaaatgatggctactcacttgatgtcttcgttgttgtcggttggcatgatgaggaaacagaggatttagtagaagcagtgcagaaggaaattggcaggattgaagagacacaagcatggtcttcatctcattcatggtctactccagttgaaaaaatgcagattgctgagaattcagcagctgaccgtgttgagataccaacagatggtgctagtgaatgggaaattgatgtaaagcttctcaagtttgggaataaagtagcatcaggatcatatggtgacctttaccggggtacatattgcagtcaagatgttgctattaaagtgctgaaacctgagagaataaatgcagacatgcaacgagaatttgctcaggaagtatatattatgaggaaggtccgtcacaagaatgttgtgcaatttattggggcttgcactaaacccccaaacctatgtatagtcacagaatttatgtccggtggaagtgtgtatgattacctccataaacataaaggtgttttcaaacttcctgctttagttggagttgcaacggatgtgtcaaaaggcatgagctacttacaccagaataatattattcatcgtgatttgaaaactgcaaaccttctgatggatgaaaatgggactgttaaagttgctgattttggtgttgcacgtgttaaagctcaatctggagttatgactgcagaaactggtacttaccgttggatggccccagaggtcattgagcacaaaccctatgatcacaaggctgatgtttttagttttggaattttgatgtgggaactactcacagggaagattccttatgagtacctgactccactacaagccgctgttggtgtggtgcagaagggattacggcctacaattccaaagcatactcacgcaaagctttccgagcttcttcagaaatgctggcagcaggaccctacccaaagaccagacttctccgaaatattagaaactcttcagagaatagcagaggaggtcggagaggagcacgatgggaagcacaaggacagaacactgggtggtttcttttcggctttgagggggcggagccattgagacacagttgaagacttttaataataaaaatgtatgtacatggcctcggtccgtcctttgaaggacctgagctacaaccagtgcagtgcctgttcctcgcacgtcagcaccagtacacagaaatacagacctgctgtgcagctgcagttgactgaagcggcaatttttatttagctgcagccatcgctttccgcatatccgcttgttattcctgagttccattacgcaatgtataacataggtgaggaagcttgggaactgtatcatcagtctgatttccctgaaagtgcaatcctgctgtagatgaaaaaaataataataagccagattcaggccgtggcgtgattcttttaagacgcaaaaaaaaaaaaggccccgcggcc

SEQ ID NO: 17661 - DNA, 2439 bp, Zea mays
ctttttcgctccgctttctcaatcactgggcctgggggagatcgagacctagagcggaggacgggtgggcggcgctgagggccttaggcgaatggcggtagaggaggccgcggagagctgcggcagccacgccgcggccgctgcgtccggcggcggcgcggcggagctcgctacgtcctcgtcatcggccgccgcggcggtgcaggcgcggaagcagcagcagcagcagcgccataagctcgaggtgtacacagaggttctccggcgcctccacgacgccggcctgcccgacgcgcgggcgcccgggttcgacgacgagctctggaaccacttcaaccgcctccccgcccgatacgccatggatgtgaacgtggagagggcggaggacgtgctcacgcacaagcggcttctggagcaggccaaggatccggctcagcgcccggctttcgcggtgcgggccgtgcaggtatctccaattcttgatgggaatcagactgatgctgattcgaatactgcaggggaggaagtcgcttcaagactgttgaacaggcagcagagcatacatcctcctcctgcctttggttcttctacaaatcttgaggcccttgctcttgaagctagcaagtctcatcaagatcacgatagcacctctgataattgtcgatccctgtacaggcccatgcatgaaatcaccttttcaaccattgacaagccaaaacttctcagtgagctgacatctctgcttggtgagcttggtctcaacattcaagaagcacatgcattttcaacaaatgatggctactcacttgatgtatttgttgttgttggttggcatgatgaggaaacagaggatttagtagaagcagtgcagaaggaaattggctgcggcgcggggacacaagcatggtcttcatctcattcatggtctactccagttgaaaacatgcagattgctgagatttcagcagctggccgtgttgagataccaacagatggtgctagtgaatgggaaattgatgtaaaactgctcaagtttgggaataaagtagcatcaggatcatatggtgatctttaccggggtacatattgcagtcaagatgttgctattaaagtgctgaaacctgagagaataaatgcagacatgcagcgtgaatttgcccaggaagtatatatcatgaggaaggtacgtcacaagaatgttgtgcaatttattggtgcttccactaaacccccaaatctatatatagtgacagaatttatgtccggtggaagtgtgtatgattacctccataaacataaaggtgttttcaaacttcctactttagttggagttgctatggatgtgtcaaaaggcatgagctacttacaccagaataatattattcatcgtgatttgaaaactgcgaaccttctgatggatgacaatgggactgttaaagttgctgattttggtgtcgcacgtgttaaagctcaatctggagtcatgactgcagaaactggtacttaccgttggatggccccagaggtcatagagcataaaccctatgatcacaaggctgatgtttttagttttggaattttgatgtgggagctactcacagggaagattccttatgagtatctgactccactacaagcagctgttggcgtggtgcagaagggattacggcctacaattccgaaacatacttatgcaatgctttctgagcttcttcagaaatgttggcagcaagaccccgctcaaagaccagacttttccgaaatattagaaactcttcagagaatagcagaggaagtcggagacgagcacgaggggaagcacaaggacagaacactgggtggtttcttttcagctctgagggggcggagccattgagacacggttgaagacttgaaatgtacatggcctcggtccatcctggaaggatctgaactacaaccagctcctgttccccgcacatagcgacagtacacagaaatacgcagacatgctgcagccggagttgactaagtggcaattttttagcggcagccatcgcttttcgcctatctgcttgttactcctgagttccatcacaatgagaggaagcttgggaactgtgcatcataaccagtctgatttctctaacagagtctaatcttgctgtagatgaaaataataagccagatccaggccgtggcatgattcttttaaggttccatcttttagcatattttcttctacgtgccgtcattcttttctggacatgctccacccctctgttgtggaacaacgcggcaagcttgagttagctgagcaaggcacctgcatctgcatgggatctgctcggaacaaagttgggttatcttgtgctaagcttttgttccccagtttccgtgactacaaatgatatcaatttattttaaagaaatggaaaaaaaaaaaaggcccctagggcc

SEQ ID NO: 17662 - DNA, 3694 bp, Zea mays
  misc_feature (3694)..(3694): n is a, c, g, or t
atgtgggctgggcctaagcccattataacagtaactcacacatgcctcccccccccccccgaactgcaagtggttagggtgtggagggcgcggacatcaccgatggcgactcacccgccgacgaagtggaggtcgatctccacgtgctttgtgtgctggtgctgcacggggttggcggagtggtagactactgtgatgttgtcgcagtaaacgagggtggttcgcgcgagaggttgttgagctcctggagcagttgacgaagccaggacgcctcggccatgccgttggccacaacacgatacttggccttagcgttgtagtgggatacgacgggctgccgcttcgaggaccaggagatgaggttggcgcccaggaacatagcgtagccaaaggtgtattggcgcatgtcagggcagttgacccaatcagcgactcagcgtcggtgtagacgaccaactcagaagtcggcgagggtcgaagaaagccgtagtcaagggtgccacgaaggtagcgaagaatctgctttgcagcggtgaggtggggctctgcggggtgtgcatgtaaaggcacacatgctggaccgtgtaggcgatgtcggcccgggtgaaggtgaggtactatagagccccgacgaggctctggtgtaggccgttgcattgcaagccggggtgccgtcatcgttggataccttcggttgagtgtcaacatgcgtgagcatggcttgcagttggacatgccagctcgctccagaatgttgactacgtgctggtgatggaagaggcctggggcggtgctccacggtgaccctgaggaagtggtggagagacctaggtccttcatcgcgaactcgcgctgctgggcagtgcgctggaggcctggagcaggatggggatgcaggtcttgtggagggcaaatttcattatcaccaatgcaatttactctatattcttggtcttggcatgtccaatacacttggtagcatacacttaagttagtgaaacattgctatttatggtagttcttttactgcagcatttaacgacattctgggtcatgaagtatcatttggttggcagcatatgatcagaagtcactcataattactgtgttaacgccttacagtcatggcaaattattccttcaagttctatttgttcatctttctacatataaaccaaatctctgctgcaattagatcttatagtgatttgcattttatcttatggtgctgtattgttttcatatttcgattttgttggtgcaaatgcttctcccattgcattgtacaataatcaatcatggtttccatttttttatttgttattttaggctgcccttggtggatctgttggcaatcttcagaagatccgagcatttcttcgggttggttttgaattgatgctattttgttccattcttgttgcttttgcactattatttatgctccaatgcatgctttgtccacatgacctgacaggtaaggctgcgggatcaaggtgtgctagactttgacgcaaccgatctacgcagacagcctccagtggatacaacctggcagcaggttatttttttgttcacttctatcgctgaaaataactctatttaacatcagtgtttccatctgttaatcccatgttgaaattgtagctagctatctgttagttcagctgcaactgcagctttatgtgaaatgacagctgtagtcattgggttatttctagacttattgaaaattgtgagttctttctaataatgacctatgattaggtttattacctttcctgaattaaccttcgaatagcaaaactatgtttttactgttcaatttggtagaacttagtaatttgaattgttgcccacttatctttgaagcttcacttattgcacacctgcagatttacttctgcttgagaaccagatactatgatgaagcaagacaagttgcccaatcatctcgtactgcatataacttcgctcccctggtaaactttccatggtcataaattcatgatggacccttcttattcagaacaagagactcagcgataaatatattttttttcacagcttgcagattggatttctactaatggtgctgtatcaccagagactgctctggcagcttctgaggaatgtgataaaatgctcagaatgggtgatcggccagggcgtcctggctacgacaggaagaagttactgctttatgccataatttgtggttgtcggcggcaaattgaaagaatgctaaaagacctaccaacactttttaacactatagaggatttcttgtggtttaagctgtcagctctgcgggaatacaccaatgcatcttcttcctatcttatgaatgaaggcttggtgccttatacgctggatgacctgcaaagttacttgaataaatttgagccatcatattatacaaagaatggaaaagatcccctagtctatccctacattctgttcttaagcatccaattactcccagcaattctttatttgtctaaagaagttggagaggatggataccatgttgatgctgtgcatatttcaattgctttagctgaccatagtgttctccctgacggtattgggtcaggccagaaaattggcgtcatggatgcctgtgcagaggctgcaagcataatacgacagtatggctctatatacttgcgtaatggtaacattgatctagccttggagtattatgcacaagctgctgctgccatgggtggaggtgaggcatcgtggattggtgaagggcatgctgataagcagcgacaacgaagtttgatgttgaagcaactactgatggagatattgctaagggatggtggtattcaacttttgcttggtccaagtggaatgggagaagaaggagagctgaaaaagtatatgatggattggagaagtaggcagcaattcttacttgaagctgcccatcggtgtcaagaggctgggctctatgacaaagctgtggaaattcacaaaagagtaggagcctttgccatggctcttcagacaataaacaagtgcttgtctgatgcagtctgtgccatggcacggagtatgttagatggcgagagtcgtgctgctgccctaattcattctggcaatgaaattttggagacagctagatactcttctgaagccagcattcaagagaaggacctcatttctgagcaacaaactgtgctgagacagcttgaagctattctccatatttataggctagctcgagctgggcaaactgtagatgctttgagggaaaccatcaggctacccttccttcatttggaccccaaggctccaaatgtgactgttgacattttcaggaacttgtcaccccatgttcaagcttgcgtgccagatctcctgaaggttgctctaaattgcattgacaatgttagagatactgatgggaccttgcgcgctgtcaaatcaaagatcgcaaaccttgtagcaagcaacatgagccggaattggccacaggatttgtatcagaaggtggcacagtgcatatgaagtggcttgtgttttgagttgatcaggaatctggactaatctgtatcagaactctgaagctttcaaacaatatggttgtcatcccatcctgtgtttaatgtgtgtcaaatgtaagatgtttattttttaaaaaagaaatttccactgatatcaaaaaaaaaaaaatatattn

SEQ ID NO: 17663 - DNA, 1092 bp, Zea mays
ctcttggtgctgcttcctggtgggggaagggaaggagaaggctgtgctgtgcgtcctgcgccgataacgcgatggtgtccattgtcaccgaggtatgggcgctcgctggatgcggcccggcgtccaaggcggcggcggtagcggcgcaggagttgccggcgcagcatccttctcctgccgcagcgggagcgggaggagggaaggccaagaagagagccgtgccagtgtcgttcagaggcgtcagcagcggcggtggccaggaccaccagcgtgaggccgccgccgccgtcgtcgtcgggcggcggcgcggcctcgcgtcgtgcgcgctcgccgccgtcgccgcctcgttctccgcccgcgctggccgccccgcgcgggcgcttgtcctcgaggaagacgacgacatcgagctgctggagcgcgtgaaggaggacaggaagaagcggctgcagaagcagggcatcatcagctcctccggcgccgagaccgggtatttgcaggacctcatctacaggctcagcaaagtcgggcaggccattgacaacgacgacctcccagccgcgagcagcgtgctgggaccaagctcagacgcccagtgggtgcagaacatcaatgcagctttctccaagctcagctcaagcccggagcagaggaacgtggtcgacagcttcaacagctcgctggccacactgtttacatcagtgagcaagctcgaccctgaatcctccaagtcggcgttcgtgtcgtccgcgacggcgttggagaaatggatcgcgttagctggactgggcggccagctcaagggctactgatgcgtgcgaggggaagagaagcactgggttgttctatgtttgggtccggcatttgtgaatctcctgaagagggtaccgtgaccgagaactgagttcagataggcatgctatgctcatcaagaaactgtgactgtttttgagactctgctgttacttacaagtggtaggaaacgaagttgtcttgtatcttgttgtccagtttaactttcgaaattccaaagcagctggtgtttatttttcttttaaaaaacaaaaaaaaaaaaaaaaaaaaaaactcttc

SEQ ID NO: 17664 - DNA, 1145 bp, Zea mays
agttcggataagggggggactctttcgttgggccagcgctgcatgcttccttgcttgcttttttgtcgcgcctgcttctcccccctcctgcctcttcgtgctgcttcctggttggggaagggaaggagaaggagaaggctgtgtgcgtcctgcgccgataacgcgatggtgtccattgtcaccgaggtatgggcgctcgctggatgcggcccagcgtccaaggcggcggcggtagcggtagcggcgcaggagttgccggcgcagcatccttctcctgccgcagcgggaggagggaaggccaagaagagagccgtgccagtgtcgttcagaggcgtcagcagcggcggtggccaggaccaccagcgtgaggccgccgccgtcgtcgtcgggcggcggcgcggcctcgcgtcgtgcgcgctcgccgccgtcgccgcctcgttctccgcccgcgctggccgccccgcgcgggcgcttgtcctcgaggaagacgacgacatcgagctgttggagcgcgtgaaggaggacaggaagaagcggctgcagaagcagggcatcatcagctcctccggcgccgagaccgggtatttgcaggacctcatctacaggctcagcaaagtcgggcaggccattgacaacgacgacctcccagccgcgagcagcgtgctgggaccaagctcagacgcccagtgggtgcagaacatcaatgcagctttctccaagctcagctcaagcccggagcagaggaacgtggttcgacagcttcaacagctcgctggcccccctgtttacatcagtgagcaagctcgaccctgaatcctccaagtcggcgttcgtgtcgtccccgacggcgttggaaaaatggatcgcgttaactggactgggcggccagctcaagggctacttatgcgtgcgaggggaaaaaaaaccctgggttgttttatgtttggatccggcctttgtgaatctccttaaaagggtaccgtggcccagaactgagttcagataggcatgctatgctcccccaaaaactgtgactgtttttgagactctgctgttacttccaagtggtaggaaacgaagttgtcttgtatcttgttgtccagtttaactttcgaaattccaaaacagctggtgttttttttaag

SEQ ID NO: 17665 - DNA, 1512 bp, Zea mays
  misc_feature (1501)..(1501): n is a, c, g, or t
  misc_feature (1511)..(1511): n is a, c, g, or t
gagtcttctgtcttctcttccacctttgtccgttgtctctaggcaagtctacacccgccggtctcctgctcttcagatctgcccatcctccatggcacctccaccgcaccgccacctgctgctgctcctccttctactccctctggtcctcctcgccggcacacccgccagcgccgatgaccttgtatcggagctccaatctctccgcgcgcggtccccgtccggcgtgatccacctcaccgacacctccgtcacccgtttcctctccgccccctccgcgcgccgcccctactccgtgctcgtattcttcgacgccgcttcgctccactcaaagcctgacctccacctgccccagctccgcaccgagttcgcgctcctctccgcctccttcctcgctcacaaccccgattccggcgacctcttcttcgccgacatcgagttcgccgagtcgcagcactcctttcaccagtttggtgtcaactcgctgccccatatccgcctcatccgttccgatcacgccaccctgtcgggatccgagcagatggaccagtcccacttcgcgcgcctcgccgactccatggccgagtttatcgagtcccgcacgggcctcgaggtcgggcccatcgtacgcccgccgctcctctcccgcaaccagatcatcctgctcggcatcctcttccttatctccatccccttcatgatcaagaggattatcgatggggagaccctgctgcatgacccccgggtctggatggctggggcgctcttcgtctatttcttcagcgtctcggggggcatgtatgggattatcaggcacacgcccatgttcctcaccgaccgcgcggatcccaacaagctcgtgttcttctaccaggggtcagggatgcagttgggggctgaggggtttactgtcgggttcttgtacacactcgtgggtctcatgatcgctgtggtgacacacttgttggtgaaggtggagagcctgcagacacagcgccttgcgatgctcgctgtcatggtggtcgggtggtgggctgttaggaaggtgatctacttagataactggaagactggctatagcattcataccttcttcccgagcagctggaggtgaaattcttgctgggtggggtggatgcttctctcctttggtctcagaggggaccaagtccgcccaaatttgcattgctggaatagagcatcgcgttgtgatggcatgccgaaagtttaaggttgcagtttctccgctgctgctctagtatgaaatagagagagaactcgaagttattttagctgaatttgcaattctgttactcaacaagaaagagtcccaattttgaacttctatatgtgatggtactgctaattggttcaacgacaatggtagtaaattttagttgatcactgtgttatggacttgtttgtatccagggaaattttgcccgtattgtgataaaaaaaatgccggcctgtcgcatgcagtcgctatcttttataaaanaaaaaaaaana

SEQ ID NO: 17666 - DNA, 4755 bp, Zea mays
ctcatcgatcgtcagctaatataatagcatatatatactccgatctcagaattgaagctcggatccgggcgtcgaccacctatggctggcgctgcaactttctcctccacttccgtcggcgctgctctcgctatgtatgcaggcgagcggcttcctcggcaagaagctcgtcaccagcatcatcatcaggaataagaagaaggggtacgactccctgcatggcgccacgaccaccatcagagtcagagccatggcggtgaacaaggagacggagcaggacaggtggaggggcctggccttggacacctcggacgaccagcaggacatcaccagggggaagggccgcgtggacccgctggtccaggcgcccatgggggacggcacccacgtcgccgggctcagctcctacgactacatcagccaggggctcaggcactacagcttggacaacatgatggatggctactacatcgctcccgcgttcatggacaagctcgttgtccacatcgccaagaacttcatgcccctgccaaacatcaaggtgcccctcatcctgggtatctggggaggcaagggccaagggaagtccttccaatgtgagcttgtcttggccaagatgggaatcaagtaagaattattaatataatatattaagaagctacatgcatgcctagcatacgtacatactgaatagaaatttaataatacttagccccatcgttatgagcgccggcgagctggagagcggcaacgccggcgagcctgcgaagctgatccgccagcgctaccgcgaggcggccgacatgatcaagaagggcaagatgtgcgtgctgttcatcaacgacctggacgccggcgcggggcggatgggcggcacgacgcagtacacggtgaacaaccagatggtgaacgcgacgctgatgaacatcgccgacaaccccaccaacgtgcagctcccggggatgtacaacaaggaggagaacccccgcgtgcccatcatcgtcacgggcaacgacttctcgacgctgtacgcgccgctgatccgcgacgggcgcatggacaagttctactgggctcccacccgcgaggaccgcgtgggcgtgtgcaagggcatcttccgcagcgacggcgtccccgacgaggacgtggtgaggctggtggacgccttcccgggccagtccatcgacttcttcggcgccctccgcgccagggtgtacgacgacgaggtgcggcggtgggtggccgagaccggcgtggagaacatcgccaggaggctcgtcaactccaaggagggcccgcccacgttcgagcagccgaggatgacgctggacaagctcatggagtacgggcgcatgctggtggaggagcaggagaacgtgaagcgcgtgcagctggcagacaagtacctcagcgaggcggcgctgggcgacgcaaacgacgacgacgacttgtatggcaaggcggcgcagcatgtccgcgtgcccgtgccggaggggtgcactgaccccaaggccggcaacttcgaccctaccgccaggagcgacgacggcagctgcgtgtacaactaatataattgtccaaacaatttctgtggcacgtacttaagtttgagccaggatacaaactttggccgctaatggttgctgtcgccggtcaagagggcgttggctacttgagttagattttggttgtgtttcatccccacgtacgtccagcaaagaaaaattgaagctagtgcatgcatggttcgtcatcaaatgcatggccggccggatacaaatttgaactgtagctatcgacgtacgcatgtattaatttatatcagagaagacaaggaacacagatacatacatgtcgaaacaatcattttctatggcacttgagctagctagcatacaattttgttttaaatgaaatgaaactgaagacgatcgatcgaattgaaggttgtggttcgtgagcaatgcaatgcagtttcacagaacgttgccaatgcaacaagccaccaagaaaagagaagtctactcgatcttgcaatgattaggcttggatgatgcgtggggccacgtacgtatggacatcgaagaaccccatcctcagcgtgtggcctgagggtgatggcaaagctgatccacacattgcggccccctttcccccctcagagaccctgacctcccgagcacagccagccaccgcgcaacgccggccaccaccaccaccaccatacctgctagcgctagctctctttatttaacgccgccgtgtgcgtgcctcgacgacctcactactttgagctgcaaggtccgaactaaaaagcacaagaaatggcggccgccttctcctccaccgtcggagctccggtgggtgaccgcgcgtgttaattccaagcatctgctagctgctctgctgctagttcgggatcttcttcttcatgcatgcatttcatgatcatatatgtatctccttgagaccttcttgacggcatatatatgtatatgtacatgcatcatgcatcgaccgatcatcaggcctccaccccgaccaggagcagcttcctcgggaagaagctcaacaagccgcaggtgtccgcggccgtgacctaccatggcaagagctccagcagcaacagcaggttcaaggcgatggctgccaaggaggtggacgagacgaagcagaccgacgaggacaggtggaagggcctggcctacgacatctcggacgaccagcaggacatcaccaggggcaagggcctcgtcgacaacctcttccaggcgcctatgggggacggcacccacgtcgccgtgctcagctcctacgactacatcagccagggccaaaagtcttacaacttcgacaacatgatggatggcttctacatagccaagggcttcatggacaagctcgtcgtccacctctccaagaacttcatgaccctgccaaacatcaaggttcccctcatcctgggtatctggggaggcaaaggccagggaaaatcgttccaatgcgagctggtcttcgccaagatgggcatcacgtacgttaatttatttcgattcgtctattattattgccttcgataatatatactagctagtagtaaatcattccaatgcatgcatgcatgcagccccatcatgatgagcgccggcgagctggagagcggcaacgccggagagcccgccaagctcatcaggcagcgctaccgtgaggcctccgacctcatcaagaagggcaagatgtcctgcctcttcatcaacgacctcgacgccggcgcgggtcgcatgggcggcaccacccagtacacggtgaacaaccagatggtcaacgccaccctgatgaacatcgccgacaaccccaccaacgtgcagctcccggggatgtacaacaaggaggacaacccccgcgtgcccatcatcgtcaccggcaacgacttctccacgctctacgcgccgctcatccgcgacggccgcatggagaagttctactgggcgcccacccgcgaggaccgcatcggcgtctgcaagggcatcttccgcaccgacggcgtcgacgaggagcacgtcgtccagctggtcgacaccttccctggccagtccatcgacttcttcggcgcgctgcgtgcccgggtctacgacgacgaggtccgacggtgggtgagcgagaccggcgtcgagaacatcgccaggaagctcgtcaactccaaggagggcccgcccacgttcgagcagcccaagataacgatcgagaagctcttggagtacggacacatgctggtggcggagcaggagaacgtcaagcgtgtgcagcttgctgacaagtacctcaacgaggctgctcttggtgaagccaacgaggacgccatgaagactggctccttcttcaagtagaaagcaactctttgctattgctagctaggcgcgaggccggcataggatcgaggaggtgaatatatatattacttggatagttttgtaatatatatatatatattactgaaccaggacatgcatacatatattcgtctatataatggatcatgtatatttcatttcagggcgccaccaaaatgcattggagctaacgaacagcgaggggcgatcatggcagcagctgccactacatcttctaaacttgccatttttattatccctgatccatgtattactcttaatttgtacgtactacaatacgggatctggccaagcgcgatatatagctgggcatgcaaagtttttgtcgatgttttttttttgaaagaaacaaggtagaagggctagctgtgcttgttaaattaaaaagaaggtgagccaagactagcagaacaaggctgtacaaaaaaaactacacaaagtgtgccaaagaagaactctcagtgtcggcctatatatcaaaattgccatatgtttcactcctgccatgatccacactccgctttcatcttttattttctgtatgttgggctgtgtgtatgtgttggtgttgggcttggaccttgtacttaggggtgtttggttccttcagtcatatgtgtttgcaacctatatgagtaccctatctgacggagtatccccgtgacacaacgaacatgtctggtgtcttatggacctctccaaacacgatgtagacctctacgagtaatatatccagtgccccattatgtgctacttcaatgcaatcctgcgtgtcaagtgtactctgattttcagccctttcttcggtacagacgcttctcctgtccgatgctttatctggtgc

SEQ ID NO: 17667 - DNA, 1688 bp, Zea mays
cattgggtacctcccggccgggccggcattgtgttgaatcctcatcgatcgtcagctaatataatagcatatatatactccgatctcagaattgaagctccgatccatccgtcgaccacctatggctgccgctgcagctttctcctccacttccgtcgtcgctgctctcgcggcgagcggcttcctcggcaagaagctcgtcaccagcatcatcatcaggaataagaagaaggggtacgactccctgcatggcgccacgaccaccatcagagtcagagccatggcggtgaacaaggagacggagcaggacaggtggaggggcctggccttggacacctcggacgaccagcaggacatcaccagggggaagggccgcgtggacccgctgttccaggcgcccatgggggacggcacccacgtcgccgtgctcagctcctacgactacatcagccaggggctcaggcactacagcttggacaacatgatggatggctactacatcgctcccgcgttcatggacaagctcgttgtccacatcgccaagaacttcatgcccctgccaaacatcaaggtgcccctcatcctgggtatctggggaggcaagggccaagggaagtccttccaatgtgagcttgtcttggccaagatgggaatcaaccccatcgttatgagcgccggcgagctggagagcggcaacgccggcgagcctgcgaagctgatccgccagcgctaccgcgaggcggccgacatgatcaagaagggcaagatgtgcgtgctgttcatcaacgacctggacgccggcgcggggcggatgggcggcacgacgcagtacacggtgaacaaccagatggtgaacgcgacgctgatgaacatcgccgacaaccccaccaacgtgcagctcccggggatgtacaacaaggaggagaacccccgcgtgcccatcatcgtcacgggcaacgacttctcgacgctgtatgcgccgctgatccgcgacgggcgcatggacaagttctactgggctcccacccgcgaggaccgcgtgggcgtgtgcaagggcatcttccgcagcgacggcgtccccgacgaggacgtggtgaggctggtggacgccttcccgggccagtccatcgacttcttcggcgccctccgcgccagggtgtacgacgacgaggtgcggcggtgggtggccgagaccggcgtggagaacatcgccaggaggctcgtcaactccaaggagggcccgcccacgttcgagcagccgaggatgacgctggacaagctcatggagtacgggcgcatgctggtggaggagcaggagaacgtgaagcgcgtgcagctggcagacaagtacctcagcgaggcggcgctgggcgacgcaaacgacgacgacgacttgtatggcaaggcggcgcagcatgtccgcgtgcccgtgccggaggggtgcactgaccccaaggccggcaacttcgaccctaccgccaggagcgacgacggcagctgcgtgtacaactaatataattgtccaaacaatttctgtggcacgtacttaagtttgagccaggatacaaactttggccgctaatggttgctgtcgccggtcaagagggcgttggctacttgagttagattttggttgtgtttcatccccacgtacgtccagcaaagaaaaattgaagctagtgcaaaaa

SEQ ID NO: 17668 - DNA, 2040 bp, Zea mays
  misc_feature (1475)..(1475): n is a, c, g, or t
ctgtgcggcgcgcgcgccggccgtccctcactactttgagctgcaaggtccgaactaaaaagcacaagaaatggcggccgccttctcctccaccgtcggagctccggcctccaccccgaccaggagcagcttcctcgggaagaagctcaacaagccgcaggtgtccgcggccgtgacctaccatggcaagagctccagcagcaacagcaggttcaaggcgatggctgccaaggaggtggacgagacgaagcagaccgacgaggacaggtggaagggcctggcctacgacatctcggacgaccagcaggacatcaccaggggcaagggcctcgtcgacaacctcttccaggcgcctatgggggacggcacccacgtcgccgtgctcagctcctacgactacatcagccagggccaaaagtcttacaacttcgacaacatgatggatggcttctacatagccaagggcttcatggacaagctcgtcgtccacctctccaagaacttcatgaccctgccaaacatcaaggttcccctcatcctgggtatctggggaggcaaaggccagggaaaatcgttccaatgcgagctggtcttcgccaagatgggcatcacccccatcatgatgagcgccggcgagctggagagcggcaacgccggagagcccgccaagctcatcaggcagcgctaccgtgaggcctccgacctcatcaagaagggcaagatgtcctgcctcttcatcaacgacctcgacgccggcgcgggtcgcatgggcggcaccacccagtacacggtgaacaaccagatggtcaacgccaccctgatgaacatcgccgacaaccccaccaacgtgcagctcccgggcatgtacaacaaggaggacaacccccgcgtgcccatcatcgtcaccggcaacgacttctccacgctctacgcgccgctcatccgcgacggccgcatggagaagttctactgggcgcccacccgcgaggaccgcatcggcgtctgcaagggcatcttccgcaccgacggcgtcgacgaggagcacgtcgtccagctggtcgacaccttccctggccagtccatcgacttcttcggcgcgctgcgtgcccgggtctacgacgacgaggtccgacggtgggtgagcgagaccggcgtcgagaacatcgccaggaagctcgtcaactccaaggagggcccgcccacgttcgagcagcccaagataacgatcgagaagctcttggagtacggacacatgctggtggcggagcaggagaacgtcaagcgtgtgcagcttgctgacaagtacctcaacgaggctgctcttggtgaagccaacgaggacgccatgaagactggctccttcttcaagtagaaagcaactctttgctattgctagctaggcgcgaggccggcataggatcgaggaggtgaatatatatattacttggatagttttaaaaaaaaaaaaaaaaaangcgtgaacaaaatgcattggagctaacgaacagcgaggggcgatcatggcagctctgccactacatcttctaaacttgccatttttattatccctgatccatgtattactcttaatttgtacgtactacaatacgggatctggccaagcgcgatatatagctgggcatgcaaagtttttgtcgatgtttttttttttttttgaaagaaacaaggtagaagggctagctgcctgttaaattaaaaacaaggtgagccaagactagcagaacaaggctgtacaaaaaaaaaactacacaaagtgtgccaaagaagaactctcagggtcggcctatatatcaaaattgccatatgtttcactcctgccatgatccacactccgctttcatcttttattttctgtatgctgggctgtgtgtatgtgttggtcttgggcttggcccttgtacttaggggtgtttggttccttcggtcatctttctaaactttagagactaaactttagtctcttcgaatcctatttgaaaaacttattttagtcaaaaaaaaaaaaaaaaaaggccccta

SEQ ID NO: 17669 - DNA, 1533 bp, Zea mays
ctcactactttgagctgcaaggtccgaactaaaaagcacaagaaatggcggccgccttctcctccaccgtcggagctccggcctccaccccgaccaggagcagcttcctcgggaagaagctcaacaagccgcaggtgtccgcggccgtgacctaccatggcaagagctccagcagcaacagcaggttcaaggcgatggctgccaaggaggtggacgagacgaagcagaccgacgaggacaggtggaagggcctggcctacgacatctcggacgaccagcaggacatcaccaggggcaagggcctcgtcgacaacctcttccaggcgcctatgggggacggcacccacgtcgccgtgctcagctcctacgactacatcagccagggccaaaagtcttacaacttcgacaacatgatggatggcttctacatagccaagggcttcatggacaagctcgtcgtccacctctccaagaacttcatgaccctgccaaacatcaaggttcccctcatcctgggtatctggggaggcaaaggccagggaaaatcgttccaatgcgagctggtcttcgccaagatgggcatcacccccatcatgatgagcgccggcgagctggagagcggcaacgccggagagcccgccaagctcatcaggcagcgctaccgtgaggcctccgacctcatcaagaagggcaagatgtcctgcctcttcatcaacgacctcgacgccggcgcgggtcgcatgggcggcaccacccagtacacggtgaacaaccagatggtcaacgccaccctgatgaacatcgccgacaaccccaccaacgtgcagctcccggggatgtacaacaaggaggacaacccccgcgtgcccatcatcgtcaccggcaacgacttctccacgctctacgcgccgctcatccgcgacggccgcatggagaagttctactgggcgcccacccgcgaggaccgcatcggcgtctgcaagggcatcttccgcaccgacggcgtcgacgaggagcacgtcgtccagctggtcgacaccttccctggccagtccatcgacttcttcggcgcgctgcgtgcccgggtctacgacgacgaggtccgacggtgggtgagcgagaccggcgtcgagaacatcgccaggaagctcgtcaactccaaggagggcccgcccacgttcgagcagcccaagataacgatcgagaagctcttggagtacggacacatgctggtggcggagcaggagaacgtcaagcgtgtgcagcttgctgacaagtacctcaacgaggctgctcttggtgaagccaacgaggacgccatgaagactggctccttcttcaagtagaaagcaactctttgctattgctagctaggcgcgaggccggcataggatcgaggaggtgaatatatatatattacttggatagttttgtaatatataattgcagctgaacgaggacatgcatacatatattcgtctatataatggatcatatatatttcatttcaagaaaaaaaaaaaaaaaaaaaaa

SEQ ID NO: 17670 - DNA, 1798 bp, Zea mays
  misc_feature (1797)..(1797): n is a, c, g, or t
cgtacgcgtgggcggacgcgtgggttctcctgcaccgtctgagctccggcctccaccccgaccaggagcagcttcctcgggaagaagctcaacaagccgcaggtgtccgcgggcgcgacctaccatggcaagagctccagcagcaacagcaggttcagggggtggctggcaaggaggtggaccagacgaagcagaccgacgaggacaggtggaagggcctggcctacgacatctcggacgaccagcaggacatcaccaggggcaaggggctcttagagaacaccctcttgcaggcgcttatgggggacggcacccacgtcgccgtgctcagctcctacgactacatcagccagggccaaaagtcttacaacttcgacagcatgatggatggcttctacatagccaagggcttcatggacaagctcgtcgtccacctctccaagaacttcatgaccctgccaaacatcaaggttcccctcatcctgggtatctggggaggcaaaggccagggaaaatcgttccaatgcgagctggtcttcgccaagatgggcatcacccccatcatgatgagcgccggcgagctggagagcggcaacgccggagagcccgccaagctcatcaggcagcgctaccgtgaggcctccgacctcatcaagaagggcaagatgtcctgcctcttcatcaacgacttggacgccggcgcgggtcgcatgggcggcaccacccagtacacggtgaacaaccagatggtcaacgccaccctgatgaacatcgccgacaaccccaccaacgtgcagctcccggggatgtacaacaaggaggacaacccccgcgtgcccatcatcgtcaccggcaacgacttctccacgctctacgcgccgctcatccgcgacggccgcatggagaagttctactgggcgcccacccgcgaggaccgcatcggcgtctgcaagggcatcttccgcaccgacggcgtcgacgaggagcacgtcgtccagctggtcgacaccttccctggccagtccatcgacttcttcggcgcgctgcgtgcccgggtctacgacgacgaggtccgacggtgggtgagcgagaccggcgtcgagaacatcgccaggaagctcgtcaactccaaggagggcccgcccacgttcgagcagcccaagataacgatcgagaagctcttggagtacggacacatgctggtggcggagcaggagaacgtcaagcgtgtgcagcttgctgacaagtacctcaacgaggctgctcttggtgaagccaacgaggacgccatgaagactggctccttcttcaagtagaaagcaactctttgctattgctagctaggcgcgaggccggcataggatcgaggagggcgccaccaaaatgcattggagctaacgaacagcgaggggcgatcatggcagcagctgccactacatcttctaaacttgccatttttattatccctgatccatgtattactcttaatttgtacgtactacaatacgggatctggccaagcgcgatatatagctgggcatgcaaagtttttgtcgatgttttttttttgaaagaaacaaggtagaagggctagctgtgcttgttaaattaaaaagaaggtgagccaagactagcagaacaaggctgtacaaaaaaaactacacaaagtgtgccaaagaagaactctcagtgtcggcctatatatcaaaattgccatatgtttcactccaaaaaaaaaaaaggataaaaaaaaaaaaaaaaaaaaaaaaagggcgccgctcgcgatctagaactagnc

SEQ ID NO: 17671 - DNA, 1090 bp, Zea mays
  misc_feature (838)..(838): n is a, c, g, or t
  misc_feature (980)..(980): n is a, c, g, or t
  misc_feature (1058)..(1058): n is a, c, g, or t
  misc_feature (1063)..(1063): n is a, c, g, or t
  misc_feature (1077)..(1077): n is a, c, g, or t
  misc_feature (1086)..(1086): n is a, c, g, or t
attggtacctcgagccttgggtacctcgaggccggccgggacactccgatacgcggggatgcataggcgtcggcaggaggagctcatgtcgaacaccaatagcgttagccgttagccaccaccagtaggcagtagccacagcagtcatggggtcggtgccgccggcagagggggacaggcgccagccccagcagcagccgcacgtgatgatgatcccgtacccggcgcagggccatgtcacgccgatgctgcagctggccaagctactccacacacgcggattccacgtcaccttcgtcaacaacgagttcaaccaccgtcgccacctgcgcgcgcgggggccgggcgcgctccacggcgccccggggttccgcttcaccgccattgacgacggccttccgccctccgacgccgacgccacccaggacgtccccaagctctgctactccaccatgaccacctgcctaccccggttcagggacctaattgtcaggaccaatgccgaggccgaggccgagggacgccccgccgtgacgtgcgtcgtcgccgacagcatcatgagcttcggcctccgcgccgcgcgggagctcggtctccgctgcgccacgttctggaccgccagcgcctgcggcttcattggctactactactaccgccacctcgtcgcacggggtatcgtcccgcttaagaatgaagcgcagctcaccgacgggtacctggacaccgtcgtcgactggatcccttgcgcgcccaaggacctgcagctccgggacttcccgagctttgtgcgcaccacggacccggacgacatcatgctcaacttcttcatccacgaggntagaggcgatgtcgcaaggcgtcggcggtggtcatcaacacattcgatgatctcgacgcgacgctgcttcacgccatggcgaatcctgtcccggcccatctacaacgtgggcccgctcctgctgacggtgcgaaacaacgtncccgcggacagccccgtcgcgggcatcggggtcaacttatggaaggaaaagagggccgttcggttggttgaagggcgnggcgnttcgttcgtgtaancaattgggnggta

SEQ ID NO: 17672 - DNA, 946 bp, Zea mays
agatcggccatccgtgcgcggtgaaacctctgtgttctccattgtccgagcgttggcgactgcgtctcccccctcgagccgccgtgctccgtcgtcattggcggccaagttgggagagaagaggtcgtgggtgggcgggtcaggcggcggcccgcttcgggcacttcgaagcgaggagggccgcgtcgagagggcgaccgaggttgccgcagtcgaggcggttcctcggagaagaatcgccattgcgaaacgcctacgttgtccaccaccgtcgttgaaggttgttggcgacaaaaggaagcggagctcgtcgccaccgtcttcatcctcctcgattcgctcctccgcactagatctgagcagagcaagaggaatccgttccaaacacttcacatcgaagaggccactgggttgggattcatcaaaggaaagggtaaagaaggcccagtttgtggacacatcttccattgattcagagtacctgacaaggatgggagaactatcgctagagtgattgtctatttacatatcggtagcttcaactgaggaaatgaagttggagtccatgaacaaaaaacgagaggcagaaactgatcctagagaggaagaagctgaaccttgagaaaattaggatggatcgtcagaaattaaaggaggacaaggaagaggaggtaatgatcctaagcatggatcttactaaatgtaagcctctacttcgacagtactacgaggccaagcaacaagagatattggcaaaggttactgcaaactcgtcatcaagcaatttgaggaccaaatgtgtttaaggtccagttatcttatttttgttttaccatatctgaaacctttatgttgttgcgtacctgttgcttcaaacttgtattatgtcagactacatttttgttatgcaagggactttgtatgttggggaaaaaaaaaaaaaaaa

SEQ ID NO: 17673 - DNA, 1452 bp, Zea mays
ttacggtctctagtcagtccctctcgcgcgccccacctactgtgccgttcgtcccgccattggcacgcacgagcccacgatataacccgccacccctcgctctcccataccagtaccaccaacaaacttctttctcgccttgcatcggccgccggccctccatccaccgcaccagctagcaacgacgacacgctagccaggtagcgtagccgaccagcctccgcgcgcgcgggcactcagttcgccatggcgcgcctgctccgcgccgccgccggcctcgcgctcctcctggccgtccttgccccggcggcgtcggcgggcggcgacctggcccagctgggcgccgccgtcgagacgcggcgcggcggcgggcggacgacgtgccgcggcggcacggtgggcgagtgcatggagtacctggacgtagacgcggagggcgaggcggacgtggcgggcatggccaccggcggcggcggcggcaagcgccgggtgctgcagggcggctccggctacatcggctacgacgcgctgcgcagggacaacgtgccgtgctcgcagcgcggcgcgtcctactacaactgccagcccggcgccgaggccaacccctactcgcgcggctgcagcgccatcacccagtgcaggggctgatgcctgcctgatgatttccgttccgtttcgtccccagctattagtcgggtcttcaatttaaagaagaagacatgcatggagcgatgtcgtcgtctttgctgtgcgcgctatagcctttctcgtccgcctgaggcacgcatgactcgtccgtcgattattgtgctgcagtggacatgtgtatgtgctcctgtttctagcatatccccttgctttcaggaagaaagtgaaagtaattatatgaaaaaaaaaaaaaaaataagcggcctctacgagggagaatgaccttgtcatgcagaaaagatcaattcaagtggctcagcgttcggattagtggtttagatatatactctttaagactagtcattattagttcatgccaccaactgtggttgggctgtcatttttcatcatatgtggagagtgagtcaatgtacctagctaggagcgttgttgttggcataaataaaagcagattcgtttgcttttcagacgatttgtacagcctattgcaaagtgacgacacagtaaatctttacaacgtccggcttggaccaccaagatccgaatccttcgtttctcagtgaatccttatgtactatacatatagtacatccgtcccacagagagcgacggttatagttttgctcctaaatcgagctatttatgtttgatcaaatttatagatgagattatcaacgtttgttgtatattaaataaatgtactaactaagataaaaaaaactactgacaatatttgtattaaatatatggagaaacgagcagtggtatctttctacaatttcc

SEQ ID NO: 17674 - DNA, 1019 bp, Zea mays
accagtaccaccaacaaacttctttctcgccttgcatcggccgccggccctccatccaccgcaccagctagcaacgacgacacgctagccaggtagcgtagccgaccagcctccgcgcgcgcgggcactcagttcgccatggcgcgcctgctccgcgccgccgccggcctcgcgctcctcctggccgtccttgccccggcggcgtcggcgggcggcgacctggcccagctgggcgccgccgtcgtgacgcggcgcggcggcgggcggacgacgtgccgcggaggcacggtgggcgagtgcatggagtacctggacgtggacgcggagggcgaggccgacgtggcgggcatggccaccggcggcggcaagcgccgggtgctgcagggcggctccggctacatcggctacgacgcgctgcgcagggacaacgtgccgtgctcgcagcgcggcgcgtcctactacaactgccagcccggcgccgaggccaacccctactcgcgcggctgcagcgccatcacccagtgcaggggctgatgcctgcctgatgatttccgttccgtttcgtccccagctattagtcgggtcttcaatttaaagaagaagacatgcatggagcgatgtcgtcgtctttgctgtgcgcgctatagcctttctcgtccgcctgaggcacgcatgactcgtccgtcgattattgtgctgcagtggacatgtgtatgtgctcctgtttctagcatatccccttgctttcaggaagaaagtgaaagtaattatatatatgatgatcgtgtaataattttcgtctacgagggagaacgaccttgtcatgcagaaaagatcaattcaagtggctcagcgttcggattattggtttagatatactctttaagactagtcattattagttcatgccaccaactgtggttgggctgtcatgtttcatcatatgtggagattgagtcaatgtacctagctaggagcgttgttgttggcataaataaaagcagattcgtttgcttttc

SEQ ID NO: 17675 - DNA, 1362 bp, Zea mays
cgtggtacacaggagaggagacaggcgaataagcgatgggcccgcgtgtgccgcctccgacgcccgatcgagcgcaatgatcaggtggtgactgaccgcgtcgcgaggcttttatatgtacgttgatcgatcgagacctgaccaggcaagaggcaacggtcgctgtcaatcccccacctactgccgacgcgacatctctccctccctttctcatcgccggtcctctcgcgcgccctcacctactgccgtccgctcgtcccgccattgccatgacccatgttataacaccccccattcccacccctcattctcccacgccaccaccaaacgcctctctctctctctctctctctctctctctcccacgccaccaccaaacgcctctctctctctctcggccgccggccctccgtcgcattcaacacgtacgccatggcgcgcctgctccgcgccgccgccgtcctggcgctcctggccgtctccaccgccgcgctgtcggcgccggcgtgggcgggcggcgtgtccgccggcgacctggcccatctgggcgccgccgtcgtgattcggcgcggcggcgggcgggcgtgccgcggcggtacgacggtgggcgagtgcatggagtacctggacgtggacgccgagggcgaggccgacgtcgccggcatggccacgggcggcagcaagcgccgggtgctgcagggcggctccggctacatcggctacgacgcgctgcgccgggacaacgtgccctgctcgcagcgcggcgcgtcctactacaactgccagcccggcgccgaggccaacccctactcccgcggctgcagcgccatcacccagtgcaggggctgatcgatgcatgcatggtttcacattccattctccggcagcagggtaaatcggttgctgctagcttcattcatgcatgtgtgtggtgcttgattttcttttttggggtctttaattgtcgtccgtcgattattgtggtgcagtggagatgtgtctgtgctgttgctagcatccttttcaggatgaatctaaaagtaataataataattatatatgatgatcctgtaataattctggtgtcgatgatattcacagccaacgtataatttgcagtgcctgcctttcatttcatatactccaattcctttcgagttgagctgtccgttctgagcaccaacttccctccttttttttccaactttataatctgtttgggtgatccgcatgcatattcggatcagaccagtcactaataatctttaggccttgttcgtttccgtcggattacacctgaaatcgtttcagctaatcaaagtttatataaattagagaagcaatccggttaggaatcgttcg

SEQ ID NO: 17676 - DNA, 1839 bp, Zea mays
acatctaaataatttatggggagtgaagcgcttgtttcatggaaagggggacgacaaatttttcattttcaatttaaggattgctgaaatctttctgcgcttgaatgtatggatagataacactgtgttttcagctgaagaattttgcctttttgtgtcttctctgttcgcaaaggcaaaaacacttcgcaataaggacctcatcgaaatatatttgagcccacttataacgtgcattccaggtcttatatccaatgctccagatgactcaaaaggctatttgttggaggtatttacggactcatttagagattgcaaggtggattgcaagctaatgttgccatatttggatgcagttggaggaatgctgtttcctgagaaaacaagcatatggcttgctgaaaatgattcaggtgtgttgggctatcatgacacatggatacatgagctacctggaattttgctacaatcaattgataaagcccccttagttacaaaggttgctttggagcttcttctaagaattgggcaatacttccctgcagtggactgtggaaggctgcgccccttcatgaagttatttggtgttgagtcattaccaggagctgtggatcttggtccttttgttaaacttcctcgtgattgccaagaacttgccatttcatgcctttattattttcccagtctgctccctgacgtcattgagccattggcctcatgttgcttaagtgatgcgctggaacccctcatactgttcagggccattgaagtcctacagtcaacatacaaggctggtagtttacatataacagagcaactcagtttcttgttgctgctaatggcaagattcagagttcatcctggggacatagttactctggaggattctagcaagctttcaaattgggatactttcaagtcattgaatcgcctaattttgacttccctatctgaaatgggtgatggctcgctggtccttgaattgatttggaataatttatttaatgcaattgctcaaaaaccatcgttgcataacatgaatggcttgcttagaattattgttacacttgatgccggaactagtaagctcatgaatggaaatgttgtaaagcttatagctggttacttggttgatgcatctttggatctgtctaaatccactgaatttggttttcaacccgctaagacgagactatttcagtactttctcaagccatgcaccatcatgtttgacaagaatgacaaggttcttcgctgcacattggagtccctcaaatcttttgtaacaggaggcgatcatctgctttcatctgtctccaccttaaactacccaggagagctgtcgtgtcgagtttgtgctgtcacaaccatactcattttcttatgcaatgaccggaaactccataggaatctttctcttggcaaatcggttattaaaggcatcctggaatatataaggcatcagctggattctagtgtgcctgatgtaacacatgtaggaaaacaaaagttaaaatctgcttttgagcaactcaagaccaaagcattgcagttgaattgctgggatagaagtgagctggagggtctttcgagtgctacatgatgtaagggggaattacctgtgtgccatcgaaaattatactcatttcttgtatgccactggtcccacatgtcatacacacacaaaaaaaattctctattgccacttaatggcacacaaggaatggttataaattttgatggcacatagggaatttttccatgatgtaaaatgacttttttttcactatatgaggttaaacacaagaaagttggaactggaggggggaaaggagtttt

SEQ ID NO: 17677 - DNA, 981 bp, Zea mays
  misc_feature (94)..(94): n is a, c, g, or t
agggccttagggcaaagcatagcaacggcggctgcgcagcaagcagttcagctcagcacctcgccggacgccggctcacccatccggccatccnggtgccggccgactctccctggtccccagcgcagcaagcagttcaccggagccggcgcagcaagtagtcagggaatgttatcaatgaattatttgcatattattcagcagtcatcaatgcaaaatcaaccacaaaaggttctagttcaagagagagtgagtttgttccacataaaaatacttgtttggtggatgaggaggaggatgaggttgatcttgatgagttgtatgcaacaacaagcaatgacaagaaggtgtcagagttagatttgtatatgagcgaggacctagtgaaggtcaatgacaatgaagcaacatttgatatcctatcatggtggaaagggcaagtcacaaattttcctattctttctacccttgctcgtgatgtgttgtctatgcaagtgtctactgttgcttcagagtctgcatttagttcgggtggacgcattgttgatgcattccgttcaagactcaaaccagaatttattgaggcattggtttgttgtaaagattggaagattgcttcggagaaagatttggagattgaaattaaaaccttaagtgaacctatgaatgacgttgacttggaggatgctgctgcaattggaacttgagaagttaaagttcaagttaccatggatgatgttgaacttgttacttattgttgtaatgttgtggagcggaggtttgctggttgtttggttgttgcaactttattttcttatttgcacttcttcacttgaacatgttaattaatgtcaactatctactatttgttatatacttgtggatttgtggattatgcctaaaataggggaaatgttgccgaatttttttaatattagtaactttgaactgcatgatgttaaaagaaaaaaaaaaaaaaaa

SEQ ID NO: 17678 - DNA, 1793 bp, Zea mays
acttcggagcccgtttacacatgtccagcccagctttgtctcaggccttaatagcccagctctgcccgagacgccctcccacggtcgtttgtgtttccttctccgtcagccgcgccgccgcccgcctccccaactgtcaggcgccgcgatggaggctctccacgaggagatgcccttcgacctcgacttccacccgtcgtctccgctcgtcgtcacctccatcatcaccggagagctctgcctgttccgctacggcccggagtcgcagcctgagaggttacttttgttaaaagcccacaaggagtcatgcagagctgttcgttttgtggactcaggaaaagtgattttgtcagggtcagctgattgctcagttcttgcctcagatgtagaatcgggcaaggccattgcccgcttggaggatgcacatgagaatgccataaaccgccttgtctgtcttactgaatctacaattgccacaggtgatgatgaaggctgcattaaggtatgggatacccgggagcgatcttgctgcaacagttttgaagtccacgatgattacatttcagatatgacctatgtggctgagacaaatcagatactggccacaagtggggatggaactttgtctgtgaacaacctgcggaggaataaagtaaggtcacgatctgaattttcagaagatgagttgctatccttggtgttaatgaagcatggtaaaaaggttgtgtgtggaactccaagtggagcactcttattatattcatggggatactttaatgattgcagtgaccgctttatcggacacacgcagtctgtggatacaatgctgaagctggatgaagacactttggtttctggatcatcagatggtgtgatcagattggtgggcatcctacctaataggataaaacagccacttgctgaacattcagaataccccattgaggcccttgctttgtcaaacgacaagaaatatttaggcagcatctcacatgataaaatgctgaagctctgggacttggaagaactcttgagtggcccacaggtagccaatggtgatgaacctgctgaagctggtagtgatgacagcgatgacgatagcgatgatgatgtgatggatgtagacatggcggcaacctcttctaaaggttcaaggagtaaaaaggcaggtaaaggacagagttcgagtcggccggcatcggatttctttgcagatctatagtcgtcaagtttcctaagttagaagctgtgtactctcctctctggttttttttgggttactgtacgcgagtgcgtgtgcgagtgggcaactttgaccgccggtgcaaggcatgccaaatgttgttttatttataagtatattgctgatggcatttatcagaagtagaagcagtaagtgttgtggacatggtgctaatggtttggaatttggaaagcggaaaccaaaccttatccaaaaaaaaaaaaaaaagaatccgatccgtggcgaggcaaaccgcgtgctcatgtgcggcccagcacgcccggtcggtcaggcgggtgaccgccgccaaacctgctcagttgccagccgtacacgcttggcctcgtcttcggtcgtgtctccgactccgttggttttttacagaggctcccagtcccaggtcaaacaaaaaaagaggcgaaacagacaaagcactcggaaattaggcaggtactgtactaggttgatctgtaggccgattgggcgactccaaatctgtggagctgtgaatcctttggcagattaaactaaaaaaaaaaaaaaaaaaaaa

SEQ ID NO: 17679 - DNA, 5470 bp, Zea mays
  misc_feature (4698)..(4698): n is a, c, g, or t
cacatgtcacgcactcatgttcccctagaaccactgtcagaacagcttagatgcacgatgtgaacgattttaaatagttagatgggctaagatttcttattttagtttattggtacaaagaactaaggaatagaagaagaaaaaatcaaaaacaaatgagcatgttagacatggtgattttttcccgtgatttgaccaagcctaaaatgaatgtctactcaaacgttgtagtgtcccaacggacaaggtttacacccaacccttcttaagtgattcaaagatcaaactcgaggatagttatttacctcatcttaactaagttagtgaggtttacgttagacacacctagaatatacctagtataaattacctttatctattataaagcagaagaatatgcctggtataaattagctttatccattataaagcaaaaaaaaacaaatggagaggtgatgcaaaaacgcatgttgatgcaataaagaaattgtgtaaggaggaacaaagaagagaaatgcaaatttttaggctatggtcagatatatggcctataaaagctaatttgtgttcttgttattttatttctccttgcacataattctgttgcctcaaatgcaactctttttttttttgaatttgttaatgatgttttgatgtatgtaaggaggtgggagagcatggatacgtccacaaagaagaaccactgctatggcaatgccacgtgaacagactacgataggtaaggacaaaaagttttctgtttttttttcctgggcacgtgtggcatgcgagcgagctaaaaagagattagtagcaataacaaggttaaattaaacaagacccggttaacggcattattgatattcaattgtcggggtaatctcgtacgttttggcatggcgcaagaggtagcaaataaagaagacgcaaatgcagatcggacaaatgtcttgccacgccagcactatcgtccgattatattattatgctctctcgcttataatttgccgccaccactgagttagtactaaaaggctgagcactgtgatgctggcggccgtcagtgcgatggcgtctttaggcagcagctggagcctggagaccctgaaagtcacgcacgcacgaccgatcgatcgattgactagtacgctaggtgaggtgctggtggctgggctgtggctgtcctgccctgctcgatctgttcaggacgttctgctggttgatgtgatcaataacattcagattttttgatggtaacacttgttcctgtttagaggggaatcgtgtgaacttattaaatctcgagcaatttggctccgaaatttctgctagagtctctgatctttggctgtcaaaccctgaacaacggccaacgggatactttgaaagctgtttctcgttccaccagcaaactctaggtacctttttttttgcagatcgctctaattctagataatggttcagtagttctttgtcagaagcctttgtgctgtgccaatggtattagtgtgcctaaaaagagtgcgtacgaggccttagcgattgaggaggttgctggtggaacgtcccttctcaagctttgcacattcttcggaaagtttggaggtaaaagaaaaactaatacagaatcaggttatgttttaggtttggaacgtactacactcctacttaccagccccacctttcagttccgaattttccaaaattggctcgggctaaatgctctgggtgggagcttttttttgggggcactatttgggaaggctcctacaggagccgtagttgctagtagtgtgcatgaaccagaagaactcaagtcagaactaaatggttttttttttcatcgttgagctgtctgacgaggaattggaaaactagggaaggagttacagagccatagcttcctcttggtcagataattgcaggacagcaacgtggctcatatatagttatatacaatggacgggcggcgagtagctagccggcacaagttgcagcagacgaggcttggccgcttggggacctccagctgcctgtgtgagagtgagagaggtgacaaataaaacgggaccaacacggcaacaccaacctccaccgctagacctcttctcccgctttaccccgacatgaaagttagatttggtagaatcgaagttggcaaagagaatgtagatccacggggctacactgcattacggttgatgagttcatctggtctatcactacaactacagttacaggcaacgcaacgagccagaatcacgtggcacgccgaggcgggtggccctacgaaaattcctctacgccgtcgcgtcacggaaacaggcccccccaccccaacatccaccagaccaccgctggtccaaccaatcgcgccaagaggccgagaccaaacgacgcgccggcgcacacgcaaaccaacaactattgccgatgtttccgcgttactccccgcactcctgctccgctcgccgctttttatatcgacctgccccggctcagtcgcacagtcctccacgcacgcacgcacgcacgaccagttgccacggcagaccaccccgcccagcggccagcttgctcgccacgaccacgatgggcttccccgtggggtactcggagtcggagatgctgctcccgcgcgtgctgctgcaggtgctcctcctcctcggccacttccaccgcttcctcctctgggccttccacgccgtggggctcggcgacctgatcgacctcggctgcaactacccgccgccctccgcgtccacggcgcaggagatgatggagcaccagcaccaggggcgcgacgacgtggcctccccgctgcagcaccagcgcccggagttcaggcccgtcgcggcggcgctcatcgaggaggcgctccccgtggtgcggttcgacgagctgtgcggcgcggcgtgcgggggcggcgactgcgcggtgtgcctgggcggcatcggcggcggcgacgaggtgcggcggctcggcaactgccgccacgccttccaccgggcctgcctggaccgctggatggcgcacgaccagcgcacctgcccgctctgccgcgcgccgctcatcccctgggccgccgacgccgactacgacatgtcctatccgtctcccctgccgcccacgccactgcggcggcctcacgagctgctgctgctgcttaccggcctgggcggcttccagtgatgcgcctgcgcgtgggcagcgtggctggcacttgggcaggccggccacgcgaatccgatccgtggcgaggcaaaccgcgtgctcatgtgcggcccagcacgcccggtcggtcaggcgggtgaccgccgccaaacctgctcagttgccagccgtacacgcttgccggcctcgtcttcggtcgtgtctccgactccgttggtttttttacagaggctcccagtcccaggtcaaacaaaaaaggaggcgaaacagacaaagcactcggaaattaggcaggtactgtactaggttgatctgtaggccgattgggcgactccaaatctgtggagctgtgaatcctttggcagattaaactaaaaattgtctctatagatcagaccaccaaaaaaaaaaccgtgcagtctggctccatttgtgttgcgccattccgcatcgatcgatcgatcactcactcgctcagtcactcgaatcctgaccctgtccagaaagtacactactgccatgctgaagagggaagacaaatctaaagtcgacatctaggacctccatctggtttaacaattaacagttttattaagcgaacaaacaagatagacaagcagctgatcggcgatatgatctgctcgcatcagagccacttggcctggcataacataacctgactcactgcctgagaggcaaaggcaacgtcgggtcaatgcgtagcggagtgctcgacagcgactgactactggacttgttgcgtgctggccatgtaggacgacgataacgagaagcaaagcgagaggctagcagtagaagcttcctacctccatccttctccttcctagctcttgggtttctgggcgggttcgacgaacacaggcagacggtgcttctgatacttcggtttggtgagcagagcactacacaccgatacgaaaaagagtgagccgatcattgctgccattctgcgcagcgaaagggggagggaggggccaatgatggacgacctctctctttcgtctgacagagacgaacttggacggacttcacacgactacacgaggacgaggcataattggtgatgggcacacgacacgacgacggcgacggcgacggcgaccataggtcccaggcccccacgggccctccttcatcagcgtcgtgcatgggacgggacgccgggcgctttttggcccagcacgctttcgacgtgctgcaaaacgggtggccatggccagccgagtttttggaattcctctctcgacatggaaagcgacgaatattgtctcggctttggttcgacgacagagacgaaactcgttctgtcattcgctctagcttagcacagtatgtcccccctgcacttgtgatcggttgaacgagtatttttcttcagcagcgaaagagaaagatccgtgtgacgatactgacttgcctctttgttgggttgcaaattagtacggagtacaagggccaatcctctccgactcaccgtagaatgggctcatgttgaacaccagnagcactaacagtaagggctgctttggtggtaagggatcccaagggaatccatgggggagaaatccccttacaattcaattttaaataacaaggggattcctctcaatggatccccttgagatcccttagcaccaaatcagccctaacagtaacttcactctccctcctgactcatcatcagttctccctcgaactgcacccgaatacttgtcacttctaaggcgagtgcagaatacaaagacgctctcagcaagagtctcgcaccctcgcagcaaggagaatgaagatttgcctagctcaagcaacaacatgaccggtcttggtgttactctctaggaactgatttggtgaccaatgaaaaaaagagatttatggggagaaattttgtcttattcaattttgaataagaatgagatttctcccgtagaacatctctatttctctggtcaccaaaccaactctaagaggctctatattctttcaaatataaatagcttctattctatatttctcgttagccacagatagaaaatgagaatgactttctagagcataaacaagctatagaaaaatattagacagttgaaatatataaaagacgatttttttataaaaaatgactctttaaataattatttagagagtaagctttgaaaaggactcccgaagatgctctaatcactctgcacccgtcaatatcggtatgttacacagttgattacaacagtgaaggagacagacaacggatcctcatttcagcccttatttctct

SEQ ID NO: 17680 - DNA, 1187 bp, Zea mays
agtcctccacgcacgcacgcacgcacgaccagttgccacggcagaccaccccgcccagcggccagcttgctcgccacgaccacgatgggcttccccgtggggtactcggagtcggagatgctgctcccgcgcgtgctgctgcaggtgctcctcctcctcggccacttccaccgcttcctcctctgggccttccacgccgtggggctcggcgacctgatcgacctcggctgcaactacccgccgccgccgccctccgcgtccacggcgcacgagatgatggagcaccagcaccagcaccaggggcgcgacgacgtggcctccccgctgcagcaccagcgcccggagttccggcccgtcgcggcggcgctcatcgaggaggcgctccccgtggtgcggttcgacgagctgggcggcgcgccgtgcggcggcggcgactgcgcggtgtgcctgagcggcatcggcggcggcgacgaggtgcggcggctcggcaactgccgccacgccttccaccgggcctgcctggaccgctggatggcgcacgaccagcgcacctgcccgctctgccgcgcgccgctcatcccctgggccgccgacgccgactacgacatgtcctatccgtctcccctgccgcccacgccactgcggcggcctcacgagctgctgctgctgcttaccggcctgggcggcttccagtgatgcgcctgcgcgtgggcagcgtggctggcacttgggcaggccggccacgcgaatccgatccgtggcgaggcaaaccgcgtgctcatgtgcggcccagcacgcccggtcggtcaggcgggtgaccgccgccaaacctgctcagttgccagccgtacacgcttgccggcctcgtcttcggtcgtgtctccgactccgttggtttttttacagaggctcccagtcccaggtcaaacaaaaaaggaggcgaaacagacaaagcagtcggaaattaggcaggtactgtactaggttgatctgtaggccgattgggcgactccaaatctgtggagctgtgaatcctttggcagattaaactaaaaattgtctctatagatcagaccatccaaaaaaaacccgtctggctccatttgtgttgcgccattccgcatcgatcgatcgatcactcactcgctcagtcactcgaaaaaaaaaaacccccccccccacccaac

SEQ ID NO: 17681 - DNA, 1924 bp, Zea mays
  misc_feature (1575)..(1575): n is a, c, g, or t
tggcccccccccaaattattccgcgcacacgattaattacgtgccacttaattcttttttttttttgttgttgccaccaatgaactgtaactcctacagctacaggcaagcttgccgcttgcgcttcccctgtgcgcgagaattcaagaattgccgagcagcacgcccagatcctattgatctccgtattcaatcctgccagttatgcggatgcaaatttcttctctctctctctatttacaggccacggcgtttgcttggagcagttattttctgcttatattgtggatcttcagtttttcaagtgtctcttgaacgcccctaattttggtaaaagcctggccctgtgctgtacgtatttaagcaactttctcacctcctccgatcccactcgtcccttcgttgctaggtggagaggagcgatgcttgtcacctactcctttttaggtcccactactctcccctctcacacttcttccgcctcttttcccgtcagattattgttatccttgagtgagtgaggcccaaaggcagcagcacgtacagagcaagcgaagggagaactcaagcgagggaggcagagggcgaagctaagcaagcagctagctgctcactgcttgctctgtgctggtcgtttgctctgtgctggtcgcgttccgtttgcaggaactccttgcctggtgatggacaggcacacctgcaggctctgcttccggcggttccacaacggccgcgcgctgggcggccacatgcgctcccatgtcatggccgcgtcgtcggctgcagcgcactcgccgctgccgcggcagcaatttggcttcgctctccctggcgtccacctcgtcgacggagatgggcgacgggccggcgcggcagaagccactcgcggcgccgtgcgtcgcacgcgagggcgccacgaaagcgttcggctttcctggactctccggcggcggcaggcccgcccgcggcgagtcttcggtcgtgcaggacggggagagcgacacggagtcgtccccgcggttcgccgtgagccggcgacgctcaaagcgggcgcgccggcgcgcgcccccgccggcggtggcgtcctccgatcccgagcagccagcgagcagcgtctccgacgcgacgccggaggaggacgtggccatgtcgctcgtcatgctgtcccgggactcgtggacgcggtccagatccggctggggcccggcgagctcggaggcggcggagcaggaccacgacgacgacggtgtccgctcgctcgtcggcgcgcacgatgccgatcacgagcacggcgtcgcgcgctcggaccacgggcaggcaccagtgcggcgcgtgcaggaaggtgttccggtcgtaccaggcgctcggcggccaccgcgccagcgtcaagagaggaaagggcgggtgcgtgccggtgccggtgccggtgccgcctccagccgcgccgtcgtccaaggctcgccgcgccgagaacggcccggcggtccacgagtgcccgttctgcttccgcgtgttcgagtccggacaggccctgggcggccacaagcgcgcgcacatgccgtccggcgcgcccgnccccgcggcccccgtccccttggacggcagcagcgaaatgcggcgacagctccatgtccatcgacctcaacgtgccggccgcgacggacgacgacttcgagctctcccccgtgtacgacaccgagttcggcggcaccagacagtgaggccagctgctgacccgatccgaccgatacttactgctacgacgccaacttcagaccggctgatgctcttgcgcagctgctgcggtaaagggcttgggtcccttccaatccatgcaagaattagacggagagtaacagttgagcattttttgtttaaaaaaaaaaaaaaaaaaaaaaaaactcgagagaggggcgccggtacc

SEQ ID NO: 17682 - DNA, 1857 bp, Zea mays
tgctctcattgacaacagacaacaagcagtctggaaccttcaacctgtctggatccattagacggcaggttctgtctcccgctagttctcttcttagtccatgtagggggtgtttggtttgaggaatcactttatccaaaatgtagtggtgcatcatgggtccattcctcaaatttgttgggatgacctcattcctcatattagtactaactaaataactataaggaatgaggtgatgatggatcaactcaatccattacacaaaccaaacaaaaaattgaggagtgagaagacgatgacctagatcattcttcaaaccaaacagcctagtagtgttaaatgttttgcataccatgggcaccgttttgataaagttgtcttacttctaattaggggcacaactaaatgtcatacctattttccgctgctcttgacgtttatttaatagggatgagacttcatgcacttaacaatgcacaccatttttttgaattttgaatttgtaggctacctattatgaactaacaaagaaatgtacacttcaagctcaaatgaatgaactgctaagttacatgcagttttagtaaagcctagaaggccagtagaaacaaatagcaactttcaagtgtttagggaactttcacatgataaattgtttctaaactaataagcattatttggagcaatacttctttgattagaaaccctgctcaggtatgggaacaattgttgtgcaagtagaccttaggtgtaagcgtgcaagcgagcctcctgaatctttagatcatggtccaaccgtagatgtaaccgtagtttgtcagtttttttttttgaaaaaagctgcataagctggtggtgaagaggtttaagtgttaaatgtgacctacacttggattaggatttaaaggatcagaaagctcgcttgcatcgcagtcttgcttgcacaacggtcgttcttctgaggtatataggaagcgcttcgtagagaagctgcacaaatggagtaaaacacagtcaaaataagtaggtttaacccatctactttttagcacaaatgggatggtgggactaagcgcaaccagaataagttgcagaaaagcattcagtttggccatgaacagcttataagctgtaccaaacaggccactggaaaaagctaatgtgataactacctgtttctatttgcagatgagtatgactcttgctgtagctgatggacaccttgttaatatggggaaaatgatagaagaaatggaggggaagctgagaaattcactggaccaagtacagttttgcattgataatgattacgccgaatattaagatatcccaaagttgctgacatcatttgcaacttgccaattccttagccgcatgcataatatcattctattggcaggtttattttgggaagaccagagaaatggtttgcactcttcggccaccaccagaagttcttaatatgagactacctgacagctgagccagtgcatagaagtgtcaacttaacaaagaaaaacgtattcttctccactctaggcgtggtctgttcttgcttcgtagttaatagtctgtgcatctgtatcgacatctgttgaggtatctatgataggagcttattatcttctgatcttttgtgattagctgtaatccgcgaagtgtttgacaggagccagtgtttgcagtggaactcagttaccaacagatgaatctccacaaaacgttgtgttggcgttctgtatcttctgaagaatctgatggtgttgtggctggacttgctatctgtcaaagtactaatgcggtgtttgttttgaggagtcgcctcatatcggccggcgcccttataaggaggggcgg

SEQ ID NO: 17683 - DNA, 2239 bp, Zea mays
gcaatgagcagcaaacagagattagagaggcagcaaagaaagataacagaagagacagacggaaagaacaccggaggcggagagccacaggaggaggagctcgagggacgacgaccagctgaattaggactggagggggcagacgacgtcgtcgtagcggcagcagcaggagaagggaagactcaaacgagggatctccgagagaggagtgtggtaggcaggaagaaagaataaggcgagccgagagccattcgcatggaggcggcgatggatctgatgcggcggatgccgccacggagcgcggagacggcgctcaacgcgctgctctccctcctccccgaccactccctcgacctcctctcccaggtcgacctcccgctccaggtttgcatggataaggagagcctgaaggaatacattctatgcgaatataaccgtgatgctgactcctaccgatctccttggtcaaacaaatatgacccccctttggaagatgggacagttccttctcaagggatgaggaatcttgaggttgaggcaaacgaagttttctcagtgtatcgtgaccagtactatgaaggtggcatctcatctgtttacatttgggaggatgaagataatgggtttatcgcatgcttcttaattaagaaagatggacaaggaaaaagagggtacatgcagattggttcatgggatgctattcatgttgttcaggttggtcctgaagaagaaggagcggcacattactgcttgaacagcactgtgatgctctcattgacaacaaacaacaagcagtctggaactttcaacctgtctggatccattagacggcagatgagtatgactcttgctgtagctgatggacaccttgttaatatggggaaaatgatagaagaaatggaggggaagctgagaaattcactggaccaagtttattttgggaagaccagagaaatggtttgcactcttcggccaccaccagaagttcttaatatgagactacctgacagctgagccagtgcatagaagtgtcaacttaacaaagaaaaacgtattcttctccactctaggcgtggtctgttcttgcttcgtagttaatagtctgtgcatctgtatcgacatctgttgaggtatctatgataggagcttattatcttctgatctcttgtgattagctgtatccgcgaagtgtttgacaggagccagtgtttgcagtggaattcagttaccaacagatgaatctccacaaaacgttgtgttggcgttctgtatcttctgaagaatctgatggtgttgtggctggacttgctatctgtcaaagtactaatgcggtgtttgttttgaggagtcgcctcatatcggataagattgtgcatcctgagtccattttaaaacctggtgtttcttatgcttttacaaattagcttctgagaaatgaagtagtgctggataatttttttctgcttcacaaatcaaataaaaaaaagaggtgcaggaagatcgtggactacatacttcttttcaccggttcgcgccagcccacatgccgtgttcgttctatttcccgcgtcggccgcctggctcttgtgtctttgccagcgccccagtcccatgcaccttgtgatcaaacaaaaccaaagtgtcccgtgcataccttgtgactaaacaaaaccgaactgtcccatgcataagaggggaggcaagcaacgtaccataccagtgttctagactgtgaaagcgacaggatgaacccgttcagttttctcaacaccggatctgaatgtgcggcctatgcaattagaatttgaatctgaatgtgcggcctatgcatttagaatttgagaaaatcttgggagctcttggagacggtacccacagattgggattaagtaatttagggagttctcaattcttttttgttgggagatttttttttgatctcttgaagatgctctaagaaggtgtttttgaatgcatagagctaatatagttagctaaaaaattactagtgaaattagttaactaacaaatagctacctaactattagctaatagatgaacaattagctaagctatttggatgccttcagctaattttagcagctaacaactaaactatttagatattttcagctaattttagcagctaactattagctctagtgtattcaaacactacctaaatttgtttcacgtaagtgagacagaggatgagatacccttgatatgagctgggcct

SEQ ID NO: 17684 - DNA, 1414 bp, Zea mays
attgggtacctcgaggccggccggaataaaaacacgcgccccgcaaagtcgtcctctttcttccgctcgccgacacggcgcaaatccccacaaccccaggccggcggacgggcggactcccacccacctcctcgcgacgacgtgctcggctcgcttccagccacctggctcgccgcccgcctcggaaaccccgctgcgagatccctgtcgcccgggccgggaggatggaggtgaaaacggtaaaagttagcaacctttcattaaatgctttgaaaagagagctcacagagttctttagtttctctggggatatagaatatgttgaaatgcaaagtgaatctgaatggtcacagcttgcttatgtcacatttaaagactcacagggagcagacactgctgttcttctctcgggggcaacaattgttgatcgtgctgtcattataactcttgctgagaacaatcagctgcctcctgaagcacacaaacaattatcgggagcaaacgtctctactgaatcagcagtcaggaaggcagaagatgttgtcagcagcatgttggccaagggatttgtgctcagcaaagatgctctcaacttggcaagatccttcgacgagcgtcacaatatcctatccagtgctactgccactgttgcatctctagaccgccagtatggcctgagtgaaaagatcaatctgggaagggccattgttggcagcaaggtcaaggaggtggatgaccgctaccaggtctcagaactcacaaagtctgccttggctgctgctgagcagaaagccagctttgcaggctctgctatactgagtaaccaatatgtctcagttggtgcctcttggctaacaagtgcattcactttggtaacaaaagcagcaggtgacatgacctccatggccaaagacaaggtagagagagctgaggaggagagaaaggccatcatgtgggaggagaggaatgggctggtgagcgactatgcaaagatccatcttgacgagccctcttcatgggagcccgcagttctgcctttggaatcagtggatgaacagaagctccaggctgtctgatccacaaaaccgaatgccaatcgttgtcacacgtaattcttttgcagctcgccctatatatagatttattctttttcgtcgatgcagtggatcaaaacaaatgcgcttatcagccatagcgccatgtaaatttctgaaagttgctcccgtgttattaccaggttttctcttacttacttcggagaaagagtggcgctaccagcattgctgctctaaactactgtgtgtgtgtgaatggagtactactgtacttgtgtctacttgagtactacagaaacagaatacaacttccttctttagatacagaatgatttaatattgagttgaaccacttgtgc

SEQ ID NO: 17685 - DNA, 1400 bp, Zea mays
cattgggtaccccgccgccagcccgggcgcctcgcaaaaagtcgccctcttcctccactcgccgacacacacggcgcaaatccccacaaccccaagcgggcgggcggacttccacccaccttctcgcgcggcgacgtgctcggctcgcttccagccacctcgctcgccgcccgcctcggaatccccgccgcgagatcttgttccccggaggatggaggtgaaaacagtaaaagttagcaatctttcattaaatgctttgaaaagagagatcacagagttcttcagtttctcaggagatatagaatatgttgaaatgcaaagtgaatctgaatggtcacagcttgcttatgtcacatttaaagactcacagggagcagacactgctgttcttctctcgggggcaacaatcgtggatcgtgctgtcattataactcctgctgagaactatcagctgcctctggaagcacacaaacaattatcgggagcaaacgtctctactgaatcagcagtgaggaaggcagaagatgttgtgagcagcatgctggccaagggcttcgtcctcagcaaagacgctctcaacttggcgagatcatttgacgagcgtcacaacatcctatccaacgccactgccactgttgcatccctagaccgccagtatggcctgagcgaaaagatcagtctcggaagggccattgtcggcagcaaggtcaaggaggtggacgagcggtaccaggtctcagaactcaccaagtccgccttggctgccgccgagcagaaagccagcgtcgcgggctccgctatactgagcaaccagtatgtctcggctggtgcctcgtggctaacaagcgcgttcgatatggtaacgaaggcagcgggcgacatgacctcgatggccaaagataaggtggagagggccgaggaggagaggaaagccatcatgtgggaggagaggagtgggctggtcagcgagtacgcgaagatccatcttgacgagccctcttcgtgggagcccgcggttctgcctctggaatcagtggacgagcagaagctccaagctgtctgacacgcagagaccgagtctctcgcacgaaattcttttttgcagctcgtcctatatatagattgttctttttcgtcggtgcactggatcaaaacaattgcgcttgtcggccagtgccgtgtaaatttctgagagttggtcttgtgttattaccaggttttgttcgtttctttcgttttggagagagtggtgctaccagcactactacactagactactctgtgtgaatggaatactactgtactttgtctcttcttctactactactacagaaacataatataacttccttcgttagattcagattaatacaatggtgacggttgtaagtgtggcaacc

SEQ ID NO: 17686 - DNA, 4116 bp, Zea mays
  misc_feature (2825)..(2825): n is a, c, g, or t
tccagcgatcctccgatgggttctgttatggatcagttcaagatacaaatgcttgtcagtttaggaagggcactgtgggtcatatatagctaaccagtccatgccagacagggggatgggtatccctgataacagacccatacccacctctatacaatctacctccacatccccactcccatccatacaaacagtttgctatgcagatgccacctaatgagccattgaagtggtcaaatgtgaattgtgatcttgggggaatctgtgactattgtgtagtacttgacatgcactgtcttatgtacctagaatattgtcacggactgttgaagtacatagattcaatatcgtttctggaactggtcagtttctgttctttgtccttagctcacatacatcatagttcaaaggaggttgctacactttatgttgcttactgttggcctaaacttatatacttgcattttatttgcaacttttcctgagtttatttatgatttcttaagttttaatagtcaaccatgacaattcgtccattattagaagtgaaggctaaacccaaagttcagagcaagggtgcagaaacatcgagcaaagtagataaacctactaccgataccagtgttgacaaatttgtaaatgatgtgttcgagatcatctccccattgttcttgtctgaggtaatccagtgagcttatctatgatagccttcttttacaacacctgttctttgtgttgataaatattgccatgctgcccatgcaggcattgaagaaattggacattaagaaggaagatctttctttgatcttagaaggcctcaggggacgggcagatccagatttgaagagtatagcggttagtttctcgaatgctatttttagaagacctgctcgaattatttcatgcatgttttacttttacaacacttgttcaaatccttctcctaaaatatgtttaaccatgtatgctgagaaaagggcaacccgaagtagaaagttgtgccttcctcctatagttccttcttcctgtgaattcttccgcaagtaagcttgagttttcagtgatgcaactctgcttaaaatgcaattcaccaacatttagtaataggctaatagcaatatctaattaagtcttgattcacgagagttcatctggaacattcctgatggatcattaccccatgcctacgaattacagaaaattaaaatttaccgtgccacacttgaatggaaatggcctggtctggacaagaaaattttaacctgtctgtaaaacttcttgatgcatttaaacacatagttgtgaacgatgttggtccaatacaaatacaatgatatagaactaaggtgctgtttggtccgtgtaattgtaacgtattccgatttcagctgtaagtgtttccatcttattttgtttggtgccggccgcctgtgtaatcggatacaaagtaatcagatacgggacatatacttttgttaccgctccttcggctctgtaatccgatttcagctatttgactttgttagtgacgtgaaccaaacaaaatccgttttcgcttacgctgaatcaaatcacagtgtcatctgattccattgacgttagtacgttacccctccgtggctggaaccaaacaccacctaattctttggtgatatatgtgcagttgtattttacatttacttctactatatacccaccaataataagcagtgagaagccatttttttttaacacccgggacctgctcgtcaatgtatatgcataactaacgcggatgttttcattgcagatgactctgaagaatgcatcatatacctcagggtttcacgctggttacaaaaccatgcagaatcgtggtctaaacggctgacccacttaggttccagtctctcaattgaatggtttgatacaagaaacaggaatctgattttacatatttgtatgctgttgaatgaagtcaacatattatgtttgatgctctcgttctatctatgacgtattctcttttttttttgtgtgtgtggatttgccttttttctctctgagagatcaatgggaattttcaccataccgtgcagtgttccatagaatatgtatttacaagattctgctactcgctctaccaacatcagagtttcagtgtatcagatacatcacatagaaatgtcttcggcgcgttccagaaaaaaaaaaaaaaatggtgcggcccccaaacagtcgttttacgtgccctttaacgatgtgtaattcactcgcctttacagtgggcgtatttcatttttacatctacgctgattttggcatcaggcttccaccaatcttccatctttgacattgaactgagagaacggcgccatagttacctgtagttcgctgttaggttgctagcacgtcggcattctgaatctggaggaggcgtacatctttggatgcggatcacttaagggtaggaggcatacatctttggatgcgataaagactccacgagaacatctatatgaaaaacagagagcgccaccaagcgtagaatgctgaaagaaatatgagagatgagaaaagaaaacgcaggttgccacaagaacaaaggactggagggccgtcatgtcattaccgccggcgtccgccgcgtcgtgcctgccgcgctgcccgtgctcccacgcgtcgccggggtcgtccatcccgcgcggtggaaacggccaggagaatggcccccattgcaccatcgtcaggggctctctctccatctccctgttcctgttgttgctgccgttgcttccgccgcgaggtgcggcctgactgctgccgttggacccggctctagntagctggtatcggcagaccgggcaggagttgtgcaggcggagccacggcacgatgcaatcggagtggtagacgtgcttgcacggcagctgccgcgcggcctccccgagctcgaagtcctccttgcacacggggcactgcgagccgtccgacaggtgcgccccggcgacccgcaccgtcgggagcgagtcgattgccgacggtggcgccggcgccggccccggcctgtcgttctgcgtgagctcctcgatgaggctgttcaggttcggccccatgaagtagtccccggggtcgatggccgggggcgtggacggccgccgcggcaccggcgccggcggcggggaaggcacgcgccgtcgtcgaaccagcgccggtgcaggagcaggaggcgtggcaggtccctgtgccggcgcaggctggcggaacgcacggcctggtaccgtcgtcggctcctcgccgtatatgacccagcggcgcgggcggccggcgtactggtgctgcgggtggaacgggtgcggaaggaagtgcgccggcgggaacccgtggcgcgccgtcggcgggtcgacctcgtggaggaagcggccgaagcagcgcgggcagaagacgtcggtggacgggcaggagatgatgcggagcgcgcggccgcactggtagcaccagtacgtgcggcacgtccggtggcgcgcgggcgctggcgtcgccgacgacatcagcgggacggtggttaattggttccttgcgtcgggttggctgttggtgcctgcctgcctgcctgcctgagcagctgttgctctcggaagaccgccttcggaattttgcatgagattgagacgacgctggttttaaagcaaatgagggtttgatcgtttgggacgcggaaattgacgcacgggtgggaaaggatggctttgcgggaggaagaaagcgattctgcggcgaggtgtgagatgaggtgagtttgcagggggcgtgctgtgttcggcgacggtgacttgtgcgtggcgccaaagcgcgtgttgcttgccgggcaggaggtggtggagtcggccagccggccaggcgggtaagtggcgcgaagcaggaagtaacggcggacgggggctgctgtgggttcaattcttggagggaaaggcacgaagaaccaagaacaagcgatgggcctggcccgagcaggagttttacgacctagcattttcggtgattttttttgggtttatggactcctcaggtacccctccagtattcgttttagacaaagtttaaattaaatttataaaattttaactataaata

SEQ ID NO: 17687 - DNA, 1482 bp, Zea mays
aagttcagcagtgcaccagagaagtcgtaacagtaacaggtcggatcgggtaacctgctatcgctagcatccgctaaccctagcagtcaaacactagcagaggagaaccgtaggatttggcggacgggcgattgcacgcccgtgacttcgaccccgacgtcccttcccaactcgtccaccgccgccgcccgccgtcgcaaaactcgccagcggccagccatggggtacacgaaggaccagcttctcgcgcacctccagaagcttaagattgatttcacgtgctacgatcacccggttgtgttgacagtggaggaacaggccaaacatgttggccatttaggaggtgctttgagcaaaaatttactcttgaaggacaagaagcatcggttatatgttatttctgcccttgctggcaccaaagttgacatgaaaattctttcccaacgtcttgggttgggaaaaggtggtctacgaatggctcctgaggaaaatcttctagaagtacttcaggtgcccttagggtgtgttactccttttgctttaataaacgagtctgcgagtgctgtttcacttttacttgatcaaggtttcaagtctaaacagagctgctacttccatccactgacaaatgatgtgacaattgctcttagctcaagtaatctggacaagtttctcatctccattgggaagcaaccagcatatgtggacttggaggctgcaccagctgtgggtaaggataatcctcctgatctagcacatttggttccaactggcgtgccaaattcttcagaacaaccagttgagaacacggcacctactaatgttcttaaagagacagaagtgaaggctaaacccaaagttcagagcaagggtgcagaaacatcgagcaaagtagataaacctactatcgataccagtgttgacaaatttgtaaatgacgtgttcgagatcatctccccattgttcttgtctgaggcattgaagaaattggacattaagaaggaagatctttctttgatcttagaaggcctcaggggacgggcagatccagatttgaagagtatagcgatgactctgaagaatgcatcatatacctcagggtttcacgctggttacaaaaccatgcagaatcgtggtctaaacggctgacccacttaggttccagtctctcaattgaatggtttgatacaagaaacaggaatctgattttacatatttgtatgctgttgaatgaagtcaacatattatgtttgatgctctcgttctatctatgacgtattctcttttttttttgtgtgtgtggatttgccttttttctctctgagagatcaatgggaattttcaccataccgtgcagtgttccatagaatatgtatttacaagattctgctactcgctctaccaacatcagagtttcagtgtatcagatacatcacatagaaatgtcttcggtgcgttccagaaaaaaaaaaaaaaaaaaaa

SEQ ID NO: 17688 - DNA, 2161 bp, Zea mays
cctgcataagagaatgtgatacaattttatttggcaaaaactttgctaaagatatataccaggggtattccaagatggttcaacaaagattatgctgactttggggccgatagactcagactcggtccgaggactcgaactcggtcttagggactcggcgaccgggagctcggtccacatgccagacaagattcgccagcctgctatagataagggaagatggtgattcgtgataagaatgatatatttgtaaatgtagcatatcctgaattataagggagtttacatgtaaagatagatataagtattcccatttattggagggggtcagttaggctgatctctacccttatcaagctaacgactagataaactttctataaccaatgacacctccttggactataaaagggggtagtatcgcccatcaagggcagatcatctgatcatattgcataggcaatagacaccgcaacacacaagacgcatagtattatcttacattgatagcccgaacctatctaaatcttcgagtcccttgtgcattttccttaaactcttgatctaccccataaattcactatcgaatatttctcgacaacctttagctttatatcaaattcatacgcctcttatatattttttctagcctcatgcatgcaactagcagtatactatttttcgtccacccagtgcaggtgccaattgcgctgccaaccatttttctgccagcaggtaaactcgtgggcatggcatgtcgaaaacagagctccaattctttgttgtgtgcttgtacccttgtgggcttgtggtagtcactctgctattcatcatgtcttgcgacagtgctgcatgctggtcatcactctcatgtggcatgtggcatacttctgaaacaaatcattgagatggtgtctccaaaaattaatctacgtactcgtcactgtgtgccaagcatgtcattctgaccaccgaagatctcataaagccctaatatcattagagtcaaataatgtctgatagatgagttagcatgtgaatatattgattctaacatgatcagcatgcgattgattcaatgcaagtgcaaggatcataaacattcttccactgtcccacgacttaacccattgtcgtggtggcactgaacgtggtgtccttgggtgacccacttagaaaatttagagtttagtgatgggtttgctcattttatagtgcagtgacctatttgcacatacaagagaagtctggtgacctcggatgcaatttacccgatatattattttgtttcatggtttatttataatttacttcatccagctcttagctcaagggctcggggcaagtttctcatctccattgggaagcaaccagcatatgtggacttggaggctgcaccagctgtgggtaaggataatcctcctgatctagcacatttggttccaactggtgtgccaaattcttcagaacaaccagttgagaacacggcacctactaatgttcttaaagagacagaagtgaaggctaaacccaaagttcagagcaagggtgcagaaacatcgagcaaagtagataaacctactatcgataccagtgttgacaaatttgtaaatgacgtgttcgagatcatctccccattgttcttgtctgaggcattgaagaaattggacattaagaaggaagatctttctttgatcttagaaggcctcaggggacgggcagatccagatttgaagagtatagcgatgactttgaagaatgcatcatatacctcagggtttcacgctggttacaaaaccatgcagaatcgtggtctaaacggctgacccacttaggtcccagtctctcaattgcatggtttgatacaagaaacaggaatctgattttacatatttgtatgctgttgaatgaagtcaacatattatgtttgatgctctcgttctatctatgacgtatgctctttttttgtgtatgtgtggatttgcctttttctctctctgagagatcaatgggaaattttcaccataccgtgcagtgttccatagaatatgtatttacaagattctgctactcgctctaccaacatcagagtttcagtgtatcagatacatcacatagaaatgtcttcggtgcgttccagaaaaaaaaaaaaaaaataaaa

SEQ ID NO: 17689 - DNA, 1896 bp, Zea mays
ttttttttttttttttgctctaccaacatcagagtttcagtgtatcagatacatcacatagaaatgtcttcggtgcgttccagaaattactgttaacatggtatatcatccaaacagtcgttttacgtgccctttaacgatgtgtaattcactcgtctttacagtgggcgtatttcatttttacatctacgctgattttggcatcaggcttccaccaatcttccatctttgacattgaactgagagaacggcgccatagttactgggtaggaggcgtacatctttggatgcgataaggactccacgagaacatctatatgagaaacagagagcgccaccaagcgtagaatgcgccggcgtccgccgcgtcgtgcctgccgcgctgcccgtgctcccacgcgtccccggggtcgtccatcccgcgcggtggaaacagccaggagaatggcccccattgcaccatcgtcaggggctctctctccatctccctgttcctgttgttgccgttgcttccgccgcgaggtgcggcctggctgctgccgttggacccggctctaggtagctggtatcggcagaccgggcaggagttgtgcaggcggagccacggcacgatgcaatcggagtggtagacgtgcttgcacggcagctgccgcgcggcctccccgagctcgaagtcctccttgcacacggggcactgcgagccgtccgacaggtgcgccccggcgacccgcaccgtcgggagcgagtcgattgccgacggtggcgccggcgccggccccggcctgtcgttctgcgtgagctcctcgatgaggctgttcaggttcggccccatgaagtagtccccggggtccatggccgggggcgtggacggccgccgcggcaccggcgccggcggcggggaaggcacgcgccgtcgtccaaccagcgccggtgcaggagcaggaggcgtggcaggtccctgtgccggcgcaggctggcggaacgcacggcctggtaccgtcgtcggctcctcgccgtagatgacccagcggcgcggacggccggcgtactggtgctgcgggtggaacgggtgcggaaggaagtgcgccggcgggaacccgtggcgcgccgtcggcgggtcgacctcctcgtggaggaagcggccgaagcagcgcgggcagaagacgtcggtggacgggcaggagatgatgcggagcgcgcggccgcactggtagcaccagtacgtgcggcacgtccggtggcgcgcgggcgctggcgtcgccgacgacatcagcgggacggtggttaattggttccttgcgtcgggttggctgttggtgcctgcctgcctgcctgcctgagcagctgttgctctcggaagaccgccttcggaatttttcatgagattgagacgacgctggttttaaagcaaatgagggtttgatcgtttgggacgcggaaattgacgcacgggtgggaaaggatggctttgcgggaggaagaaagcgattctgcggcgaggtgtgagatgaggtgagtttgcagggggcgtgctgtgttcggcgacggtgacttgtgcgtggcgccaaagcgcgtgttgcttgccgggcaggaggtggtggagtcggccagccggccaggcgggtaagtggcgcgaagcaggaagtaacggcggacgggggctgctgtgggttcaattcttggagggaaaggcacgaagaaccaagaacaagcgatgggcctggcccgagcaggagttttacgacctagcattttcggtgattttttttgggtttatggactcctcaggtacccctccagtattcgttttagacaaagtttaaattaaatttataaaattttaactataaataactatttgttatttagttttaaaaccctagtatttatatatac

SEQ ID NO: 17690 - DNA, 1642 bp, Zea mays
ttgggtacctcgaggccggccggataacttctcgcaattgatctagtcaccatatccgcggtaagatagtttctaaaaagactttctcatcccctcgccgcccgccgcccgccgcgattcacccccgccaggccgccacgcccgcagcccgccgacgcaaagccgcgcgcgaggcctctcccctgcgtacgcggcgatgaagatcgtccaccgcgacctcgttcgcaacgggcctggctccgtcaagttggtgccggaggaggaggacgacttgtggcacgcgtacaacctcattgccattggtgacagcctccaggccgtcaccgtacggaaagtgctgagagaggtggcatctggaggacgtgatgccgagcgtgtgaagcttaagttagaaattgtagtcgagtctgtagactatgacaaggagggatctgttttacgtgtgcgtggaaaaaatatcactgagaatgaccatgtgaagattggccagttccacacgttagagcttgagctgaagagaccttttgttctacgaaaggaaatttgggattggttagcacttgagaccattcagcaagcatgtgatcctgctgcaagtgctgatctagcagttattctcatgcaagaaggacttgcccacctattcctcattggcaaaagcataacagcaacccgggcacgtattgaaacatcaattcctaggaagcatggccctgcaattgctggctacgagacggccctcaagaagttctttgagtatgttttgcaagcatttctgaaacacattgattttgaagttgtccagtgtactgtaattgcaagcccaggttttacgaaggaccagttccgcgattatttgtttcttgaagctgcacggcgagatttaagagtaataattgagaacaagcaacgccttgttctggcgcatgcaacatcaggttacaagcatagtttaaaggaagttttggatacaccaggtgtgatggcactgataaaagatacaaaagcagcacaggaggtccgagctctgcaggatttcttcaatatgcttactaatgagtcagctcgtgcttgttatggaccgaagcatgttgagtttgcactgcaacagtttgctatccagactcttttaataactgatactttgtttcggaacgctgacattgctacgaggcaaaggtacgtgaagttggttgaagatgtcaagaaaaatagtggcacagtacacatattttcctcgatgcatgtctcgggcgaacagttggcgcaactgacaggaatagcggctatacttcgttttccccttcctgaactagaggacatggagctgtgatgaaaccaacctttttgcttctcgataacattctttttggttgtgatctgttagcatactacctgtatcatgtgtaacgttatggagctatttgatattgtataggcaaccctggaaaggaattctggtattttttaaggtatatcctattcgttgtaaaaaaaaaaaaaaacggcggccgccggttctttttctcattaagtctggttattttttaagtctggttatttttcacatcctaaactatctgcatgtaaagtgaccactgagcgttggagctccagacatcagaactaattttcgtgggcc

SEQ ID NO: 17691 - DNA, 2327 bp, Zea mays
cctccgggccctcgggccggccaaaccattcaccattctaaaaaaaatccccgatcttactacctttctcctcctctctctcacggtctcacctctagtttccaggatgacaaaatatgagatcagattcgattcgtgagcctgtagaacaaggatgctcctccaatccatactaaattgaacccacgcagcagacatccgcgcgcagtacgtccccttcgcgaagcaccgccatcctcaccacgccgccgagtcgggcggcgcatgcgccatggcgttcctattcggcgcattcctgggcctggtggtgggcgtggccgtcgtgatggcgttcgcgcgattcgagaacagccgcgccgagcagcgccgtgagctggctgctacagctgcagctttctcgaagttgactgtacaggatttgaggaagctcatcccacccgagttttatccatcatgggtttcattcacacaaaagcagaagcttaaatggctgaatcaagagctgacaaaaatctggccatttgtcaatgaggctgcatcagagttgatcaaaacttctgtggagcctatttttgagcagtacaagtcattcatcctggcctccctccatttctcaaagttgacacttggtactgttgctcctcagtttactggtgtttcaatcttggagagtgatgattctgccatcatcatggaacttgagttgcaatgggatggcaatcccaatatagtacttgacatccaaacaacacttggaatttctcttcctgtacaggtgaaaaatattggattcacaggagtacttcggctcatatttaaaccgctggtgtctgaattcccctgttttggagctgtttgctgttctttaagggagaagagcaaggtggaatttaccctcaaggttattggtggcgaaatgactgctattccaggaatttctgatgcaattgaggggacaatacgtgatactattgaggatacactgacatggccgaatcgcataattgttcccattgtacctggagactatagtgacttggagttgaaacctactggggtattagaagtaaaactggtggaagctagggacctaaagaacaaggatcttgtgggaaagtcggacccttttgcattgatatacatacgtccattgcatgataaaacaaagaaaagcaaaacaattaacaatgatttgaatcccatctggaatgagcactatgaatttgtggttgaggacatatctacgcagcacttgactgtaaaaatttatgatgatgaaggactccaatcatcagagatcattggctgtgctcgagtagacttagctgatatacagccaggaaaagtgaaggatttatggttagatcttgtgaaggacctggaaattcaacgagacaagaaacctcgtggtcaggttcacctggagctcctctactacccttacgctaagcatgaaggggttcctaatccttttgctaatcagattcaactaacttcattggagaaggttctcaaaaccgagtctaatggatatgatattaatcagaggaaaaatgttattatgagaggagtcctttcggtgacggtcatatctgcagaggagttgccacctatggacattggtggcaaggctgacccatttgtggtcctgtacttaaagaagggagaaaccaaaaagaagacaagggttgtgacagacacgctaaatccaatatggaaccagacatttgatttcatggtagaagatgcactgcatgatttgctcatggtggaagtatgggaccatgatacatttggaaaggattacatagggaggtgcatcttgacactgacgagagttatactcgaaggtgaattccaagatacctttgtcttgcaaggtgccaaatcgggaaaactaaacttgcatttcaagtggacgccacagccaatctatcgtgatcgtgacagggatcagtgagacttgtaaacgaaaaaggccgataaacacttatccccaacgatgctatgtatattagtcgttctgtatttacacaaatcccacggttcttatagccacgtgaccaaaaagagatcaacccaccgacctgtattttctcctttgtgatgcaagtcagcaagtgcatggacctgtatatttgagtcgtgaatgaataggaaatgctgttactatgctgcaagcacatatatgcttagtggtgccgtggtggtggttgcttcaaaaaacaacaaaaatcttccggttgttattatttccataaagaaaaatgtttttcatttcttttttctttaaaaaaaaaaaaaaaaaaaaaaaaaaaaaaaaaaaa

SEQ ID NO: 17692 - DNA, 1692 bp, Zea mays
ttgaaatcggtaactatagcagcgggtcgccgcaatgcgcacggcagccctcttcctcgggaagatttcaaatccccgcggcctcttccatctcctgctcggcacggcactccggctgcccgaaaaatttcgcacatcccagattcccgcccgctctggttcgcgccctcgtctggttcccttgccaacccggtcattcaacgtcgcagccaccccgcgcggctagggctgggactcgaggcctagggtttggctgtaagtttggtaacacgatggcgggggccgcgggggagagcagcggcgagcggcaggggacggtggagcggcggatgctgcggtcgcggtaccacgccgtgaagagcatcatcagcgatgagcgggatgagatgtcgagggcggattcggacaggttcacagccatcatccagcaggtggattgcctacacgagctcgtgcagaggcctagggagcaaatagcggatgcagaagctctgcttggcattacaaacactttggtaacttcggtgaggtcccactcaagtgaaggaatcagcccttctgatttcataacagctttactcaagaagtttgggcagcaagggaatcatgatgatgagtctgtctcattacgatggggtgatcttgggctttctgtttcacatatcttcaggcctgtgcctggatgctgtaccatgcttggtcctatgaatactgaagtaaagcaacggaaagttgtagctgtcggtaggaaacggactgcacggccaacagaaaatacctgtcctgaagagcttgctgagtcttcagaggaagtaaagacagacactgacaggaatgtcttagttatgtttgatatcctcaggcgaaagaagagcgcaaaattggaaaaccttgtgttgaataggctttcatttgcccaaacagttgaaaatgtttttgcactatctttcttagtgaaagatggtagggtggaaataactgtagatgatagcgggcatatagtacggccaaggaatgcacctgctgctagcgctatagcctcaggagaagtctcatacagtcattttgtttttagatttgacttcaaggactggaagcttatgaaagaagttgttacagagggagaagagctgttgccacataggacttcccagagcaatctttgcaacgaagaaaacgaccaaccaaatctggaggcacgtgcgcaaataacgcctatcaggaaactcacccggaaccgaggattggtcttgcaggatcatgtagtcgaggaaactcctgaagagaaccaagcgtctaagcgcaggcgccttttcaggaatcaagattgacctagcaattgcttggcatgagtagtgtaggcaggcaacctggcttgtgttgtatgcaaaaaattgcctgagcctgagtaacgtgtctttcactaggtctgttgtgccatgctgtcttgttcttggcacagctcgtgcttatctgaacttccagttgtgccagcggagtagagctgtaattataaattgtttgaagttctggtcacatcttgcaactacagaatggtgtttgtagggctgagtgtaactagctagcttggctcggtctggtctgggtcattaactcatttattatcatggcaagatgtgcctcgggtcagcttgttaggctgtcatagcttactgaaaaaaaaaaaaaaaa

SEQ ID NO: 17693 - DNA, 5884 bp, Zea mays
  misc_feature (1457)..(1457): n is a, c, g, or t
  misc_feature (2980)..(2981): n is a, c, g, or t
aactggatgtgcactttggattctgttggtctgatctctaaatatctgacctctgattcaattaattcaatgcgcttagtcatacaagtttgtttaaagtgatgtgctttgttgctgattcagtgtggagctgcctgtatataaagcaacacctctgaaaaaaatttgaatatgttgtcgatgatccttgggtttaataagatcatctttaagcttttccataaagcagcacctctgaaaaaactgaactaataaattaagttgtgtcgtatgatccgatatagtgcctttatttatcttatattactatttatttgtgcaggaaaccccaggcgtttcaaagttagagtttcacaacttgcagcgaatttgggttctttttaatttgttgctttagtattgaattaacgtatgatcattgtggtttatggttcgcattggaatttatgtgttgttcgtgcttgatgaattttctccaaaacccccccccccccaatgagaggtgtgtaatatgaactctacctaatgccttgttgctctacaaaatgtcccatatgtattcttctgtactctaatcttgtttgttgttgttggtcatccttatactttcccccactattgcaaggcgatgttgaagttgtcgatcccgggaataaagctgttgcggaaccggtgggagatgtagctgttgcggaacacgaaaggtattatgccaatctgtttttgcttttcctaatatatatgaacatggatgaatcacaagcaacttcctaatatatatgaacacaaatgaagttttgcattatataagttttaatcaagggaatggtccaagggtgcatcactggaataagctcgagaccacaagtgtcatatctcctctaatctttactctctcaggtatatgcatgcttggcattgtcttaatttatttagcacttctaaactaagaataagttaagctcttcatattttgttgtttatcctaatttgtctccattcggcttcatagtctggtgtctatcagaagctactcctttctacttaaaaggtttcagccatggctgtgctgaatttgcaacgggaggttccagttgaatatgttcattgctacaatgaagccgttttgttgtttgttgttcgccgccgtattcggggtctttgcctgcctctatgggctcagggcggacaggggccctacaagatctcctcgggccaaggaatcgttcccctccggcgacctccctcccccctttcgtctcaggcctgccctctcgcaccgcaccagatctttatctggcgagatccacttgttgattttggtcgtatgccagtcaatcgatggaggatgttggaatataatgaccagatctacgcaatccttgccttgttccttccccgcgatggtcgcccagatcctcctcgccaaacctctccttttttgttttcaggccttncactgtatctccatcaaagcgaaggatcagaggctactccgttaggaggagaggtaagccgattgcctttgtatgcgtctgtgctatgctctaggttgggattagttctagccaaaagaaagggaataagggatgctatcaaacgatgtgaaatcatttcccagggttgcctgtatggttgcttctatatgtgcgtataagatgcctgtgcataggcgtgcaggcgcgcccaccaccctgtcacgtatagtcccttgctgaaatagacaaattaggatggcaaaccttaggtccggttttgatttctgaagtactttgctgccatgtcaacaacaaaaacgttctgttgctgattggttcacatcctgcaggaaaggaattgcgagccttgtgttggagaagtcgaagactgagagtatatggtggctccattggtgtccatgttaatggctggcgtgttctagagcaactcggggttgtcgtagagcttagggagacttgccagccttagggagacttgccaaccttgtcatcgcgtaagtttctgtctctgcatggaaatcaacatgtgcctgatgaacaatctattagtttctaaagatttcttgatgctttggtatttttagaaatgaacatttcttataaaacaaactctggattcctctttgactgaatctactaaggcattttagctggttaactgttttaatttatttggttttttccaagtgttctcactcatttgacccgagtcaacacaaattctctttatcttggtgcagccatcggtctcttgagccagaaaaataaattataacatgatttctactttcttctgtttcgtaacgccgagataaactgttgttaatatgtagatcctcattctccatgctgaaccatttgtcctgtttacttatgctgattacaccatagcatttcttctatcatgagtgtgctggatgtataattactttggtcacccaacgccgcttctattgtcttgaaatgtaatgctatagattcatgtccttgatgacaagggactgttaaagaatgaattaacacagaacacaatcatttacacttgacactacttgtgctaagcattcacattggcttctctctttatatacaagaagtgttttacttctattaaggatgtggctgatgcttatctcccaaattctcaattaatagtcaagaatgtaccatgctcaaggatactcatattgattgcaccttgatcatgcaggtaccatgccaacagaatgcttagcttttacgcaccaggtgtgttctctttaggatttgaaattgtcttgtgatttcttttcaatgaacagaattttgatttttttcagactttttttctggatgctaagttgtatatagagtagtttttagtgctcgcatgtgtggttaatcatacaacataggttcttcaagctcatattctggatgcatgctattgttactttgttagcgtgttcatagattttgtgttcagttgtgcaaataaccanntcatagccttatgccatgccacacctgttttagagaaccttgaagatagcttgcctcacttcacagacttgtagatgtccataagcgtaatgttttacccctaagtcgttgtttgtctaaactattttgtgtgctcgctagaaacattctgcagttgtttaactagatgctggtttcttgcaaaagttgtggtctgtgtacatatagaagtcactgatgtttcctatttttcagggtcaatgttatatatttattattaagaattgttcgatgtttacaatcttcctgtttttttactgtcaagcgcgtgacgccatgtgggagcaaagttgggaaaatggatattggcggtggtcgagaggtttgtgtctctgtctcacacttaaccctgtgtgctcctgaatggatttttttgtgtgtttggcgtataacctcccattgtgattattcctaatttcagttgttatcagtagccccatgattatattattgaatttgttgtgttcatgtgtactccaaataatatatcatgatagaaatttaaagcttgtgcagtatgtttcagtcctatggtagttatattttgcaccaaaccatttcaccatttttctttgcttcatgatatgactcccactctcttcggtctttgctaattgtttgacccaaaagtgaccctgtggtttgggtgaacttgtgatgttgttctttgtttcagctttctaatttctgttgtgattggtttggtatgtcattgatgctttcgttattaaacatgctgcttctattttatcttcatctatctgaatgatgtttcctttcgggtcactcttattggaagtctagaaatgccaaaggatgacatatggcttgtcacagctatcctatctggtctgattgaatactgtgcgaagatataagtcacgtaagtgatttaatttataatacccaacaaaaaatcacaacagctggtcttgctgattcatgggagcagtggctatcaatttctgtgagtcagatctttcttggcctcctatcttcgcctcaggcagctgggagtggttttatactcgctgatgacatcaagtcttaggtgcttccattgatcaataactcagggaaatatggagggatcatgatgtggttcaagtactatgatgatcaagatggctacaattcttgagtgaagagtgatgtttaggttgttgcctgtggtgtgtcacaatatctgtgtgttacttgtgtgtatgtgagaaattatgtgactctggagtctggatagtgcaataagtattactcaagtatatgattgaatcttctgtcatactattcaaattatgtcatattgtatcttttaaggtatgtaaacatccacttttagcgatgctaacaaaagaatagaacaacaattagtgttttcatataatgtatttcatcatattgattccgtagcaacgcacggacatataactagttaaatttattaagttgttatcccagctaatttgatctctacatgtagcaagtactttctcactctcgaaaagcccattcgcaccattttttatttcagagccttctcctggcgcgttggcccccctgccgcctagaaaaccaccattttctctctcttcaaaatagtccacaccgcccgaggccctagtcctcgccgctggccccatccccgccgctgccgcctggcatgaaatccccaccgcatagtattatgtgaaacaatttgacacatgttcttatggaagatcatgggaaccttttccttgtatgtgctaagcttttccatccatcaacttgtggcatggaatgacacatgttcttgcggcaaagcatattctatccaatgataaacaccttgcattatggcttcggcagctagcaggcttggctggttgcgattcaaaaactggtgaaggatactttcctgacgtagcagtttcggcggcagatgtgagacttcgtccgacggcgcaagaacaaagggttcgtggatccaaaaactgttttggtaacaaatggccccaccaaagattcaaaaaagatttagcttcctatataataggaatcgctagagatcaatgcttttttactcctaaagctaatttagcaactgagctattatttagagaattactggagttactctaataaaagtgtcaagacatggattcatatagtccggggacgtggttctttagtcacccctagactttagagaccaaactttaatccctaaagtttctatttggtaagtctcatttaattatactgtttgctagttgagggactataagcaactctaatagattagctatttttgttgtggatgttattttacagtgtagtaaaaggtagactccgacaaatgtgttatctgattttgtaaaataaaaatttagcgatcccttgattttggttggccatatatagcaaccttgggtattttttatgtggctttgtaaaatggcaaggttattgtggacctcttcctttttttagggactttctatttttcaaaatggcaaaatactaggatttagctgttaattttagccaagccgttggagttgctctcgaagtgattaaactttagtcactaaagtttagaagttggaaaccaaacacccttaaactttagtccctagaatttttatttggaaggcttcatttagtaatgttgtttggcagcttatgaactaaaagcgattaaactaaagtttaggaggtggaaaccaaaggattgggcatttgagtataactgaaattctggatcaggttttttgggtattcaacagttgatcccaatctcacccgaattttcgagtaccaaaatttcgggtatccgaaatattaggttcaagtattctacaaatacccgatattcgcagcca

SEQ ID NO: 17694 - DNA, 1809 bp, Zea mays
ccggccgggaagcccggcccaaaacactcggccacaaacccatcaaggtcgggcccacgtgaggtccctcgccggcagtagctggccgtggacaacgccacgacgaccccgaccagagccagtccgctccgctccaccccttgctcacctccgcgacccgcaccaatggcgacgcccacggccccatcccacttacccctcgccaccgcctccgcgtccacctccttccccgaccgcttcctccgcacgccgtgcgcgctgcggccccgctcttggccccgcctgcgggcgggctccgtcaaggagtggcgcgagttcgaggacgacgcgggcgccgtcaaggagtggcgggagttcgaggacgccgtcaggaggaaggacctcccccgcgcgctccaattcctgcagtccgtggagcccgcggcggtgcaggtcgcggtccccgtgccgccggggcgggactgggaggtgctcgacgcctgcgtcgacgccgacgacatgcgcctcgtcggccgggcgtaccagttcctcgtcgaccgcggggtcctcgccagcttcggcaagtgcaagaacatcgttctggaagggccaagagaagtgacaccaacggttttgaaggagatgaccggtttggaagctgaaaaacttgcgccgaagaaatggggtctgtcgggaagttcaccgtatgttctcattggatttcttggaggcgtatcctttctactaacacaaggggtcgatctacggcctaaactgagtgctgtattgggattagcagcagccgatgcaatgttgctcggtggtccttgtcttgctcaaatctcatgtttctggcctccgtataaacgtcggatccttgtacacgaagcaggccatcttcttactgcttatctaatgggctgcccgatacgaggagtcattttggatccatttgtggcattgcgaatgggcatccagggccaggcagggactcaattctgggatgaaaagatggaaaaagaactagctgagggccatctatcaagcacagcgtttgacaggtactgcatgattatgttcgccggaattgctgctgaggcacttgtttacggggcgcccacgcgtccggaaaacgacgagaacttattcaggagtctgtgcattctactgaacccaccccctgctgttgcacagatggcgaaccgagctcgatggtccgtcatgcagtcttacaacctcctgaagtggcacaagaaagctcatagagccgcagtcaaggcgctggaagacgggcacagtctcagcgttgtgatcagaaggatagaagaagccatcgcttctgacagcaaataaatatgaccgttgatcctttacatgtgttcttgtcaaccaagctttgttggcagcttccacaggacgcggaagaaggagaactttcttaattcgcgcgaagggttagtgtgtgttggaacatgagtggcgcttttcaaagaaagaaaggcagaagatccttggagctggagggaatagcggagaccacgaccagggcgtctgatggacggactagatcgagtgatacatccgttggagattttaaggaagtcaaaaggccgttgtgaacttgtgattagtgtcgatgccagatatggcagatgtgcatagggagatatgactatatgatgtcttgatgagtatgcagacatgagctattttgcaatggatggataagtaccgttggtacttgaggtacttctattgtttattatttatttatttgcaatcagtttggtaattaaaaaacaaaaagggcggccgtcgactagtgagctc

SEQ ID NO: 17695 - DNA, 1709 bp, Zea mays
ttgggtacctcgaggccggccgggggcagtagctggccgtggacaacgccacgacgaccccgaccagagccagtccgctccgctccaccccttgctcacctccgcgacccgcaccaatggcgacgcccacggccccatcccacttacccctcgccaccgcttccttccccgaccgcttcctccgcacgccgtgcgcgctgcggccccgctcttggccccgcctgcgggcgggctccgtcaaggagtggcgcgagttcgaggacgacgcgggcgccgtcaaggagtggcgggagttcgaggacgccgtcaggaggaaggacctcccccgcgcgctccaattcctgcagtccgtggagcccgcggcggggccaggtcgcggtccccgtgccgccggggcgggaactgggaggtgctcgacgcctgcgtcgacgccgacgacatgcgcctcgtcggccgggcgtaccagttcctcgtcgaccgcggggtcctcgccagcttcgggaagtgcaagaacatcgttctggaagggccaagagaagtgacaccaacggttttgaaggagatgaccggtttggaagctgaaaaacttgcgccgaagaaatggggtctggtcgggaagttcaccgtatgttctcattggatttcttggaggcgtatcctttctactaacacaaaggggtcgatctacggcctaaactgagtgctgtattgggattagcagcagccgatgcaatgttgctcggtggtacttgtcttgctcaaatctcatgtttctggcctccgtataaacgtcggatccttgtacacgaagcaggccatcttcttactgcttatctaatgggctgcccgatacgaggagtcattttggatccatttgtggcattgcgaatgggcatccagggccaggcagggactcaattctgggatgaaaagatggaaaaagaactagctgagggccatctatcaagcacagcgtttgacaggtactgcatgattatgttcgccggaattgctgctgaggcacttgtttacggggaggcagaaggtggagaaaacgacgagaacttattcaggagtctgtgcattctactgaacccaccccctgctgttgcacagatggcgaaccgagctcgatggtccgtcatgcagtcttacaacctcctgaagtggcacaagaaagctcatagagccgcagtcaaggcgctggaagacgggcacagtctcagcgttgtgatcagaaggatagaagaagccatcgcttctgacagcaaataaatatgaccgttgatcctttacatgtgttcttgtcaaccaagctttgttggcagcttccacaggacgcggaagaaggagaactttcttaattcgcgcgaagggttagtgtgtgttggaacatgagtggcgcttttcaaagaaagaaaggcagaagatccttggagctggagggaatagcggagaccacgaccagggcgtctgatggacggactagatcgagtgatacatccgttggagattttaaggaagtcaaaaggccgttgtgaacttgtgattagtgtcgatgccagatatggcagatgtgcatagggagatatgactatatgatgtcttgatgagtatgcagacatgagctattttgcaatggatggataagtaccgttggtacttgaggtaaaaagaaaaaaaaaaaaaaaaaaaagccgacgcggccg

SEQ ID NO: 17696 - DNA, 883 bp, Zea mays
acatctctcgatcgggcatatactcctgacgcctgagtgagatcgagtaggcgagcgagcatatatatataagcgacctagctagctcgtggacggacggtgacggcaatggcgattccaaaggcaacctccatcgttctggctatggtgctaacccttgcgatggtgtccctggtcgcggggactacaggatacgcaactttctacaccccaagctacacaccgtcggcttgctacgggtaccaggacatgggcacgatgatcgcggcggcgagcgatgtcttctggaacggcggcgcggcctgcggcgaccggtacgtggtcagttgcaagggcggcaccaacgagggcgtgccgcacccgtgcaccggccggagcgtcaccgtccagatcgtggacctctgccccgccggttgccagggcaccatcgacctctcgcaggacgccttcgccatcatcgccgacccggacgccggcaaggtcgagatcgaatatcgccggatctaaatttcgcaaggcgccgcggctacgaagcaggagtatttcgtcgaagagtgagggcatatttagattcactccctctaaactttataggtctaaaagttaagagcactttagctcacttttaagttctaaaactctaatatgaggcgaactaaagtttagagccttgtttagagttttggacctaaagtttagagaagagaatacaaacgtgtgcccgcgtcttcacaaaataacaagagctcgaacctcgaagcgatcgaatgtgtgttacccagctatgaatcagtagctagctgcatgttgtacttgtgtggggaaaactgaaataaaagacagtgctcctgttcggtttgcgtcttaaaaaaaaaaaaaaaaa

SEQ ID NO: 17697 - DNA, 1667 bp, Zea mays
attggggtcccccgcgccggccgggggcccacgctaacgccttcgttctaaaaaatctaaccatggcaaccgccgccgccgccgccgccccgcttgacgacgccaaggccaagaatgttatacgccaggtggagttctattttagtgacagcaacctcccccgcgatgggttcctacgcaggactgtcgaggaaagcgaggatggattggtgagcttggctctcatctgttccttctcgcggatgaggtcacacctaggtctcgaaggggatgcgaaaccagaaacagtgccagaggagaccgtgcttgcagttgccgacatcttgcgccgttccacagcgctccgcgtatcagaggatgggaagaaagttggtaggtctaaggagttgtcgaagccagatgaggttatagagcaagtggactccaggacagttgctgcatcaccgcttccttacaatgtaaaactggaggaagtcgaatctttttttgctcagtgtggcaaggtaaatagtgtgaggctacctcgacatgtttctgacaaaaggcatttctgtggcactgctttagttgaattttcagaagaagatgaggcaaaaggcgtttttgagaaaaatctcatttttgctggggcagacctggaaataagaccaaagaaagaatttgatactgaaagagaggcaaagaaagaagcatatgagaagtcacatcctaataagagcagtcatggtgaaggctatccaaaaggtctgattctggccttcaagctgaagaaaactgcagatgatggtgagacaggaaaaagtggtgggggcaaagtagatgacactgaccttactaagaataatggagcttccgatgctacagagaaatccagtgtagagaatgatgagaagatcactgagaataaaggcaatgtgagtgaggagcaggccgatgccgttgaggaattgaaagggctgtctgctggggaaactttacaatctgttcccaaggttgataaaagcccttcaaataaagatcaagatataatctcgagggaggatttaaaagaagaattcactaaatttggcacagtgcggtatgtggacttcagcattggggaagattctggattcattcggtttgaggatcctgcagcagctgacaaggcccgtgcatttgcagccattgcagatgaaggtggtttgactatgaaaggccacatagtcattttggaacctgtgtctggtcaagctgaaaaggattattggagtgcaattcggggcgttcaggagaaatataaagatagccgaaacaacagaggacgggactggaagaacaacagaggcggaaagcagtttggcggtgggaagcggggtcgccacttcgactcccgtgacagggcctccaataaagctcagaaagtttagatgcaggatatagatttaatctccatatataatgaggaaaacattattttgcgcttcttcagtttgcatcgtggaattgtcatttgttttttatgtttattttctctttgtgaatgttggcctgcactttgaagagaaccccgaggcatgctgataatggaaggggcttggctcatggtaggggcttggctccctctatggttgtttaagtatattgtactattactcattagttatactaattctaaaagtcatggt

SEQ ID NO: 17698 - DNA, 1490 bp, Zea mays
  misc_feature (22)..(22): n is a, c, g, or t
cctcgaagccggccgggccggngattcctcggccatccgtacgtctccgccttcggggctttcttcttggtctcgttccttgggctggaaaaaacacctgtggcagcggccgcgctgcttgcctcgccttgctctcggttcgtggggcatggcggcttcgccggcttgtgctccggggctcatctccggccccaccctccctcccctgcccgttgccttccgctgctactgggcccaaaagccctcctccgcgtcgacctcctccaggcgcccgtgccgcaggcggttcgttcccgttgcagctgcctccacccgcacctcctctgcggctgctcggggcctcgacgccgacgacttccgccacccgctcgacaagcagaacactcttctgctgagagcaattccagggctcaacgacgtgggcaaagctttgctaggacccgtctcggagcaagttatggtactccagaacattggaacatcagttctcgtctccccgaaccagcttccagatctccaccaactgctggttgaggctgcgaagctcttgaacaccgaagctcctgacttgtacataaggcagaatcctgttccaaatgcctacaccttagcaatcaacggcaaaaaaccattcattgtcgttcacacaagccttgtggagctgcttactccaagggaattgcaggctgttttggctcatgagctgggtcacctcaagtgcgatcatggtgtttggctcacttttgccaatatactcacaatgggagcatacactgtccctggttttggcatggttgctggcttcctggaagagcagctatacagatggctacgagctgcagagctgacttgtgacagggcagctcttcttgtggtgcaagatccgaaggtagtcatctctgttctgatgaaattggccggaggatgcccatctcttgccgacaagctaaatgtggatgccttcctggagcaagctcgttcgtacgacaaggctgcatcgaacccagttgggtggtacatccggaatgcacaaaccagagagctttcacaccctttgcctgtgatgcgagccagagagatcgatgagtggtcaagaagccaggagtacaagaccgtaatgcaaaaaatgtttcagatggggctgaacagagtatagttagtggcgacacatacgaagaggtctgtacatggaatccatcatgtttctttgcaaggatttagctttagatcatgactgtcctttcctgtatatctgatcatgagtttgtgattttctcctgggtggctgggcaccgttttttttccaggactgtagagtctgtagcttgtgtatggaagggagtgtctgtatatggagaaggctggtgtttctggaaaaaaaacagatacaaacatagacatattgtatatatttgcagttgaatttagtctccttgtatatgataaaaaaaaaaaaaaaaaaaaaaaaaaaaaaaaaaaaaaaaaaaaaa

SEQ ID NO: 17699 - DNA, 2421 bp, Zea mays
cggcacatttttgtccacgcttcatgagagacaaaaacacctgcacttaaattcacatgctgcactgaaggcccgatcactgaggagcgaactgccgtaactcccttctatatatacccccccgcccgggtccggttttcgtcaagctagcagcaccaagttgtcgatcacttgcctgctcttgagctcgatcaagctatcatcagctacagcttccgatcccaactgcaactgtagcagcgacaactgccatggaggcccagaacgtggaggttgctgccctggtgcagaagatcgcggccctccacgccgacatcgccaagctgccgtcgctgagcccgtcccccgacgccaacgcgctgttcaccagcctcgtcatggcctgcgtcccgccaaaccctgtcgacgtgaccaagctcagcccggacgtccaggggatgcgagaggagctcatccgcctctgctccgacgccgagggccacctcgaggcgcactacgccgacatgctcgccgccttcgacaacccgctcgaccacctcggccgctttccctacttcagcaactacatcgacctgagcaagctggagtttgacctccttgtccgctacatcccagggctcgcgccttcccgtgtcgccttcgtcggctccggccccttgccgttcagctcgctcgtgctcgccgcgcgccacctgcccaacacactgttcgacaactacgatcggtgtgccgccgccaacgaccgtgctcggaagctggtccgtgcggacaaggacctgaacgcgcgcatgtccttccacacggtcgacgtcgccaacctcacggacgagctcgccaagtacgacgtggtcttccttgccgcgctagtaggcatggcggctgaggacaaggccaaggtggttgcgcatcttggcaggcacatggcggacggagcggctctcgtcgtgcgcagcgcccacggggctcgcggcttcctctacccgatcgtcgatcctgaggacattcgtcgcggtgggttcgacgtgcttgccgtgtaccacccggacaacgaggtcatcaactccgtcatcatcgcgcgtaaaatggacgcccacaccaaggggcttcagaatggacacgcgcatgcacgcggcacggtgccgatagtgagcccgccgtgcaagtgctgcaagatggaggccaacgcgctccagaagagagaggagatggcgaccacgacagagctgtccatctgatgcaaggaacttttgagcacctatgcgtgcgtggtaacaataatagttacaaatcgctgcttctgaatttctcatgcacttctttattcgatgctatgcattgtgaagtgtttaataagaatgtgttcttcctatgtgatgatatatgccaagttgctagcacttttacgtgtgatgtgacggacatcgtgtgaacagtttgatggatgggttggtttatcatttctcactcatatcaattttgttttatggtaattagttggtctatcttcaaatcatgccttacaaactactccctccgtccaaaagtggcatatatcatctcagattttattgacacagtttaatatcgtacgcgaacaacgcgcgatatgcacgaacgacgcgtggcaatgcacgcgacacgcgcgaaaacaccgcgcgcgacacacgcgaaaacagcacacgtgacgacgcacgacactacgcgaaaagtacgagcgacaacacgtgaacgacgcacaaatcagctcgtggccacgtgcgaaaccgcgctcgcgatactcgagaaaagctaaatagacatcgcatttatattaaacaaatatttgttgaaaacatcccagttggtactaaccacattaacttgtgtcaataaaatcgtaatttaaaaactatacattaattttaattagaatgttgtttaaataaacatcggataaacgattaactggataattaacgaaaacatgcgttgcgacaaaataatattactaacacataaacctatattcctaagttgattttaattattataaaacatatacgaaagatatttcagagtaatatctaatttagatttaatccgaattataatttgagttgaagtcatatttcaaagctcggtaagttacatctacgttacatagaattcgtagcgtctaaattattaatttagaacagaagtggcatgcgagaactaataacatatatcccctctatattaaataagtattaaatcaaagtatttgagttgacgttaatcatattaacacatgtttataaagcgtaaattataaattagttttaattagatttctatttttatatgcgtcgaataaataaataattattaactaaataaaaacatgtgtcgcgatagaataatgtttttaacatgcacacgacattataaggagcgaaccag

SEQ ID NO: 17700 - DNA, 2330 bp, Zea mays
atgagcgaaaattctatatataccctcagtccctgttccagttctcgtcaagctagcagcacgagttgtcgaacacttgcctgctcttgagctcaagctatcatcagctgcgtcttgtgcacagcaacagcttcccaaccgcgcgcaactgtaccagcgaaactaccaactgccatatggaggcccagaacgtggaggttgctgccctggtgaagaagatcgcggacctccacgccgacatcaccaagctgccgtcgctgagcccgtcccccgacgtcaacgcgctattcaccagcctcgtcatggcctgcgtcccgccgagcactgtcgacgtgaccaagctcagcccggactcccagaggatgcgggaggagctcattcgcctctgctccgacgccgagggccacctcgaggcgcactacgccgacatgctggccgccttcgacaacccgctcgaccatctcggccgcttcccatactttagcaactacatcaacctgagcaagctggaatacgacctcttggtccgctacatcccgggtctcgcgccttcccgcgtcgccttcgtcgggtcaggccccttgccgttcagctcgctcgtgctcgccgcccgccacctgcccaacacgacgttcgacaactacgaccggtgcgccgccgccaacgaccgtgcgcggaagctggtccgcgcggacaaggacctgaacgcgcgcatgtccttccacacggtggacgtagccaacctgacggatgacctcggcaagtacgacgtcgtcttccttgccgcgctcgtcggcatggcggccgaggacaaggccaaggtggtcgcgcaccttggcaggcacatggcggacggagcggctctcgtcgtgcggagcgcgcacggggctcgcgggttcctatacccgatcgtggatcccgaggacatccgtcgtggcgggtttgacgttctgacggtgtaccacccggacgatgaggtgatcaactctgtcatcatcgcgcgcaagatcgacgcccatgcaaacacggaggtttctgccctggtgcagaagataaccggcctccacgccgccatcaacaagctgccatcgctgagcccatcccccgacgtcgacgcgctgttcaccgagctcgtcatggcctgcgtcccaccgagccccgtcgacgtgaccaagctcggcacggacgcgcagaggatgcgggaggagctcatccgcctctgctccgatgccgagggccaccttgaggcgcactatgccgacatgctcgccgccttcgacaacccgcttgaccatctcggtcgcttcccttacttcaacaactacgtcaacctgagcaagttggagtacgacctcctggtccgctatgtcccgggcatcgcaccttccagaatcgccttcgtcgggtccggccccctgccgttcagctcgctcgtgctcgcctcccgccacctgccgaacgtgatgttcgacaactacgaccggtgcgccgctgccaacgaccgtgcacggaagctggtccgcgcggacgagggcctgcgcaagcgaatgttcttccacaccgccgacgtcgccaacctcacggacgagctccgcaagtacgacgtggtcttcctggccgcgctcgtcggcatggcggccgaggacaaggccaaggtggttgcgcaccttggcaggcacatggcggatggagcggctctcgtcgtgcggagcgcccacggggctcgagggttcctgtacccgatcgtcgatcctgaggacatccgtcgcggcggcttcgacgtgcttgccgtgtaccacccggacgacgaagtcattaactccgtcatcgtcgcgcgcaagatcaacgcccacgtgaaggggcttcaggatggacacgcgcatgcgcgcggtgcggtgccgatagtgagcccgccatgcaagtgctgcaagatggtggcgaacacgctccaccaaaagagggaggagatggcaacggcgtaggtgtccatctgatgcatggaacttttgaggacccgcgccacgtggtaacaataattacgaatcgctgtttcaatctctcgtgtaactgttgttgtcatgccttgtgtgtaagtttttaataatgacgtgattttcctatgtgatgatatatgcaagttttgccaccactttttatgtgcctcatgtgacagacatcgacgagaacagtgtgcacaatgcacctaaaagaatactactttaggaagggtcaatctaataatttatgtgtaaacggggtcgaaagcaaatagctacctaagttatccctagagcgcctccatcgtgagtgtatctaggagggtcaatggt

SEQ ID NO: 17701 - DNA, 1437 bp, Zea mays
cgcactacgccgacatgctcgccaccttcgacaacccgctcaaccacctcgaccgctttccctacttcagcaactacatcgacctgagcaagctggagttcgacctcctggtccgctacatcccagggctcgcgccttcccgtgtcgccttcgtcgggtctggccccttgccgttcagctcgctcgtgctcgccgcacaccacctgcccaacacactgttcgacaactacgatcggtgcggcgccgccaacgaccgtgcgcggaagctggtccgtgcggacaaggacctgaacgcacgcatgtccttccatacggtcgatgtcgccaacatgacggacgagctcggcaagtacgacgtggtcttccttgccgcgctcgtaggcatggcggccgaggacaaggccaaggtggtggcgcatcttggcaggcacatggctgacggagcggctctcgtcgtgcgcagcgcccacggggctcgtgcctttctctacccgatcgtcgatcctgaggacatccgtcgcggcggcttcgacgtgcttgccgtgtaccacccagacaacgaggtcgtcaactccgtcatcatcgcgcgtaagatggacgcccacgctaaggggcttcagaatggacacgcgcatgcacgcggcacggtgccaatagtgagcccgccgtgcaagtgctgcaaggtggaggccaacaccctccagaagagggaggagatggcgacaatgacggagctgtccatctaatgcaaggaacgtttgaggaattgtgtgtggtaaccgtagttgcaaatcgttgttgcgtctctggatctcccatgtaactgtttgtttgcacttctttatttgatgtcatgcactgtgaagtgtttaataagaatgtgttcttcctatataaaaaaaaaaaaaaaaaatgtgctcatacaaatcgaggggaaacttaaacctgggtttgtgaacataactcactacagtaaacgaggaaatttccgacggctaaaaccgtcggacataagaactaagccgtcagagatacgctatgtccgacggcattaacttatctccgacggttttaagccgtcgtggataatgcgtcggaaatagccttatgtccgacggcggccgtcggacatacgctatgtccgacggccccatcgaaccgtcggagataaggcggcgtaaccgttttacccgccgcctgggcccacagctgttatgtccgacggtttaaagccgtcagacataacacatagcgtatgtccgccggtttaaagccgtcggacataacataccttatgtccgacggcctacactaagccgtcggacataacgtttttcagaaattgcacaaaaatctgaaatttaaaaaatctgacatttgcaaatacaaaacagatttcatacacatatacacattcacattaacaaatatactcac

SEQ ID NO: 17702 - DNA, 3467 bp, Zea mays
  misc_feature (1109)..(1110): n is a, c, g, or t
cgatccgaaagctgcaacatatcgaaggaggcaacaaatccaccaataaccacttgcagaagaaaacccactgatccggaggagaggcgccatttgcaacgaccaaaggaaacaactagaaggaaggtcgaggagttacccgattggtcatggatgcgaaggttccatctattccaaacagcatgttggaactctattccaggggcgaagtttaatccattgaggagcggcgagggacaatccctactcaccggagcctgtggatgcctcggcgcagccaggccggtcctcaggatggacgtggccttcaccccccaccgctagccgccttaaggttgaactctctaatactagtaaggtgcactttctgttgtcatggttattaacaaaccgataacattgttatggcagtgagttaccgagaagtagtagagttacccctctatagccttggggcatgaacatctgcatgataaaaggtaaatcaaatgctaagtcttgttccattccggcttctctttatccttttagtcagtgcttaacgttcctgttgacttgtgcttgtcataatgatatctgaagaattgttgctaccattcttcaatcatgtttttgtaaagttacaaaaccgtcatatgttgttatgtgcaatcttttccaggttgagagaatgacatgaaagtcagcactagcaaattatgtttagtagcacaaggagcatttgtgtaattacaaggatttgccttcaatagagcttgaagtcgctcctcatgatgaagtattctgttcaaatgatgagatacagatgatgaagtattctcttcaaatgatgagatgcagacacggtggcctttaggacaagtagacccaaagagcgtgagcaggaagggccaaagtcctattatactctaatatgactatctgtagttgtagttaaatcgttttatcatacactgcgagttagaactgtttggctttcagaaattgaaatgtatggctgaagtcctttttacaaactttatcttagggctagcatgggaactacatttttctaagtaatttctattttttcaagaaaaataaactaatttctctttaaaaaaataaanntgtctcagaaaaatgggttcttagactagtcgttaacgtggagagaaaatttgagaccagcattttcgatataaactcccattggactttgcaatgtctgatatatgattgtcgggtccagagaaagcttctcaaacggccatcatgcgaactttttatctcgttttgaatggtcctccgtgaaccccagtcaaccacagacaatcgacagacaacgcaccacgctcaccaaccgaaaaccccaagaaaaagaatacagtactccgcacaacagcccatggatctctcaaaatcaaaaggcgatgccttccaggtcgaccgcgagcactccggctagcgcctcgagccccacgccttcaccgccgtcccctccgccagcgacgcggatcatggcgcggacctcctcgtccgccgcgggcatcccggcccagtcgaggtaggccttgaggtcctcgaagccgaccataccgtccccgtcccggtccatgagccggaaggcgccctccatggcggagcggcgcccagcgcctcccgcggcggcggcggccgccgcggcgcggccggccagcaggcgctcgaactcgtcgtactgcacgaagccgtcgcggtcggcgtcggcggccgcgatcatggccgcgaggtcgtcgtcgtcgaaccggtcgccggcggcgggccccgcggcggcgtagaaggacttgaggtcgtcccggctgatccggccgtcccggtccgcgtcaagcacgtcgaacgccggcctcaggtcgccgccagcgccggagaggtcgagccccaggtacctgccggtggggcacatgttcgcggttcgcctgcttcgccgggactcgcgaggagaggacacagtgggaaaactcggggaacagtctggacctctggatcggaaacgtgagccgattctgcggagggtcgcggctaattgcggtgcggcttgtgctgttggcatcgcacgggaggctgacatttataggagcgggaggcgaactctcccgtcatcgaggacgtttgccgtggacacggtgcaggaaatggtgcgtgtgacgcggtgggatcgggtgcttttgtggtgggaccgatgagtccggtgcagcgatgagtggtggacgaggtgttttaggggggacctgtgtgactgggagacggtgacatgtcaacgcgggcaggagatacttttgaattggttggctggcttgagatccgtggtgagcttgcgacgcaaggagcctcagcttgacgggcagctggggtcggcgtgggtttggaccaggacaaactggaagacgtgttgggtgacgtctttgcggccacattcttgcggcgctgggcgtcgctctcccgctgagatcttccgtggcgtcaaccggggattccatttccacctgcccgcgcctgcgcagttctctgagaccgttcccgtgctttcgttgccacgagtttgccgctgtaaactaccaagcaccagcacgttggtatttaaagaaaaaggaaaaaatcgcgtgacagcttttttcgctgaattcaagcttttgtttctgaatctcttcaaagaaaagtcactgcacggaaagaaaagtccggattcccagttttcgtggaggtggaacctgttgctccaataccgacggtagagaaaaaaagatttctttatatttttcacggtttcgacaatgacgaaatgctctagattaccagtcgcccaaactcttacgaatggcgagtgcctggcgtgcatattttactggacgagaaggacgcgacgtggcaacgtgggcacttggcaccggcggaccatgtgccgtggctcgtgtgatgaaaggctcgccatttgcttggagctagcgggagagcggcagacaggcagaccatatacaacagtcaagtcacacacatacatcagctacgagacaacagccagactggtccaaatcgatatggtacgacgctagtattgtcacggcctggctcactttctaggacggcggtcgatcaaatgtcacatggctctggcactgagcggtaaccggaggttcatgagcagctacgtggagcacgcctggtcagtgatttagggagggcactagcctggtaatggtattccgaccatgcaaaaacagaaattaacctagcaaaaattaaatttaactagactcataaacagtagtatcaaaaaactattttaaaataaaatgttttaaatttaactagattcatgaacagcagtatcaaaaaaaatatcgtaatgaatctagacgtttttatgcttgtttttaatactcacaataatatctcatacatatatacaaaccatattggtcatgaccaaatttgtactaaatctaaca

SEQ ID NO: 17703 - DNA, 3685 bp, Zea mays
  misc_feature (3372)..(3372): n is a, c, g, or t
  misc_feature (3409)..(3409): n is a, c, g, or t
  misc_feature (3459)..(3459): n is a, c, g, or t
  misc_feature (3477)..(3477): n is a, c, g, or t
catactatgaaccatcaaaggaaaatcaagaagaatcaaaatggtttggtttgttctaaatctatgaaccgaagtgttctgtcgtaaactcaagggcggagctaggtagtagctagattgttgcacccccctaaaaatgtgaaaacaatgtctttcaccaaaagtccaccatatatgcactcatgaggcaattatactcaacactacttcgctactggagcatgaaacaattagcttgttttgttgtacatttctgaaggttcaacttcattttgtatggttacctagattaggtgtgattcttcattgtaattattgttttgtctaccatgtatataaaacatatgtatcgactcttgaggttggcagaatgcaccacaaacgacaacaatagtgaaccacttatataaagttgtgagtttattattgttaaaaaatgctaggaagattgtctctaatgtttggtttgtgctttgtttgctaatacttttgactacttgatgctatgtacattttatcatatgcaacttgacatatggccatcttttcagttactaaagactattctaaagggtatgctaactgaagttattgactttgtgcaacagacgtggaagttccaagccacaaatatttgcccataggattcaattcgtacctgatatatcgatcaaatctaaaagattgtatggaccacccgtgtcctagaactcaaggaacggctttgtgcacgctccgtctgtttggtttgcgaatctggagagcctggccagatccaactgttgttggactgatctcttcatcaagatggtccaacaacttcttttaaaatgagacagaatgccccactgaccatttcaaagtggtttgttgggtgtttttgcagaagtcgcagtggagcccacatattatttgatctctttctcttatataaaaatcatagcttttctatatgaagttgtattaaatataaattttatatagatatgtagagtttgacattatccacaactttatagctgatagtttttttatttaatatattttagagactcaaatatgcgtttaagttaccaaatttaatataaaaatatttttttaaatagcctcaaatgttgacatagtttataccttgtactcgataactttttttgatctaagggagacctaaatattcttttaaagtttttatatttttctaatttattttttgttatttttttcacacgacctctgatgttgacttggtatacaccaaagttatatctctcaacataatctataattttctaattggcaaatttttattaaagaccatttatagatctatttttatgtttgaattctttttaaagaatttaaaataaataattagacctataaataaatttagatataatattatcaactacaaaggtatagtatatattgattgttgcagctatgtgacgtagaccatgtcaacgttagagagaaaaagacaagatactggtttgctctacttctttgttgtgattgagggagcagttttcttgattaagttttttttaaaaaaaaacttgtattttgattttaatagttctatcattagttataaagaaagaagattaattattctccggtggagatcgtgcccgaccccgaccaaggtcatgatatggacgttgcaagcccacttcacgaggggacaaaaaagaaacagggttaccactttcatcagttaaagggcgtgacatggacgtgttgaagatccagcacattcccacgtcatggtactaacgaggcatgaaactggccacatggccatggacgcgtgaagcgcgccatgcattggacatgctgcatccgaacttctgaagatcagatcagagagacactgatgagcgaactgccgtaacattctattctatatataccctcagtccctgttcccccgggctgcaggaattcggcacgaggttgtcgaaccttgcctgctcttgagctcgatcaagctatcatcagctgcgtcttgcgcacagcaacagcttcccaactgcaaccgtagcaaccacaacttccatggaggcacagaacggggaggttgctgccctggtgcagaagatcgcgggcctccacgccgccatcgccaagctgccgtcgctgagcccgtcccccgacgtcaacgcgctgttcaccagcctcgtcatggcctgcgtcccgccgagccctgtcgacgtgaccaagctcagcccagatggccagaggatgcgggaggagctcatccgcctctgctccgacgccgagggccacctcgaggcgcactacgccgacatgcttgccgcgttcgacaacccgctcgaccacctcggccgctttccctacttcagcaactacatcgacctgagcaagctggagttcgacctcctggtccgctacatcccagggctcgcgccttcccgtgtcgccttcgtcgggtccggtcccttgccgttcagctcgctcgtgctcgccgcacgccacctgcccaacacactgttcgacaactacgatcggtgcggcgccgccaacgaccgtgcgcgaaagctggtccatgcggacaaggacctgaacgcacgcatgtccttccatacggtcgatgtcgccacatgacggacgagctccgcaagtacgacgtggtcttcctggccgcgctcgtcggcatggcggccgaggacaaggccaaggtggttgcgcaccttggcagacacatggtggatggagcggctctcgtcgtgcggagcgcccacggggctcgagggttcctgtacccgatcgtcgatcctgaggacatccgtcgcggtggcttcgacgtgcttgccgtgtaccacccggacgacgaagtcattaactccgtcatcgtcgcgcgcaagatcaacgcccacgtgaaggggcttcaggatggacacgcgcatgcgcgcggtgcggtgccgatagtgagcccgccatgcaagtgctgcaagatggtggcgaacacgctccaccaaaagagggaggagatggcaacggcgtaggtgtccatctgatgcatggaacttttgaggacccgcgccacgtggtaacaataattacgaatcgctgtttcaatctctcgtgtaactgttgttgtcatgccttgtgtgtaagtttttaataatgacgtgattttcctatgtgatgatgtattcaagttttgtcattactttagattatcctttggcgtgggtaattgactaatcccgccccccccaacgaaaaactgcgttagacgcccgggtggcgcgtatttttctattccggctcgccggcgggattttgtgtgcctttgttttgttgttgattatagaaaaatctacgaacatacttttcgcccgnttttatttcggcggctttgtgagttgatataggaaantctcgcagaaagctgcttctagccatctgcgcgccgacttcgtgtcgcgnttttttttttcgcgcggnctgttggggcccgtggcgtcgataaggattatcctctgttcgtctgtcttgcccgctatttatttgctccgacacgattcgtgatccggcgacccatcaccttattttattcccccaatggtattatcggccgcatttacacgggtgacacatacaattctagtccgacgcggcgttgtcctctccctccccccccacgcactaggtg

SEQ ID NO: 17704 - DNA, 3302 bp, Zea mays
  misc_feature (1950)..(1950): n is a, c, g, or t
ttaaagggcgtgacatggacgtgttgaagatccggcacattccctgcgaaatgtacacgtcatggtactaacgaggcatgaaactggccacatggccatggacgcgtgaagcgcgccatgcattggacatgctgcatccgaacttctgaagatcagatcacagagacactgatgagcgaactgccgtaacattctatatataccctcagtccttgttccagttcccgtccagcccgccgcgccaagttgtcgaacacttgcctgctcttgagctcgatcaagctatcatcagctgcgtcttgcgcacagcaacagcttcccaactgcaaccgtagcagccacaacttccatggaggcacagaacgtggaggttgctgccctggtgcagaagatcgcggccctccacgccgccatcgccaagctgccgtcgctgagcccgtcccccgacgtcaacgcgctgttcaccagcctcgtcatggcctgcgtcccgccgagccctgtcgacgtgaccaagctcagcccagacggccagaggatgcgggaggagctcatccgcctctgctccgatgccgagggccacctcgaggcgcactacgccgacatgcttgccgccttcgacaacccgctcgatcacctcggccgctttccatacttcagcaactacatcgacctgagcaagctggagttcgacctcctggtccgctacatcctagggctcgcaccttcccgtgtcgccttcgttgggtccggtcccttaccgttcagctcgctcgtgctcgccgcacgccacctgcccaacacactgttcgacaactacgatcggtgcggcgccgctaacgaccgtgcgcggaagctggtccgtgcggacaaggacctgaacgcacgcatgtccttccatacggtcgatgtcgccaacatgacggacgagctcgacaagtacgacgtggtcttccttgccgcgctcgtaggcatggcggccgaggacaaggctaaggtggtggcgcatcttggcaggcacatgactgatggagcggctctcgtcgtgcgcagcgcccacggggctcgcgccttcctctacccgatcgtcgatcctgaggacatccgtcgcggcgggttcgacgtgcttgccgtgtaccacccggacaacgaggtcgtcaactccgtcatcatcgcgcgtaagatggacgcccacgccaaggggcttcagaatggacacgcgcatgcacgcggcacggtgccgatagtgagcccgccgtgcaagtgctgcaagatggaggccaatacgctccagaagaggcaggagatgacgaccacgaccgagttgtccatctgatgtaaggaacttttgaggacctgcgcatggtaacaatagttacaaatcgttgttgcgtgacttgtgtctctggctctcccgtgttcctggccgtccgctcttctgtatttgatgtcatgtgttgtgaagtgtttaataagaacgtgttcttcctatgtgatgattatgccatgttgccagcactttttacatgactgatgtgccaactaagtttgaggaaggggtggatttatcatcttctcagtcatatcaattttgttttacaggaattagttggtccatcttcaaaacatgccttacaaactactccctttgttcaaaaatggtaaatgtattctcgtcagaaggacactctgctcataattataatgctccaccactaaaactccaaaaagtccattgcccaagcatactactcattttgctttcaatgcacgttacataataagaaaatatgcaagtggcgaagtcaagattatgtccttagttccaccaaacaagaatatgcctaagaagattttaagttgcaaaattttgctttagaagcttgtatagtttcatcaagttttgttgcctaaacatgatttgcatttgaactttttctaccttcgttgctntctgctcttcattttcacgatagacaaccgctttcacttctcctgtgcaaaccattctaggatacatagatgtatcaggtaatgtaaacccaattgcattgtgaaacaacgctcctccttcttgtggtcttaaggtagtaatcgaggagtaagatccacatctaaacttgtagacaagcagaacctctgcctcatcatatccttaacttcaaatctatccaataggactgccgtttacagaagggcttgcagatgctccttctctttctccttctgctttgactctagccaatgagatctagatccatagaaccactcattgaattgacacttccagtattcgtgctgcatcagaagatacataagtatttttgtatgtaccaatactgattttaaaagaaaaaaggtgcatttacttatgtcggtgttttgacccgatggtcctaaccaactagtaaatttgtgttgcgtgtctttgtctcggatagttgatgcaagaagacacataagatttatcctggttcgggcaagagaagactctacttccagggaagggagacttgtattatctcgcacctaagtgctcatagtagaggatacaagtagtcaagagagggagtgaatccctagcctctgagtatgattgaggcgagcaccaatatcaggagtgaggtgagtcgtgagccgtgaagtccccatagaaggccccgggctcctccttttatagtcgcaaggaggaggcccaggagtacatggttgttatgttgttgttgtggtcagaggagatgtgtccgagcccagtagcggcatggtcgatgggatcgccctcgtccttgtgtcgtcttttggtcaggagaagcacgcccgatccctatagcatgttcctttgacttggtagagagccaaggctgggttcgggggcatgggcagacgcccgaaccctagcttgtacagggtgcggatgagacattttccaagtgtgtcgagtcggagtggttgaaatagtgcttggcatggtcttttgtgaggttcgcgggagagtaggtggcaattaatgcgcgtgctctcctactgggcagttggctgaggtcgagctcgggtgaggtgaagatttctctggaggcagaggccgagattagatgttacatgtagtcacgctcagagtggttgaaacagaggtcagaatgggggaacgatgccccatattcgcgccctgaccgtcgtagtgggcggtaaaggtagattagaccgtagtcgtgttgtcctttgttgactttggcacctttagcggggcaggtgaacgtacagacgcaaagagtggctggccaatgtggggcaccttccggagcaaa

SEQ ID NO: 17705 - DNA, 659 bp, Zea mays
tcgccgtggtgccgcgcggcggtggggagcggggcgggggtgccgcatgaactgatggatcatgccacctccgctggtcggatattaccggggtcatgcactgcacaagacaacgatgcaacaaatcctatgtcgcttgtcatcatggttgcacttccctaatccggtttgatcccgacggaggtttgcacactagaagcgtcctttttctcgattttgatgagaaacatgttggcaggaaaaaaacatcggcccttgccttgtttgtgcatgccatcgatatccatgcatgcatatgagagagacttgcaaaatggacgatcttacaggagaccgaagatggagcccttgatgatgccgttgacgcttgagatggtggcgactcaacattcttgcactcgccagttcttgcgtccggacggcagtaccggggatacactcctatttctactctcaatggagcatctacttctctctgtttttttttttttttgcgagcaaaagtgctgataacgtgttgtaactcagtggtaaacaagtgaacagagggatagagaaatgacagcccatcttctttattgcagaggggaaaaaaaaaaaaaaaaaaaaaaaaaaaaaaaaaaaaaaaagggtaaaaaaaaaaaaaaaaaggcccccta

SEQ ID NO: 17706 - DNA, 1257 bp, Zea mays
tgggtacctcgaggccggccgggccggggatagcaacttcgccgtcgccggctcttctgcttctacgtactctactcccctccccgtctctctccggcctccgaccggctcataaatgggccccgcgacggcggccgggccggcggacgcgcgttagcagagctcaagtacctgcgccggccagctatagacaagaggcggcttggagaggcaggcaccatcatccatggcgccctccggtgacaccattgccctcgtccacagcggcatggacagcagcaacaagacgctgctcaagagcgaggccctctacaagtatgtcctcgacacgtcggtgctgccgcacgagccagagtgcatgcgtgagctgcgcctcgtgaccgacaagcacgagtgggggttcatgcagtcgtcgcccgacgaggcgcagctgctgcggatgctcatcaagctcaccggcgcgcgccgcaccctggaggtgggcgtgtacacgggctactcgctgctggccacggcgctggcgctccccgacgacggcaaggtcatcgccttcgacgtgaaccgcgactactacgacatcggccgccccttcatcgagcgcgccggcgtggcgggcaaggtcgacttccgcgagggccccgcgctgggcaacctggacgagctcctcgccgacgaggccaacctcggcgccttcgacttcgccttcgtcgacgccgacaagcccaactacgtcaattaccacgagcagctgctccgcctggtgcgcgtcggcggcaccatcgtgtacgacaacacgctctggtgcgggaccgtggccatgccgccggagacgcccatgtcggacatcgacaggaggttctcggccgccatcagggacctcaacgttcgcctctccgcggacgagcgcgttgaggtctgccagctcgccatcgccgacggcgtcaccatctgccgccgcctcgtctgatggagtcagtgcgtgcccagggcatgcatgcatggctcgcgtgtggatattccgtcgaccagttctccatccgatccgtttgttgttgcatgatgctttcaataaagatctgttttcctttccttcgttctgttttcttttttcacttttggagttgggagcgtcaggtcgacagatgctgtgctcatttatgttacctggtttggaacaactacaccacattaaggccttatttggttattcacaatacacatgattggatgaaattagaaaaaattaagaagaatttt

SEQ ID NO: 17707 - DNA, 6481 bp, Zea mays
  misc_feature (411)..(411): n is a, c, g, or t
  misc_feature (5269)..(5269): n is a, c, g, or t
  misc_feature (5593)..(5593): n is a, c, g, or t
cacaaatcattataaatgcttggtacgtgtttgaaaaactatctcgtttaaataagatctacatatgtaaatctgtagcaatacatgacacctcattgatactgacctcgaaagacttaaaaaaaccgaaccacttctctctttaaatacagataaacatggttagtgagtgtcggcctgagtatttaaatccgaacaaaaggctagtatgatttaagaatggcggcggagcgaatgaagtgatagtcaacttcgccgtcgccggctcttctgcttctacgtactctactcccctccccgtctctctccggcctccgaccggctcataaatagacggtgtcaccgcttccaggccggacgaaggaccttagcagagctcaagtacctgcgccggccagctatagacaagangcggcttggagaggcaggcaccatcatccatggcgccctccggtgacaccattgccctcgtccacagcggcatggacagcagcaacaagacgctgctcaagagcgaggccctctacaaggtatacgtacacacgtgcaacttttttttccatttcaaaattttgccttgtctagtttgccatggactctttatttctctactttttattgctagttttagtgtattattttaaatacggaggacttttgtgtgtgtgtgtgtgttgcagtatgtcctcgacacgtcggtgctgccgcacgagccagagtgcatgcgtgagctgcgcctcgtgaccgacaagcacgagtgggggttcatgcagtcgtcgcccgacgaggcgcagctgctgcggatgctgatcaagctcaccggcgcccgccgcaccctggaggtgggcgtgtacacgggctactcgctgctggccacggcgctggcgctccccgacgacggcaaggtcatcgccttcgacgtgaaccgcgactactacgacatcggccgccccttcatcgagcgcgccggcgtggcgggcaaggtcgacttccgcgagggccccgcgctgggcaacctggacgagctcctcgccgacgaggccaacctcggcgccttcgacttcgccttcgtcgacgccgacaagcccaactacgtcaattaccacgagcagctgctccgcctggtgcgcgtcggcggcaccatcgtgtacgacaacacgctctggtgcgggaccgtggccatgccgccggagacgcccatgtcggacatcgacaggaggttctcggccgccatcagggacctcaacgttcgcctctccgcggacgagcgcgttgaggtctgccagctcgccatcgccgacggcgtcaccatctgccgccgcctcgtctgatggagtcagtgcgtgcccagggcatgcatgcatggctcgcgtgtggatattccgtcgaccagttctccatccgatccgtttgttgttgcatgatgctttcaataaagatctgttttcctttccttcgttctgttttcttttttcacttttggagttgggagcgtcaggtcgacagatgctgtgctcatttatgttacctggtttggaacaactacaccacattaaggccttatttggttattcacaatacacatgattggatgaaattagaaaaaattaagaagaattttgacttgtttgggattcaaaccgatccagtcccactcaattcacacggattaagagctaaccgaaaagccctaaagtgtctatgtttgtaagatcctactttgagttgtatgtatacaccctcgtcttaaaagtattgtgctcatgcttataatttgcaaagtttgttgaaagacaagccatagttttagagaaaaagtctttggggttccgtttggattcttggaattgaatttcattctaataacctaatttaggcataaatcaattaagctaatattttttttatacaaaaattatttgtataatggtgttggtcttatgtgggagttgtttatatgctatatttttactatagagaagcgagtcgggaagcgtgttatgagttgcgcagtagaatcataacctattgatacataaaatcaattttcgcccatcgtcctataaatttaggattgacatatatcaaactaaataacctactctattaagtaaatttccaatttcttcaaaaatgaaaggattacaaagcattacattcataatctcctagagtaatttagtgtctcataatctcctcgcgagctatcttcaatgtgtcccaaatttttttaggcattgtcgaaaccacttactttcttgtactcctccatgcataaagaagctaacaacacaagtgaacagagagagcttgggaagaagcaaaatcgcaagaaattaaaaagacaagtgaaactaaaatatagaagggtgactaagggaaccaaaggttataatatatgaaactaacaacgtgctacaagttcacaaacggtggtacaatattcgttataatatggttccctgtgacagatatcgccgtatgtacagactgtacacacccacccacgacgggacggtggttcgccatgtagtagttgaacccaggagaaaagaaaagaaaaaaaaaactaacgcgagctccagacgtgtcgtcagccatcatccatcaccgcccggccggtggcagacagcaaacgactaacatgcgattggtgaaattatattatgaagtcgtgcgcccaacccaacccaaccaaaccagcgcacgacgacgggccccgacgcggcaggtggcgttccgttccgttccgttccgttccgttggcggaaggttcagggcaggttcagttattcaggcatcaacgggctccatggaatccaactcaattttccgtcccaggggggttaagttggtgagtgcctccggcgcgtaaagtctacggcagtttgctttgctttattaaaaacgaaaaaaaataaataaaagagcaatcaagcaaacgctagtgccgctgtcacctaccctctgctcgtcatatttaaatacagcagcagcagatggccgaacgaacgaagccacaagcagcgccgcgagccacagctagcaccaccaccttgcaccgcacccgcaccgagacgaacagatcgaccatggctgccggcggcgacgacaccaccatcgcgcaggtccacagcggcatcgacagcagcaacaagacgctgctcaagagcgaggccctctacaaggtccgtccgtattcatgcatgcatatgcctgcctgcctgccgctaatctaatctaatctaatctcccccgcgtccggtgggatgaacaacaacagtacgtgctggacacgtcggtgctgccgcacgagccggagagcatgcgtgagctgcggctggtgaccgacaagcacgagtgggggttcatgcagtcgtccccggacgaggcgtcgctgctgcggatgctgatcaagctgagcggcgcgcggcggacgctggaggtgggcgtgttcacgggctactcgctgctggcgacggctctggcgctgcccgccgacggcaaggtcatcgcattcgacgtgagccgcgagtactacgacatcggccgccccttcatcgagcgcgccggggtggcgggcaaggtggacttccgggagggcccggcgctggagcagctggacgagctcctcgccgacccggccaaccacggcgccttcgacttcgccttcgtcgacgccgacaagcctaactacgtccggtaccacgagcagctgctccgcctggtgcgcgtcgggggtaccgtcgtgtacgacaacacgctgtgggccggtactgtggcgcttccccccgacgcgccgctcagcgacctcgaccgcaggttctccgccgccatcagggaactcaacgtccggctttctcaggatccccgcgtcgaggtctgccagctcgccatcgccgacggcgtcaccatctgccgccgcgtcgtctgatgtgatgatgatccgacgaccaagatcatatatcattcgctcgtcgtctctgtcatctttcaactgcctgcccgccgctgtccgctgccgtcgtcaattaataatgcatggttcttgttctttttttttttgtacttgcactgtgtgtgttgagttgaacatccggcgatgtactgcaacaactggaatgcaatgcaacatcatgcgtgcagctgtaactaaaaaaaaaaaaaaaggtgacgtccatgcatggaccgaggcggttatattaggtgtcgatcatccatgagtgaccgaggcggttaggtgtcgatccatgagtgacggagagtggcggccggcggcgaggccatgattggcgcgtcgtcgggtaggggaagggatgggcttgcactgtagtctgcggggagataagcctcctcggtcggtcgggatggcgggcgtgtcgttgtcgtctcgtccgccagcccggcacggagggcaggaggtggaagcaaagaatcacagtcgtcgtcgcccgtaccctacccatggagacatgcatgcatatcctcagagagaccacctcaggaggataacataaacataatagtagtagcgcattacgtgccactcactcgatcggggcccgagatgataatataacctactcctccttcctgacactaacctctgctgcctgctccgatccggatggtgatgcagcgtgcaagcatggtgtgccgagacgacgtcagtcggacgcgtgcgtgtcatcgcccagccgctaacatcccatcgatcaaaaccacctgcactagaaccagcctcccctaagagcttctactagtactagtaaacgaacactagaataagtccaccaaaaatttgagtaattcctcaagctaggcagtcgtaggcaccagaatgacctcgtcaaccttctgccagcgtgtaaatgtgaacggttctcaaaagttgcgaggttagatttttttttagttttgtagataaaaatatgacaaatcgaacgaccgcaaacagtacagcgacatagttcgtcaaatagatagttcgtcaaatagatagattgagcgtgataaatcatcgaacgacggcaacaccacgacagccgaacctcgggcaccgcagcatcgtcggcggcacgccacggccgacgagcacagctggtggcgtgaaaaaatttgttattttagcccttctaacatgagctccctgctattatgtgaccctctgtttataacttgtggactatttatatctatgatttgtaggtctgatgataaaatagagaagtccacaatgacggcatcggctcatccaaccgaacgcctncaccatccgctcggcatcggctcatccatgtcgtcgccctcgccaaatcggcatggcggcccaaactattccaccaacacacccagcacagaaggccaacagtaacatgggctgtcgcaacaatctgtatattagcaggccactagaatcacagccggtgtggcatggcatgtacaggtgcatcgacggcaccaagctcgccactgtctgtctcccacctccagccacggggtcagcactcagcagtactcaagtacgtacagaacgactccagccattcggacaccaaccagcaccatctatctctctctctctcgcgcgcgnctggccaagaaacaagggtggtgcttggcgaccgccgcagcattcaccaatcaaaaaggcgccacccggcccgggccccgccagcagagtacggccaaatggaggcactacaaaaaaggggcggcatgaaaagggaagcagcagccaacagggggcgccgccggtcttctcttccatttcggtgttaggtgagagtcggcggcgtcggcttcggcggcggcggcagcgaggtcaaaaatggctccggctggctggtggcagagagtcgcgtcagcttcacggtcggttggtcggtcggttaatgtcgacgacatggttcggggtcccgtgctgttgacctccatgtcctatcaacagaacatcctcctctgcgacgtacacagggagggagagcagggtcgtgttgttcaagctcattagcagaactaccgaaaccggcgggcgaaattcattccagcagaccattggaagagggcggaggacattgaatcggcgaactgttgtgtaccttggctctaggcagctcctgcacagactccagagccacctcctccaccagcgccttctgcttcgccacggtcgcgttcagcactcttttggtcctctcgaggtcagcctcaacagaccggatccgctcgaacgagctcagcagaacgcgctctttgtcctccgggatctgcgcaggcctggtggcaaggtggccgcacagcgactcgagactgtccaggcgctgcaggcaggcgcgcacctcttcttcgctgacggctcggggcggctttggcttctctgctgctggtggtggggcagtgcgacggaccttctctagcctactctcggcggctctggaaaggaacagccggatgaaggagaagagcctcgtgccgaatt

SEQ ID NO: 17708 - DNA, 1313 bp, Zea mays
ccacgcgtccccggacgcgggggtttaaatacagcagcagcagatggccgaacgaacgaagccacaagcagcgccgcgagccacagctagcaccaccaccttgcaccgcacccgcaccgagacgaacagatcgaccatggctgccggcggcgacgacaccaccatcgcgcaggtccacagcggcatcgacagcagcaacaagacgctgctcaagagcgaggccctctacaagtacgtgctggacacgtcggtgctgccgcacgagccggagagcatgcgtgagctgcggctggtgaccgacaagcacgagtgggggttcatgcagtcgtccccggacgaggcgtcgctgctgcggatgctgaaacgaagccacaagcagcgccgcaccctggaggtgggcgtgttcacgggctactcgctgctggccacggcgctggcgctgcccgccgacggcaaggtcatcgcattcgacgtgagccgcgagtactacgacatcggcaggcccttcatcgagcgcgccggggtggcgggcaaggtggacttccgggagggccccgcgctggagcagctggacgagctcctcgccgacccggccaaccacggcgccttcgacttcgcgttcgtcgacgccgacaagcctaactacgtccggtaccacgagcagctgctccgcctggtgcgcgtcgggggtaccgtcgtgtatgacaacacgctgtgggcgggtactgtggcgcttccccccgacgcgccgctcagcgacctcgaccgcaggttctccgccgccatcagggaactcaacgtccggctttctcaggatccccgcgtcgaggtctgccagctcgccatcgccgacggcgtcaccatctgccgccgcgtcgtctgatgtgatgatgatccgacgaccaagatcgtatatcattcgctcgtcgtctctgtcatctttcaactgcctgcccgctgccgtcgtcaactaataatgcatggttctgctggttctttttttttattttcttttgtgcttgcattgtgtgtgttgagttgaacatcccccgcgatgtactgcaacaactggaatgcaatgcaacatcatgcgtgcagctagctttaactaaaaaaaaaaaaaaaaaagtcggccatgcatgcaccgaggcggttatattaggtgtcgatcatccatgagtgaccgaggcggttaggtgtcgatccatgagtgacggagagtggcggccggccggcggcgaggccatgattggcgcgtcgtcgggtaggggatgggatgggcttgcactgtagtctgcggggagataagcctc

SEQ ID NO: 17709 - DNA, 1130 bp, Zea mays
agccggcgggacggcagcccgctggaacattgggtccctcgaggccggccgggaacgaagccacaagcagcgccgcgagccacagctagcaccaccaccttgcaccgcacccgcaccgagacgaacagatcgaccatggctgccggcggcgacgacaccaccatcgcgcaggtccacagcggcatcgacagcagcaacaagacgctgctcaagagcgaggccctctacaagtacgtgctggacacgtcggtgctgccgcacgagccggagagcatgcgtgagctgcggctggtgaccgacaagcacgagtgggggttcatgcagtcgtccccggacgaggcgtcgctgctgcggatgctgatcaagctgagcggcgcgcggcggacgctggaggtgggcgtgttcacgggctactcgctgctggcgacggctctggcgctgcccgccgacggcaaggtcatcgcattcgacgtgagccgcgagtactacgacatcggccgccccttcatcgagcgcgccggggtggcgggcaaggtggacttccgggagggcccggcgctggagcagctggacgagctcctcgccgacccggccaaccacggcgccttcgacttcgccttcgtcgacgccgacaagcctaactacgtccggtaccacgagcagctgctccgcctggtgcgcgtcgggggtaccgtcgtgtacgacaacacgctgtgggccggtactgtggcgcttccccccgacgcgccgctcagcgacctcgaccgcaggttctccgccgccatcagggaactcaacgtccggctttctcaggatccccgcgtcgaggtctgccagctcgccatcgccgacggcgtcaccatctgccgccgcgtcgtctgatgtgatgatgatccgacgaccaagatcatatatcattcgctcgtcgtctctgtcatctttcaactgcctgcccgccgctgtccgctgccgtcgtcaattaataatgcatggttcttgttcttttttttttgtacttgcactgtgtgtgttgagttgaacatccggcgatgtactgcaacaactggaatgcaatgcaacatcatgcgtgcagctgtaaaaaaaaaaaaaaaaaaaaaaaaaaaaaaaaa

SEQ ID NO: 17710 - DNA, 1955 bp, Zea mays
  misc_feature (25)..(26): n is a, c, g, or t
  misc_feature (29)..(30): n is a, c, g, or t
  misc_feature (32)..(38): n is a, c, g, or t
cattgggtacctcgaggccggccgnngannannnnnnncattgggtacctcgaggccggccgggaacgaagccacaagcagcgccgcgagccacagctagcaccaccaccttgcaccgcacccgcaccgagacgaacagatctatcgatcgatagctagatccatggctgccggcggcgacgacaccaccatcgcgcaggtccacagcggcatcgacagcagcaacaagacgctgctcaagagcgaggccctctacaagtacgtgctggacacgtcggtgctgccgcacgagccggagagcatgcgtgagctgcggctggtgaccgacaagcacgagtgggggttcatgcagtcgtccccggacgaggcgtcgctgctgcggatgctgatcaagctgagcggcgcgcgccgcaccctggaggtgggcgtgttcacgggctactcgctgctggcgacggcgctggcgctgcccgccgacggcaaggtcatcgcattcgacgtgagccgcgagtactacgacatcggccgccccttcatcgagcgcgccggggtggcgggcaaggtggacttccgggagggcccggcgctggagcagctggacgagctcctcgccgacccggccaaccacggcgccttcgacttcgcgttcgtcgacgccgacaagcctaactacgtccggtaccacgagcagctgctccgcctggtgcgcgtcgggggtaccgtcgtgtacgacaacacgctgtgggccggtactgtggcgcttccccccgacgcgccgctcagcgacctcgaccgcaggttctccgccgccatcagggaactcaacgtccggctttctcaggatcccccgcgtcgaggtctgccagctcggccatcgccgacggcgtcaccatctgccgccgcgtcgtctgatgtgatgatgatccgacgaccaagatcgtatatcattcgctcgtcgtctctgtcatctttcaactgcctgcccgctgccgtcgtcaactaataatgcatggttctgctggttctttttttttattttcttttgtgcttgcattgtgtgtgttgagttgaacatcccccgcgatgtactgcaacaactgggatgcaatgcaacatcatgcgtgcagctgtaactaaaattgacgacgacagcgtcgtccatgcatggaccgaggcggttatattaggtgtcgatcatccatgagtgaccgaggcggttaggtgtcgatccatgagtgacggagagtggcggccggcggcgaggccatgattggcgcgtcgtcgggtaggggaagggatgggcttgcactgtagtctgcggggagataagcctcctcggtcggtcgggatggcgggcgtgtcgttgtcgtctcgtccgccagcccggcacggagggcaggaggtggaagcaaagaatcacagtcgtcgtcgcccgtaccctacccatggagacatgcatgcatatcctcagagagaccacctcaggaggataacataaacataatagtagtagcgcattacgtgccactcactcgatcggggcccgagatgataatataacctactcctccttcctgacactaacctctgctgcctgctccgatccggatggtgatgcagcgtgcaagcatggtgtgccgagacgacgtcagtcggacgcgtgcgtgtcatcgcccagccgctaacatcccatcgatcaaaaccacctgcactagaaccagcctcccctaagagcttctactagtactagtaaacgaacactagaataagtccaccaaaaatttgagtaattcctcaagctaggcagtcgtaggcaccagaatgacctcgtcaactttctgcagcgtgtaaatgtgaacggttctcaaaagttgcgaggtagattttttttttagttttgtagataaaatatgacaaatcgaacgacccgcaacagtacagcgacatagttcgtc

SEQ ID NO: 17711 - DNA, 1966 bp, Zea mays
ccatcattatgaacaaacgacggcagccaatcactcgggcacgcgacggccacgtatccgtgcggcagccgcgtgcgcgcgcccggaaacgcaccgccagcacccggtcaccagaccaccccaccggtggccgccggtcgcctccgcctgcgcgaacgcacacgcacacgccacggataaatcactgggtacctcgaggccggccgggatttctcctctcctctcctctcccctcgctcgttcgtcgcgtcctcctcagatcaacaaaccgtgtcctgctgctgcctctggaaaccaccgggggatcgccccgccctttccttcccgcaccccagatcctccgtcccaaaacggcagcttccggaggtctcccgtctccctgctccttccggcgcgacgggtggcccggctcgcggatccggcggtcttcggtcgacggcgaggcggcgctcgtcttggatcgggagtggttgctgaggcgcggagatggtggccgaggcggaagtcatgcatcagtcccccgttccggtgctggaggtgcagtaccaccggcgcgcgacgaccaagggggttgacgacgtcgtcgggatgtccgcgcccgcccccgcggaggttggggttggggttggggttgaggtcgaggtcgaggtcgaggtcgccgtggaggtgcctcgcatggggttggagcagcctgatgtcgcaccaagtttatccacggacatgatacagcagtttgtgcccaacatccgttctggtagcttcgccgacattgggcctcggaggtatatggaggacgagcacatccgaatagatgatctttccgcccatctcggctcgatgttggtctgccctctgcctagcgccttctacggggtctttgacggccatggcggcccggacgccgcagcctacatgaagaggcatgcgatgaggttcttgtttgaggaaagcgagttcccacaggcgtcgcaggtggatgaggtgtacctcgagtccgtggagagctgtgtccgcagagccttcctgcaggcggaccttgccctggctgatgatctggacatcagccggtcctctggaaccacggcgctcactgcattagtgtttggaaggcaactggtggtcgcgaacacgggggactgccgcgcggtgttgtgccggaaaggagtggcgatggagatgtcccgcgaccaccgcgcgaaccacgtggaggagcgcgagagggtggccgcgtcgggcgggtacatcgaggacgggtacctgaacggggtgctgtcggtgacgcgggcgctgggcgactgggacatgaaggcgcccggcgcgtcggcgtcggcggcgctgatcgcggagcccgagttccggcgggcgacgctgggtgaggacgacgagttcctcgtcatggggtgcgacgggatctgggacgtgatgacgagccagcacgcggtgagcctggtgcggcgcggcctgcggcagcacgacgaccccgcgcgctgcgcccgggagctggtgatggaggccaagcggctggagacggccgacaacctgacggtcgtcgtggtgtgcttcgcgccggagatggggtcgccgtttacaccgcagcaacagcaggaggaggagctgcccgcgaggcccaggagctgcaagaagggcctgtcgacggaggcgctgtgcagcctgaggagctggctggatacggaccaccggtagagggaggaagagctggggggtgtgtaaatactggagtattatgctgacagcaacactggttgattatgagcgctgggccatctgttgaggattttacgtaggctggttcagcagccagcagttttgtaggtttcgttcttccttttcacccttgttatctagtcgtttgttgtacatacatgtatggatgctgctgatgacatctgtgtgctgcgctccattgccaccaactttctttttaccgagagcccagtgagaagag

SEQ ID NO: 17712 - DNA, 1956 bp, Zea mays
agcagccgaggcatcccggtcccggattcgcttcctattcctatgcgtgctacggtgctagccgccagcaacgggctgaccttcagcgtcaccaaagaccaaactggtctcgctcgagcggcacatgtgccgccgccgcccatcctatcaccgtccgtaccgacacggctggttccattccaatttccatccatcccattcctctcccgtcgtgtctgaccttatctgcagcagtgcagtctccagctcttccaacacggccacaccccgacaccggcatggccacatccctttcccttaaatagacgccatcgccgccgagccgcgcattgggatcgtgcggcaatggcggcggcggcggcggcgcacgtgctggtgttcccggcccctgcgcagggccacctcaacagtttcctccacttctccacggggctcctccgcgcgggcctccacgtcaccttcctgcacaccgaccacaacctccgccgcctcggtactgctgccgccgaggctacggtcgcctcgccgcgtctccgcttcctatccgtgcccgacggcctccccgacgacgacccgcgcaccgtcgacggcctcccggagctcatggagtccctgcgcaccaaggccagcgcctcgtaccgcgcactgctcgcctcgctgcgcgcgggaggcggaggcttcccgccggtgacgtgcgtcgttgccgacggcataatgccgttcgtggtcgacgtcgcagaggagcttggagtcccggcgatctccttccgtacggtgagcgcgtgcgcggtcctggcgtacctgtccgtgcccaagctcatcgccctcggcgagctccccttccccaaaggtggcgacctcgacgcgcccatccgcggcgtcccggggatggagagcttcctgcgtcgacgagacctcccgatccagttccgccagctcaccagcacgtacgaggagcccttggtagcgggcggtggtcgcggccaccgtgcacagctgctgcaaggccagagctctcatcgtcaacacgaccacgtccctggagaggtcatccctcgggcacctcacgcaggagatgcgcgacgtattcgccgtcgggcctctgcacgccatgtcccccgcgccggcggtggcctcgagcctgtggcgccccgacgacgggtgcatggcgtggctcgacaaccagcaggcggagcgggccgtggtgtacatcagcctgggtagcctcgccgtcatctcccacgagcagttcaccgagttcctgcacgggctcgtcgccaccggctacccgttcctctgggtgctccggccggatatgctcgtggccagccaggacgccgcgctccgggaagccatcggcgcggtcgggaaagacagggcgtgcgtcgtgccgtgggtgccgcagcgagacgtgctgcggcaccgcgccgtggggtgctttctgacgcacagcgggtggaactcgacgatggagggcatcgtcgagggcgtgcccatggtgtgctggcccttcttcgccgaccagcagatcaacagccgcttcgtaggcgccgtgtggaggaacgggctggacatgaaggacgtgtgcgacagagttgtggtggagagcacggtgagggaagcaatggagtccgaagagatcaggaggtcggttcatgctctggcggagcaggtgaagcgtgacgtcgccgacgacggggcatcggcgttggaattcaagcgcctcatcagcttcatcacggagctcagcacgtcagcagcacagggaaccccatcttcaaaatcgtgaagtgaatgaatgaatcgaaagtaaacttgatagatacgcaccggattcaacaaccggctgaggggtgttttggaatgttatttttgaaggaatttctattttctcaatagaaaatgaactaatctctctgcgtaaaatgaaaatcccttaggcggccaaggtaaaag

SEQ ID NO: 17713 - DNA, 1186 bp, Zea mays
  misc_feature (2)..(2): n is a, c, g, or t
anacagagtcgttgtctacctcggtcattcctcattcgcgaaaagaaaaacacaaggcgaccgcagagggcaggacaggacagagacgccgaggctaggcagtccatctgttggggtggccagtggggatctcgccggccgggaggtctggggggcgggggctgccaaacttcgccatattggtgaatcactgaatccgcccctgccagcaaccgttctgacgtggcggggtggggcaggatccagatggcggcggcaatagaggaactgcggctcctgggatccatccctgtactggaaggtccgggagaggtcgacggcgtggtgggtgaggaagggcgaccgcgaggcggcggcgacgacgaggagatcctgcgattcatggactcggtggacagctacctgctcctcatggactccctatcctccgctcttcgtcagggctggcttgacctggcaagtgctcgccattctatgggcacatcacgcgtttcgagtacactgtttgatcacaaggagcagtctgctgccactaagcttcaagttgttgatcatgatggcctgaaatcatcagagtcaataccacactttgctctatcaaagtggtctttgcaagaagaatgtcactccacctatgatctcagtgagagagattttactgagccaaagatgaggcatcgaggatcagttactaccccagaaaagggaaaccatgaaagtgcaaacaccacaacactgtctacaggtgctgatgctagcaatcgtgttcaaagagcgagatcaaaagcattatcagtctttgggggattggtatccccaaaactaagaaccgcccaactttcatttgaaacagcacttgacttgattgtggagctagcaaattcaaggtcgaatatgttagctagtttctcccacttaaaagagtgaagacattatgttatgagattttgtaccttgggcaccatctattcagcactcatgagatcgcagcaactgtaaactaagttttgagatccagtatattttaagaacgactaaatagcatataatgcttgctatgctgattactcgctgcgaaggtgttgctaacatatctgtgaatgcgagaacacatgctggaagcagtcagaaattatggtttgattataaacctcctcattttctactataaaaaaaaaaaaaaaaa

SEQ ID NO: 17714 - DNA, 1187 bp, Zea mays
ggccgggccggggatattactcgggttctacgcgggggccgccacctcgccgcctcttcctctcggttaagtccagcccactccgccgccgccgaccgcgagaggagttcgcttcgccgcctcaaggacgagatggacacatcaagccctgcagcacttgtcaatgcaaagattatgaacatgtttgttgggcaaagagtgcgcacagttgttcaagtccaacacaatgatggtggaatgcttgtcgggcagtcccctgatgggcatcaattgagtatcaaaagcgccatggatgtccctgtatcacactttatggaagtttatggaattgctgaaaacagccagaccatccgcgctgaagtttgcacagattttggtcctgactttgatcccgagacttttaatcaattgtgcaacctggcgagtaacaagttcaagcacatgttcctgtagaggtcatcatcaagtggaggaccttcggccaactgaagcttgtttgaaatcgatatgattcacctctaaatgttctttcactcaccccagtactctgttgtcagtattggactccttttagcatgtattaatctaagcaacataagactacgaaggcaagcaaaatatatcgtgtagttgaagaacgtatggtcttttctacttttaggcaatccaaagctaagcttgttatgttgctgtcacttacatttggaccctgagaagttgctacaatggctaatgcagcttgatgagaggaaagagttctaatgtgatagttacatgccccatctgaaaattcgagctttgattttgtctgcatgatccaccgtagtcaacctgaaaccctctattcagttcttattgggtttaaggcttgagatttagatttttgtgtgcatgattctgcaaatgcgcacctgaatatactgtatccatgatggctactcggcagcaggcagcaggctatatgctggtgaagctttgcttggttgttggggttttcttgcaagtaaaagagcattgtttacacagggatggtataaatggctgctagtgttagctagtttggtgtggagactggagatagctgtgaaaaatgacttccatttgattctcaatatttggtacacttaaaccagtgccaatttgcgcaacattgttcttcacttctgttatctctgaaagtattttca

SEQ ID NO: 17715 - DNA, 891 bp, Zea mays
acgagatggatgtctcagatgctaaaatgagcacttgagcaccgtagccgtctgagcacgatatgttcttaaaaaaagcaaatttgccgtctgcaaaacccctcccacagccgtcgccgcccgccagcccgccagcgagagaagtccgcttcatccgttcgccgcctcaaggacgagatggacacatcaagccctgcagcacttgtcaatgcacagatgctgaacatgtttgttgggcgaagagtgcgcacggttgttcaagtccaacacaatgaaggtggagtgcttgtcgggcagtccaccgatgggcaccagttgtgtgtcaaaagtgccatggacgtccccgtatcacattttatggaggtttatggaattgctgaaaacagccagaccatccgtgctgaagtttgcacagattttggtcccaactttgatcccaaggtttttgatgagttgtgcaagctggcgagtggcaggttcaagcacctgttcctgtagagataatcatcgcatggaggatcttcagccaactgaagcttgtttgaaactgaatgtttcgcctttaaatttaagatttggctacatgttcctttcattgcatggaggaccttcagtaccctgttactcgtcagtattggacttctattagcatgtataagcaacataggactgcgaatacaagcaaaatatatcatgtagttgaagaacctatggtctttttctacctttaggcaatccaaccctaagctttttatgttgctgtcgcttgcatttggaccctgagttgctacaattgtcatggagtttgatgagaagaaaaatgattctaatatgctagttccatgtcccatccaaaaaaaaaaaaaaaaagcggccctcgagctcagcttt

SEQ ID NO: 17716 - DNA, 2349 bp, Zea mays
  misc_feature (6)..(6): n is a, c, g, or t
cctcgnagccggccgggtctctgaagaaatggtcaggcagcaaactgcaccaaaagttgtgaggcattatccatcagaatctacactcttcccatccgcgcttttcggctcgctctatgtcaaggttgagttgcgcccgtttggtcttcataacctaggcaacagttgctatgcaaatgctgttcttcagtgtttgatgtttactcgaccactcacaacatatcttttggaagggcttcactcaaaaaactgttctcaaaacggatggtgcttcatgtgtgaatttgaaaaactcattgtggagggcaaacggcgcaagattgccttgtcaccaactgggatactctctcatttgaatgacattggcagtagctttggtcctggtaaacaagaagatgctcatgaatttcttaggtatgcaattgatgctatgcaatctgtatgcacgaaggaagctagaaaaggaggtgttcttcggtcagcggaagaaacaactcttgtccaattgatatttgggggctatttgcgatctaagatcaaatgttcaaggtgccatgttagttctgaacaatgtgagcccatgttagatcttactgttgaaatagacggtgacattagttcgctcgatgaagcacttgtgcgctttacatccacagaagccttggatggagaaaacaaatatcactgcagcagatgcaaatcttatgaacgtgctaaaaagaagctgacaatagaagaagcgccgaatattctgactattgcactgaaaagatatcagtctggcaagtttggaaagatcagcaaagccatcagatttccagaaaccctcaacatagtttgctatatgaatccagatactgatgacatatcgccagtttacagcctctatgcagtggttgtccatcatgatgtcatgaatgctgccttctctggtcattatgtatgttatgttaaagatacacatggaaagtggttcaaggcagatgacagtcaggtgaaacctgtatctctggacaatgttatgtcaaagtgtgcttatatgctgctgtatgcaaggtgttcaccgagggcaccgagctctgttaggcaggctatttcggacccagcacgcccgaagaaggccaaacagaaggtggttccaggaggaacaacatggcgaggaggttctttcaacaggcaccaagatggtcagcggcatagcaaccacacggcagatgaccttacccatgcatttgacgaatataggaatgcaccatattcgccttcagattctccgagtcctagtgagagttcatccctctttagcaactctgatgcagggtcgcacagcactgtaagcaccgatagcagcgagagcacgaggaactcgaccagcaccgaggagtatgagtatgtgttcggagctgctgatcagatgtacccaggaggccccatgggaggagcacctgtggagagtgatcaaatgtacccaggaggccccatgggaggagcacctgtggagagtgactattctacgtattcccgatccaggtccagcttgaataccagctcatcaggccgggatgcatacagtgcggctagctctgccgaccacaagcatcaggtcgtcggttccggtgggcaggttgagggcgatgagagcacgtccttgttgtatactgacagaagtaatcagcagttgagcagtaagttaacagaccaatataggcagttagatgggagcggacatgaccctggagaaaccaggggcggtgtcttattgagaagaccatctagggacaggaccgctcaaacattttattgatgtgcagggtttgggctgtagagaaataatgtaatgtagcctgtaatattatctcgctgcattgtgtaaaaagagaagagagatgtcgtagtccataaaagttgaatccccaacttggtgatataatcccgaggaacctgtaacaaatgtcacgtattccacgggatcgacgtaggactgtaggagtagatcataagattaatgcaaaagttcattgaacacagactctgaaatctgtgggcctggcaacgctcaaacagatggcgtgtcactactcactagtaggctcgattttttgcaagtacaagtttgacatatatagggatggcttctccttgaacgacacggccggcgacgaggcttcggattcgtaagtcgtaaccctgcagcagcattgattgtatgggccaagcgatggccaggacccttatcggatatataaggtgatctggttggcataatgcatgcatcacgtgcttgttgatagctatcgagattctggaaacccaggaccgcaaaccccccaaattctagctggttggcag

SEQ ID NO: 17717 - DNA, 2886 bp, Zea mays
  misc_feature (4)..(4): n is a, c, g, or t
attntgttgtcccgttgcaaggcacggacacatacttagtgaataattaaataggaacgtggaaaataggcatttacggccggatccgacacagccggagctagccggttccgtttttgttatacatacatcatcaccagggatatgcttcggagccgggacaggaccgttcctattttattagtgggaacctaccgacagtcatgactcataagtcgtatcggcgagtacaaggattatccctaaccttatcgctcaaacaaaaatccaaggattatctccactcgcctgcctgcactgctggttgatcggctgcggattaatcaatcgctcatggatggactggtcgacagacaacacgcccttgagcggctagtcaggaaaaaaggcatcgtagcagcagctagccaggagaagattgcaggaacgcaacggccacatgatccgtgtctcgctctcggcagcgaagcagccaaatgtcttgtccatatcaatccccccgtccgaggccgcatattcgcgcgaaagcttctgctaatctactgctagtccacgtcgctggcagccagcagccgcccggtttgctctccggacggacaccaccgagaccgagcccaaggcttccggcgtcacgctctgctccggcctctgggtcgctcgctgctccggacccgggtcccggcaacctcgtccacgtcgctctcccgacaccggcagctggcctctgcccgcctgcctccacaggtgatggtgatctgacaggtccaccaccgcaccccaacgcgcggcgcgcgcaggggggaggaacgtgtcaaaacacgtcagctcgcctgcctcgtctatccaaatccagaccccggggcggggcccggaggtcagtcggccagaaccgcccggccggctccaacagtaacggatagggatggcccctgctgcttcctaatccttcgtcggtccgtctgctggccttcccgagcccacaggaacacgggggcggaaaaccgcgggtggacgcggtccactagccacgcacgcgagggaggctcatccgggactcggatcctctgcgtcgcccaaaacagcgctccggatgtctgggatcatacgcttagcgctttagctatctccagctgctccgtctctcatttcaaactttaccgtaaatggttcgttctacagtatttccccccgtaagaggtgtatacggtgccagatcactaaccctgttggcgtgcattgacatacaatcaattgcagaacagcacaccgcacgtattttgtgctttggccgcagaggatcctggggctttgcgccctgcttcagcctacaaagaccccgcgcacccaggctgcgtcctggtccttgctcttatcctatcctgcttttcttcgcttctctcttccccgctctctcattcttctcatacaagtctgttgttggagggacacacgtatccagcccaccaaagatttactcaatttatcccagacgagacacacactcgcaacgaccggaccgtcgaatctcgcgactccggcgacatgtcgacggcggtggcagaggtgcggccgccctacgggttccccggatccgggaaggggagcggcggcgggtatgggaaggaggcgcacttggccgcggccgggaagaggaggagcgacggcttcttcatagaggaggaggaggttgaagaagacgtgctgactgacaactcgtcgatcggggcgccgtctccctcgggatcgtcgatcggtgagaactcgtcgtcggaggccggcggggacgacggggaggaggaggtcgagagcaagctcaaggagggtgatgtgctcggctgcttggacgcgctcgaggactccttgccgatcaagtgagttcataaagctttcggtttttttccgcgccttggatcgcgcatgctatttcgcttgattctgcgaagtgggatctttttaattgaaaaggagataatttttttgggacgtaccaacattgctaaagcactccatggatttccgcctcttcatttataacagcgagcgaagagagagaaaaaagacagtagctttccccaaaatcggctcaaattgcgcatggtattaactcagacttttaatttggttgatcaggaagggcctctcgagcttctactccggcaagtctaagtcgttcaccagcctcgccgaggccacagcggcggcggcggcggtcaaggaggtgctggccaagccggagaagcccttcaacaagcgccgccgcatcctggccaactggtccaggagagcctcctgcagctcgctggccacggccacctacctgcctcagctcttgggccccgaccacgccgtggccgaaggggacgagggcgaggaggacgactccgacgacgacgtggagtacagccaggtgccgcaccacggcaagaacgtcagggacgcgccgacatcgccactgccgctccctagactcggcggtgttggcagcatgcagaggaggaacggccttgggagcttcagatctcctaggtccttctcgctgtctgatctccgtaatagcagtgctgatggtagtgattagcggccacagatttgcttgcagctctggcctctcctggccagtaagtagagatgtagtagccacttgctatatggttccggtgtataagatccaaatttgttgtgttcaaaaaaaaaaaaaaaatctttaacctcagattccgaagaagtgcatcgactgacctaacaactctggaggtatcattaacaaatggtgatcatggtagtcagctgccttagattaactcgtgatgtggcggtgttgaccgggatatgatcccggtccctagggcccgtcagtcacaaaactccacttccaagtaagactta

SEQ ID NO: 17718 - DNA, 1184 bp, Zea mays
ctcgaattccgttgcttcctatcctgcttttcttcgcttctctcttccccgctctctcattcttctcatacaagtctgttgttggagggacacacgtatccagcccaccaaagatttactcaatttatcccagacgagacacacactcgcaacgaccggaccgtcgaatctcgcgactccggcgacatgtcgacggcggtggcagaggtgcggccgccctacgggttccccggatccgggaaggggagcggcggcgggtatgggaaggaggcgcacttggccgcggccgggaagaggaggagcgacggcttcttcatagaggaggaggaggttgaagaagacgtgctgactgacaactcgtcgatcggggcgccgtctccctcgggatcgtcgatcggtgagaactcgtcgtcggaggccggcggggacgacggggaggaggaggtcgagagcaagctcaaggagggtgatgtgctcggctgcttggacgcgctcgaggactccttgccgatcaagaagggcctctcgagcttctactccggcaagtctaagtcgttcaccagcctcgccgaggccacagcggcggcggcggcggtcaaggaggtgctggccaagccggagaagcccttcaacaagcgccgccgcatcctggccaactggtccaggagagcctcctgcagctcgctggccacggccacctacctgcctcagctcttgggccccgaccacgccgtggccgaaggggacgagggcgaggaggacgactccgacgacgacgtggagtacagccaggtgccgcaccacggcaagaacgtcagggacgcgccgacatcgccactgccgctccctagactcggcggtgttggcagcatgcagaggaggaacggccttgggagcttcagatctcctaggtccttctcgctgtctgatctccgtaatagcagtgctgatggtagtgattagcggccacagatttgcttgcagctctggcctctcctggccagtaagtagagatgtagtagccacttgctatatggttccggtgtataagatccaaatttgttgtgttcaacctcctcctagctttctttaccctcagaggccgaagaagcgcatcgactgacctaacaactctggaggtatcattaacaaatggtgatcatggtagtcaaaaaaaaaaaaaa

SEQ ID NO: 17719 - DNA, 2137 bp, Zea mays
  misc_feature (1027)..(1027): n is a, c, g, or t
  misc_feature (2052)..(2052): n is a, c, g, or t
  misc_feature (2061)..(2061): n is a, c, g, or t
cttttactttttttcaagccaaagcatttgaaaacaagtccccaacatatgctttacaaacgcacacattttttactaacaacttgtttccttatttagggactaaagttaattaaagtcactttaaaccatatgggaccctagattagttgggtggccaaatgatttgttttcaccaaatctaaggagggggccaaatcgtagaacaagcatcggatttctatttcaaccccttccccaaaccgtccttgttgctcttctcgtcttccccctctcctcccaccgcatacatttcgtttcctccagccaaccaaaaagcacagcgggcgtcgccatgggcgttattgagctggcgaacacgtgggggcatcctcccgaagggatcctcgagcacatcttctcctacctcccatcctatgccgaccgcgcgtcttgcgcatgcgtgtgcaggcagtggtacttctacgccagggagaaggagagcacgaccccgctgttcccgtgtcttctgaggccgtccatcagcggggcctcctgcttccacttgttcagcaggacctgcacgagcatgcccaccgtccccgccgcgcgcttctgcggatccatggagggccagtggttcgtggtcgcgcgtgaccagtggcgtgggtacgcgctgctccacctcgcctccggcacgcagatcctgctcccgcaaggcctgctgcaggaagacggggatcgcttcaacttcaacgacctctgggtcggcctcgaatcaaccgacctgatcatccgtgccgcgaccgcgttccgcgcgccgcgttatccggacggcgacgagcactacttcgtcgccgccatcaccctcggcgagcacagggccgcggcatgtctgagcgggaatgggcggtgggctctactggagccggaccaaggcataatatgtccagacttggacaagatgctggtcatgtacgaagagatggaggacgtgatctactacagctgcagtggactagatggcttcttcttccttacgactgangagcatcttatggtgttcttaccggatgacgacggggaaggcctcagctccggcggcccccccccctacctcttccggggccatactatggcctcgcccccggaagccggccacgtggttgctgcccggtacctcgtggagtcggagggtaggctgctcatggtgaagaggttcgtcagtccatgtcaggggcagcagtccacggtgtctttccaggtcttcacgctcatgtgggacaactggaaccggaaagtccctcgctgggagaagtcctcgcccacctccgcccctctgctcgggaagatgctcttcgtcggccgaggctgctcccgggccatcggaaccggacgtaccggcccggccttcatctacttcttggacgacgcggttgcatcgccttacgagttgctgaccactattatcagaaccgagaaggagtaccgttgcagcgacatgggctggtgccgctatgaccagcagtacattggaaaggactggccccaagggcccccggcagactgctcgccatggatttggctctaccgttgatcaatttatggtggagcaattcttggcatatccatagtctgaaactagtaggaaatgttgatgtcgaggcacgaacgattcgaacctactactgctagtaaggtgggtgcatgaaactttaattggtactgagtgctcacttcactgaatttgtagttgctgctttgctggaaatggaagtatctggtctcaacttccttttggcactggaaatgatctctgtgtgcactccattgttttcctgatttattacctaatgctctgttttcgtgtttgctgatcagtagaagcagctttcactgtcaatgtagtaaatagtttaataattaacaatgcatgactatttgttgcaaatgctcattgtattatttgagaaatacctgccgccacaccttgcattatttgttaattcaaaccagaacatagcgaagacagtatgtatgactgaagaattcatactatccagagttttcgantactcacanaaaatgagtcatacattattgcagcctgtgtacataatatccagaagttttttttatattcgtctgtgtacatttt

SEQ ID NO: 17720 - DNA, 983 bp, Zea mays
atttgcatcttgcatacagagaaggcccatctacgccgcggaccgcaggccgcttgttcacggctcgaaagaccagaggaagccggaaaaccgcacggccggcctgcctctcgtcgtcgtcgtcgtcgtggtggtgcttgcggcagctccggagtccaggcagcacgctagtcggggggcgcgggggaggagatatggatcggtcgtatctccccgtggcggcggcggccgtcgccctggtcctcgtgtgctgctccggcctctgccgcggcgagcggctcggggcgagggagtgcgaggacctggggttcaccggcctcgctctctgctccgactgcaacgcgctctccgagttcgtcaaggaccaagagctggtggaggattgccataaatgttgcaccgaggattcagatgattctatcagcaagctcacattttctggtgcaattattgaggtgtgcatgaggaaactggtattttatccagaagttgttggcttcctcgaagaagataaagacgacttcccatatgtggaaacccgttattcttatggttcgccaccaaagctcataatgcttgacaacaagggtgaacagaaggagaccataaggattgataactggaagcgagagcacattcggcagtttctcaaggagaaagtgaagccagtgaaattagacagctgagttcttgcgataagtgcctgaatatttccagtttgacgttccaatagaacctacgtaacctgtaccttgctaccaaaatcgtagctgatgtatgagattggcgttctcatatttacacctcaaaatgatcgtacgagaagcctgtgtgtgcggcatactttgtaacctgtttgttactcttacagtcaggtagtaagtatctggcactatgatccgtgaagagtagttaatgtgcgagttgtttcctggttaaaaaaaaaaaaaaaaaaaaaaaagggcggccgccaccgcggtgga

SEQ ID NO: 17721 - DNA, 974 bp, Zea mays
aggccgcttgttcacggctccaaagaccaggggaagccggaaaccgcacggccggcctgcctctagtcgtcgtcgtcgtcgtcgactcgtcgccgtggtgcttgcggcagctccggagtccaggcagcacgctagtcggggggcgcgggagaggagggatggatcggtcgtatctccccgtggcggcggcggcggccgtcgccctggtcctcgtgtgctgctccggcctctgccgcggcgagcggctcggggcgagggagtgcgaggacctggggttcaccggcctcgccctctgctccgactgcaacgcgctctccgagttcgtcaaggaccaagagctggtggaggattgccataaatgttgcaccgaggattcagatgattctatcagcaagctcacattttctggtgcaattattgaggtgtgcatgaggaaactggtattttatccagaagttgttggcttcctcgaagaagataaagacgacttcccatatgtggaaacccgttattcttatggttcgccaccaaagctcataatgcttgacaacaagggtgaacagaaggagaccataaggattgataactggaagcgagagcacattcggcagtttctcaaggagaaagtgaagccagtgaaattagacagctgagttcttgcgataagtgcctgaatatttccagtttgacgttccaatagaacctacgtaacctgtaccttgctaccaaaatcgtagctgatgtatgagattggcgttctcatatttacacctaaaaatgatcgtacgagaagcctgtgtgtgcggcatacttgtatcctgtttgttagtcttacagtcaggtagtaagtatctggcactatgatccgtgaagagtagttaatgtgcgagttgttttgagttagtctctttttatgtgaccgaatttatataaaaagtagcatggatacttctgaaaccaaatatattttatgt

SEQ ID NO: 17722 - DNA, 1158 bp, Zea mays
cgggtcccccccccccgtcgtccccccgccgcctctagtcgtcgtcgtcgtcgtcgtcgtcgtagtgcttgcggcagctccgaggaggcgaggaccaggcagtacgctagtcggggggcgcggtagaggagatatggatcggccgtctctccctgtggcggcggcggtcgtcgccgtggtcctggtgtgctgctccggcctctgccgcggcgagcggctcggtgcgagggagtgcgaggacctggggttcaccggcctcgccctctgctccgactgcaacgcgctctccgagttcgtcaaggaccaagagctggtggaggattgccataaatgttgcaccgaggattcagatgattctatcagcaagctcacattttctggtgcaattattgaggtgtgcatgaggaaactggtattttatccagaagttgttggcttcctcgaagaagataaagacgacttcccatatgtggaaacccgttattcttatggttcgccaccaaagctcataatgcttgacaacaagggtgaacagaaggagaccataaggattgataactggaagcgagagcacattcggcagtttctcaaggagaaagtgaagccagtgaaattagacagctgagttcttgcgataagtgcctgaatatttccagtttgacgttccaatagaacctacgtaacctgtaccttgctaccaaaatcgtagctgatgtatgagattggcgttctcatatttacacctaaaaaatgatcgtaccagaagcctgtgtgtgcggcatacttgcaacctgtttgttactcttacagtcaggtagtaagtatctggcactatgatccgtgaagagtagttgatgtgcgagttgtttcctggctaatttctggagttgttttgagttagtctctttttatgtgaccgaatttataaaaaaagtagcatgaatacttctgaaaccaaatatattttatgtacatctaactatactaatttggtgtcataaatcttacaaaaataaaaaagaataatgcaaaccatctgtaactgctaagtgtggaacttacattcaggtgattgcaatgtcataaatctgaacgggtggagacaagcaaaataaaaagagttcgcctccactccggccgctagaggatgcacgtcag

SEQ ID NO: 17723 - DNA, 2562 bp, Zea mays
  misc_feature (2556)..(2556): n is a, c, g, or t
tttattagcagactgctgtggttttatattttttagcattattttgtttttcaacaacccccgataacagattttgaggaaaaaaagtttagtgacctcttgaagttgttctaaaaaaacatcccgtgtaggtggggtccccaaatgtctacggtcggtggtggtccctagctagcacgatacgaactcccctgttgtagcaatctggctcaacaacatccgccgcaaaacacgagagatgcgttgagccacagcaacgggattctccagctccaggtatattttggatcgacccaacatcaaccaaaggcgtactatcaaactacatctcacctgccgtacacgccctcgtcgttggtgggtgccgccgactcgatcgagtgtgccgtgtgcaatatcaggacccggtaggcgctgcggcgcatgcatgctgcggccgggtagatgatcccgagttccggctgaaaacttcccttcctatcctacccgcagcaaggactgcgtgcacatcttagcagcgggattggagtagcggtccgagtcacgctgctgcacgcgcgggcggtcgttggagtggccgactgcgagatcgatcggagcagctcgggacgggaacccggccgcgtccgtgcgtgactccatggagaacggcggccgcgtggccgcgatcgccgtgcctctcctcgtctccgcgctcttcgtcgcagcctttttgctgccgccttactcctcctccttgggcggcggcggcggcggcgccgagtcagccagcatccgggagcacttcctgcggcacgttccgcaaaagccgtcgcggacgccgccggtgccgagcgcgcaactcgccgggaaggtacgtacacgccgtgtcttcaaacgcaacgcggcgtcacggaaatcacgcaacactctgcgggatatatatatatatatcgtcgttcctctcgcgtttgatcgttcatacgtgtgcatcaggtgagcgtcgggccgatcgaggaatccctggcccggtctcgggcggccatccgccgcgcggctcgcggggctccagcagcgactgcggcggcggagaacgctcggcgtcggcggagcttcaaggacgtcggcgacgccttcgtgccgcgaggcgccatctaccgaaaccccagagctttccacaggtaaactaaacacgtatgccgtcctgcagttctcttctctcggatatatggccagatctcatcgaacgcacgcaccaatagatagatgatttttttattagtattattatttacatagacacaatcacacaaagcatatatgtgtactcggtagtcggtactccctttgtcccttcatgcacaaatcaataaagattcaatcttgaaaccatgcaggagctacctggagatggagaggaagttcaagatatggacgtacagggaaggagagccgccgctggcgcacctcggcccgtccgccgacatctactccatcgagggccagttcttggaggagatcgaggacccccggaaccccttcgccgcgcgcgaccccggcgaggcccacgccttcctgctcccggtcagcgtctgcaacctcgtgcactacatctacaggctcaacaccacggcctacatggcgcacatgcgccgcgcgctcgccgactacgtcgacgtcgtcgcccacaagtacccctactggaacaggtcgcgcggcgccgaccacgtcatcgtctcgtgccacgactgggcgcctctggtctccgaggcgaaccgggagctctacgccaacgcgatccgggtgctgtgcaacgccaacacctcggagggcttccgcccgcgcaaggacgccacgctgccggaggtcaacctcgccgacggcctcctccgccgccccacgctcggcctcccgcccgagaaccgcaccacgctcgccttcttcgccgggggcatgcacgggcacatccgcagggccctgctggggtactggctcggcaggaaggacccggacatggacatccacgagtacctccccgcggggcaggactaccacgcgctcatggccagggcccggttctgcctctgccccagcggcttcgaggtggccagcccgagggtggtggagtctgtgttcaccggctgcgtgcccgtcattatctcggatgggtacccgccgccgttcagcgacgttctggactggagcaagatgtcggtgaccgtgccgccggcgaggataccggagctcaaggccgtactcaagggggtgtccgagcggaggtaccgggtgctgcgcgccagggtgctgcaggcgcagcggcacttcgtggtgcaccggccggcgcggcggttcgacatgatccgcatggtgctgcattccatctggctcagaaggatcaacgttaggctcccatactgacgcagctttcggtcagcttcattcatgtgctcaattattgtacattattcgtgtcttccggttttatttcggacatgtattgatatagtagggtttttttttgttgaccgtcaaatgtgttatcttgagttgaagattataaaaaaaacaaaaaaaaanaaaaaa

SEQ ID NO: 17724 - DNA, 5338 bp, Zea mays
  misc_feature (4201)..(4201): n is a, c, g, or t
  misc_feature (4341)..(4341): n is a, c, g, or t
  misc_feature (4387)..(4387): n is a, c, g, or t
cgaagcatgacacgcacacgcgttaaaaacctatgagcttttttctcagccgtgcgtgcaagtcgccggccggtggcactggcagggccatttacattgtgcgcctagcattattgctcttattaggtagggccggctcctccaaacataggcgcccccccaaaacaaacccttgttccggtcctttctctctctttatatatagaccccacaccacctccccgcgtccccctcctccctcattatctctctctcccaagctctttctaccgtttctcttctagtcgagcggggaaaacaaagaaacaaaaaagcaaggaagcagctgcacgcacgccgtcgcctggccggccatggggttcccgtcggtgtgctactgcgtgatcctgccgcagccgctcatcctggtgctgcagctgctggacttcctgcggcacgccgtgctgctctgcctctcctcgctgggcctcgcggcgccgccggccgccgacgaccatccggcctacgcctacgcggcgccgccgccgccgccgtcggacctctgggcactgcagccgtcgtccctgcagcagcagcagcagcaggcggcggcggcggccctggcgccgccgcccacgccggcagccatcaaggcccgcctgcccgccgtccggtacgccgacctgctcggggcccgccgcgccccgccgggcccggccgtctgcgccgtgtgcctcggcgcgctccaggcgcggcaccgcgtccgcgagctcggcaactgcgcgcacgccttccacaaggcctgcatcgacaagtgggtcgacaagggccaggccacctgcccgctctgccgcgccttcctcctccccggcctcagcgccggagacggcgacggcgacggcgacggcgagctcgcctcctcctccttccctttctccttctgaacccacgcgtagtacgtacgtacgtacgcgcgcgtgctccagccgacaagcaaaagtgaaggcgcacggccggcggcgtgcgtagtacgtgtacgtacgtccctgcagcccggcggccgattgggaggcagagcaaggtcagtagcaaagccacctacctacttactacactactcctgctagctgatgagacacgagccccgtcgtacggccggccccggtcctgtgaccatccatggatcccgatgagacgagcaaggaaacagaggagagagaagaggaggtgtcagtgagcgtgaggtggtgcagtattattggtaggtgaggcacaaattatgaggaggacagggatggctacctgcattggatctggtggatgcgtagatccatccactccgcactgctccacccttttctcctgcagtgcagctccaattcacaccccccctctctctttctctctcttttgtttattaattaataattattagtttccttttctttttttttctttctctctctatctttctttcttttttctgtggtccctcctatatattattaacttgatctgcgaggggaaccaggagagatgtgcgttgtacatagctgcctccacttgacaataatattattgcaacggaacaaaaaaaaaaaaaaaaacgcccctggggcctcagtcgtcgtcaacaaaagtgatctctgtgtgtgcacatgtgcttgagctgtgctactagctacactaacactacacacacgctagctagctagctagctagctcccctgatgtgtgatgtcattagcataatgcaatttggctggatgtgtctgtggtatgatgtgtgcatggggggtacggtgtatctctgattggggttccccagtggatatgcccctcccgtgtttggtgattagggggcctctcaggtctctcaatcacggtgtcactgtgtaggaggggggcaatcatgatgtgagccttgcttaacgcaacgtgcaagtgcccagatagtcacgccacgccactagctagacccctggggatacgtagtacgtaggcatgatgttaccatagtactacttcgtgataattttgtaggagcatcgatctccactagtcctataaaaaaacaactccctaaaatcaggtttagcaagttgctagctaacttaattttcctagttatcacttgcagctttaaatataaagttcaataatcattgttctttccttttagttaatattttcattttgcgtgctaatcgcggtcgatcgcaacttcagacttgccttccctttttagttactattttgtattttcatttcgtatgaatcacggtctcgatagcatcttcagacttgccaaacgagaggatgaaatccatccttctcgtagctcagatcattcaaagtgcgtcacttgtatatagacacgaactcggcatcggacaagtgatttcatattgtggttggttgacacacgacataggctattgggggagtttcgttttacgcgtgtgcggtacatctttagactcccttaacttctcgatagatattgctctcgatagatattgcacgtagttcgttcgattattcaaattaacttaataataataaaatttccgtacgatactgaaactatactacactatagtattaaatataaacctaaattatattttatatttaatttaatcaaataaagtatagaccaaatctatattgttgctctaccgacgattccgtttgcacagcaccgtgtcatttattagtccgtgatcgaacagcaccgcacaggcacgcaggggtcgcgatatttcacgtggacctggcacacgtacgatcttttgcgtgtcgaactttacgacgcgtccagctcgcaagacagcaagagtggcaaatttccagtggttcatttacgaatttgtggccaaccgccgtggattttgtaagaaaaaactagaaaccgtgaaatgtaaaaagatcaagccttttttcattttaaaaaggggagatcgaccttttttcaccactcaccaggaggcaggaccagggcgttcctttgcttttgcttgtgtcattgtgtggttactgctgctctgcttgcttttgctcgtcgtggttgtgaaacaaacctctggtggaagccaacgcagcgaccggcacatgaaaggcgttttgttttggaattcgaacttgtgactgccgagccttgttcgaccggtgaaatttcgctggactgaaattgctggattcaaatccggcggtgataaagtgggttctgaattcatgctgatgataaagcggggatcggtctgactccagtgtcgttcgtcctcccttttggtagcaaatgcagcgcgtgttctcgggctggccactggcctggcctgcctgcaagcggaatactaagcagggtgacaggcccatctagacttttggccctctcttttgcggcagcgattcaattccctcgtaccatcagaactggacgcgctgcactgctgcaggcatccaccggtcactgaagctttgctgcgaattcaaaccaagcagccacagggataccggggtccgggggccggggcctttatagtttttattataacatgtccaatagtttacctactgttacatagtgaaattttgaatatggggattgtcaagtaacgactcacccgaagggaatctctgataggacacgtaatcacgactcacttgaggccaacttcagacatggtcacgaagctaaccttagacgtgagactcagttatggctcgcccgaggcgaacctcagacgagcggtgacccatccgagtgcatctcgagcgatgctctggaagttgcccaactccgtcgactaattctgtgaagcggaccgaccgaccaactctctgacgaccaactcactgtcgagcaaccgagcgagtctgtgagacggggcgaatgatcgagtctccgctccgcaaggaaggaatcagatccgcaagaaagcaatcagaccaggtctttctccggaaaaggaggaaattttcataatgattgttattttttatttacatctttgttagtaaatatagcctacaatgtggcttagagtgtgtttggtttagctttctggatcatacccgtagccaaaaaaatggaatcccaatgaaacacaggagaataaaaaattgaaaatctacagttttttctagttcaattcagaatcacctcctcgtaccccagattttctaaatttttgttatcaatgtcataaattgtcattntcttataaagtctatataaccaataacctttagaagatgatctatttcacccacttggtcacttaccttcaaaaccgattgtttagcccctcaactttacaaaaaaagacaaataaccttcttgacaatattagttggcntttatgatgatgtgacactaatctaagtgatacaagttttgtcctnttcaattatgccttctagtatagtatccaaaacctatattattgtacgcaaaaacgataagtatatattatatttctcttaatttttctataattttcggagtaacaacttaataactaaaaacaaaaaaaaactatataaaagtgcttaacattttttatccttgatacatttcttatcttctgatactagattttttactagagctaaacaatattatttttaaactactatttttgattttattaagcaagttaactcatctttcttctaattactaattaaattaattttacatttgttttttagaaacgcttagcaaacaataacaaaatgatctacaatttttacacatatcttcacttggttaaactaacatatacaaatatttttaaaattacccgaggaattaaaatctaaacccatataaagttctcaggaatatttatgtaaattgtgtgtctagattcgaacttctcgaaacaatctagtaatatttgtgtatgctagtgtaactaagaaaaaggttgtgcaaaaaatagagatatttttattactgtttggtaataaaaaatttggtaagtgtttctaaaaaataaatataaaaatgatttaatcagtaattagaagaaagaccacttagtttgattaataaaattagtagaaaaaatattagtttagcaataatattgtttatttttagtaaacattttattctcaaaagataagagatgaattagagacataaatattaaactctttttatatattttttatttttagtaattaaggtactacttctattttttggaaaattatgaaaatatttttccctagatatgcatgatagctatgtatcactatattaaaaatgaggggaaaagacccaggcctagaacaaaaaagataaacacacagggacgaaaacatcatacgcacaccacttaccac

SEQ ID NO: 17725 - DNA, 2552 bp, Zea mays
gccggccgggccggacggtccccgtctctgaacagcctagcaaagctcggccgtcatctttaccccttgaccccttccctcccgcttcgccgtcgccgtcgccgcgatctatccgcatctagtgcgcacgcactcgtccctatccccttgcgccggcgtgtgtcgcgcagagagcggagcttatccatcatattaccaggacatggtgatttaccagtcgcactctcaccaaccgctcttgttcgctaccagatccacagcgcgcacttgtgcctatttatttattgtggaggcgtgggtcggcgagggactcggatcagccgcagttgatctggaggcgcgggccggccatggaggagggtggcgagcacacgagtcttctggtcaaggatgatgcatcatgtcatggcgaggaaacacagagtctattggaagcaaatctagggccacagctgaaaagtaaatgctctgattggagagcaccggcactcatcctgggattggaatgcttggagagcatggctttcaatggcattgccacaaacctagttgtgtatctccgttcagttctccatgggggtattgcttccagtgcagcaactgtatctctttggtatgggacaagcttctttgtgccaattcttggagccgccatagcagatacttgcttgggaaattataagaccatcttgatctcccttatcatgtacctatttggaatagtactaattacagttgcaacattcatgccttctacttcagtcttgtgcgacgtcagttcatgcttgtcatcaaatggaactcaaaccatgattttctttgctggtttgtatctcactgctgttggatgtggaggagtaagatctgcattgcttccgtttggtgctaaccagttcaacaacgagaacagtctagacataaaaaagagaagaaatttcttcagcttgttctatatatgtgtcatctttggtgtgattacttctgggacaatcatagtttgggttcaggaaaatgttagctgggctattggatatggagtcgccactacatgcataggtcttgctttgataggatttctggtgggaacaccaatattccaagaagatgagccttgtggttctccagtgaagagtattttccaggttattgttgcctcttttaggaacatgagcttggaagtacctgctgatagctgtcttctgtatgaggtcgggagcaaccacatacaaaggacaaaacttgctcactctgatgattttaggttcttagataaggcggcagttatttctgatccaagcctggtgtatggaggctgtcgaagctcatggagcatatgtacagttactgaagttgaggaactgaaaatacttatccgcttgctcccaatatgggtgactggaatattctttggtgctgcgatctcgcaaatgcacaccacttttattcagcagggaactgtgatggacaccaagatcggttccctgtccattccaccagcatccttatactcatttgaagtgatatgtgtcacgctttgggtacttgctgtcaacaaagtgcttgtgccggcaatccgaacgtattttgcaaatggggtagagctcacacagttacagaggattgggatcggtcgtttcctgatgatctttgccatggcaatggcagcacttctagaaaccaagaggctgcatattgttcaggagggggaactgctaagcattgtatggcagcttccacagtacttcgtcattgctggggctgagtgcttcggtatcatcactcagctggagttctttcatggccaggcgccagactccatgaagagcattttaacggcatttgcattgctcaccactgcccttgggaattacttgagctcagctatcatcaccctcatcgcaggggtgaccagggtatggcatagccctggttggataccagatgatctgaacaaaggacaccttgactactactactggtgtcttactaccctctcattggtgaattttgttgtgtatctgtattttgctagtaaatacaaattgaagaaagttgtttgttaatactaccaaacactaatgaaatatctttacgtgtaacatatgaaatataacgtttcaaatgtttatgtttattaatataaggtttcaaatgtttatgtttattcactatatgtatagcagtataggaacatggaagccttaggctatctcagcagatcctctatctcatcttttattttaaacttcactctgcaaacaatatcatctacagtttcgtgttccctattttatacgatccgctcaagacagttttatgtcccagaactgccccttctcatagcgatgtgtaaatgttaggagaaagatattgtatgtagtaactattcattgattcattctctatgcttatgctggagggatgtgttgattatttcagttatatggaatgtaatactgatttgctggtggttgagttcgaaaaattaaatactgattttctggtgaaacaagcttggtgtaaacataattttgttaaagcatccatgattt

SEQ ID NO: 17726 - DNA, 1758 bp, Zea mays
ttgggtacctcgaggccggccgggggacgctcactgcaatcacaggccgcggcctcccagaacggcagaaagggcagcgcggccggctatataaatccatgcccgtgctcgggtccaaaccacacacaaacacatcagcattcagcaatagctaatcgagcatcgtcgccttagctcctctcctctcctcttctctccgtcgtcgtggaacttctctccgccggctgccatataaaggaggaagaagagaacagcaacgctagctagccggccggcctccgtcgtcgccggcgtcgtcgactagctagctaactctcgatctccagttcctgcccccgccccacgcccggccgtcgtcgatcgtcagcaatataatggcaggaggcctcttctccatggctcacccggccgtcaccctctccggcatcgcaggaaacatcatctccttcctggtgttccttgcaccagtggcgacgttcctgcaggtgtaccggaagaagtcgacgggcgggttcagctcggtgccgtacgtggtggcgctcttcagctcggtgctgtggatcttctacgcgctggtgaagaccaactcgaggccgctgctgaccatcaacgccttcggctgcggcgtggaggcggcctacatagtcctctacctggcgtacgcgccgcggcgggcgcgcctgcggactctggcctacttcttcctgctggacgtggcggccttcgcgctcgtcgtcgccgtcacgctcttcgccgtccgcgagccccaccgcgtcaagttcctcggcagcgtctgcctcgccttctccatggccgtcttcgtcgcgccgctcagcatcatcgtcaaggtggtcaagaccaagagcgtcgagttcctgcccatcagcctctccttctgcctcacgctcagcgccgtcgcctggttctgctacggcctcttcaccaaggacccctttgtcatgtaccccaacgtcggcggcttcttcttcagctgcgtccagatgggcctctacttctggtaccgcaagccccgcccggcggccaagaacaacgccgtgctgccgacgaccacggacggcggcaacgcggtgcaggtgcaggggcaggtcatcgagctggcgcccaacacggtggccatcctgtcggtgagccccatccccatcgtgggcgtgcacaagatcgaggtggtggagcagcagcacaaggaggccgccgtggccgccgagacccgccggatggccgccgcaaacccggacggcgccatgccggaggtcatcgagatcgtccccgccgccgccgcggtgtgacccaacgccaatcaccatgcaccgtacacaccctgctagcttcttattagctagctcggatgacgtacgacagtttggtggcaagtggctggcagctcaagcatgcagatgcaggcatcgtcgtctgctatagttggtcgtttagttggttaattgttggattattattgcgtatctctctcgtgtgcgtcgtagccttgtctcagttcagttcagtgtcgaatcaagtagtagtagctgttgtttgcattggatctgacaatgcatgcatgctaataattatggtggtgtgatggtcttggtcgatctggtgtatgtaatgtacgtacgcgcgcggtacgtacgtagtcgtctacgtacgccgtgtcaacgtcgtagatctctacgggaagatgataagactgtaacatgcagggcatgcatctatttatacttaaaaaaaaaaaaaaaa

SEQ ID NO: 17727 - DNA, 1588 bp, Zea mays
tcagcattcagcaatagctaatcgagcatcgtcgccttagctcctctcctctcctctccgtcgtcgtggaacttctctccgccggctgtcatatatataaaggagaagaagagaacaccttcgctaccccagccggccggcctccgtcgtcgccggcgtcgtcgactagctagctaactctcgatctccagttcctgcccccgcgccccacgcccggccgtcgtcgtcagcaatggcaggaggcttcttctccatggctcacccggccgtcaccctctccggcatcgcaggaaacatcatctccttcctggtgttccttgcaccagtggcgacgttcctgcaggtgtaccggaagaagtcgacgggcgggttcagctcggtgccgtacgtggtggcgctcttcagctcggtgctgtggatcttctacgcgctggtgaagaccaactcgaggccgctgctgaccatcaacgccttcggctgcggcgtggaggcggcctacatagtcctctacctggcgtacgcgccgcggcgggcgcgcctgcggactctggcctacttcttcctgctggacgtggcggccttcgcgctcgtcgtcgccgtcacgctcttcgccgtccgcgagccccaccgcgtcaagttcctcggcagcgtctgcctcgccttctccatggccgtcttcgtcgcgccgctcagcatcatcgtcaaggtggtcaagaccaagagcgtcgagttcctgcccatcagcctctccttctgcctcacgctcagcgccgtcgcctggttctgctacggcctcttcaccaaggacccctttgtcatgtaccgggccaccccatcgtctgtcgcaggctgtcctgcgtccagatgggcctctacttctggtaccgcaagccccgcccggcggccaagaacaacgccgtgctgccgacgaccacggacggcggcaacgcggtgcaggtgcaggggcaggtcatcgagctggcgcccaacacggtggccatcctgtcggtgagccccatccccatcgtgggcgtgcacaagatcgaggtggtggagcagcagcacaaggaggccgccgtggccgccgagacccgccggatggccgccgcaaacccggacggcgccatgccggaggtcatcgagatcgtccccgccgccgccgcggtgtgacccaacgccaatcaccatgcaccgtacacaccctgctagcttcttattagctagctcggatgacgtacgacagtttggtggcaagtggctggcagctcaagcatgcagatgcaggcatcgtcgtctgctagttgatcgtttagttggttaattgttggattattattgcgtgtctctctcgtgtgcgtagtcttgtcagttcagttcagttcagtgtcgaatcaagtagtagtagctgttgtttgcattggatctgacaatgcatgctaataattatggtggtgtgatggtcttggtcggtacgtgcgtagtcgtctacgtacgccgtgtcaacgtcgtagatctctacgggaagatgataagactgtaacatgcagggcatgcatctatttatacttaacatattctttgtgtgctt

SEQ ID NO: 17728 - DNA, 1595 bp, Zea mays
gcccacgcgtccgatcagcattcagcaatagctaatcgagcatcgtcgccttagctcctctcctctcctctccgtcgtcgtggaacttctctccgccggctgtcatatatataaaggagaagaagagaacacattgggtacctcgaggccggcctccgtcgtcgccggcgtcgtcgactagctagctaactctcgatctccagttcctgcccccgcgccccacgcccggccgtcgtcgtcagcaatggcaggaggcttcttctccatggctcacccggccgtcaccctctccggcatcgcaggaaacatcatctccttcctggtgttccttgcaccagtggcgacgttcctgcaggtgtaccggaagaagtcgacgggcgggttcagctcggtgccgtacgtggtggcgctcttcagctcggtgctgtggatcttctacgcgctggtgaagaccaactcgaggccgctgctgaccatcaacgccttcggctgcggcgtggaggcggcctacatagtcctctacctggcgtacgcgccgcggcgggcgcgcctgcggactctggcctacttcttcctgctggacgtggcggccttcgcgctcgtcgtcgccgtcacgctcttcgccgtccgcgagccccaccgcgtcaagttcctcggcagcgtctgcctcgccttctccatggccgtcttcgtcgcgccgctcagcatcatcgtcaaggtggtcaagaccaagagcgtcgagttcctgcccatcagcctctccttctgcctcacgctcagcgccgtcgcctggttctgctacggcctcttcaccaaggacccctttgtcatgtaccccaacgtcggcggcttcttcttcagctgcgtccagatgggcctctacttctggtaccgcaagccccgcccggcggccaagaacaacgccgtgctgccgacgaccacggacggcgccaacgcggtgcaggtgcaggggcaggtcatcgagctggcgcccaacacggtggccatcctgtcggtgagccccatccccatcgtgggcgtgcacaagatcgaggtggtggagcagcagcacaaggaggccgccgtggccgccgagacccgccggatggccgccgcaaacccggacggcgccatgccggaggtcatcgagatcgtccccgccgccgccgcggtgtgacccaacgccaatcaccatgcaccgtacacaccctgctagcttcttattagctagctcggatgacgtacgacagtttggtggcaagtggctggcagctcaagcatgcagatgcaggcatcgtcgtctgctagttgatcgtttagttggttaattgttggattattattgcgtgtctctctcgtgtgcgtagtcttgtcagttcagttcagttcagtgtcgaatcaagtagtagtagctgttgtttgcattggatctgacaatgcatgctaataattatggtggtgtgatggtcttggtcggtacgtgcgtagtcgtctacgtacgccgtgtcaacgtcgtagatctctacgggaagatgataagactgtaacatgcagggcatgcatctatttatacttaacatattctttgtgtgctt

SEQ ID NO: 17729 - DNA, 1571 bp, Zea mays
  misc_feature (1459)..(1459): n is a, c, g, or t
  misc_feature (1492)..(1492): n is a, c, g, or t
  misc_feature (1527)..(1527): n is a, c, g, or t
  misc_feature (1558)..(1558): n is a, c, g, or t
  misc_feature (1561)..(1561): n is a, c, g, or t
ccgggacacacaaacacatcagcattcagcaatagctaatcgagcatcgtcgccttagctccctctcctctcctcttctctccgtcgtcgtggaacttctctccgccggctgccatataaaggagaagaagagaacagcattgggtagctccgacggccggcctccgtcgtcgtcgtcgtcgactagctagctaactctcgatctccagttcctgccccccaactccgtcgtcagcgatggcaggaggcctcttctccatggctcacccggccatcaccctctccggcatcgcaggaaacatcatctccttcctggtgttccttgcaccagtggcgacgttcctgcaggtgtaccggaagaagtcgacgggcgggttcagctcggtgccgtacgtggtggcgctcttcagctcggtgctgtggatcttctacgcgctggtgaagaccaactcgaggccgctgctgaccatcaacgccttcggctgcggcgtggaggcggcctacatagtcctctacctggcgtacgcgccgcggcgggcgcggctgcggacgctggcctacttcttcctgctggacgtggcggccttcgcgctcgtcgtcgccgtcacgctcttcgccgtccgcgagccccaccgcgtcaagttcctcggcagcgtctgcctcgccttctccatggccgtcttcgtcgcgccgctcagcatcatcgtcaaggtggtcaagaccaagagcgtcgagttcctgcccatcagcctctccttctgcctcacgctcagcgccgtcgcctggttctgctacggcctcttcaccaaggacccctttgtcatgtaccccaacgtcggcggcttcttcttcagctgcgtccagatgggcctctacttctggtaccgcaagccccgcccggcggccaagaacaacgccgtgctgccgacgaccacggacggcggcaacgcggtgcaggtgcaggggcaggtcatcgagctggcgcccaacacggtggccatcctgtcggtgagccccatccccatcgtgggcgtgcacaagatcgaggtggtggagcagcagcacaaggaggccgccgtggccgccgagacccgccggatggccgccgcaaacccggacggcgccatgccggaggtcatcgagatcgtccccgccgccgccgcggtgtgacccaacgccaatcaccatgcaccgtacacaccctgctagcttcttattagctagctcggatgacgtacgacagtttggtggcaagtggctggcagctcaagcatgcagatgcaggcatcgtcgtctgctagttgatcgtttagttggttaattgttggattattattgcgtgtctctctcgtgtgcgtagtcttgtcagttcagttcagttcagtgtcgaatcaagtagtagtagctgttgtttgccatggatctgacaatgccatgctaataattatggtggtgtgangggtccttggtcggtaactgcgtagtcgtctangtaacgccggtgtcaaagtcgtaaaacctcctacngggaagatggttaagacctgtaacatgccanggnaaggcatcca

SEQ ID NO: 17730 - DNA, 826 bp, Zea mays
aacacacaaacacatcagcattcagcagtagctaatcgagcatcgtcgccttagctcctctcctcttctctccgtcgtcgtggaacttctctccgccggctgccatataaaggagaagaagagaacagcaacgctagctagtcggccggcctccatcgccgccggcgtcgactagctagctaactctcgatctccagttcctgccccccaactccgtcgtcagcgatggcaggaggcctcttctccatggctcacccggccatcaccctctccggcatcgcaggaaacatcatctccttcctggtgttccttgcaccagtggcgacgttcctgcaggtgtaccggaagaagtcgacgggcgggttcagctcggtgccgtacgtggtggcgctcttcagctcggtgctgtggatcttctacgcgctggtgaagaccaactcgaggccgctgctgaccatcaacgccttcggctgcggcgtggaggcggcctacatagtcctctacctggcgtacgcgccgcggcgggcgcgcctgcggactctggcctacttcttcctgctggacgtggcggccttcgcgcttcgtcgtcgccgtcacggctcttcgccgtccgcgagccccaccgcgtcaagttcctcggcagcgtctgcctcgccttctccatggccgtcttcgtcgcgccgctcagcatcatcgtcaaggtggtcaagaccaagagcgtcgagttcctgcccatcagcctctccttctgcctcacgctcagcgccgtcgcctggttctgctacggcctcttcaccaggacccctttgtcatgtaccccaacgtc

SEQ ID NO: 17731 - DNA, 4532 bp, Zea mays
  misc_feature (4176)..(4176): n is a, c, g, or t
tggctaagataaagtgcaattctacagtttaatatctgataagtgggccatatacccacctttaattttttttggtgaggtttcacttttattttaaatttatttttgtggggagggtttaacatcaaatacacacagttttcattaaattgctagctagttctgctctccggcgtttggtgcattattaagcatgcattattacatctttctccacgggtctatgtctttctacaaataaaccacacacacagccaaagttgaagtaatcctgtctacttgcgattggcaggtgaaaaaaagacacggcactttatatagcccacttttcacacgcgtcaaatgccagaaaaaagtcctttgagtgcagtgtacatatattatttttgtttcggaaaaataaattattgagcttgtagttagttagcagcgcatttgttgcgtaccaagatctttgtaggaggttatatatatatatatgcatatttcagcaaaccaatcatgtatatatacaacaactatagctgtaacacactttctgctacttgtgagacaagtgaaaaacccatatatacaccgtacacttgtttaatttttgacatatttcagacgttaaaaaatatattatgtatggactagtgccatctcttattaatcttaattaccatggcatacagtcatctatatattctgagagtggagaaatatataggagagaggggcagagaaataaaagaggtagctttattagcatatgcacaaatgacttcccctcgaaatctactgcaaggaaagtgcagattagatacacccattgtattgtatgccactgtgcgatcgacctgcatgctgtgctggttggtacacgcatgcatgcatgcatgtaccactgcacaccatgcattattctcttctctcgccaacaatgccgaactggacagcaccactgcaatcaacaggccgcggcctcccagaacggcagaaagggcagcgcggccggctatataaatccatgcccgtgctcgggtccaaaccacacacaaacacatcagcattcagcaatagctaatcgagcatcgtcgccttagctcctctcctctcctctccgtcgtcgtggaacttctctccgccggctgtcatatatataaaggagaagaagagaacagcaactctagctagccggccggcctccgtcgtcgccggcgtcgtcgactagctagctaactctcgatctccagttcctgcccccgcgccccacgcccggccgtcgtcgtcagcaatggcaggaggcttcttctccatggctcacccggccgtcaccctctccggcatcgcaggtacgtacgcgccaatgaaacaacaacgtcgtctcgagctagatcgatccatgcatgacgccggccgggaccggccggatagataggcggagatcgacttgcataatgcttcgcgtgtttggccttttcctggtgcttctttttttttttaaaaaaaatcttatgggaccttgatgacatgcttttcatgtggttttcattcattctgttgccgtactacgttcttctagattttgtttattccgacatgacgactgtcttgtccatccttgtatcatcgatccgtcctttgcatgcatgcatccaccagtcgtcagccttcctttttgccgtttgtgccattgcactgtagagcacgcacgcactctctagctgtagagaggcgcggcagtaggcatgcatgcagcagctagtcacactggacaaccaactgtcttgtccatcatctatcaacaatacttgcatatcagaatacgtagtatgtagctttagcatttttttttcttcacctatactactgctagctgcatcttcttgaactttctctgatgctccccgcggcccattgagacgacgatgcactctttctccaattcgttagctgcgatcatggcacaggcctttaatttgttgctagctagaacacacatgcatgcatcgccgaggtatagcaacttttccactcaagaataatggtaataagcagtgcagatcagatccacatattgggcattagatcacgaaatacagttgcaaatagctgctcacaacgtaacgcactatctaagaatcatttctatatacgtgtattttttgctggaatggttatgatcgatcggttgggcatgcagcagggaaggcgtgtgcgtgtgcatgcagctacctagctttttgccatatcagcgtttccttaacctaatcaccacgcttctctctgttagtggacgcacacgcattgtacatatatatgtgtatagtattgtactcctaccacttttactgaaaatgacgacactgacgcgtagttaccctcttctctcttgtttcttcgatttggattgtgcaggaaacatcatctccttcctggtgttccttgcaccagtgtaagtagctagctatagccacctttcttcgttcccttactgtctcaatttcagaccgactcggattcatgcgtgaatcgatggatgatccaagactgacatggcatgcctcttgtacgcaccgtaccaaaaacagggcgacgttcctgcaggtgtaccggaagaagtcgacgggcgggttcagctcggtgccgtacgtggtggcgctcttcagctcggtgctgtggatcttctacgcgctggtgaagaccaactcgaggccgctgctgaccatcaacgccttcggctgcggcgtggaggcggcctacatagtcctctacctggcgtacgcgccgcggcgggcgcgcctgcggactctggcctacttcttcctgctggacgtggcggccttcgcgctcgtcgtcgccgtcacgctcttcgccgtccgcgagccccaccgcgtcaagttcctcggcagcgtctgcctcgccttctccatggccgtcttcgtcgcgccgctcagcatcatcgtcaaggtggtcaagaccaagagcgtcgagttcctgcccatcagcctctccttctgcctcacgctcagcgccgtcgcctggttctgctacggcctcttcaccaaggacccctttgtcatggtaacgactgatcaataatgtaatatatggttaactgatccatatatatatataaaatggtaactgaataatgctggggatgtttctcgattatatatatctattcagtaccccaacgtcggcggcttcttcttcagctgcgtccagatgggcctctacttctggtaccgcaagccccgcccggcggccaagaacaacgccgtgctgccgacgaccacggacggcggcaacgcggtgcaggtgcaggggcaggtcatcgagctggcgcccaacacggtggccatcctgtcggtgagccccatccccatcgtgggcgtgcacaagatcgaggtggtggagcagcagcacaaggaggccgccgtggccgccgagacccgccggatggccgccgcaaacccggacggcgccatgccggaggtcatcgagatcgtccccgccgccgccgcggtgtgacccaacgccaatcaccatgcaccgtacacaccctgctagcttcttattagctagctcggatgacgtacgacagtttggtggcaagtggctggcagctcaagcatgcagatgcaggcatcgtcgtctgctagttgatcgtttagttggttaattgttggattattattgcgtgtctctctcgtgtgcgtagtcttgtctcagttcagttcagttcagtgtcgaatcaagtagtagtagctgttgtttgcattggatctgacaatgcatgctaataattatggtggtgtgatggtcttggtcggtacgtgcgtagtcgtctacgtacgccgtgtcaacgtcgtagatctctacgggaagatgataagactgtaacatgcagggcatgcatctatttatacttaacatattctttgtgtgcttaattttgcctgtcttgaatacccaaatcaaaagagtgcagttctagatttagtcggtccaaataaatataagaaaaagataataataagcatatttacactaatcaagaaactaatgttgatttaatctataaaattgtttcctccccaaacactactagggtgctaagctccacgaacacctaccaagtcaagacaatgcttcaacttgatattagataatgactttaacaantacaagattttcatcttcacacacattaagcttatgtacctcctgtaagcaataatcactctattgctcaagatagacttagaagtaatattgtttttgccacatggatgtcgtgacattgatagtatagctcattatgctctcattgctgctcaagaaactaatgttgcatttgaaccttcttcttattcggaagccatcttaaaagtcgtctagaggggggtgaataggcaaaacctgaaaattataatctttgaacacacactttacccggggttagggttagaaataaataatgttgaattcggagtgtggaagataattcttcttgctattagttgctcaattaatgcaga

SEQ ID NO: 17732 - DNA, 1052 bp, Zea mays
acatccaaacactgtaacaacttgtgtagtacttaatccctcgcacctcatgaatcccaacttcaacagtgtgtggagcgctcccgagatcaatatgatgaactcactcatcactagtcacatcgccaacaacacctacacaaacaacaaccagcatgttgtggcaagtcgtagtgccattgtgaaccacaataactttgggatgccaacggaggtcgttccacccgtggacaacatggacatgatgcaaggctatctaatggatgatacggatgccatgaggcttgttcagggacaacaacatatgccaaatgttgttcctaatcaaaggaggcatgcagtgaagttttggactacagatgagcacaggaatttccttcgtggtctagaagtgtttggccgtggtaaatggaagaacatctccaagtacttcgtccccacaaggacaccagtgcagatctctagccatgcacagaagtatttccgcaggcaggagtgcaccacagagaaacaacgctttagcatcaacgatgttggcctctacgacacacagccatgggtgcggcagaacaactcctctagcagctgggaggcgctcaccttcactgctggccgtgcgtacaatagtacaaactactgtgcctttaacagcctcccgtatgccagcagccaggcaagtaacaaccaggtagctacatggattacagaccagcaggcaactgcaagttcttctatagctcctccagcgacggaggagagccagatatataaccgataatatatataatggtcatcagcagctgggagaggctttcttcatatataatcaataggtagatagatatggacaacgtccattgactagtttaatttctatctatatgttttgtatccaatgatgcatgtaaaacctagttggttgttaaaggtcattagtaccatactatatatgggctagaaacagtttcattgaaatttgcccctgagcaatacaatgaaattttaccaatgtgttatttatatattaatgtgtctaaaaaaaaaaaaaaaaa

SEQ ID NO: 17733 - DNA, 1237 bp, Zea mays
  misc_feature (1)..(169): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagctacgtaggccccccccccccgtccaggacacggccagccggaacaccccgacaacccaggaccagaacagccgcgtcgaggcggccctcgagacccccggccccgacccatcccaccaccacccccacccccacccccacctcgcctcccggatccgcacccgatgggcagcctcggcggcgacgcggagccgcagggcgcgaggcggcggccgcggttcctgtgcctgcacgggttccgcaccagcggcgagatcatgcgcaagcaggtgctcgggaagtggcccgccgacgtcacggcgcgcctcgacctcgtcttcgccgacgcgccgttccccgccgagggcaagtccgacgtcgacggcatcttcgacccgccctactacgagtggttccagttcgacaagagttttatggagtacaggaatttcgacaagtgcctggcctacatcgaagagctgatgataaaagacggccccttcgacggactgatgggtttctcccagggttccattctgtcggcggcgcttccggggctccaagaacaagggctggccctgactagagtcccgaaggtcaagtacctcatcatcatcggtggcgccaagttccagtcaccgacggtggccagcaaggcgtacgccaacaagatcgcatgcccctcgcttcacttcatcggtgaaaacgacttcctgaaagtccatggtgaaaagctgatagaatcatgcgtggacccattcgtaatccgtcacccaaagggccacacagttccgaggctcgatgacgagagtttagtggtcatgcaccgtttccttgagaagattgagggggaggtacttgagtattcgtccaaagatgtcaacgaaaccgaagtgggcatgtgataaagactttagaccattagtacttgatgttggcgaaaaggctatacttgtactatttatttacagaatgaacatgtgatgtaacctcgattttcatgaggcatgattatgaaaaatacagaataatcgttttatattctatattacaagaagaaaaaaaaaaaaaaaaaacccgcggcc

SEQ ID NO: 17734 - DNA, 3418 bp, Zea mays
  misc_feature (2435)..(2435): n is a, c, g, or t
cctcgaggccggccgggggatttttcagaggaagaagggaaaagcctaggaaagccaccgctcaccttctccggagcacccccaccaccaaacacagctaacagcttggtgggatggggggaaaaggcttccctttggcttgcctgtgagtgggatctcttcttcctcccccagagcccctgccctcttccgccgacagcgagaaagcacgcggcgcacagcaacacgtccctgccgttccttttgactccggggatccctctcctccttgcctgccgaggaacccactagcttcctactacttcccctccgtcctctcgatccctctccccgttcccttgaccacccgagcatcaagtggcggggagggaacgcggcggcgcgggcgaggaccgatggagaaggggagcgcgccggcgatggccctggcgctcgccatgcttctcgcctgctccagcatcgctgccgtcacggcgcaggagaccgagcggatcgaaggaagcgctggtgatgtgttagaagataaccctgttgggaggctcaaggtctttgtctatgatctccccagcaaatacaacaagaagctgctgaagaaggatcctaggtgcctgaaccacatgtttgccgccgagatcttcatgcacaggttcctgttgtcgagtgctgtccgaacttttaatcctgaggaagcagattggttctacacgcccgtatacacgacatgcgatctcacccccaagggtcttcccttgcctttcaagtctcctcgaatgatgcgcagcgcgatccagctgattgctacgaattggccttactggaatagatcagagggcgctgatcatttctttgtcacgccccatgactttggtgcttgctttcattatcaggaagaaaaagcaatcggacggggaatccttcccttgcttcagcgtgctacgctggttcagaccttcggacagaagaaccatgtctgcctgaaggatgggtccatcaccatcccaccatacgcgcctcctcagaagatgcagactcaccttatccctgcagacacccctcgatccatcttcgtgtacttccgaggtctgttctatgacaccggcaatgaccccgagggtggttattatgcgagaggtgctcgcgcgtcggtctgggagaacttcaagaacaacccgctgtttgacatctcgaccgaccacccaccgacatactacgaagacatgcagcgctccgtgttctgcctctgcccgttgggctgggcaccgtggagtcccaggctggtggaggccgtggtcttcggctgcatcccggtgatcatcgcagacgacatcgtccttcccttcgcggacgccatcccgtgggaggagatcggcgtctttgtcgccgaggaggatgtcccgcggctggacagcatcctgacgtccattcccacggacgtcgtgctgaggaagcaacggctcctcgcgaacccgtctatgaagcaggccatgctgttcccacagcctgctcaagcaggagacgcgttccaccagattctgaacggtctcgcgcgcaagctcccgcacggtagcaatgtgttcctgaagcccggtgagagggccctgaactggacagccggaccaccaggcgacctcaagccttggtagcgtcttgtggatggatatgacctcttctctggaaaggaagtatggacaacatgattaatatacctgtgcctttgaactgccatgggtgcacatagtgctgaccacaagccaaatgtacattttttttgtatgtttttttcttctatctacaactgttacatatatatcttcatttctttttttctctttcccatttgcttgatgatataagagttccaaaccctgtcgaccatgtgtggatatatcataaatggaatttacaagattgtactgctaaaaaaaaaaaaaaatctttcaactgatgaatttgttgctgagttgtcaaggaatgctggggcaaattggccttgtgatgagagtaaattaacctagagaacgactgctggtttttggtgtaaagagggtgcagcagataggttaggaaacgagggtcaacacctgcacttagggcttattcgtttcaccattaattcatctggattaagtgccattaattcatctggattaagtggtattgagttggtttatatttataacaaatcaaaatttatcttaatacatttgaatccacatagaattgaaatctatatctatactacttattaaggttgtaagggtagcttgccgttctgcagggccgggctagagaaatttgaggccatgtgccaaatctggacctgcaggtggggtcaatcctcattttttttgtgaggggctgcaaacattctggtttgcagccagctgcaccaattttttcctcaaatctaaagcagtgtaatatatgtttttatnaaaaaccagtaataacaatctgcaagttgcagtaatatatattgcaatagaatatctaaagaaacatttctattttatttgaataacatcattcttttggtgggttttaaagaaaatttgtacaatatgcttatattcgatcttctccaaagcttcactctcgaatgctattgtggctaaataatacgtcttttttatcatagtagaacacaaatatgatacagactgagggatcgaacctaagatgtgctgaatcaaatatgagatagactgagggatcgaacccaagatgtgctgaatcaaatatgagacagactgagggatcgaacccaagatgtgctgaatcagcaacataactcaacccttcaaaccactccaccaactatgcttctttgtgagaaaaaacaatctttctccctttaccatttacgtggttctactactcatctccaccataatattgtgtcccgtacatccagattcccacgatcttcgcccgaagtctcctccttcggtccttccctcgattgatcccaactgccagtaccccatgtcgtctccgccatcgagtgcacgaatctcctcaaccgcacgcaacgcaaaaccctagccgcggtcgctcccgcccactcctagccccacgcctttgcgtcgccgtcctccactctccacgtcgacatcgacgtcgcgaccgttgctccgcccctcgcgattcttcctccccttctttccaagctatctaggtttagggcaatcactctggcacaaaccataatggaggaggaggcgcaagtcgtggagggcggcgctgtacgcgcgcgacctctctaggccacatcgacatgctaggtcgaggtcggccacatcgaagcaggagctgaggaaatcatcggcgcccagggtgacggcctccgaggcgcgcttgaccacgaagtagcacctgacggctccttccccaactccatgccagcggcgacatcacc

SEQ ID NO: 17735 - DNA, 1707 bp, Zea mays
  misc_feature (38)..(38): n is a, c, g, or t
ctcgaggccggccgggggagtcctccccctccttgccntacctggcgccgtgccgggccccgacggcatccaactagcttcctactacttccccccccgtcctctcgatctctctccccgttcccctgacgagccaggcgtcaagtggcagggaggagaggaggcaccgcgtgtgaggctcaatggggacggggagcgcgcgggcgctggccctggcgctcgccgtgcttctggcctgctccgacgtcgccgtcgtcacggctcaggaaaccgagcggatcgaaggaagcgctggtgatgtgttagaagatgaccctgttgggaggctcaaggtctatgtctatgatctccccagcaaatacaacaagaagctgctcaagaaggatcctaggtgcctgaaccatatgtttgccgctgagatcttcatgcaccggttcctgttgtcaagcgctgtccgaacttttaatcctgaggaagcagattggttctacacacccgtatacacgacgtgtgatctgacccctaagggtcttcccttgcctttcaagtctcctcggatgatgcgtagcgcaatccagctgattgctacgaactggccttactggaatagatcagagggcgcagatcatttctttgtcacaccccatgactttggtgcttgctttcattatcaggaagagaaagccattggacggggaatccttcccttgcttcagcgtgctacgttggttcagacctttggacagaagaaccatgtctgcctgaaggatgggtccatcacgatcccgccatatgcgcctcctcagaaaatgcagactcaccttatccccccggacacccctcgatccatctttgtgtacttccgaggtctgttctatgacaccggcaatgaccccgagggcggatactacgcaagaggtgctcgtgcatcggtctgggagaacttcaagaacaacccgctgtttgacatctcgaccgatcacccaccaacatactacgaagacatgcagcgctcggtgttctgcctctgcccgttgggctgggcaccgtggagtcccaggctagtcgaagccgtggtctttggctgcatcccggtgatcatcgcagacgacatcgtcctccccttcgcggacgccatcccgtgggaggagatcggcgtcttcgttgcagaggatgatgtcccgcagctggacagcatcctgacatccatccccacagacgtcgtgctgaggaagcagcggctccttgcgaacccgtcgatgaagcaggccatgctgttcccccagcctgctcagccaggagatgcgttccaccagatcctgaacggcctagcgcgcaagctcccgcacggcagcaatgtcttcctgaagcctggtgagagggccctgaactggaccgctggaccaccaggcgacctgaaaccttggtagcgtcctgtggatctgagatggatacgacttgttctgaaaggaaatatggagaacatgattatatatatacccgtgcctttgagttaccatgggtgcatagtgctgacaagaagccaaatgtacatcgttctatgttctttttctataactgttatatacatataaatatcttcgtttcttccaaaaaaaaaaaaaaaaccgccactagatgataagagtgccaagccttgtcggtcatatgtggatatatcataaatgaaattcacaagattgtact

SEQ ID NO: 17736 - DNA, 963 bp, Zea mays
aggccggccgggccgggaccttctctttctctgtagcctctgccccaaacagctttggagtgggatctcctcttccttccccgccctcttccgccgacagcgggagagtacgcggcgcagcggctacaccaccgtctccaggctcccaaacacgtccctgccatccttttttgactccggagtccctcccctccttgcctacctggcgaggatcccatacccaatcccatccaactagcttcctactacttcccccccgtcctctcgatccctctccccgttcccctgaccagccgggcgtcaagtggcagggaggagaggcggcaccgcgtgtgaggctcaatggggaaggggagcgcgcgggcgctggccctggcgctcgccgtgcttctcgcctgctccgacgtcgccgtcgtcacggctcaggaaaccgagcggatcgaaggaagcgctggtgatgtgttagaagatgaccctgttgggaggctcaaggtctatgtctatgatctccccagcaaatacaacaagaagctgctcaagaaggatcctaggtgcctgaaccatatgtttgccgctgagatcttcatgcaccggttcctgttgtcaagcgctgtccgaacttttaatcctgaggaagcagattggttctacacacccgtatacacgacgtgtgatctgacccctaagggtcttcccttgcctttcaagtctcctcggatgatgcgtagcgcaatccagctgattgctacgaactggccttactggaatagatcagagggcgcagatcatttctttgtcacaccccatgactttggtgcttgctttcattatcaggaagagaaagccattggacggggaatccttcccttgcttcagcgtgctacgttggttcagacctttggacagaagaaccatgtctgcctgaaggatgggtccatcacgatcccgccatatgcgcctcct

SEQ ID NO: 17737 - DNA, 1939 bp, Zea mays
ctgagttggaaggaagggagctggtcgctctctgcgcggccttccttcccgccaccaacttctcgcgcgccaccggccgctaaccatccaccgtcccaatcccaacgaaatatccccacatgcactgctcctcctccacctagtccggcggcattcggctatttatatgcgctccccgatccctctctcccgtccaggcagccattgccaaccacccactggccaacttcccatgagccctacccctgcatcatcaccgcggcagccggtgccggcgcccgcgctggcgtggcacggcatgccgcgttcaaggtccacagggactcccacagtatacacaaggccacctcggccgctctcctactccttgtcctcgatcaactcgtccatgtcgtcttcgtccaacgccgtaatccccagcagcggccaccaccggccggccccggcactgcagccgccagcgcggaggcagatgcagcagccaccgcagcagcagaagcaccaaccggtaatcatctacacgcactcgcctaaggtgatccgcaccaacccgcgcgacttcatgtccatcgtgcagaagctgaccggcctcgacggccccggtcaccacgcccgtggtgctgctggtgctgcgcctgcgcccccggcgggtcgcatcaactcggggtcggtcgtcgtcccctccccgcaggacgagtcgtcttcgtcttcgtcctcgtccgagagctgcgccaacacccacgccgcagggccgcctccctacgcggacacgcggttgatgccgccggccccgccggccccttcgctggatgcgcacttcatggcgcccgacatcccgctgctgtttgcacccgacgccgcagcatcagacccgcagcacctctgcgcgccaaggggtctctacggccagttcccgcaggtggacgccgcggcgatcggtccagtgatgtcgacgaacatgaacagcgctgccaccaacggtggtgccgtgttctccccgtcgatggtggagaccgtaagaatgtttccgggctataattaggcaggatttttttttctttaaaaaatctactccgtgcatgaatcaggcctcaggcgatgatgcagcgatgcaggagccgttgttatgcgatgcgtgtgcaataaccggaggttcatttttgcttgatcttttttttcttgttatggttgataccgtgaatgtgtagcagtagagaaatcaaagagaggaagatgatagatgagtcatgctgctccttgcgacatctcaatacatgttgcgatggaagtgaacctctagccgagttatatacatgtcctactactagttcaaaaaaaaaaaaaaaagaaatgtacgtagttagttaccgcttggttctattccatgagatccctgtaggctgtaggtattttttttcttcttattttggttccatctcacatgtcaattcataagcttttctttcgctctacataaatagaaactttggagggttttttaacatagcaccttcgaaaaataaaagctagctagatctgcagtgatgaagttaccaacaatgtcgatctcattaatcattattaacggtcactagacggctacattagctactactgaaataatactaatataatattaaattctaaataaatttagtaaaatttgagaactcaccataaaacgagaacttgaacataacttcataggtttgaccataagaaagcttactaattgttagggcgtgtaaagtttacggatattatccagacgtccgatcattcaaagaggtcaattattaagttggatagttttttcgaatattcgtagcatgtccagatatcagatgattgatatcttagattttggatatccggaatattttcctagatacatctttttagatatctagatatcttcatagatagttgtgtgcattga

SEQ ID NO: 17738 - DNA, 2084 bp, Zea mays
tgattaatgactaataaatttaaatcttttttgtaagcatcaattttttagccatcacgtattaatttcatagaaatcagtttttttatagagagaactacaaaaaaacaggaaaaatttgctgtgtcgttccaaacagaactttactagtgacatacgggacagttaaaattgatttatatactgcacattcagtcaaaattggaattgcacacggctgtcgaaaatggtacagacgcttcgtattccaagatttaccgggctctggttggcgggagaaaaagcgcgggcgtggttggcgatcggggtctgcacctcccaacttttatgtatctataaatacaaatacgagcaaattctatccctgtcggcgacccatttccagctccaccatggcaccaaccatccccgccgacgccatctccgtccccccccctgggcccggccggcccgttagcaacaccctcgtcatcgtgtcctcctctggatccgatcaacctgttagcaacaccctcgtcgacctgtcctcggcgaccttctcctctcgctccgtcgccatcctcccagacccatgcgccagccgtggcggcggcgaccaggccagggacgcgccgcggaaccggcgcccacactcgacggcgccatccgtcgtgcccgtcctttcgtcgaccgtcgtcaccgctgcttcattcgccgacggcagcggagccgaggccacgagccggcggaggccgacggcggctgcgcggcagcagtgcccgtcgccgcgctctgttttgtccgtccgcgcaccaggcggcgtcgccccagccccagcccctccctccagcggcggcggcgatgacgaggccacgagccggcccaagaggaaggcgcggtaccgaaagtggggcatcgacgacgagcgcaaggtcctcgctaccctagccgagctccgcagggacaacatgggcgtgctcccccagatctccgtgcttctcaagaagctctgcgcgaacggcggcctcgtccgccgcggcgtggatgccatcgagctttctgataaggtgtacaagctcaagaaaaagtacgtgaaggccgctgccaagttcgctgccagcggcggcaggcgcattcgcaaataccgcaaccaggagctctacgagatatccatggaggtgtggccggagctgatgagaggcgaaaaccaagacgtcagggtcggccactgatcatcgtctacgttcacgacgtgtcgtccacttcaaaatgaccagcagtccagtggctattgtatgaatctacctagctagacatgctgttcctgatgtgcatgtatgaactaccagtctagctagctagtactgtcttttggatatgaacgaagaatcttttgcacttgatgtcttactgttgatcccaggccacaaaatcacgcgtacctacaggacacaaaatagagatatatttggaataaataatcatttttttgaaacgacgctgagacctaaggtttagtaaagatgataaccagaaaccttggcatcccagccatgaatcaaacacggagtgaactactaaactagggcatttttctattcaattattagcaagcttgaatttatgggtgcccattaggtcgacaatatatgaccatctagcaatttaccaacatgttctacggcaacctgcaaaaacaaaccttgttgatcacttgctctgatttctgaaaggcatcaaagccaggcaacgcaaactttctcccttccatttatctttaactttggagataaactgatgagaagaagtcaagtgagattgaaattctaacagaattaagaattagtacacagaagctcaatagtagcgattgtgaaactatttttattgacggtcctcagttacccgcatgtaaaatcgatgattccactttcactgtaagttgagttaagaaaaccattgatgaaaatcggcgatcaacgtagtaaaccattgaaaataattttcagaaacattaaacgagttttaaaaacagcaaaaaatttatcttaggagaggcctcagcccaccccaccagccccgtctccgtcaaaatcgcgagtggc

SEQ ID NO: 17739 - DNA, 1367 bp, Zea mays
ggtactggccggcgcagctgttcacgcacctgtcggaccacgccgccatggtggagtggggcggcgaggtggtggacaccaggcccggcggggcgcacaccgccacgcagatgggctcgggccgcttcgccgccgagggcttcggccgcgccagctacttccgcaacctggagacggtggacgccgacaacagcctggccgaggtggcgctcgacgccatccagacgctggccgaggaccccgcctgctacgacatacgcaaggcctacgacgacgacgacgacgacgacgacggccagcactccgcccgcggaggctggggaacccacttctactacggtggcccgggacacaacccggcatgcccctgatggccggatctctgtcctctgatggagttgtgacgatgagcgcgcgcgcggcacctgaccggccgtacgtaccatggatggcatgcattattgatttaacttccgcctatatatgtgtacgtggccaaattttgacgtacgttcgcacgtgcctttgctagtatttcaagctttcgctaattctacctgtaaggacttgcaatatgtaattaacgaactgttgatttatctgttctttcaatcgatcccaaggatcgtcccaaatttcattttcctcgaaagccatcgatgctgcgtgagttccaaaatgctgctcattgatcagtggtgtggtggacctaagatatgctcaagaatcaagactagagcctctttctaattctagctgtggaaactacctattataactctaccaaatcctacaaagaccgggtgtttgaatacactagaactaatagttacttgactaaaaattgttagtggaattagctagctaataaatagctaccttaactattaactaatttaccaaaaatatctaatagctgaaatattagctagggtgtttagatgtctcaactaattttagctacttactattagatctagtgtattcaaacatccccttagattcttgatcacaaagtggacagagtttcatctgacatagtttcatccccgtgaaactaatttcatcgccataaaacttattcctcataaatgtcatgtcatatctaaaatctaatatagcatattattaaatgtgtataaaaccaccataaaagtatcattgagaataaccttatcatagcatctccagaagaccatgtaaaggagtgtacaaaacataattttggactgtaaactgcactatttatacattagagtttaaaataaggaggtctaaacggaacaaaagcaggcgtaagatttaagaaaagcccaagcggatactaaaataataatagtaacagatgatctcacatcaacaaacag

SEQ ID NO: 17740 - DNA, 1732 bp, Zea mays
cggatacgggccgattccccgcgcccctggacatgcaagtgacgaaccctttttagatctggcctgcacccacgcatacaggctcggatggtgctgtgcaggtaacaatcaaacacgcagctacggtcaacgcattccacgggtctggacacagccggccaggaaaccaatcatacggatagtctcatgtgtgccgaggttcgtgcctcggaggctgggctcgcgaggcttggaacggggagagagggaggtcgtcggcgtcgtagtaggttggacaggtggcgccgtgtcagggagacagggactcagggagctagggttacgtaggttttgtagtaggctgccagctgagtcgtggcccgtggaccatgggggctagcgctcggcctgggtgcctggcggccttctactagtggctaatttggctggatatttctggtatatttggtatcttagatacgggttaatatccaattagatctgaacttagttcggttatttaatttcgttacccgccggaactgttcgggtaatgagcttagggctaaacgggtacggattcaagtatttcaggtataggacttcagactcaggttttatgccagatctggttgaatgcctaggttgcaatatttgaaatgccgtaacaaacataaaaaaccctatgaaccacgaaaactatgtattacaagtatttgagctcctgacatgtatagtaaatcaaaataactcatggttcgtgagcataaactagcctgtctctaaattggagttgttgttaattaatgggccaaagaatcgtgtccacatgggacgcccactaaacttccccggccgtctcgtctcgtgctcgctcttttttcgttctttctttcccgtctccgcaccgctgtcttgtgtcccctccccccctcagatcagatctctccctctccttctcccggccccgagtggagctgtggaggcacctcgcatcaccgccttcgtctctccagactagccgagagagatctcgacaccgccgcccgttgccatggcggcggccaacgcccccatcgccatgcgcgaggcgctcacggtaacaccttcgccacctcgtcctcctcttcttctccatccattcacccactgatcgttcgttgcttgcctgtcctccgcagctcaccagcctgggcatcgcgccgcagtttgtcaccttcacccacgtcaccatggagtcggagaagtacatctgcgtccgcgagacctccccgcagaacagcgtcgtcatcatcgacatggccatgcccatgcagccgctccgacggcccatcaccgccgactccgccctcatgaaccccaacaccaggatcctcgccctcaaagcccaaatacctggaacaacacaggatcacctccaaatattcaacatcgaggctaagactaagatcaagtctcaccagatgccggagcaggttgtattctggaaatggatcactcccaaattgttgggtttagtgacacaaacatctgtttaccactggtcgattgaaggtgattctgagccctccaagatgtttgataggacagctaacctggcaaacaatcagatcatcaactatcgatgtgacccagcagagaagtggcttgtgcttattggaattgcaccgggagccccagagagaccacaactggtgaagggaaatatgcaacttttttctgtcgatcaacagcgtagccagcgacagcaacg

SEQ ID NO: 17741 - DNA, 1059 bp, Zea mays
cccacgcgtccggcaattgttagtaatgcagatttggacagctgttcttctgaaattctggagctcttcaataaagctgaggataatattgagaaaggtatagagatgtgggaggaaatggaagaacagcgtctgaagaatcgatctaaacctagccaggagaatattgtgctagagaagatgggcttggaggagtatatcaaggatgtatccactgatgatgcggctgaacaggcttccaatttaaggtctcagataaacattttatggggtatgctcctttatgaacgttcagttgtggaatttaaattaggtctcccaatgtgggaggattgtttgatggctgctattgaaaagttcaaacttgggggagcttctgccacagatattgctgtgctggtgaaaaaccactgtgccaatgaaactgctcaagatggtttgggcttcaagattgatgaaattgttcaagcctggaatgaaatgtatgacattaaacggtggctgcgtggtgttccatcgtttcgccttgagccattatttaggcgaagagttccacaattgcatactgcacttgaacatatatagtactcatgaagttgttctacatcatattggatttcaaggcttttttatcagtgacacttttctcttttttggtcaatttctgcatgggatacactacatggatttgttatattgcattttttacacctgaaagagtctgcttcctggttgtgaagctattcatacaagcctattcttttcacaaggctggtagccctctgtggtttgcatactctagttcttgttttggtcaggtttgctatgtaactcacaggaagctgtgcttttgttattgaattagttgttcatatgattgtgacatggtagtccattgttgggggatgtcatgggtggcatcctccttttcctttgtggtattttatctgttctgcaatgcgcaaactcagttaggcttgtactgcagttacatttagaattcgttgttttcttaaaggaaaaaaaaaaaaaaaaaaaaaaaaaaaaaaaaaaaaaaaa

SEQ ID NO: 17742 - DNA, 1121 bp, Zea mays
cagctcctcctccctcctatcatcctcttcctcaacgctccctcgtcattatataacacgaggatcagttcagagctgcttgacaaacactcacacctagcgaacagctatacacccaaccaggtggagagctgcaagccaccaagaccaaagtgatcgcaacctgtgcggcggcggcggcggcgacgatgagcaggaacaacggcaaggcgtcgaagctggagctcctgaggatgggcctgtcgagggcgaggggcgggccctcggcgacggcgcggcccggcggcggggacagcggcagcaacggccgcgcgacgacgtcgccgcgccgggtgtcctcctcgtcctcgtccaccgcgtcgccgccgagctcgtgcgtgtcgtccgagggcagccccgacgcggccgccgccgcgccggcgcccatggtcctggccgggtgcccccggtgcatgatgtacgtgatgctgtcccgcgaggacccccggtgcccccggtgccacaacgccgtgctgctcgacttcagcgagggcgaccagcgccgcccgcgtcagcgccggtgaaatggaaccaccacgagcgatcgagcacgtctgagttcgtcgttgccttcaagaagtcgtcgtcgtagcttcattttcccattcgcggccggagtttgtttcgattacccaaggaattattgcatagacctgtttcttccgagcggcacggtgccaaagggatcggtctaggtaataatttcatgctttgttagacaataataataagaataataatttcgtcttcctactagtactacgcgttgtgctagtgtacaagcattgttctatttttgctaataactgaagttgcgctcttgttccccacacgcgaaaataaaaaaaaacatttctcgtagtaccggcggacggtgcataaatatgctgcagccacatgcaatgcaatgcgattgatgaaatgcatgtgcatgcattatattgtggctcatagtgtagtgtaaggacatgtagaactctaagatgaggttcagtttttcaaatacgggagacagttaataaaatatatgatacaacactgagattttagaatatgaatacatttaatagacaatatgtatg

SEQ ID NO: 17743 - DNA, 1718 bp, Zea mays
ccctatcttaggtttggtggatcgtttaatggtttattgtggcatgttcaaccattttctaagggcccgttcggttataccgaaataagccaggattcattctagctcatcaaaatctatataaattagagaaataatccggctaggaattaatccgaggcttcaatcccaaacaaccaaagagggcctaagacgtccaatttcctgatcagagtatgtgtacatgtacattcaagaaggtgcagatgtcaggctactcactccatctgctaacacttgtattgaattgtaataatatgaaaacggtgttgattactcgtgtagtttcatcacccagaaaatacaaattttgatcggttacattccacggttccttatggtcccgcacagaagctggaagcaacaaaagtagcctacagtacagcactccctatatgttcagacttgggagcggttcacgattgggtgcgttttcagttttgggaggaacgagcagttcacgatttcatctctgaaactgaaacgataatgtgagctgatactgcaaacctactgagctcatctgaggcagggaaattgccaacagaatcatcaggaggagacagacgatttgctcggcatgcaccactgacggagcagcccctagtcctagtgcgcgcgcgcgccggcagcagcaacttccttgcgctcactgtcaccgtcgtcatcgtcgtcgatccaatcccagtagtggcgcttcacggtgatggcaccggcggcgtcgtcctcgccggcctcctcggtctcgaactcgccgtcctcgggcacgccgtccaccacctcggcgtcgaccgcgtggagcacgtagcgggcggggaggcccgggtaggacgcggactcccgctcctccacgcgcgcgccggccccgccgaggatccggacgcgggcgcgggcgccgagctcctcccggacggcgcgcgccgcggcggcctcgggggactcgccgggccgcatcttctcggacagcggccgcgggccgcgccgccggaccgtgccgtcggagagcagctgccgggtttccacgagccgcgcgccgcgccggttgcggatgcggaccgtggccacgtgcaccgcgcggaccacccgcggcgaggcggcgtccagcgcgcagtcgcccacggcgagctccaggaacaggttcgcgagggtcttggtccccggcacggcgccccaggaggagagcgccccgggagggagccgcggccggaggaacgccgccagcgagtacagcgtcgggaacgcgacaggcggccgcggcgacgacggcgacggcggccgcatcggcgcggggtcttcagcggggcggtggatgggatcgggccgcgtcgcctgcgctgctgctggtggtggggaatccttctccatgcggggatcttcagtggagcaggaatttcctcttccaattcgctgggatcgttttctgaccagatcggcgtaggcccaatcgtgacttggcccattcgcgttggcggcgtaatacggatggaacgcggaaaaagcagcccaagcccaacaaatagaaacgacgtcatgattttgcaactttgcaatgtgaatgtcctatgttccatcctctcttccagtctttttcttcatgaatccatgatgaatcttgtcacatttattgatttgcaagcgaagttatatagtttgtcagaatttgtatataatcaatcaga

SEQ ID NO: 17744 - DNA, 1142 bp, Zea mays
ggccgctttttccgggctcgtgttttttttttttttttttttcacagaagaagtcgcagtaactgcgtgcattagactttgggcaaaagcttaccagcataatctttctaggctaaaagaaaaaaggtgtttcagaatatacggcaaaacttctacaggcctttctattcatatcagtctgaacattcagttcacaacagcacatgctgctgatgccagcatgatctcttcaggcttcattttcgtggtggcggcggctgcctcttcacggaccggagttgcggcgagttctcaaagcagtggtagaacccaaagtgtgggaaccgctcgtaccacgtgtcctgcggggcgtgcgtgtcccagtgctcgccactgctgctgcgcccgtacttgtgcacccacccagacccgttgtgccgctcaccccaggtgcggttccaccggtccccatgcttgcccgcccaccatgtctccccctgcttgacgccatgcccattcaggtcgaagtgctcgtcccacttgtcgccccatttagaccacccgtcgccctccgaacgctcggcccacttgtcggtgtacttttcgctgccaccaaggccgtcgtacttctcgccccatctttcatgccagacatgggcatggccgacatccagcggtgtgtttggatccaagctgcaccatttatcagcccatttttcggttttgccggtcgagtcatagtgctcaaaccattgctcttgccactgctcccctttaccgttctgtccccacttgtctgcattcttctccatatgcataaccccacatgtgtaatcctgccacattgactccttccagtattcccgccaaacgttgcccgcagcatcacgcccagacttctccgagcctaactctttatgatcgaaccggtctgaggcctcccagtatttgtcttcccattcaacagcgccatcagcactaactcccctgatcacggtccacttgcaaacaacaccatcaggtcttcgttctacacctacttccttccaccacattgagccatctagatgtattccgtgtgatggtttcccgacgctctcactgagcgcgcgagccgccgccgccggccccggcccccttgccgccgggaacatcgacgtggg

SEQ ID NO: 17745 - DNA, 1234 bp, Zea mays
ctcaagaagtcgtaccgccggctggccatgaggtggcaccccgacaagaaccctggcgacgtcaagaaggaagccgaggccaaattcaagaagatctccgaggcctacgaggttctgagtgatccccagaagagggcggcgtacgatcagtacggcgaggaaggcctgaaggcctccgcagacggtggtggtggtggtggttccacgtccacgaacggggccgccaaccaacgtttcaaccctcgcaacgccgaggacgtgttcgccgagttctttggcagcaacaagccgttcgagaacatggggcgagccaagtcaatgaggttccagacagaaggcgctggcaccttcggtgggttcggtgggaacgagagcaagttcagaccatacaacaacgattcggccggcaccggctccagtcaggctcggaagccgccgcccgtggagaccaaactgccctgcacgctcgaagagctgtacgcaggctcagcacgcaagatgaagatctccaggaacgttgtgaagccgaatgggcaactagggaccgaatcggagattctaacgatcgatataaagcccggctggaagaaggggaccaagatcacgttcccggacaagggcaacgagcagccgaaccaactccccgccgacctcgtcttcgtcatcgacgagaaaccccatgacctgtacacgagagagggcaacgacctcctggtccaccggaagatcgatctggtggacgcgttggcaggaacgacggtcagcctgaagacgctcgacgggcgtgacctggtgattaggctcacggacgtggtgacacctgggtacgagcttgtggtcgccaaggaggggatgcctatcgtcaaggagaacgggaggagaggcaacctgaggatcaagttcgacgtcggtttccctaagaggttgtcgtcggagcagcggcacaccattcggaaggttcttggaggccagcctcagcagcagtgagcacaggcgttcgaaacaagattgtctgccccttattggctacccatgcaaagcagatttgcagactagttcagatgttcttctctttctttggctggcttgtattgtatgtttagttgatttttcctttgtggtgttttctgatcttcttctcccttgttggaaaaaatggtggtattgaagaccacaggtgtaatacaagaatgctgtctacatgtttcagatatcgtttggttcacatatttgt

SEQ ID NO: 17746 - DNA, 2912 bp, Zea mays
gggacacgagcacgcaccaaccctctctctgaaaaaccacgcaccaaacccaacaccgctggaccgtgcattccgcctacccctcctccctgccacctccgcttgcatttattaaccacctcccctcccccacgacatctcgtgtctctgttgggagctccttcaacatctcgtctctctcatcctccgacgccatccgctcccggcccggccgagccgcgcgttgtgtatggattccaaaagcaatcatacaggggctatggcgaggccttacaaacctaagaatatcctcattacaggagctgctggttttatcgcctcccatgtcgcaatccgcattaccaagaagtaccccgattacaagattatcgtccttgacaaacttgactactgctctaatctgaagaacctgcttcctgtgagctcatcaccaaacttcaagtttgtgaagggtgatattgcaagtgttgatcttgtcaacttccttcttgtcacagagaacattgataccataatgcacttcgcggcccagacacatgtcgacaattcatttgggaattctttcgaatttaccaagaacaatatttatggtacacatgtacttcttgaggcctgcaggattagtggccagatcaagaggttcatccatgtcagcactgatgaggtctatggggagactgacgaggatgcagttgttggcaaccatgaagcatcacagctgcttcctacaaacccatatgcagccaccaaagcgggagcggagatgcttgtaatggcatatgggagatcctatggactgccagttatcactactcggggaaacaatgtctatggcccaaatcagttccctgagaagcttatcccaaagttcattctcttggccatgagaggggagcccctccctatccatggtgatggagtcaatgttcgtagctacctctattgtgaggatgttgcggaggcatttgaggtcattcttcatcatggagaagttggacatgtttataatattggaacaaaaagggagaggacagtgcttgatgtggcaaaagatgtttgcagactcttcaatcttgaacctgacaaagtcatcatgtttgtcgagaacagacctttcaatgaccagaggtatttcttggacgatgagaagctcaagagccttggatgggctgagcgcaccccatgggaagaaggcttaaaaaaggcaatggagtggtatgtagcaaaatctgattattggggtgatgtttctggggccttactgcctcatccaaggacattgatgatgccagggtgcgagggctcagaggagattaaaggaatactcagccggtttaataacattcaaacaaaggtcggttcaacatcagataatgctccagaaccgcatgccttcaagttcttgatatatggcaggacaggatggatcggcggacttcttgggaaaatatgtgagaagaaaggaattccgtatgaatatggaaatggccgcttgcaagagcgttcttcactagtcctagacatccaaactattaagccaacacatgtcttcaatgccgctggtgtgactggaaggcccaatgttgactggtgtgaatcgcacaagccggacaccatccgtaccaatgttgtgggcaccttgaatctagcagatgtatgtaggaagcatggcttattgatgatgaactatgccactgggtgcatatttgaatacgatgcacatcatcctgaagggtcaggtatcggcttcaaagaggaagatacaccaaattttactggttcgttctactcgaagacgaaggcaatggtcgaggagttattgaaggagtatgagaacgtctgcactctgcgagttcggatgccgatatcctctgacctcagcaacccgcggaacttcgtgacaaagatcagccgttacaacaaggtggtgaacatccccaacagcatgacgatattggacgaactcctgcccatctcagtggagatggcgaagaggaacctgcggggcatctataacttcaccaaccccggcgtcgtcagccacaacgagatcctagagatgtacaagcagtacatcgaccctagcttcaagtggacaaacttcaccctcgaggagcaggcgaaggtcatcgttgctccgcgaagcaacaacgagatggacgcaaccaagctgaagaacgagttccccgagctgctgtcgatcaaggactcgttgatcaagtacgtctttgagcccaacagaaaggtgcccacagactgaagcccgaagggctggcacagctgataccgtacaacacagcaaccattagtgttagactatgtgtgtgggccagcactactttacttttgggctgtcggtctattagggttagagtcctgtgagtctatatattgtacctcatctcttatacaatacatttttgggctgcgagtctaaaaaaaaaaaaaaaacagaggcgggcgcgggcggggctgtccgcccagatccacaccgccgccgcttctagggcaggtcgtcgtgacctggacctcccccgcacggacatcgctgcggccgctggacgcggccactaagtgtgtttggtttgatgtcaaagtaggatgagtcgggggcgctatcgtcccctcgattttttgggatcatgccgcccccaaaaattacttcggtgttcacctcgcccccgcttaactctcaaccaaacactatataaaatgtggctgtctcattctatccctctttgtacattcaaccaaacacaccctagctagatccacgcgccacccaccgtgatcccctgccctcctcctcatcgggtcagacgccagcgacccttccccgccccatcgacctgtgcacgtgcgggtgtgcagccacgccgctccgacgaacgggtgccctgctgcaggcatgc

SEQ ID NO: 17747 - DNA, 2339 bp, Zea mays
acgcggggaagcacaagcaaccagccagctagtttccaagggatcacctgctctctagcactagcagcaatggcggccgtcggcgctccgggcagctctctgcacggagtcacggggcgcgagccggcgttcgccttctccacggagcacgaggaggcggcgagcaatggtggcaagttcgacctgccggtggactcagagcacaaggcgaagagcgtccgtctcttctccgtggcgaacccacacatgcgcaccttccacctctcctggatctccttcttcacctgcttcgtgtccaccttcgccgccgcgccgctggtccccatcatccgcgacaacctcaacctcaccaaggccgacatcggcaacgcgggcgtggcctcggtgtcgggctccatcttctcccgcctcaccatgggcgccgtctgcgacctgctgggcccgcgctacggctgcgccttcctcatcatgctgtccgcgcccaccgtgttctgcatgtcgctcatcgacgacgccgcgggctacatcaccgtcaggttcctcatcggcttctccctcgccaccttcgtctcctgccagtactggatgagcaccatgttcagcagcaagatcatcggcaccgtcaacgggctcgccgccggatggggcacaatgggaaggcggcgccacgcagctcatcatgccgctcgtctacgacgtcatccgcaagtgcggcgccacgccattcacggcctggcgcctcgcctacttcgtgccgggcctcatgcacgtcgtcatgggcgtcctggtgctcacgctggggcaggacctccccgacggcaacctcaggtcgctgcagaagaagggcaacgtcaacaaggacagcttctccaaggtcatgtggtacgccgtcatcaactaccgtacctggatcttcgtcctcctctacggctactgcatgggcgtcgagctcaccaccgacaacgtcatcgccgagtacatgtacgaccgcttcgacctcgacctccgcgtcgccgggaccatcgccgcctgcttcggcatggccaacatcgtcgcacgccctatgggcggcatcatgtcggacatgggcgcgcgctactggggcatgcgcgctcgcctctggaacatctggatcctccagaccgccggcggcgccttctgcctctggctgggacgcgccagcaccctccccgtctccgtcgtcgccatggtgctcttctccttctgcgcgcaggcggcctgcggcgccatcttcggggtcatccccttcgtctcccgccgctccctcggcatcatctccggcatgacgggcgccggcggcaacttcggcgccgggctcacgcagctgctcttctttacctcctcgacctactccacgggcagggggctggagtacatgggcatcatgatcatggcgtgcacgctgccggtggtgttcgtgcacttcccgcagtgggggtccatgttcttcccgcccagcgccaccgccgacgaggagggctactacgcctccgagtggaacgacgacgagaagagcaagggactccatagcgctagcctcaagttcgccgagaacagccgctcagagcgcggcaagcgcaacgtcatccaggccgacgccgccgccacgccggagcatgtctaagtctactactaagatggatcgatcgacgatcacctatacctctttgtatgtacgaatatgccttgttattactgtgcgcgcgcatatacaatacacgtgtgctccgttgacatgagttatatagcactaaaaacttcttttgaattcgcgtctattcagcttaatcaacgtttgttgaagcgattaggtgttaaatttaaacaaaatttcacacaaaaccacttaaacacatgttattttaccacaatccaacttatataatctaagataagagggccataagatccatacacagacatggaaacaagtcctataatatctgttgaggcacaagtatgtactagtaagtatacaaactaaacttacatttttgttgtgtataataatgtgtgttattgattgttttaagcacaacatttgtatcaacacactttgcatgcacattgccattccttcggtgccacaaatgttttatgatgtgtaattggtgtactggatttggcacactatcttagaaccaacaatctctgtccattcaaaattcgctttcattatcgaacttcaaactaacagtgtcgacttcgacttttaagcaaaatatatcagcgattctcgaacttagcatgttgtgtcatttgagacccagaactctcaaaaccaagaaaaacaagtgatgtaacttggttgacccatc

SEQ ID NO: 17748 - DNA, 5088 bp, Zea mays
gcgactttaaaagtgaattatccaaaactatatttctttcgcatatattttttcctatatttaacttatacaaaatttaacaccacatatacatgcaaatagaaaacagaaattatttgtgataaccatttatgccgaacacttccatcattttctcttctgcttccataaactaagacatttgtttcccaattatacaggttcaaaatggacctctacgtattaaagaaaggtcggacacaagatcttccaacaactgaagattttctcagattatcagcagcttttaggttgtagaatgtcctttatataattatatataactgctcaacttttatgaagacatttcatgtaaatataacaaggtagcttgaaatgttgcaacaaacatactaccttctgccagtgctcatttaactctattttactttatacaaatctgctatgctctaaactgtcttttactctgtattattaaaaaaatcgcttgctttattagtacagcaatattgcataccatttaccacgcgcgctttgcgcgcacccgttactagtaaatattataaagccaacagttgttgcacctaaggccatattcagccgccatgtaaacggccatgtaaagtggagcattaggtaggcctctggtctgcagtcttggttcaatacagcttaatggtctgtttggcattcgagctttaccatcagtttttggaaggagccgtaccaaactttttttaaaaaagaagagctgttgttttctgtacagtagaggagctagagccgtttttaggtgaggagctggagtttgtacaaagtggctcagggacctgaagtgctctggctccaccaaaggatcacttgagaaggagcccaaccaaacatgccctaaccatttatctgattcccaggaaacattcacataacattatacagaacagtttggacctataaatttattgtatgtttggttttccagaagctgattaatttaatatttggatatctccaaaagaatgagattaagatccaaagacacttggatttcagaacccacatatctatactaaccctgcaatttggagactctcactatgcaaaggaaataaccattatgtgaatgacatagggtcttcttttatctagaatatagaatgtaggttagtagaaggagatccaaataagagcagagcgatttggtttgcctaagagcatctccaactaaaaaagtaaaacgaattttattttgggacaaaacaaccgcatctctgaaagaggagagaaaaaagagtacctcagttcgaataattggaagttgagtagaggatgcattcgatggaacttaggaaactcttttgacagtgacagcccaccaatgaacaacagcccaactagagagaaatgggcctagtgaagcgaaaagggtaagtgtgctccacgtacaaaaaaaaaccatcaacacacgttaattagttttttaacagaaaatatgtaatttttataaaaaaaataaaaaggttaagaaaatacaaacttataaaagtgtttcatcttcatcagaaatacttcatccatcctaaaatatagttctttctagactttttttgtccatatacattggaatcataataaatataaatatacatataaactactatatgattagtctaaaacaaattatattatgagagcagagtgagtatattctagtaggactagctgtgtacggctgttgtacgtaccaacagtcaagtttattttttgctattttttttgtgtgtttaagtcaaacacctaacgtaaccgctgaaaataaaatagatataagaatggatgtatatatatgtgaacgcatggctgttaattagtgttgagactgaatggaataaaacgtctatcagagctgtaaaagctcatgatatcgcagggtcggctgcagccctcataagtcctaagggccacatgcatattccttgcttgattagcttgaaattatatatattagttgttagagagaacaggaaaagaaaggaaaacgacgcatgcaagcagtgtgagtgtgatgtgatccttggaggattccatgggataattacgttcggatcggagatgcggcgccaaggttttcactccctgtgctgtgctcattcattgcctgctagcttctctatttcaagtcataggacataggagtccatgtcagctgctgttgatctagctagagagatcgactaaagatcgactaagctgctatggattctatttttcaccggtagactcatgaatactatacggcctcatcgttatgggctcctagaacacccctaaatctggtcggtagatatacgatgaacaacaatatagaggaaacctatctatctaataactgcgttcgtacgtatatgttggcccgtccgaactcgttaaaacacacatcttctcttacaacattctcacgtgtaggcgatgtatcagcagaagcaagcatataatgtaccatgaatgtatgactaatccacatcatctcaacgacctcgtcttcgacccatcctgttcgctgttgcggccgttcgactgcgggtacgttacgcctagctagctaggtcggcactctgaattattgtctgttcctttccttcctatgagccaggaatgaacagtacgtgctttagtcgtcgttgctactagccccggccggcctcttcccaagctgcagtggccataaggagacgcggcgatcaggccttccttaattttcttctgttccatcctcgctctacctgcctgctgccagtttcaactctccaaggtcaacgccagccctcgcgcgcttggtgtactctagtttagtacaccaatccgcatgcattcttttttgtttgtttgtttgtttgtttgttttgattgacaaatatatgcggcagagttaagaacgaatcgactccgtcgtctcggctagtcgaccgtacatatccacgacctccaaaggccgccaaaacacccgatccggccagccttgtcgtgtcatcgtccagttagatgtcaactcccatctgaatctcctcctccatggcggctttcctataaatacgtcgcctttccatgttggatgtcattccattccagcaggcaacagcagctatagtttccaagggaaagggatacatcacctgctgctctagctctgctatagcgctagcagcaatataatggcggccgtcggcgccccgggcagctctctgcacggagtcacggggcgcgagccggcgttcgccttctccacggagcacgaggaggcggcgagcaatggcggcaagttcgacctgccggtggactcggagcacaaggcgaagagcgtccggctcttctccgtggccaacccgcacatgcgcaccttccacctctcctggatctccttcttcacctgcttcgtgtccaccttcgccgccgcgccgctggtccccatcatccgcgacaacctcaacctcaccaaggccgacatcggcaacgcgggcgtggcctccgtgtcgggctccatcttctcccgcctcaccatgggcgccgtctgcgacctgctgggcccgcgctacggctgcgccttcctcatcatgctgtccgcgcccaccgtgttctgcatgtcgctcatcgacgacgccgcgggctacatcgccgtcaggttcctcatcggcttctccctcgccaccttcgtctcctgccagtactggatgagcaccatgttcagcagcaagatcatcggcaccgtcaacgggctcgccgccggatggggcaacatgggcggcggcgccacgcagctcatcatgccgctcgtctacgacgtcatccgcaagtgcggcgccacgcccttcacggcgtggcgcctcgcctacttcgtgccgggcctcatgcacgtcgtcatgggcgtcctggtgctcacgctggggcaggacctccccgacggcaacctcaggtcgctgcagaagaagggcaacgtcaacaaggacagcttctccaaggtcatgtggtacgccgtcatcaactaccgcacctggatcttcgtcctcctctacggctactgcatgggcgtcgagctcaccaccgacaacgtcatcgccgagtacatgtacgaccgcttcgacctcgacctccgcgtcgccgggaccatcgccgcctgcttcggcatggccaacatcgtcgcgcgccccatgggcggcatcatgtccgacatgggcgcgcgctactggggcatgcgcgctcgcctctggaacatctggatcctccagaccgccggcggcgccttctgcctctggctgggacgcgccagcaccctccccgtctccgtcgtcgccatggtgctcttctccttctgcgcgcaggcggcctgcggcgccatcttcggggtcatcccctttgtctcccgccgctccctcggcatcatctccggcatgacgggcgccggcggcaacttcggcgcggggctcacgcagctgctcttcttcacctcctcaacctactccacgggcagggggctagagtacatgggcatcatgatcatggcgtgcacgctacctgtggtgttcgtgcacttcccgcagtgggggtccatgttcttcccgcccagcgccaccgccgacgaggagggctactacgcctccgagtggaacgacgacgagaagagcaagggactccatagcgccagcctcaagtttgccgagaacagccgctcagagcgcggcaagcgaaacgtcatccaggccgatgccgccgccacgccggagcatgtctaagtctactactaataagatggatcgatccatcatccatgttcacctgctacctacctctacgtgtatgccttgtaacgcgccggaccggagcacttgtttgatacaaaagcacatgttaccaacacatagttgagatgtgccaacgatattcatcatgatgagtgattaccaaaaagatatcatctttggtttacagttgactaatcttagcatgagtatgggtgatgttgtacagcacgtctcttggcttatggtgtgtactaggtggatgaccgtacgttgctacggagtcaacatgtaatta

SEQ ID NO: 17749 - DNA, 2355 bp, Zea mays
gtttgacttctcccagttccttcagacacagtcagctacaaaatataacccatctgttgcacctaataatctgccaccaatctccatgctgcagacttcaaaacagggaggcttccccaatactcagtctacgcaacatgttcccagtacaagcatttcgtcgggtcttcctctcccacaacaattgcctgtatactctcagccaactctgccccttgggccttttaccagcctggttggctatccatatttgcctcagaactattacctaccttcacgttgctgtcggcaagcgtactcaagtaatgggcctttccatcaatctgctgctcctgccgtgcctggagctggtatgaagtatccgatgccacaatacaagagcagccctcctgcttcgaccctaccacaaccatcatcactctctggttacggagggttcggaagtgcaaataatatccctggaaatttcagccaaaatcagggtgctcccgctgcacccacaactttgggatttgatgaagctttaggcacacaattcaaacaccccaatcattatgcagcactacagcaggtaatgatgacatagtgctctggttcatcttctggtgcccttggttggatctatagccttctttagttgcatgaggttttcgtgttcctatttttgttttggaggttcatttcattctgtcgttttttttgtttccatatcagagtgataattcaacgatgtggcttcatggaggcgctggttcaagaacaatttctgcagttccgcctggtaacttctatggtttccagggccagagtcagcatggtggcttccgccaggcacatcagccatctcagtacggtggtcttgggtatccaagcttctaccagtcgcagaccagtctgccacaggagcacccccagaaccccactgagggaagcttgaacaatccccagggggtaccatcccagccttcacaccagctctggcagcacatctactaaaccttctgtgctctccttggagatgcctctctacgctgccagcttacctgcaagcgagcagactagctgagcccaacagcaatgaagtgtgttgtttttctttctttcttttttttctccagctgtgtgttctggaactaaattaggctgtcgtggtttttacttgatagtgagtggtgttgcagaggtgctatcttgtaacggtaaagtcctaactcatctaacagatctgcttttcataccctgtaatgtgccattttgttcttgatgcctagaagcttctacgtgctgcagctacttttgatatgcatgcatgcttatgaagttgcagccctggtttgcagaatcgtacaggatgagaatgggtactgctagcctgctacaaatttcccatgggctttgtttgcttggagaagcattgaagaacccaacaatattgaagtcaccaatccggtggactcaactgcgatgttcacatgcaatgcaaatgttcatgcaaaccagtgtatcaatttataagcctgctatgttgttatcgaaccagctttaacaaaacagccgcagagtgtcaggcagttccatggaaattgagctgtaccgtatgcattggagttaaattccaggacgattctgggaaaaacgggacagatgaaatcactagcgcgacactcagtcggacagatgatctcagtagcgctgattcagtgttgggtctttttctactagaagaaaaggttaatcagagttcaaaatgcctgaagatcaagataataacgggacatgatcgcactagcgtgttcaatgagcatcgcccatcgaatcactattgatcaattcttagaggctcttcgcaaggatttagaagcgaagaatgctgctaatgtggtagctcctctagcggattgttcattcaaacaacgattaagtatgatggctgaagaatataagtccactaacatcgaaaccacttattggagcgacaatcacgtgttgggctatctggcgttattgtgatgttgtttttgaatggaaaactgtacaatctcctttgcaggtaatcttttcaggtatccactagaaccgagcatggtgctagctacttggggctgtttggagcaggtgctcaggaagatgacgatggcaatctagtccccggattgatctcagctaggtgtcaggaagtttttagcttcttttttcattcgtgtgggctgtgtgtatgttgacacagaggccgggaaaacatagtcaacaaaagttgtaatcacttgatgtaactatcttgatcttaattaaaattttcccttataaaaaaacatccaaacctacaacttcgaggctccatctatttctacatcc

SEQ ID NO: 17750 - DNA, 3138 bp, Zea mays
aggaatttggccgccgtctgcgttgcttgggtggggaaggagcaggcggccaggcgcagagccgcaaaagcagacgcgaaaaagcccaggcccgagccgaagcggggaggcgacaccgctgcacctgcactaccgctcgcacggtcagcgatttgccgcctcgcgggagccagctttggcgtcggcgtcggcgtcatcgtcggcggggagttcccggagagggattccggtgaggatgagcagcggcggcggtggagggggagccaggggaccgtcggggcccgtgccggcgtccgcgaggaagctcgtgcaggggctcaaggagatcgtgaaccgccccgacgcggagatctacgcagcgctgcgggagtgcaacatggacccggacgaggcggtcagccgcctcctctcccaagatacttttcaagaggtaaagagcaagcgtgataggaaaaaagaggttaaagaaactccagagccaagatctcgaggagcaagtaactccagtcgatccagtagaggtggtgtggaccgtgctggacgaggcaattcagttcagtctggatcgagtggcactgattatatggcttcaaggtcatcaatattgggacctgctgtggcagctaccaatgccatgcagaagccaacagttcctagtttgtccacaaacaaagatgtggttcctaatggatcagttggagcacaacaatcatcatctggttttcagcacaattggtttggggtgccaggtcagatgtcaatggctgatatagtgaaaatgggaagacctcaagtgaggtcttctggcaagcctatggctgcaggagacacatcatatgctggtcaaaccccatctttatctagctctataaaccagaactcaaaacaatcggcaagcacagccctaccaactacttttgaccagggctttcctgctctcccagaccctattccacacacagtgaattctagtcatggttcagctgggaacaaccatacacatgagaatgattggtttcctcaggacgacctgccatctggagttcagcccacatgcattgaggcgtctggtgaccagtcgctatttgtggcatcactggaccaatctatgttggttgccgatgcttcttactcacaagacatttctcatgcagaagagaacaactccactgcagttgaagcaacactgtcttccccgagacacttggaaattgtggaggatgacaatcatttcaacgacgggttattgcagaactcaagcgcttaccaggctcaagtgcattcctatgttgataatgaagttgggatttccaatgttgatgcagaatcagcttcgatgaacttccagcatttaagcctgcagaatgaagatatagctgcaaccaagtctgctgaggataaccctgcggttatactccctgatcatctacaagctgcaaatgcagattgtgctcatttgagctttggtagttttgaatctggtgccttctctggcttgctttcatcaaaggtcccaaaaggcagtttggaggacgacgaggtgctcattccagatgaatcccgatcagttaatcgaatagatgttaggaatcaagattactatgatgacgatgctctaaattcttcagaaaatgtggatgttgagacaagaattggtaatatggataacattgatggaccttcagtttcagaatctgatgcactgaggcagggtgccatagatgtgcctggtcttcaatatgacctgccatcagtttcaagtcatgcatattcaaacacaacacagccaagtacaatggaagaaccacaaggaaacacacaagcacaacccctttcccatttttctggcttactgcaagcaaatactctacccaataacttgttggggtcaaatcttacccctcttcgggagtttgacttctcccagttccttcagacacagtcagctacaaaatataacccatctgttgcacctaataatctgccaccaatctccatgcaagagacttcaaaacagggaggcttccccaatactcagtctacgcaacatgttcccagtacaagcatttcgtcgggtcttcctctcccacaacaattgcctgtatactctcagccaactctgccccttgggccttttaccagcctggttggctatccatatttgcctcagaactattacctaccttcagcgccattccagcaagcgtactcaagtaatgggcctttccatcaatctgctgctcctgccgtgcctggagctggtatgaagtatccgatgccacaatacaagagcagccctcctgcttcgaccctaccacaaccatcatcactctctggttacggagggttcggaagtgcaaataatatccctggaaatttcagccaaaatcagggtgctcccgctgcacctacaactttgggatttgatgaagctttaggcacacaattcaaacaccccaatcattatgcagcactacagcagagtgataattcaacgatgtggcttcatggaggcgctggttcaagaacaatttctgcagttccgcctggtaacttctatggtttccagggccagagtcagcatggtggcttccgccaggcacatcagccatctcagtacggtggtcttgggtatccaagcttctaccagtcgcagaccagtctgccacaggagcacccccagaaccccactgagggaagcttgaacaatccccagggggtaccatcccagccttcacaccagctctggcagcacatctactaaaccttctgtgctctccttggagatgcctctctacgctgccagcttacctgcaagcgagcagactagctgagcccaacagcaatgaagtgtgttgtttttctttctttcttttttttctccagctgtgtgttctggaactaaattaggctgtcgtggtttttacttgatagtgagtggtgttgcagaggtgctatcttgtaacggtaaagtcctaactcatctaacagatctgcttttcataccctgtaatgtgccgttttgttcttgatgcctaaaaaaaagaaaaaaaaaaaaaaaaaaaactcgaggggggcccggtacccaattcggcttatactcagtcgtgttgcatcccctggccggcgttttacaac

SEQ ID NO: 17751 - DNA, 2807 bp, Zea mays
  misc_feature (1781)..(1781): n is a, c, g, or t
aatacaagagcagcccacctgcttcgagcctaccacagccatcatcactctctggttatggagggttcggaaatgcaaataatattcctggaaatttcagcctaaatcagggtgctccctctgcgcctacaactttgggatttgatgaagctttaggcacacaattcaaagaccccaatcactatgcagctctacagcaggtaacaatgacacgataccctggttgatcttttggtgcccttggttggatctgtagccttgtttggttgtatgaagttttcgtgtttctgttttggaggttcatctcaattctaagaccccaatctgctgtgctgctttacatgtcagagtgataattcggcaatgtggcttcatggaggcgctggttcaagaacagtttctgcagttccgcctggtaacttctatggtcttcagggccagagccagcagggtggcttccgccaggcacatcagccctctcaatacggtggtcttgggtacccaagcttctaccagtcgcagtcgcaggccagtctgccacaggagcacccccagaacctcaccgagggaagcttgaacaattcccagggcgtaccatcccagccatcgcaccatctctggcagcacagctactaaaccttctgtgctctcttgggagatgcctctctacgctgccaggttatctgcaagccttggcacgctgcgccgtgaagcgaacagactagctgaactgccgtcttgagcggtgctgagcagaggacggtccatccaacagcgatggagtgcttgtttttttccctttctttcccagttgtgttctgaaactaatttaagctgtcgcggtttttatttgatagtgagtggtgttgcaaaggtgctatcttgtaacggtgaagtcctaactcatctaacagatctgcttcccatacccctgtaatatgccattttgttcttgatgcctagaagcttgaagcttctacgtgttgctgctactttcatacgcaaaaaaaaaaaagaaaaaaaaacccgggcttgcggactgggtgtttggttcctaccatctaaagtttagggcttgtttgggagcaatgaaattgaggggttaaaatccctttttattaaatagtactcttcctaaattaaaattcattttagttaattaataacttcatacgatatttgatgtatgtattttatatatgtctaggtttatcttggtttatttgaatatagacatacaaaccaagagttaaaaccaagagttaaaacgattactattttaggtctgagggagtaagattttagctccttccatctcattctctcaaaaaagccattagcaattaaagttaagacatttttagtctttaaactgacaaacaatatgattaaatgaggcctttcaaatataaattctagcgattaaagtttagtccaaagtctaggagaatgactaaaggaaccaaacacctagtaatacaagatagtggatgcatctagccttccacaaatttcccatgggttttgttcgctttgaagatcccagcaataattaaagtaaccaatctggtaagtaaccaatctgggaaagttcaccggtagtgtaaggaaaggatcaagatggctaatagaaacaaggagagcgaattaggcttctttaaattttcttatgtaaatttaaagttataagtaagtctagctttatcccgtgtgattagtagtatttctatctctctctttgatcggtagtgtttctatctattgatcaaaagttttacacnataagttctaaatgctttattagcatgacaattttagtgaagctccaatacaatactaacatgtagacctgatcattgactactcgacctgattaacttgaatcaacttgcacgaaaaatacttgacccgagcaggccaggccacctcgtcggtcaggctcaagccataaattttagtctaccaaaaaagttgggtcatgcgtgggctagaatttaaacctgtagattgaccaaaataatgtctcatgcatgcttggtaagtgatttagacacctaagtgatttatgtacgtaagaatgctttttatggcacttaaatagctttcttagaattagcttaatccagtcgctccagatctgcctgagacaaagcctataagatcgttattaagtaatgaatttgcaaatagagaactaaactataggaatcaatccaattctcgttctacaacaagaagaagatccatgaactggaacggatggaagatagcactagaagtcaaagaaatattgaaaggtgcgaagcaatcacatcgcaacaaataggtatgtattactttgagtttctcgctgaactccactggacaccgacctcctaaaactgacctctctgctaattcgaatcgaggcttactgccgcttggtcgaaatctttcacacatacacatactaaaccatatcaggtctagatgcgattaaatataacaactactagtcataaaacaatagagagtttagtcaatcagtttaccctcccctcgtctgtgtcgagatttccatttgatgtcattggagttttgattggcttacaatcatccatcttaaatcttttgagtaagtctttggtgtagttcacttgaaagccgaggaagagtgcaagctcaccaatcatcgacttgaactccttgggcatcaattcattgaattccttgtaatgccattcatttgtctagccaaatattatattttaacataaacttgacaaatgtagatactactgtgattttcttggtgaacaatatgagtc

SEQ ID NO: 17752 - DNA, 1064 bp, Zea mays
cattgggtacctcgaggccggccgggcccacgcacaaagccttcggtatttggccgccgtttgcgttgcgtgggtaggggaagaagcaggcggccaggcgcagagccgcaaaagcagacgcggaagcagcccaggcccgagccgaagcggggaggcgacgccgctgcactaccactcacccggtcagcgatttgccgccttgcgggagccagttttggcgtcggcgtcggcgtggagttcccggagaggggttctggcgaggatgagcggcagcggcagcggcagcggcggagggggagccagggggcagtcggggcccgtgccggcgtccgcgaggaagctcgtgcaggggctcaaggagatcgtgaaccgtcccgacgcggagatctacccggcgctgcgggagtgcggcatggaccccgacgaggcggtcagtcggctcctctgccaagatacttttcaagaggtaaagagcaagcgtgataagaaaaaggaggttaaagaaaccctagatccaagatctcgaggagcaagtaactcctgtcgatccagtagaggtggtatggaccgtgctggacgaagcagttcagtccagtctggatccagtggcactgattatgtgacttcaaggtcatccatattgggacctgctgtgccagttaagccaacagttcctagtttgtcaacaaacaaagatgtggtttttaatggatcagttggagcaccacaatcatcatctggttttcagcataattggtttggggtgccaggtcagatgtcaatggctgatatagtgaaaatgggaagacctcaagtgaggtcttctggaaagcctatggctgcagcagacacatcatatgctggtcaaaccccatctttatctagctctgtaaaccagaactcgaaacaatctgctagcacaaccctaccaactacttttgatcagggctttcctgctctcccagaccctattccacatactgtgaattctagtcatggttctgctgggaacaaccatacacatgagaatgattggtttcctcaagatgagcctcaatctggag

SEQ ID NO: 17753 - DNA, 1989 bp, Zea mays
ttttttttttttttttgacttactatggattgatactcatctaattatctccaatctatatgaattggagagaaaatgaacaggtctttatatagattgagagcaaaacgaaaaagcctttttacggataaacaagatattcaccatctactttgcactctcaatcattttaatgaaaaaaataaaacacagagagagaggagcttcagcctcgaaagcaacccaaaactcgcagcaacgaattgggcatattccccccacctgcaccccccacttttggcactttcccttccggccccctctcctcggcgcgatctaaatccggtccggcgatggacggcggggggcagcccccggacacggagatgacagacgccggcgcgggcggcggggggcagccttcgccaccgcagcagccggcgggcggggccgggatgatggagaacatccacgcgacgctcagccacggtggccgcttcatccagtacaacatcttcggcaacgtgttcgaggtcacctccaagtacaagccccccatcctccccatcggcaagggcgcctacggcatcgtctgctcggcgctcaactccgagacggcagagcaggtggccatcaagaagatcgccaacgccttcgacaacaagatcgatgccaagcgcacgctccgcgagatcaaactgctccgccacatggaccacgagaatattgttgcaataagagatatcatacctcctccattgagggaggcattcaatgatgtgtatattgcctatgaattgatggatactgatctgcatcaaattattcgttcaaatcaagctttgtcagaggagcactgtcagtattttctttatcaaattcttcgtggcttgaagtatatacattcagcaaatgttcttcaccgtgatttgaagcctagcaatcttcttttgaatgcaaactgtgacctcaagatatgtgattttgggcttgctcgcaccacctcagaaactgattttatgactgaatatgttgtcacaagatggtatagagcaccagagcttttattgaactcctctgaatatactgctgccattgatgtgtggtctgtgggctgtatatttatggaactgatggaccgaaaacccttgtttcctggaagagaccatgtccatcagctacgtctactaatggagctcattggaacaccgaatgaggctgatcttgattttgtaaatgaaaatgcaagaagatatatccgccaacttccctgtcatgctagacagtccttccctgaaaaatttccacatgtacaacctttagcaattgacctagtggaaaagatgctaacttttgatcctagacagagaataactgttgaaggcgcacttgcacacccttacttggcatcacttcatgacataagtgatgagccagtctgctcaatgcccttcagcttcgacttcgagcagcatgcattatctgaagaacagatgaaggatctgatctaccaagaggctcttgcattcaacccagattaccagtagccaaagttcggttccagccggtgattgccttcattgacatggagatttttatcccacctgatgtcactgcaaaaagtccccaactccgattgctagctgtaaataattgccttccccgaagaccccccattccttccttgattaaaaaaaagcaggagacggtggccattcaagggtagaaaagagcgagcttgtgaaggtcaaatttctgcgcagctatggattcttgtgcttacaatatgttgtttttaatcaggctttcctttctttttcttcttaagtacttctcggtgttgtctgtaagagaggtagctcatgaacgatggctgcctgaattcagtggctgtcgtcaaagttaacagttctagtcgacttaagaattcttgttttatctacttcattgtttatataaatggacctgtatctccgaaaaaaaaaaaaaaaaaaaaacgagccgcccggt

SEQ ID NO: 17754 - DNA, 4977 bp, Zea mays
  misc_feature (20)..(20): n is a, c, g, or t
  misc_feature (4430)..(4430): n is a, c, g, or t
cattgggtacctcgaggccnggccgggccccggcctcttctgctaaaatagacccaaatctcgcagcaacgaattcgcatttcccccacctccacccccactttcccttccgtccccttctcctcgtcgcgatccaaatccgcggccatggacggcggggggcagcccccggacaccgagatgtcggaggccggcgcgggcggcggagggcagccgccgcagcagccactgccgccggtgggcgggggcgtgatgttggacaacatccaggcgacgctcagccacggcggccgcttcatccagtacaacatcttcggcaacgtgttcgaggtcaccgccaagtacaagccccccgtcctccccatcggcaagggcgcctacggcatcgtctgctcggcgctcaactccgagacggcggagcaggtggccatcaagaagatcgccaacgccttcgacaacaagatcgatgccaagcgcacgctccgcgagatcaagctgctccgccacatggaccacgagaatattgttgcaataagggatatcatacctcctgcgcagagggctgcattcaatgatgtgtatattgcatatgaattgatggatactgatctgcatcaaattattcgttcaaatcaagctttgtcagaggagcactgtcagtattttctttatcaaattcttcgtggcttgaagtatatacattcagcaaatgttcttcaccgtgacttgaagcctagcaatcttcttttgaatgcaaactgtgacctcaagatatgtgattttgggcttgctcgcaccacctcagaaactgattttatgactgaatatgttgtcacaagatggtatagagcaccagagcttttgttgaactcctcagaatatactgctgccatcgatgtgtggtctgtgggctgtatatttatggaactgatggaccgcaaacccttgtttcctggaagagaccatgtccatcagctacgtcttctaatggagctcattggcacgccaaatgagggtgatcttgattttgtaaatgagactgcaagaagcatcatatgttgcttcatgatagtagtgagctagtagatattggatacatcaattcactcactccaagccatctacccaccatcttcactcgtattaagacctgctcgtttatgtattattcacatgcagtacagtaatggttgaggtgttgaaaggctggcactacaaatatgtatgtaatggttttgtgtggtcttaaagagcaaacatcatatgagttgtcacgattgaatgtaaaaataataataaacataatataaccccatagatacttgctgttttccgtataccagctgtcatgtaaatctagccatgcataagaaattcttcatattaatccaagtccaaggctcagtagagaatttaatattttttttaaaaaaaatattgtgcactttgtttcatgtttaatttctcaccctatttctttcatgcagctcattggaacaccgaatgaggctgatcttgattttgtaaatgaaaatgcaagaagatatatccgccaacttccctgtcatgctagacagtccttccctgaaaaatttccacatgtacaacctttagcaattgacctagtggaaaagatgctaacttttgatcctagacagagaataactggtaacacttttgaaggcttgtccatcttttgtttctatatatatatttttgaagctttctttatttcaaaatgttgtttttgccataaatagtcaccattccacttcgaaaatagcaagtgcacttatggcatcttttgtcagatcgtgtttcaaatgttggaaacacatgtcttttattagcacactattcttcctaatttgctgattgtgtcaccaaatttgaagttgttaaattctccctttttattcttatctccttttcatttaacagttgaaggcgcacttgcacacccttacttggcatcacttcatgacataagtgatgagccagtctgctcaatgcccttcagcttcgacttcgagcagcatgcattatctgaagaacagatgaaggatctgatctaccaagaggctcttgcattcaacccagattaccagtagccaaagttcggttccagccgggtgattgccttcattgacatggagatttttatcccacctgatgtcactgcaaaaagtccccaactccgattgctagctgtaaataattgccttccccgaagaccccccattccttccttgattaaaaaaaagcaggagacggtgccattcaagggtagaaaagagcgagcttgtgaaggtcaaatttctgcgcagctatggattcttgtgcttacaatatgttgtttttaatcaggctttcctttctttttcttcttaagtacttctcggtgttgtctgtaagagaggtagctcatgaacgatggctgcctgaattcagtggctgtcgtcaaagttaacagttctagtcgacttaagaattcttgttttatctacttcattgtttatataaaaggacctgtatctccgacgttgcctgcgagaacaatggctgagtgagaccctgtggttgcgattgggcatcaggtttcattcagcctggggtcagggttacctagccggcgatttgttgttcccagactagcctaaatcgcgttgacatcgtcacccgattgggtatgagccatcggtatcctatatgacaatttatgttagcatgtatcaactctgaatgatattggagaatcatattgatccagtgaacgatgtgagggccgtagataagaggaaatgtaaggtctattcaaatgccattagtgtgacaaataagggtgtatttggttcagcttcttgaaccaaataaagtctacaacgccttcttcacaaaagcacagaggatgaggaagccagcacaaggcgaaggcagagcaggtcaggaccaagacaccaccaacagcagatgcaacagcagacgagtcagtatatatacaccaccaacataccagcctccattagtagatacagcagcaacaaaccagctagtaggtacaataggagatacaactcaaacaccacatcctccagtagtagaagaggctgcaccagctgatcagcctgaaacagacaaacagtagaacaggatgcatcagctgaacaagcaatagtagaacagcctgaagaaaatgtacaagaagcttcacctgagcatgtagcacaagaggagcatcaacaaccatctcaagcacacaaggcaccaggccaacaggccatcccagctacgcctccaaccccaccacactcaccaacaacagttccagcaatttcagacgatcctcggtaataattacaaagctacccagtaacaactacagtttgcctccgtccacaaatgttggtcgctaggtatttgtgtcagtcaaaatttcttaagttcgactagatttataaaatatattagtaacatttgtatcttcgaataattgtactataaaaatagatttaaagatctatctaatgatactaattatgtactataaatattaataatttcttatataaatatgatcaaagttaaaaatagttgactcctcgataatagtatctatgtaatgatactaattgtggacggaggggagtataaaatatttagtaatacttataaaatgtccagtaattaatataaagtgttcagtaataagtgcattatgatcagtaataaattttaaacgtccaataataactatatagttcgagtcattacaccacatcgtcttctgttaatgattcgttttggtcatcatctgaagttgcacaacttttcacacgacctgtccctttaggcctacctctctgtcttttgattacatattttttgtgatcgttcacacatgttgatgcatttgcccctagtcatataggccatatttcccgtactttcttcttttcttctgcaatgcagcgggccaatattttcttcacctggcaaaaaattcttcctgtcgccttttgttgtcaatactggtggcacggacgctgagacgataatatcatcttctctgtttgacatagcgtgagtctagttcacagtacttggtatatggtcttccagaataacgtctggtggtataactttcagtaccacgggtgcatcttatatcatccttctagctctatgtattgcctgttttgttaagcaaatgaaaatcgaggtagtcaataataattatagacagtcagatagtcagcgactaactccagtagcttttctataccctaatgatattcaaactatattctacaaacaatacaatgtacagtgcaaaacagtgttttgggtgaccatataccatatgcgtgcaatgtatacatccatatggtcaccaaaacattgttttacactatacattacactgtctgtanagtgtggtttgaatatgtcatatgggtaaactgatggaggtagtctaacctaccacatcgcctgtgaagagcttcgggttctcgctgggatcccttctgccacctaccgccctcgccagcgtcgacgaccccatcgccatatcctatttaggcttttgaatttaaaaatgatttagagcctaactgtgtagtggctagaaaataagctataggctcacgagccagcttaaactcagagcgactcgcgagcctcgaataaaccgattcgagcctaatttttgggctcgtcgttgaagcgagctgagccaactcgcgagccgcgtcaactgtgctgaattaatcaatttgcgtaatcataatagattatcggttcattttttaatctgaattaatcaatttgcgtaatcataatagattatcggttcattttttaatctttaatgatggatatataacaattaaaattttagatcgtcataatattgaataatgattctatatttcatatttaaatactattagtttaatacataatacaattatatta

SEQ ID NO: 17755 - DNA, 1725 bp, Zea mays
tcttctgctaaaatagacccaaatctcgcagcaacgaattcgcatttcccccacctccacccccactttcccttccgtccccttctcctcgtcgcgatccaaatccgcggccatggacggcggggggcagcccccggacaccgagatgtcggaggccggcgcgggcggcggagggcagccgccgcagcagccactgccgccggtgggcgggggcgtgatgttggacaacatccaggcgacgctcagccacggcggccgcttcatccagtacaacatcttcggcaacgtgttcgaggtcaccgccaagtacaagccccccgtcctccccatcggcaagggcgcctacggcatcgtctgctcggcgctcaactccgagacggcggagcaggtgggccatcaagaagatcgccaacgccttcgacaacaagatcgatgccaagcgcacgctccgcgagatcaagctgctccgccacatggaccacgagaatattgttgcaataagggatatcatacctcctgcgcagagggctgcattcaatgatgtgtatattgcatatgaattgatggatactgatctgcatcaaattattcgttcaaatcaagctttgtcagaggagcactgtcagtattttctttatcaaattcttcgtggcttgaagtatatacattcagcaaatgttcttcaccgtgacttgaagcctagcaatcttcttttgaatgcaaactgtgacctcaagatatgtgattttgggcttgctcgcaccacctcagaaactgattttatgactgaatatgttgtcacaagatggtatagagcaccagagcttttgttgaactcctcagaatatactgctgccatcgatgtgtggtctgtgggctgtatatttatggaactgatggaccgcaaacccttgtttcctggaagagaccatgtccatcagctacgtcttctaatggagctcattggcacgccaaatgagggtgatcttgattttgtaaatgaaaatgcaagaagatatatccgccaacttcctcgtcaccctagacagtccttacctgaaaaatttccacatgtacaacccttagcaattgacctggtggaaaagatgctgacttttgatcctagacagagaataactgttgaaggcgcacttgcacacccttacttggcatcacttcatgacataagtgatgagccaggctgctcaatgcccttcagctttgacttcgagcagcatgcattgtctgaagaacaaatgaaggatcttatctaccaagaggctcttgcattcaaccctgattatcagtagccaaagttcaatttcagccggtgattggcttcattgacatggagattttttccccacctgatgtcagtgcaaaaagtcaccaactccgattgctagctgtaaataactgccttacctgaagatactccattcctctgattaaaagctggtgacggtgtcattaagggtagaaaagaacgagcttgtgaaggtcaaatttctgcgaagccatggatttctgtgcttacaatatgttgttttcaatcggactttccttcctttttcttgtcaaaaacgtctcgatgttgtctgtgagaggtagttcgtgaacgatggctgcctgaattcagtggttgtcatcaaagttaacatttctggtcaacttaagattaagacttcgtggcttcttgctaaaaaaaaaaaaaaaaaagcccgg

SEQ ID NO: 17756 - DNA, 3528 bp, Zea mays
  misc_feature (3506)..(3506): n is a, c, g, or t
  misc_feature (3526)..(3526): n is a, c, g, or t
gataagaggtcgagatgctgcttttttgggcccagatgataatcaatatgctattctggaggaagatagaactggtctgaatctctttagtctcaaagctgtagctacaaaggaagctcttgaaaataatgctgctgtgcttgaagaaaacacttttgctgataatgctgctagtgctacctcaacggaacgtcaaggtcctctacagtttacttttgaatcagagggatataggctgtctgcagacaacgggctatccattacaacaaaaactgatgggaagaagtttattaagttgaaaccaaatgagactgttcttcaggcccactggcaaacaaccctaagaggtcctgttcggtcaggaatcagaggggaatatggacaaatcagagggtgctaattgcttctgctgatcttgatatactatcaagcagctcaacaaagtttgatcgtggtctcccatcatatcggtcaatgttgtgggttggaccagcacttatcttctcaagcgcaactgcaataagtatgcttgggtgggacaacaaagtccgatcaatcctctccactagcttccctcgctcagtattacttggtgcattgaatgaccgcctactgcttgtaaatccgacggatataaacccaagacagaaaaagggagtggaaataagggcctgtttagttgggcttcttgaacctcttctcattggatttgctaccatgcagcaacacttcgagcaaaaacttgatctttcagaagtcctgtaccaaataacctcgaggtttgatagtttacggatcactccaaggtcattggacatattaactaaaggacctcctgtttgtggagaccttgctgtatcattatctcaagcaggacctcagtttacccaaatcatgcgctgcaattatgcaatcaaagctctccggttctctactgcgctgtcaattttgaaagatgagttcctgcgctccagagattatcctcaatgccctcccacttctcatctgttccagcgtttccgagaattgggatatgcatgtataaagtatggtcagtttgacagtgcaaaagaaacttttgaggttattacagatcacgagagcatgctggatctatttatttgtcacctgaacccaagtgcattgcgacgccttgcacaaaagttagaggaatctgctacagattctgagctgaggcgataccttgagagaatattaagagttcgttcgactggatggacacagggtgtattcgccaattttgctgctgaaagtatggttcctaaaggccctgaatgggcaggaggaaactgggagatcaaaacacctaccaacattaagaatatacctcagtgggagcttgcaggagaagtcatgccttatatgaagacaactgatgctggtatcccatctgttgttgcagatcatattggtgtgtacctgggtgtgatgaaaggaaggggtaatgttgtggaagtaagtgaaaagagtttggttaaagctatagctgcagctagcagtgagaacacacagccggtgtcttctgcatcagcagagaaaagtaaggcaattcctcgtggtgattcggttggtgatactttggcaaggcaactgggagtccagattgcatcttctgatgaacaggcaaaagctgccgaggacttcaagaagactttatatggtgttgttgatgatggaagtagtgatgaagacgagtcaacctcaaagactaaaaagatacatataaggatacgtgataaaccggctgcacctactgtagatgtcaacaaattgaaagaagccactaaacagctaggcttgggtcctccgctgagtaggacaaggtcattatcagggacacctcaagacttcaatcaggctcctacacaaccaggaggtccagccgcagctgtttccccagcaatgccaaattctgcgattgatttatttggaacaaatactttagtgcagccgcaagcaccctctagttccacaggtcctgttattgcaggcatgggagtgacggctgggccgatccctgaggacttcttccagaacactattccatcgcatcaacttgcggctcaactacctcctcctggaatagtcctgtcacggatggctcaacccgctcctggcattgaacaaggccgaccagtacctaatcaaatgatggctaatgttggtcttccagatggtggggtgccaccacaagcaccaccgcagcagtcccagtttcctccgcagcagtcccagtttcctcagcaaccaggcattcctatggattctattggcctgcctgatggtggtgtccccccacagagtcagccacttccttcacaaggccagtttcttccttcacaggcacagggctttcaacttggtattcctgctccatcacaaccaattgatctcagcgctctcgagggtcctggagcggcgaagcaagctgctcgccctccagcacctactgctgtgcggcctggccaggtaccacgcggggcccctgctgcagaatgctacaagatggctcttgctcatcttgagcagaatcagcttaccgatgcactatcttgtttggacgaagcattcttagcccttgcaaaggaccagtcacgtgaagccgacatcaaagcgcaggccaccatttgtgctcagtacaagatcgcagttgctctgctgcaggaaattgctcgtctgcaaagggttcaaggagctggtgctctcagtgcgaaggaggaaatggccaggctatctcggcaccttgcttccctgcccatccaggccaagcacaggatcaactgcatcaggaccgccatcaagcggaacatggaggtccagaactacgcctacgccaagcagatgctggacctcctctactccaaggcgcccccgacgaagcaggacgagctcaagagcctgatcgacatgtgcgtccagaggggcctgacgaacaaatccatcgacccgttcgaggacccctcgcagttctgctccgtgaccctcagccggctgtcgaccatcggccacgacgtgtgcgacctctgcggcgccaagttctcggcgctctccgcacccggttgcgtcatctgtggcatggggagcatcaagagatccgacgccctcgctggtgggcctggacccgtgccgtcacctttcggctgaaggtcgagtctgctcctttcgtcctccatcggtcctgatattgtatctatagtgttcagtttgcgttcattacattcgattcgttgcagcttgtattgtatgtagcctttttgacgtgtagcacgcttggtgttgagagcaatgtacacctgtactgttgggttggttgtgattatacacgcggttttttttggagctagcaatgtaaggtgcatgtgcatatctgagacgcgagcgtcgacgtgaaacgttctagtctccagagttggtaaacacagtcacggcaggaacttgcctctatctgtgaataacagtgatagagagtctaatggatccatcgnatgggtttatctctcttatnat

SEQ ID NO: 17757 - DNA, 5410 bp, Zea mays
  misc_feature (28)..(28): n is a, c, g, or t
atcagtccgaacaactggctttaatatnaagcgaacaatgtgagtaacaaaaaaattaggttacaatccatgaagataaaataatgagaaataataaaaaccgttttagattaaagtcaatcgaacaacttaacttgtagagctagcatgcctcatttttttttctttcctctttcctcgcgggatgatggcatggggtcacattatatttggtgagcgtaaattaatgctacggtcgtaaataaataaacggatatagcgctggactagcatgatgacgtccagagtggaagttgctctcaccatcatctatcatggcggggcattttgctacattttttcttgtatgaaaattgcgtgctgtgaaattttggcatacggtgaaaccaaagtgatactgtgagaatacgacgcaaataaaagtaaacttctgaattactgttgatcgcgaaaacccatgacaggctgtgtgttgaagttatccctatgtgcgtgaagtgaattagaaggagcttctacttttctccgcccacaatccttcggttcattttatatgatcactttacatgtcatcattttaaagaaccaccatagaattatctctaataaaaagctatttgataaagcatcactgaattcatcctagaagttgtctgggagttctacaaaacactcccttgctctaagcacaactgatggaccactacaaaacactcccttgctcgaatccgctaagcacaggcccaaaccgtccacttggaaactcgaagcccatcctgtctttcctttgcgtcagtcgtcttcgacgcaaggagaattgggaattcaggaatcaggatgcggctctccttcccccttgtcgccggcgccgtcgtgtaagtccctcggttccccatctctcacctgcaccatcctctccatggatgtcacgcggcgtctctcgcctgcccgatgccgatctagacgcgcctatcgagttgatgctccactgcgacatccgatttcgggtgcccttgtagccccggtgtcctctgtctctagcgtagatggaactctgaccttgcttactgccgttgtagctcctgtagtccctgtgtttagcgcgaaagggttgtgggtgtcagtcacagctctgattaggtgaacggaaagcttcgccggacacacatcttcggcgtggcagcaggttgctcgtgttgtgttaggtagtacctgacccattctcgtggtgggttagaagcattgcgtagtcgcgtgtaatgaacaagaatatctgttctctcttctcaggttatgaaggattgcgtattgcgtgggacaccatctaattcattgtggtcaattgtttttttttggttaacttattcatcagccagtgaatatttagcagaactgtataaattcaatgattcaactagtaattcgatgtggattcaagatagtgtgtgaaggatgtgtgtgatctatccattttcaacatatcaaattgctcccctagcagtttctgtttggtaacttgatgccaaattaacaaacctcaccaggatcctaataataaagcaaaataggacagataggtaaatggaggaaactgccttatgggtttcagtttcaataaatttgtgatttagagatgagctatgcgatactatcaactcaagaattgtttatgcatattctattcgattgggaactaattcttatatgagaaagaacactgttagaaaatggctgttgtgaatctgtgttgctaggattgtgaaatctgcacagctgaatgaagtgtgttaacctaggattttctgtaagaaaagtttaatatatttacttttagtttgacaaaattattaaatgtcgatgttactgtgatcacataactacctggctgtgcatatatggagatgccatctcaaatgttggtcgctgaacaataacacctttcctgttttccatgtagcaactgaataactgaatcgaacagattctaggaacggttgaaatgatacgacatcttctgtgcatggctgagtttctgatatcccacaaggctacagcatgagtttctaacctttggcctgggcacgactttagctttaggaattttgctttggagtaggtgtggtgtgtgcattcatgatagcttttatgtgcataactgcagatgcatcatttatatttgatttcaatctagatattgtaaaagttgagagcctttcaacattaaagaactttgtggactgcaacatgatcgaacagtgcatggtccttcgattacttcatgtagttgttattgattataaagactaagcgtgtagtgtggacacgagttttttcagtagatcatttgatgaaaacttctcttggaatctgaaactaagggtaacagagtcgccatcatatataaatttgggagttggcaactcatgaagtccagcacccagcgtgcagtatcatttgtacttctgcgacaatagcatgaagattttttttggcttttgcatccacataaatatataatttatcttgcaagtggtgtttccttgtgctgattgtacatggcaattattgttttggagtaggtgtggtgtgtgcattcatgatagcttttatgtgcataactgcagatgcatcatttatatttgatttcaatctagatattgtaaaagttgagagcctttcaacattaaagaactttgtggactgcaacatgatcgaacagtgcatggtccttcgattacttcatgtagttgttattgattataaagactaagcgtgtagtgtggacacgagttttttcagtagatcatttgatgaaaacttctcttggaatctgaaactaagggtaacagagtcgccatcatatataaatttgggagttggcaactcatgaagtccagcacccagcttgcagtaccatttgtacttctgcgacaataacatgaagattttttttggcttttgcatccacataaatatataatttatcttgcaagtggtgtttccttgtgctgattgtacatggaaattattgttttgtgcccactgcccatttctgttttatttcctgagttgtctttgtcaaaggaagtcctgtttcttatgtgctcgctggctacagtcgcagttgcatatctacttaggagaattgggaattcaggaatcaggatgcggctctccttcccccttgtcgccggcgccgtcgtgatcggagtgatttctgggaatgttatatttgggccaccgcttcagaagtactgggcagagaagcagcagcaagaggcagcaaaagaaggccaagctggttcaacctgacaaaatgtcctccccttctgcagttacacggagaaatgtgtactcctcggtcctgaactagcatcggcttttgttagcattggttacatttagttgcccaagtttttggcgctggaagaagacaccgtgcaatgcacagaaagatttgaaaaacgtttaaatgctggttgatctcattctgaaatacagtacctttgatgaatgcaccgtgcaagacacggtggagacaccttcgaatgatttcaagcctcctttgaaatacctttgaagaagacaccgtgcaagacacggtattgtagtttgcatatctccgagtgcaggttgatttctgaaatagctagaagtcaggatcacagcgctgtatatcctactatcctagcctctttttcgtggcttccggatcttgctgggccgaccgttcgtctgagttctggcccaaattggcttttccggaatacggctcggccctctccagtacaacctccaccgctttctgaacacgaattagaaaaggacgcgggacccccgaggcccccccccatttttcaccaatcaccagccctagccgcccattttccccgcttttcaccaatcacaagaacctttgcgtcctccggcgaggcggcaaccgccggatccctgaacgtctgaatcctggagtgaaccccgcacaggatggcgaggaaagcgaaacccgccgcccaaggcaccgcggtcgtggctgccgccaccggcgtccagtactggctcctgaagacggagccgggcgagtggtcgtggtccgaccaggcgcgcgccccgggcggcgtcgcgccgtgggacggcgtccggaaccggcaggccatgagcagcctgcgcgccatgcggccgggcgaccgctgcctgttctaccactccggcgccggcgccgcctcccgccgcgtcgtcggcgtcgtcgaggtcgccaggccctggtacgagggcgagggcgaggaggcggtggccggtggcgccgtggacgtgcgggcggtcggggagttccggaaccccgtccctctgggtgtcatcaagaaggcggcgggcgaggtggaggggatgaaggacttcgcgctgctccggcaggcgcggctgtcggtgatgcccgtgccggcgaagatctgggactgggtttgcgacgcgggaggcggcctcgtgcaagacggcgagggtgaggacgaggaacaggaagaagaggcttgattccgcagaccagcaaatgtgaagaaggtacacggccctgattttgctgtgcaacagagaacttgatcagtgttgctacatctctatagtaaatctgtaagttatctgcttattctgacgtcttcttgtagaaccaagttgctcctgctggtgacatgagcagttgcaacttgcaaggcggcgttgtgtgggagtccttttggcctgcaagtgttttgctagctttgacaaggcactcctgtttcttcagtgttcgccgtctcggcgccgaagtgcccaagaaaaaaatgtatttactatttgatctactcctatgtaagttcagtggttcatgtagccaagtagcttggatatctatgaaggtactcgagctgttgcatgctgcggcagttttgcacacacacacgtcggctatacagccatccagattcagataggataggacccaatgaatgtgacccggaccctgacgcagagggctgggctgggctgtgctgggacttggagcagcggcagccggtagtgagctgtggcgcaagctctgcgttttatctgtttcgtcttcaattcgtcccatgttgcctgtcggcgacttgcttggggtcgtgactactttttctttctgccactgccacgacacgagccaatcccaccagatctgggcggagcattgaagtgccggcactcccaagtcctgcgggcaccgtcatcatctttctttgaattcctcgcagtaacaggtggatggacgctggagaaggacaaacgcgctggctaccaaagcacagctccggagcgtcaaattatactgagctcagctttgctgttttctacagcatctctctccgctgcctcccttttctgaccggtggccccctag

SEQ ID NO: 17758 - DNA, 1959 bp, Zea mays
atcctagaagttgtctgggagttctacaaaacactcccttgctctaagcacaactgatggaccactacaaaacactcccttgctcgaatccgctaagcacaggcccaaaccgtccacttggaaactcgaagcccatcctgtctttcctttgcgtcagtcgtcttcgacgcaaggagaattgggaattcaggaatcaggatgcggctctccttcccccttgtcgccggcgccgtcgtgatcggagtgatttctgggaatgttatatttgggccaccgcttcagaagtactgggcagagaagcagcagcaagaggcagcaaaagaaggccaagctggttcaacctgacaaaatgtcctccccttctgcagttacacggagaaatgtgtactcctcggtcctgaactagcatcggcttttgttagcattggttacatttagttgcccaagttttcggcgctggaagaagacaccgtgcaatgcacagaaagatttgaaaaacgtttaaatgctggttgatctcattctgaaatacagtacctttgatgaatgcaccgtgcaagacacggtggagacaccttcgaatgatttcgggcctcctttgaaatacctttgaagaagacaccgtgcaagacacggtattgtagtttgcatatctccgagtgcaggttgatttctgaaatagctagaagtcaggatcacagcgctgtatatcctactatcctagcctctttttcgtggcttccggatcttgctgggccgaccgttcgtctgagttctggcccaaattggcttttccggaatacggctcggccctctccagtacaacctccaccgctttctgaacacgaattagaaaaggacgcgatattgcagaagctcccgcccatttttcaccaatcaccagccctagccgcccattttccccatttttcaccaatcacaagaacctttgcgtcctccggcgaggcggcaaccgccggatccctgaacgtctgaatcctggagtgaaccccgcacaggatggcgaggaaagcgaaacccgccgcccaaggcaccgcggtcgtggctgccgccaccggcgtccagtactggctcttgaagacggagccgggcgagtggtcgtggtccgaccaggcgcgcgccccgggcggcgtcgcgccgtgggacggcgtccggaaccggcaggccatgagcagcctgcgcgccatgcggccgggcgaccgctgcctgttctaccactccggcgccggcgccgcctcccgccgcgtcgtcggcgtcgtcgaggtcgccaggccctggtacgagggcgagggcgaggaggcggtggccggtggcgccgtggacgtgcgggcggtcggggagttccggaaccccgtccctctgggtgtcatcaagaaggcggcgggcgaggtggaggggatgaaggacttcgcgctgctccggcaggcgcggctgtcggtgatgcccgtgccggcgaagatctgggactgggtttgcgacgcgggaggcggcctcgtgcaagacggcgagggtgaggacgaggaagaggaagaagaggcttgattccgcagaccagcaaatgtgaagaaggtacacggccctgattttgctgtgcaacagagaacttgatcagtgttgctacatctctatagtaaatctgtaagttatctgcttattctgacgtcttcttgtagaaccaagttgctcctgctggtgacatgagcagttgcaacttgcaaggcggcgttgtgtgggagtccttttggcctgcaagtgttttgctagctttgacaaggcactcctgtttcttcagtgttcgccgtctcggcgccgaagtgcccaagaaaaaaatgtatttactatttgatctactcctatgtaagttcagtggttcatgtagccaagtagcttggatatctatgaaggtactcgagctgttgcatgctgcggcagttttgc

SEQ ID NO: 17759 - DNA, 1574 bp, Zea mays
cctcgagccggcccgagattcggcccatcgccggtgttctggtggatcacgcgtccttctctccaaccgcaccgaccgatatcttcctctccgctagggcaagggcggtgccggtgaggcgatccgtcggtggtgtcggagcggtggaggaggatggccgacgtgcagggagacaacgaagcagttctggaggacgacgctttccccgacgacgggcccttagatacggaggagggaggtggaggagaacccatcagcggaggcgacgaggaagaggaggaggacgtcgacggcctcgccagcttccttgagtcggagatcctctccggatccagcgacgaggatcctattgacgagcagcggcagcagaaggaggaaggtgatgctgcgaagaataagcggaagcagggttcaggatcggacggggatggctgcagcggcagcgagggggagcagacgaagagggcgaggagggaggagaagaggaggcaggcgaaagggaaagccgtggcgcctcagatcgacacgggcttgttcagcaacgtcccccctgagctgttcctgcagatcttcaagttcctctcctccgaggacctcatctcctgcgctctagtctgccgcttcatgaatgctgccgcgtccgacgagaccctctggcgccgcctgtactgcatgaggtggggactggcctccaatgccaaattcagggagtgcgcttggaagaacctctacatacagagagatagagaggatatggttgaatttgtgaggaatactcctacagagttcaaggagtactatattcagatgcaggctgcaaaaaggagtcaagctccccgtccgtcagaagtcaacgacgacaaggttatgcttgataagacagtagctgaccaggtatctagttggaaaaacagccgggggcttactgatgaagctgtcaaggggcactcttgttctggaaatacatgctcgtacacccagattggtgatgcttacatttgtgagaagactggtcgtgtccacgtttgtgatgacgcttgtcgtgaatttgtcttggaccaatctagtgggctgcttctttgtacgatatctggccactgctttgagaggtggctgtgtcctgatgatgaatgggatgctgatgataccgatctgcaacaggctggtgtagtggatgaagcagagccattcatgggatctggacgttacgcacgggcgattatgttgggctacaactgcactgatgagaaggagcttgaggatgccttgcgtttctgttgacgtgtttctgtcgatatgcccttcactcttgatcaagtgaagacgaagccagcggggatatgccggatgtatagctctgtgctatgttttcactgtatttcaccctcgagcatgtacctaagaatagaaggatgtacctaagaatagaacttgtttttgaggtagatcgctgatatgttttgatcagcagagggagccgttatgttgtcgtatgatttcataaattatgcctgtaataaaatataatttacataatgagttttttgtttgtatgacaaaaaaaaaaaaaaaaa

SEQ ID NO: 17760 - DNA, 1587 bp, Zea mays
  misc_feature (663)..(663): n is a, c, g, or t
gcgccaagggccggcctagagattcggcccatcgccggtgttctggtggatcacgcgtccttctctccaaccgcaccgaccgatatcttcctctccgctagggcaagggcggtgccggtgaggcgatccgtcggtggtgtcggagcggtggaggaggatggccgacgtgcagggagacaacgaagcagttctggaggacgacgctttccccgacgacgggcccttagatacggaggagggaggtggaggagaacccatcagcggaggcgacgaggaagaggaggaggacgtcgacggcctcgccagcttccttgagtcggagatcctctccggatccagcgacgaggatcctattgaccaatcgaattggttgccgcggcaggagcagcggcagcagaaggaggaaggtgatgctgcgaagaataagcggaagcagggttcaggatcggacggggatggctgcagcggcagcgagggggagcagacgaagagggcgaggagggaggagaagaggaggcaggcgaaagggaaggccgtggcgcctcagatcgacacgggcttgttcagcaacgtcccccctgagctgttcctgcggatcttcaagttcctctcctccgaggacctcatctcctgcgctctagtctgccgcttcatgaatgctgnccgcgtccgacgagaccctctggcgccgcctgtactgcatgaggtggggactggcctccaatgccaaattcagggagtgcgcttggaagaacctctacatacagagagatagagaggatatggttgaatttgtgaggaatactcctacagagttcaagggagtctatattcagatgcacgcggcaaaaaggagtcaagctccccgtccgtcaggagtcaacgaccacaaggttatgcttgataagacagtagctgaccaggtatctagttggaaaaacagccgggggcttacggatgaagctgtcaaggggcacccttgtcgggaatacatgctcgtacacccagattgtggggtgccttacatttgtgagaagactggtcgtgtccacgtttgtgatgacgcttgtcgtgaatttgtcttggaccaatctagtgggctgcttctttgtacgatatctggccactgctttgagaggtggctgtgtcctgatgatgaatgggatgctgatgataccgagctgcaacaggctggtgtagtggatgaagcagagccattcatgggatctggacgttacgcacgggcgattatgttgggctacaactgcactgatgagaaggagcttgaggatgccttgcgtttctgttgacgtgtttctgtcgatatgcccttcactcttgatcaagtgaagacgaagccagcggggatatgccggatgtatagctctgtgctatgttttcactgtatttcaccctcgagcatgtacctaagaatagaaggatgtacctaagaatagaacttgtttttgaggtagatcgctgatatgttttgatcagcagagggagccgttatgttgtcgtatgatttcataaattatgcctgtaataaaatataatttacataatgagttttttgtttgtaaaaaa

SEQ ID NO: 17761 - DNA, 1733 bp, Zea mays
aaaatcaaaccaatacaaccgactcgccccctcctacccaaacaagtgcagtgcagcgcctcgccataccggccatgtcggcgattgaattggtgcaggggtcgcgtgccggccaggaagcggagcaggaaccagagtcggagccgcagcgcaagtgggtggccctcgtctccgttgccgtcctcgacaaagaggacgatcggacccaggagatcgtcctcggcaccgacgtgctgctcgatctcaaagacccgccgctaccctcctacctggtgctgcaccccagcgtgtcccttgaccccaggagtaacgaagagccgctgtccgcctacatcctcgccgcccaccgctccggctacattctcctccaggtcgtcgaaggcaaccgcccggacttcttcctctgcgacacgcacagtcgtaccgtcaccatcctccccttggtgtcctcctttcttcggacttgccagggcctcgacatctgcacccacctcagcattggcctcatcgccgacccgctccgccggggccactacgtggtggcccagcttcaaccccccaactccttctaccaccccaacaggctcctctgctactccaccgccgaacgtcggtggtttgtcaggcacctcacccgggaaacggaccacatgtgcagccccttctcgcagaacggcgtgctcgcccacgaaggtcgcctctggtggatcgccctcgcctatggcatattcttctgcgaccccttcacgcctgacctccggttccccgagctgtgcttcctcccgcttccggccgactgccagatggacggctacgtcgtcttcgagccacacatcaggaccctcatcaaccaacgacgctgcgtcaggcccagcgagggcaagctgcggttcgtcgagatccgcggcctcgcctacgacgatgtgctcatcgacgaggacgacgcacccccgggcccggctaaccccaccgtcgggatgtggacgctcgacgacgacccggagggcccggacccgtggaagctcgagtacgaggtgccctttgccgaaatctgggacaacgagacctatgccgacgccggcctgcatccgggcgaggtgccccacgtcgccctcgtcgaccccaacgatcactgcgtcgtctacttcttccagggctcgaagctctttggcttggacgtgctcaagaagcaggtcattacctgcaaggaatgtcttatagaccgtgatcaagtcatcatgttccaatcctcccgccccatcgtcgatgcctgggagctgtcgtcaccaccacctacgctcccgggagacgacgacgacctttcaccagaagataatgtttcgccgggacagcctgacgagggagaaaagaagcgccaggtgaccgagtctgtttactcttggctaagcgatgtctgggagtggacaaggggggatgtggacgagaagatggcaccatcaacatccgatgatgaatcatctcactcctcggatgcgccggagatacagctcccctcctctccctaggtggaacagagagcccaggggcgctgattatattggtcatgtcagtatatggacacttctttcgatcatcttgcgtttcagatacaatacatatagtagagtagagcctgcagctttgtgtcatggacatgtcatccattctcattcatgcctattattgaactatatgagaacctgcaattagaggtggcaaaaaaaaaaaaaaaa

SEQ ID NO: 17762 - DNA, 511 bp, Zea mays
aaaatcaaaccaatacaaccgactcgccccctcctacccaaacaagtgcagtgcagcgcctcgccataccggccatgtcggcgattgaattggtgcaggggtcgcgtgccggccaggaagcggagcaggaaccagagtcggagccgcagcgcaagtgggtggccctcgtctccgttgccgtcctcgacaaagaggacgatcggacccaggagatcgtcctctgctactccaccgccgaacgtcggtggtttgtcaggcacctcacccgggaaacggaccacatgtgcagccccttctcgcagaacggcgtgctcgcccacgaaggtcgcctctggtggatcgccctcgcctatggcatattcttctgcgaccccttcacgcctgacctccggttccccgagctgtgcttcctcccgcttccggccgactgccagatggacggctacgtcgtcttcgagccacacatcaggaccctcatcaaccaacgacgctgcgtcaggcccagcgaggg

SEQ ID NO: 17763 - DNA, 860 bp, Zea mays
gcccggacccgggggctcgacgcgtggactcctccgtcctccctccgcgtttacacccgccgccactcctgctttggcgccgtagctagcaaaggcgatatccatggcgacccctgcacggatcgagctggacaagctgagcgtggagcagctcaaggggctcaaggagcagacggatctggaggtcaacctcctccaggacagcctcaccaagatccgcaccgccgccacccgactcgagaacgcctccgccgcgctccaggacctatccctccgcccccaagggaagaagatgctcgtgccgctcactgcgtccctctacgttcccggttcactggacgacgcggagaaggtcctcgtcgatgtcggcaccggttacttcatcgagaaaaccatggctcaggggaaagaatactgtgaaaggaaaattaatttattgaagtcaaattttgatgaattggttgaggtggctacgaaaaagaaagccatagcagacgatatgggtttgctactacaagccaagctgaggcaagcgtcaccgggcccaagttcatgagagctggatgcacacctcgtctcttctacctatgttgtatcaaacatcatttagtaattttgaagttggagtcacgcagcagcgtagattatattctttggcatcttctgtcgtacagcacactatttgaatggtttaattttgttcctactgctgcccgtggaactttcatgagcttgtatgggtgggaccaaacattgtaagtctggcccgatggggggtggtacggcaccaagcattgctctattctattgtaggtgcaggctggtgcatttcgtgcgaaattaagcacggggttgggtgc

SEQ ID NO: 17764 - DNA, 2702 bp, Zea mays
catctcctgcccatatgaagcctgggaggcaaacataccaaatataaatgcatcaacaagttgatgcacaaacacattctagagtaccctaaacccactagacagtcggtggctgcctgagtgcataaaacatcaggattatgaggatcaaaccctctatgcccttgcatatacacctccacatttgtgggtgtacgaccgattttgacttcatgtacatacaagttagaatgacatatttttatgtatttcgaagttagaacatactatgacataccattcgtttagccaagcgcacatgtccatcgccatcgtagttgtggaacgacttagtaccatggtttcccctagtcctttcggaaatggtgcgaaactcaggggatcccaccacctatgttgggctttgtggctaagtagaaataatgtttttttagaaaaaagtttgttgcttttctgtgcagggtatctttggagtcgttcactggttcgttcgtgggcacctatgaaacgactagattcgtaggaggttgcggtgaagccatcgcgtcttttgttgctcgtggctatgaagtgtttttcttaggttcatgggtggtgatctagtctaagaattgatagtcactaaagtgtactcggccgattagtaatgttgggcggtgtgttccattggaaaacagaccgaaagatgtaactcaagctttgaagttaatatatcttccttttccaaaaaagtgtagataaaaaggatgatggggtgcaagcaacgcagcagccgctggagctcacataagagaacactgaagcgaactagccttcaccatctcaagatgatgcaactggtaacaatcaagccacaacaaatggcaccgttagcaataatcctcccttgatcccttgaagtttgtatggagtaagaaaaaaaattaggctctgttcggttgtttgggattggaggcccggattaattcctacccggattacttctctaatttatatatattttgataagctgtaatgaatcctgacttattccggtacaaccgaacgaacccttagagagagagtgctttgaagatctaggaccaggtgatctttatggctaacgatcatgatttcatgatcgatgaaattgtactatatgcctacactgagttagtatatgacatcgtgattaattatattcctatgtacgtgttgatagaacactgttttttattaaataaaacggatgatgtttgattttatctgagtcaactgttggctcgccattgaaatatgtgcattgatgcgtcggttacagtttttctataaaaaaatatttgttacaatcattattatttaatcaagcataatatactcgtatgattcttaagaaaaagtatgatagaaaatgtagtgctactcggtatgagtctagagaaaaaaatcctgacaaaatcgtttttagttcttgtgaataatcttggcaaagcgtttttttagttcgcgattggatctttcacatgatatcattcttcacgagttcgcgttcccttcattacttaggaataatattgtgtgtcttgggaaaaaaagatcgatttggattttgaaaactggatccaaacaggtccgaaatgactaggaagttgcgattctggaatttaaaattataatcagaaatgaagactagaaaaccaaaaaataaaatatgcccccatgcaggatcgaactacagaccttcagtttacaagactgacgctctaccactgagctataggggcaattgtgatttacgtctttgtgtaggatatatatgtatttttcagatccggccgggtaaccttcgagccccgcggccgcccccgttactcctccgtcctccctccgcgtttacacccgccgccactcctgccttggcgccgtagctagcaaaggcgatatccatggcgagccctgcacggatcgagctggacaagctgagcgtggagcagctcaaggggctcaaggagcagacggatctggaggtcaacctcctccaggacagcctcaccaagatccgcaccgccgccacccgactcgagaacgcctccgccgcgctccaggacctatccctccgcccccaagggaagaagatgctcgtgccgctcacggcgtccctctacgttcccggttcactggacgacgcggagaaggtcctcgtcgatgtcggcaccggttacttcatcgagaaaaccatggctcaggggaaagaatactgtgaaaggaaaattaatttattgaagtcaaattttgatgaattggttgaggtggctacgaaaaagaaagccatagcagacgatatgggtttgctactacaagccaagctgaggcaagcgtcaccgggcccaagttcatgagagctggatgcacacctcgtctcttctacctatgttgtatcaaacatcatttagtaattttgaagttgggagtcacgcagcagcgtagattgtattctttggcatcttctgtcgcgcagcacacactttgaatggtttaattttgttcctactgctagcagcccgtggaactttcatgagcttgtatggttgggaccaagcatcgttccgtacttccattgtaggtctggccgatgggggtggtaccattgtaccaagcattgctctattatagtaggtgcaggctgttgcatttcgtgcaaaaaaaaaaaaaaaaaagcggcc

SEQ ID NO: 17765 - DNA, 692 bp, Zea mays
gcatttggaaagatttccactgggccgtctagataacaagcggccccaccacaccgctgcagtcgccgtgctcgcgcatggagcttggaggcggagggcgaggcggcggcgaccgggtccggcggcagttgcagtcggtggggcggctggcagcgtatctcggcggcggtttcctcctcctctccgccacctcttccgtcgccgtccgcgccctccgcgccatctccgacgccaaccagaggaagttcgcgaagccgtgcggtgcctgcgaggggaagggcagctactcgtgcaggctctgcaggggcagcgccaccatcgagtggtctccgatgcacgacccggtgttcgtcaatccgtgcctctgccctacctgcgatgggactcgggtgcagcgctgcttgaactgcctgggaaatggttacgcttgaagaagcgatgtcagttttcattatcgatgatagatggttgttggggagttggtaaggaaataattggaaatttactgatgaattcgttgcctcgtgtgattataattgctgtgagtctatgatttgtgggtctgtttatgtcgttttctgtgactatgaattgtgggcatgatgctaaatttacaaatctctcgttggagagtcacagttggaactttaaaaaaaaaaaaaaaaaaaaaaaaaagaaaaaaaaaaaaaaaa

SEQ ID NO: 17766 - DNA, 3401 bp, Zea mays
ctcttctccccccactcctcccccaccaaatcctcgttcatttttttttccaagcgacttcgcgtgtgagggcgggagagcgcgcggggctagggtttccgcgggtgatggaagcagaggctgccgcggcggtagtggcgtcgtccgcatctgcctcggcttccgcgggccggtctcgcccatctagcagcgccgcccaggtcaccagtaattcggctgtgcgagctggagaagaaaatgctgcctccctctatgttttatctgttattgactcgttaaaaaagaggattaccgcagatcgtttgacttacattaagaataggataggggagaacaagactaatatcagcagctatacacagaggacttacaatttatcaaaaaataggcaaattagtacatcaaagggtactgattcagcatcaaatttgctcacaaaaaggcaagatgatgcgctatgcaccctgcatagtcttgatattattccggttgacaaagatggtggcacttttcaagacgaaagtcctttctcttcatctaatgttatgtttggtggaaatcttggtcccaagaatgctattattagaccaattaaactaccagaagtgccaaagcttccaccttatacaacatggatatttttggacaggaaccaaaggatgacagaagaccaatctgtacttggtcgacggaggatttactatgataccagttgtggtgaagctctaatttgcagtgatagtgaagatgaagccattgaagatgaggaggaaaaaaaggaatttaaacattctgaagatcacattattcggatgacagttcaagaatgtggcatgtctgatgctgtactgcaaacgctagctcgacacatggagcgggctgctgatgacataaaggccaggtatgaaattctgcatggtgagaaaactaaggattcttgcaagaaagggactgagcataatgtcaaagtggaagatttgtactgtgacaaagatttggatgcagcattggattcttttgacaatctcttctgtcgacgatgtctagtacgcttgactgtaactttcagatattcttttctaggacctgtgtgctgatggacatttctgctcattggtgatgctgataggtgtttgattgcaagctacatgggtgttctcaagatttagtatttcctgtaagttttcacaagttgaaagagttatttataaaattgtgtgtttacttgatttgtgtcttctttgtacagacagaaaaacaaccagcttggagtggcgttgatgacagtgtaccctgtggtattcattgccataaactggcatctgaaccagattctgctgctggtgctgatcacatgctttttgatgttgaggagccaactcactcatcagacaatgtgatgaaccagccaggttcaaataggaaaaagaacggctccagtggaaggaagactaaatctcaacaaagtgaaagctcttcaactgcaagagttatctcagaaagcagtgattcggaagtacatccaataagcaataaatctccacaacactcccctagtccctcaaaagttaaaattgggccaaaaggtggaatcagaaagattaccaatagacgaatcgctgagagaattcttatgagtgtgaagaaaggacaaagggaaatggcatcatctgattctaattttgttagtggatatcttttggcaagggacatgaagcttaggtctgatacacgaaatggaaataaggaattaattgtatcctcacaacagagttctccaagcacaagaagttccaaaaagaagagtacacctcaaattgggaacagctcagcttttgctgaggctcataatgattcaacagaggaagcaaataaccgtcattcagcaacagatggttacgatagttcaaggaaagaagaattcgtcaatgagaatttatgcaagcaggaggtgtacttgagatcatggaaggcaattgagcagggacttcttgtgaaaggattagagatttttggaaggaacagttgtttaattgctcggaaccttcttggtggaatgaagacgtgcaaagatgtttttcaatatatgaattatattgaaaacaacagtgcctctggagctcttagtggtgttgattctcttgtcaaaggatatattaagggtactgagttgcgcacaagatcaagatattttagaaggcgaggtaaagtccgtcgtttgaagtacacctggaaatctgcaggttacaatttcaaaaggattaccgaaaggaaggatcagccttgtcgacaatataatccttgtggttgtcaatctacatgcggaaagcagtgtccatgtctttcaaatgggacatgttgtgagaaatactgtgggtgtccaaaaatttgcaagaatcgttttcgaggatgtcactgtgcaaagagccagtgtcgcagccgccaatgtccatgttttgcagctgacagggaatgcgatccggatgtttgcagaaactgttgggttgggtgtggtgatggtacattgggagttccaaaccagagaggagataattatgaatgccggaacatgaaactgcttcttaaacaacaacaaagggtcttacttggaagatcagatgtctctggctggggagcattcctcaagaatagtgttagcaaacatgaataccttggtgagtacactggggaactaatctcacacaaagaagcagataagcgtggaaagatatatgatcgtgagaactcatcgttccttttcaacctgaacaatgagtatgttcttgacgcatacagaatgggtgacaagctgaaatttgccaaccatgcccctgacccgaattgctatgccaaggttatcatggtaactggtgatcatagagtgggcatattcgccaaagaaagaatcctcgctggtgaagagttattctacgattaccgctatgagcctgacagagcccctgcttgggcccgtaagcctgaggcgtcgggagcaaaggatgatgggcaaccgttcaatgggcgtgcaaagaagctcgcccaaaacaacagaggctgaatctgatttgattctttcattgttaggacaaatttggcagccattcaactaatataaggaacctgtcattcataggccccaatttatttgaactcgtcattgtaactcgtatgtgcttgaattctccatggcagctggtcctgccatccgtagagttaggtcccgtttgttttgaggaactaaaaattaatccctctattttagtcacattgagtcttagattgttaaacggcgggactaaaacaaaagactaaactatttgtctctagtacctcaagccatgactaaaagggaataaatcatataaattttatttttatccttcaaaaaaaaaaaaaaaaaa

SEQ ID NO: 17767 - DNA, 1912 bp, Zea mays
  misc_feature (1138)..(1138): n is a, c, g, or t
ccagcgggcgcggcaaaggttgaaggcatccgattcttggtccccgcgcccatccacaaattttaatgcgggcctcttctggtttcaagcaacgaatcttaagcgcccaagtggtgtccgaggatcagcaccctgattctcctctctgcctaacaatgcacacgaattccacgcctcctcatatacacgtcgacgtcgtcgtccatgaccggcgccgcgctcgcaccaaacgtgcggcaaccgaactgcaaagaaatctccagagagcctttgttccggcctaaccgcgcagaccggccgggagacagtatatatggcggtgcggttccccgtggccggacggggttgcctcttgtctcgtgtggatactggattggctgtatcatatatcaccatactgtaccaggttgacgagcgaggactaataacagacaacaatggcgttcatgcggtactaccgtgcgctgccgcagggggagacgacggtggaggagttcagggcgtggctgagccagttcgacgcggacggcgacggcaggatcagccgggaggagctggagcgggcgctgcgcagcctcaacctgtggttcgtgtggtggaaggcgcgggaggcggtgcgcgcggccgacgccaaccgcaacggcgcggtggacggcgacgagatgggccggctgtacgccttcgcgcacaagcacctccacctcaagatgagccagctgggcctgggtctgggcctggaggagtagcgctgggccgctggcctgctagagttctaaggcgttgccgggaacgctgggtttttcgctgtaaattggactgttattagactcaagtggtcgtgctagctcttggtcgtggattttgttgtttcataagctcggcaagtagaggtggtgatattaatttgtaaatgaaagtagtatgtataaactcttttttttcgattacataggctacaccagcaacatatacttttatgaatctggacactgtaaagttttgacaaatggacgtgtggacatattatgctgctcatcatgggaaaacaatttggttacaaatggtcctctgatgcactcattagctgatagggtagagaatgcactcaattatatgcaaaggtttctgtgaggatctnccaagttgcaataatacaacggttttcttagtcatatctgaaaagcctcgctagaccagtttcatgcagagatagatacccatatttggtaagaataagtgtgatttccctcaaatcattgtagacaattattatttttccaggtaaatagtctttcattaaatataatgctcattaaaatatattcatatatttttcatgccattaatagtcatggttgcatcactgcaaatggcttcaggtattcaaatgacaccatgatttgggaaattaaactgggatcagttttctgccgctgtcgttgatacgtttggggtcctatgagtaccccaaggccatgtatgatttcttacctttgacgcagactggttctatagattcttatgtcacagaatttgatgatctgcgttttagtactgctatgcataatcctgagttggatgaaatcttctttgccaacagtttatgaagggtttgaaacaagatcttcagggacctgtgatgtgttggccaagttgctgcaagaagtgcgggaaaagagtaagttcaggtctcagaaaggtgctgtggttcagaaacataatatacagagcaaattcgagctcatatctggtgcttggggggtctaaagacgagtatatgcttctaaatgcagtaagcaggttcagacttctctgaatgctctgacagttgaggaccaagtgtagttttggttaagtttgttactctctcggttctaaaaatatagttctttatagtcatcttttttccgtc

SEQ ID NO: 17768 - DNA, 796 bp, Zea mays
  misc_feature (795)..(795): n is a, c, g, or t
cactcctatgggcgattgggtacctcgaggccggccatggttccctagccaactatagctgctaatagctgtagctgtacgtgtgtagccgagagactccattatattatattgctcgatctctccatctgaacgtacacacagtccaacacagatggccgccgccaccgccctggtgagcagcagcagcctccgcgccccggcggccttctccgtcgtcgtccgcgcggcctcccggccggcgcctgtcgtcgcagtagtgacgccgctgcccgcggccaaggcagctgccgcccgcggcgccaggctgcgcgcgcaggccacccacaacgtcaagctcatcacgccggacggggaggtacagctcaagatgcccggcgacgtctacatcctggactatgccgaggaacaagggttggacctgccctactcctgccgcgccggcgcctgctcctcctgcgtcggcaaggtcgtctccggctccgtcaaccagttcgaccagagcttcctcgacgacgaccaggtcgccgagggctttgtgctcacctgcatcgcctaccccacctcggacctcgtcatccagacgcacaaggaggatgcactcgtcgagtcgtactagtatagtcagcaattaatgcaccacgtacgcacgctctccttgcattgttgcatgcatgtaataataataataacgacgccgccatgtaataataactaactatacatggtcctcatgcgtatgcaaaccaaaagaatgagagcagtatagcaaaaaaaaaaaaaaaagcgcccctna

SEQ ID NO: 17769 - DNA, 842 bp, Zea mays
  misc_feature (37)..(37): n is a, c, g, or t
ttgggaccctcgaggccggccgggagtcattgtaaanaacattgggaccctcgaggccggccgggatggttccctagccactatagctgctaatagctgtagctgtacttgtgtacgtagttgtgtagccgagagactccattatattatattgctcgatctctccatctgaacgtacacacagtccaacacagatggccgccgccaccgccctggtgagcagcagcagcctccgcgccccggcggccttctccgtcgtcgtccgcgcggcctcccggccggcgcctgtcgtcgcagtagtgacgccgctgcccgcggccaaggcagctgccgcccgcggcgccaggctgcgcgcgcaggccacccacaacgtcaagctcatcacgccggacggggaggtacaggtacagctcaagatgcccggcgacgtctacatcctggactatgccgaggaacaagggttggacctgccctactcctgccgcgccggcgcctgctcctcctgcgtcggcaagatcgtctccggctccgtcaaccagttcgaccagagcttcctcgacgacgaccaggtcgccgagggctttgtgctcacctgcatcgcctaccccacctcggacctcgtcatccagacgcacaaggaggatgcactcgtcgagtcgtactagtatagtcagcaattaatgcaccacgtatgcacgctctccttgcattgcatgcatgtaataataataataacgacgccgccatgtaataataactaactatacatggtcctcatgcgtatgcataccagaagaaaaagagcaggataacaacgaaaaaaaaaaaaaaaaaagcgggcc

SEQ ID NO: 17770 - DNA, 1525 bp, Zea mays
ctcgaggggccggccgggaaaaaaaaaaaattgggtaccaccgggcaacccgagcccaatccctatcttccgagatttgtctgcgcccctgcggcgcgcatggcgccacgactgaccgtggccttgggcggcgctcgggcatgagtacatggcgctcggtggcctcgcgtcgcgttactcacccaccggcaccgcgccacggccgcgttcgtctcaacaggagccgatggccactctcgcgccacggccacatatcctcctcggcttgacaaggccgcagcccatagcgcttcgtgcctgcgccgccttctcccgctcccgccacgcgccagtcccaccgcgggccgcgcagccgcggcgcgtcttcctcggccttggcgctgccttcatcgaccaggccacccgcatggcctccggcggcacctcgtcccgctctttcgttgccggagcgcggccgaggcaaggcgtttccccagtcgagcagattctcaagaatgtcgagtggccagatgagttccctttcaagcctgaggacttcagccgcttcgacgaatcatcagatactctgttctactcggttccacgttttgtcactcacattgatgaccaagcaatccaagctctcacagagtactattctgaagttcttcctccaagtaatactcctggggtggccattctggacatgtgcagcagctgggtcagccattatcctcccggttacagacaagagaagatcgtggggatgggtatgaatgaagatgaactgaaaaagaactcggtactgactcagtatgtcgtgcaagacctcaatgtgaacccaaagcttcctttcgaagataacacttttgatgttatcaccaatgtggttagtgtagattaccttacaaagccaatagatgtttttaaggagatgcgacgaatactcaagccaagcggccttgccataatgagcttttcaaaccggtgcttttggacaaaagctatatctatatggacctcaactggtgatgctgatcatgcatggatagttggtgcttacttccattatgttggaggttttgaacctccccaggcacttgatatatctcctaatccaggacgaactgacccaatgtatgttgtatgctcgagaaagaaaatagggtaactaaacaatatatttggcaagtgctatcaagaaacaaatagaaggaaaaatacaagaagcaagttgtttggccctgatcgcaggacctattggtgagctgatgtttccgtgagtaatgtaacgacagaaaaaagaagcaactactacataaactatttatagaagcggcagattcacttcataggttgtagcaactgtctttactaaaagtgtgtttggtttgaggaatgaagtgatccatcttcttctcactcctcacttttttatttggtttgtgtaatagaatgagttgatccatcaccactccaaaaaaaaaaaaaaaataattagtatatacatgaggggtgggttgattccaccaaaattgatagaatg

SEQ ID NO: 17771 - DNA, 2708 bp, Zea mays
atatagggtgataattcacctagacccaactgacaaaccaaacaccccaccaaatgaatcagttagcccaccaaatcgggagtctgcaatccactaacgggttgcgtgcccagtaacgagctcgcaagacgtgcacacagtattagctccgtggacacgtgactcccacatgagccgtacgcgcccacccggtcgccacatcatctttcagcaatttgtgatctctctgtcatttatcgcccaatttcagtaattattagtaagcacagtatttgctagtgcaaaaaagaacaattactgacaaaacattcaataatttatgcagtcacttctcgaaacattcagccatttctagaaatgtttaataattgcatttagccatttctgaaaatgttcagtaactaccaaagcatctcagttatagatgggtaatagcatttcagtaaaggacaacactagcccagtaattgttaaacagaattgtcagtaattatcactttagtagtgaaaaaagaaataacaattaactagtcattacttaatcattcgataatttattagaactcgttaattacccacggaatttaaataactgacgagttgaatcgagcgcgcggggagcagatcgtggatcggtctcaggttagtcgggtatgtccgtatgtgagggagggcgtgctcgtgggtcggagggcgtgtggggctaggctaggtgagcttcgtactggatgacaaatggcgcagcctacggagagagagacttcgttacaactcctggtagaaaacaaaacctttttattttgatagtggcggaagaaataccatttttgcctgccattttgttggttctgaaacgtcaggccacgatgattgacctatagaccacgcgtcatctgaatttccaccacaatataatacgataattgtttcgataaagttgcaacatactaccgttgctactataaatttagcctcgggtcctcgccgccggccggcatgtcgagcagggagtaggcacacaagatagctagctagggacaatggaggagaaggttctcgtcgccgtgggcgtggccgtgctactcgtcgtcgtcctctccaagctcaagtctgtgctcgtcaccaagccgaagcttaacctgcccccagggccatggacgctaccattaataggcagcacccaccacctggtcaccagcccgtcgatctaccgggcgatgcgtgatctcgcgcaaaagtacgggccgctgatgatgctccggctgggcgaggtgcccacgttggtggtgtcgtcgccggaggccgcgcaggcgatcacgaagacgcacgacatcgcgttcgccgaccgtcacatgaacaccaccatcggcgtgctcaccttcaacggcaccgacctggtgttcggtccctacggcgagcggtggcggcagctccgcaagatctgcgtgctggagctgttcagcgtggcgcgcgtgcagtcgttccagcgcatccgcgaggaggaggtggcgcggttcatgcagagcctcgcggcgtccgccggcaccgtgaacctgtcgaagatgatctcgagattcatcaacgacaccttcgtgagggagtgcatcggcagccggtgcaagtaccaggacgagtacctggacgccttcgacaccgcggtccggcagacgtcggtgctgaccgtggccgacctgttcccgtcgtcgaggctcatgcaggctgtgggcacggcgccacgcaacgcgctcaagtgccgcaacaggatcacgcgcatcctggagcagatcatccgcgagaaggtggaggccatgggccgtggcgaaaagacggcgcacgagggcttaatcggtgtcctgctcaggctccagaaagaggctaacttgcccaccctgctcaccaacgacaccattgtggcgctcatgtttgtaagtcttgtcttgcaatatatgtttatttcaccatgcatgcatctagatcgtcgtcgttcagcctgcgtgctgacctctcaagtttctcctaggacttgttcggcgccggcagcgacacctcgtcgacgacactgaactggtgcataacggagctaatccggcacccggcggcgatggcgaaagcccaggccgaggtccgggaggccttcaaggggaaggcgagaatcatcagcgaggacgacctcgccggggcagggcttagctacctgaagcttgtgatcaaggaagctctgaggatgcactgcccactgccgctgctgctcccacggctgtgccgtgagacgtgccaggtgatgggctacgacatccccaagggcacggccgtgttcatcaacgtctgggcggtttgcagggacgccaagtactgggaagatccagaggaattcaggccagagcggttcgaggacaccaaccttgagtacaactacaaggggacgaactacgagttccttccgttcgggtccggccgccggatgtgcccgggagcgaaccttgggctggggaacattgagctcgcgttggcgagccttctgtaccactatgactggaagttgcctgacggagtgaagccacaggacgtccaagtttgggagggcccaggactgatagccaagaagaaaacaggcctgctgttgcgcccggttacctgcattgcttttgcttgctccagcggctagctgatgcgtaataaattaacgacaagcccaacatacttggaga

SEQ ID NO: 17772 - DNA, 1099 bp, Zea mays
ccggtccgaactccgggtcgcccagcgtctttctgtcacgatagaaggggagttgtaaagaagagggaccatcactaaaacttcagtgaagttagtgggcactggaagaaagccttacccgcaaaaaggaacaggaaaagcacgacatggaacactgcgcggtgcccagtttcgtggtggtgcaaccatgcatgggcctaaacctcgaaagccatgcaatcaagctgcagaagaaagtacggcggctggggcttaagattgccttgtctgctcgaactgctgaggggaagctcttgatctttgaggacttggaagttcctagccacaagacgaaaaacattgtgcaatacattagacagatggatgactcaaagaaggttctgttggtggatggaggcgacattgataagaagctaaagctggccactcaaaaccttcactacgttaacgtacttccttccattggcctcaacgtctacagtatcctccagcatgacacccttgtaatgactcgggccgctatcaacagaatcgtcgagcggatgcatacccccatcaaccgctagcaaggggggtttctgagtcgcaccactgtttcttacagccagcaacctgtgctttttcgttccctgttaaagctcgaaggtttcctgttatcttggtgctaacatggagctgcaacgtgagctgtttattttctgtcagactggaggtaccgaccgaggtaggagggaaatgttgtggccttttgtaagcaggtcattggatgtttattttagattattttttggcgttttacccacactacccttgaaacttagtgagttcttatccagcaaataagattatgtaatcctggattatataggtccaaagcttgggacagcaatttgtttagagtcctgtataatctagctgtcacgtcgcaggactcacgtggagaaagatgaagggatttgcatcgtttagggtttaaaaaaaggaaaaaaaaaaaaaatttacttggatttggtccattttcatagaagttggctgaaaacgaaaggtttggttggcagaagccaattttaagagccaaagaaaaaaaaaaaaaaaaaaa

SEQ ID NO: 17773 - DNA, 1381 bp, Zea mays
  misc_feature (1349)..(1349): n is a, c, g, or t
  misc_feature (1352)..(1352): n is a, c, g, or t
cattgggtaccccgcggccggcaaagggagggacagcccacgcggatcggtgtgcgtggctccgcgctcccttccgccgccagtccgccggctcaactccagccgccgcgtgcccctcctctccccacccgatgcgggccctcgcgcgcgccgcgtcgctgctccgccgcgccgcggggtccgcgcctactacggcgtcgctgtaccatccgccgcggaacgtaggcccttgcctcgtgaagaatctgccaggtttctttttcaatgggtattctactcttttggctccaccaaatgaagtgttgattccaccagaactcctttctagcaggactgtgtggacaccagatcgggagcttgggcagtatgaagacctggtagctagggtcacaaacttccataatgaggacaagggcttcatggttttggatggcgatgtttttgatgttccaattaggaaggacattgttcaccgagtagtaaggtggcagcttgctaaaagacagcaggggacacactcaactaaaactatcagtgaagttagtggcactggaagaaagccttacccgcaaaaaggaaccggaaaagcacgacatggaacactgcgcggtgcccagtttcgtggtggtgcaaccatgcatgggcctaaacctcgaagccatgcaatcaagctgcagaagaaagtacggcggctggggcttaagattgccttgtctgctcgaactgctgaggggaagctcttgatctttgaggacttggaagttcctagccacaagacgaaaaacattgtgcaatacattagacagatggatgactcaaagaaggttctgttggtggatggaggcgacattgataagaagctaaagttggccactcaaaaccttcactacgttaacgtacttccttccattggcctcaacgtctacagtatcctccagcatgacacccttgtaatgactcgggccgctatcaacagaatcgtcgagcggatgcatacccccatcaaccgctagcaaggagggttctgagtcgcaccactgtttcttacagccagcaacctgtgctttttcgtcccctgttaaagctcgaaggtttcctgttatcttggtgctaacatggagctgcgacgtcagctgtttattttctgtcagactgaaggcaccgaccgagataggagggaaatgatcgggccttttgtaagcaggtcattggatgtttattttagattatttttttggcgttttacccacactacccttgaaacttagtgagtacttatctaccaaataagattatataaattggattatataatcccggattatataggtccaaagcttgcgacaaanaanaaaaaagcaatttgtttagagtcctgtat

SEQ ID NO: 17774 - DNA, 687 bp, Zea mays
  misc_feature (660)..(660): n is a, c, g, or t
acggagagaagtagctagaggaagcaccagcaaaccaaataagcagaccaccttctccacccggctggcctggccggccttcgtcttcctccgatccccaggccccagccactccccgtacaagccaaaaagaccagtaggtaggcaggcagttcatcgtcgatcgagcaagatgtcggactggggccccgtggtgatcgggctggtgctgttcgtgctgctctcgccggggctgctcgtccagctccccggccgccaccacttggtggagttcggcaacctgaagaccagcgccgtctccatcctcgtccactccatcatctacttcgcgctcatcaccctcttcgtcatcgtcatcggagtgcacatcaccaccggcgactagctcgatcgatcacacgtctctgtcgattaatttcctgatcggtctgcttggcttctttctttttcatctcgtgcatctgtgttactatatatactacaccataccatacacgtctctcccacctccgacccctctctgtccttcccatcagcatatatactagaacgtcgtgcgtcagcgcgtgtatgatgctgtcgaccatggcaatcgaacttaattaatttctcagcatccatctagaatagaaagaaggaaaagaatgttgtctgtaacanatgttgtctgtaatgtttcagttcatg

SEQ ID NO: 17775 - DNA, 3320 bp, Zea mays
  misc_feature (2853)..(2853): n is a, c, g, or t
tcacgcctcttcaccagctcagctttgcatatacgtacctaaaactaagaaggataaaccctgacagaccgttccgactcaatatgtttaaggattgtgagaggcgatcgatagcgaagctattccatcatcgatcagaagagagtcacagtggtgcacagctaacaagatgacacatccttcttggtgatggggggcagaagagggagagatcagggattgtattttttatacagctcagcagtcagctatgcacaagatccattgaaatttatacccctgtcgaagagttcatactttatataatgcaagtcatctttacccttgttactctctagtgctgcagaccagttcccgcctttcatgttttgcagttgacaaaggcagattaggaggttctagctgtttggtttttctttattctccgtaaagctctgtttattctttggataatatgggaaagttgtggctgggcatggacttcccagatgtattattattgccacaccactgtaggactgtagtgaggccatgattctcctgcaattctctgtggtcttacagaaaatgtaccatacaatcaatagggaactgcagtatgtacttctctccatgacagtaaccgattttggcctttttttaaaaaaaaaatcccaaagttctcgtgtaggatgtaaatggtacatactatatgttcgtatttgaatcgatctgtttaaaaagttgagatccatctatatctaagttcggcggcccaatattcgatttgtatccaatttatatccgtatatttaaagttgaatatttaaaatattaatatccatttaaattttatccaacacaacttgataatatctatattcaatttgaatttgaagagaacatatgaaaacaaataaatatggaacgagtaatattcgtatccgatctgattataccctactctctcgaccacttttcactgagcaaccatgtgtaagaaatatagaacatgcgatgtctgttcagtgttcacctaattagcaacatttacgttacgtagaatgaataactaaatttgtactttattcacatagcagccttctgtacgccactgactgtttcaatcccgggattggattctataaagcattcagtagacatgcaaaaataatttcacttcagacagaaggtcaatacaagtaaaattacaaaccattggaaatgaaaacaaatctggacatctgcatacacatatctgacactgaagattttttacatttctacaccacttgcaaaacaaatccagctgatcaaatagaaatcagcataaagcccagcattaattctgaagatctccaacctgcgcaaggtcaatcaatggattgatccagtgggtaatctaaagctcacctcaaggtcaagttagagccttgtctctgaggatccccagcatctcattccttcccctgaccacctcatcaaatacttcgtcaaggacacagtcgaacatctccaccccttccctgagctcacctgaccgtgccctcggcccctgctcgccgccgtcgaccttgccattgacgaggtctcgaaccgcagtggcgaccttctcgtgctctgccacggccgcagggctcgggaaccgggcgtggatcaacgacaacgattcgcgccacggctcaagctcagggacgacgccaacggcggaggcgatcgtggtccggacgccaccgctgtcgacggtggccggggcggttagagcctggagcacgaacatggataggatggacgtcgtgatcttggcgacgagcgtgacgacgaccatgccgccagcgtccccgccggcgccgccggagacgatgatcgcccttcccagacgctccgcctcggccaccgccgccttcgcgtccgccatcttttcgcggaaggcggccggcggtgacgacgactgggcctggcacggttcaggggcggcgccggcgctctccacgacgaggaaggctgctgcgccgccgtcgcggccaccggcggcgcggcccgcgacctgcgcggcgaagtcgacgaccatgcagtagcggtgcatccgcgacacggcggccttgaacgcgttgcagaagtcgagcagcgccgccgtctcctgcatgtagtgctcgaaccagtccgcggcagcgccggacgaggagacggcggcggcggccaccggcacatcggctttcctgaagatggccagcatctcacgctgcatccgcttcacgagccgcatggcgtccgcgcaccatcgcatggacaccgtccccggcgacgccacaccaccgccgccgccgtgatgatcaacctccagcgtgctctcgaggtgtgccagcccctcgacgagcgaggcgcagaaggccgtcgtgtcgccgccaagaagccgacatctccggcgactactaggccggaggcggcaccttattctcatgcccgattgcccgtgcttatgcatggccaaatactgctgtttgcaaggctaatccgtcgacggatatataggtctatatatccatgcccacttgctcatgtgagagtgctcgtgtgcatatggtgagggcagctgaaatccagcaagggcgcacctgcatgcatgtttgcaaatggtggctaggtttcttggaagagtagggaagattatttccaagggggagggaggaagatgaggagtgaagcaagaggagtggcatactattctatccctgcacctgacatagcttgctttgcttggccttgttccttggtcttgggcatgcatgcatggttgtcaaagaggaggttgggtgtttggacaaaactcaccaaacaaacaatttgggagattggggttgttttggacaagcncgttcagatgatgtggatgtggcagcgtattaagatatggattgacttgtaaggatatgcttcaagggaccctcatgcatacatgggccctttgtgttgggtggcttgggattttgagaaggtagctaaagtgtagcgctgtcgctgaaggagggaccatatggacgccctttgtcgtcgcaattgtgcaattgaaacttcagaatcgatcgtatcattgcagtatctttgccatgtatacagtgcccgttcatttttatttctttatgttggctcgcttttgggccaatcaccaataaatgaactctagggccggcgcatgacgcgcgagatcttggagtcctctgcgtgagcacgaactgtctgcgatgagcggctggaccgtctgtgattgtgcagagagactctggtcttctccgcggtcatgcagaccgtccgtttatgagtgacggaccatccgcgaggcg

SEQ ID NO: 17776 - DNA, 2774 bp, Zea mays
taggggccttttttttttttttttttcgctcgtttttttttttttttttcatcggtaattgcaacgtttttttattcacaacaataaaatattattttctgcaagagggaccaaaagaattaaataaaagtaccctccgaggtgacgttgcttgttacagaggacgtgccaagtcatttcgggacaacaagtttgcacaacggaaagctgttcaaaccatttcagacagaatatgccggtatctgacaaagtccgatgtggccttgaagctcggagtgaactcgcagaagaagctcagcactgcagccaggttgtgggcgctgttcttcgccagggctttctccagaaatagggcaggctgcacggtgatcaccttgtattttctggcatagcgcagggcctccaagtagtacccatcttgcagcatcgcagtcacgtagtcgtgatgcaggcctcgctccctcagcatgtccatgcccagcttcctcgttggcgggtgctgcagacccagctccataagttgcattgccagttctttacacggctcaagaatcttgtttgacacaaacaatgctatttcagcgtaacggttgctacgagctagtagtgtcgccgtcatcacataaaggttgtgaggagccttaagcccagcctttgagacactccgtagaaactctatgatgacagcaataagatatgcaggatcacccatcatttcatcttcaacaagtgtaaagacagactggaacatctcaattggagaaattgccacggttccagcatgttgtccatgttgcgtcattgtgcctgaagacaatggtcggctagcttcgcctacagcttgctgtcgtttgtcgacagcatcagatgtattgtccacagaatcagaagatatgtttatatttagtaatcccctgtctattgtatgctcaactcctggatttgactgcacatatatatccacagcctcacttccgtggtctgggttcacagcaggactaactgttgttccaggactggattcctgagaaaccacatgggagccatcaataggctgactacctgactgctgattttgctcatgtattcgcctaaccccaggaaaagcccctcccattttcatcaaacgcgtgtaggaatcaaggacaacatccatcgccttagcaactgtgggcactgacctcctttccaggatgattgtccgaactatagctaggcatagagtcttaaccatgcttgggtcagactttcgtctctgaaggaattccaaaattgaaggagcatcagaactactagcagcaatagccgccagatctaaatggagcttccataagagcccattctcagcatcacagatgaggtctggaatgaggaagttccaaccttctccatagatggttccaccgtatgcactagactggctatccgcagtctgagatacttgtctactattgatgggcagtcctctcaatagcagtggaagtggtgcagaaactggggcataagaatccagggacacatcgtaaagcatgactacttttgcatctatttggtgaaccataattatgttgtcaacggcactaactgcaattctgcttgagtatgttggcagagtacactgttgtacaacagcatcacggtaaaagcgatatagattcaatgacatactaactctgtcaagctgcaagcaataaatcctaccatagactgttacaatgtaaacatcatctgcagctagaacaggcttgttgtttgcttcacttttagacatcatcatctcaaacttcggtattttgacaatcccaccagcagaaaactgatagccagtaaacatcgtgcattgcattccagaagcaagtagaatcagcctactttcatgtgtgtaaagataccagctcacattgaacttcttcgattccaccaagtgaaaagcatggggctgaggctcgtaggcaagaagatcaagaccacttgtttttacaagtataacatcacatgttgggcaatctgtcccgaccggcccccgcgcgcgccccgcagcagctctgcactttttgctacaagtctcccctgtttccctatttctaaactcaatttcatgtctggatcgttgaatcccaataactttatgatccagcgaatatcgaactgacaagacaggtccttcattaactggatcagagtttggaggtccagatggagtaggtagaattgttctccagtacaatatccgatcagcagttggagctataagggaacttatttgcatcatcatagaacagaccctgagtgtctggtatgtcacatcgcagcggaggatgctgaacataagcatgagacagtgccccagatgtgcccaagcccccttgtatctgattgcccaacattttctttgtctcttgcgtgcttaggctctactgattgtttagccaagaaaatgaggttctactttttaagatgactgaaaaatagaaaaggatcaaaaatccgcagcaattaccaaaagagattagtatcaaacttcctataaatatggagcctcaagccttgttcttaaccacagtctgcatgcatgctctgagtgctagaaactccttggaacacatattatgttcaatctcagggacctttgctgctatgcatctcccataatcttttgcctgggacgcgcagaccgcgaggatccggaccagagcggaggaggaggatgccggcttccgctccttcatccgtgtcctgcccagtgctcactgcgcggggcggcgggcccggcg

SEQ ID NO: 17777 - DNA, 2081 bp, Zea mays
tcgaggccggccgggaggaattcctctcagccggcttgcatctctcaacaaggcagagatcccggtccttatactaggctccattgcctcagtcatcagtggagttatcttcccgatctttgcgatactcctgtcaaatgtgataaaagcgttctatgagcctccacatctcctaaggagggattcacagttctgggcttccatgttcttggtgtttggtgcagtgtacttcttgtcactccctgtcagttcgtaccttttctccatagcagggtgcaggttgattagaaggatccgactgatgacatttgagaaggtggtaaatatggaggtcgagtggtttgatcacccagaaaactcaagtggagcaataggtgcaaggttgtcagctgatgcagcaaaagttagaggccttgtgggggatgcgcttcaattggttgtacaaaactcttcgacactagttgctggtttggttattgcatttgtgtcaaactgggagctatccctcatcatcttagctttaataccactcattggcctaaatggatggatccagatgaagtttattcacggtttcagtgcagacgcaaagatgatgtatgaagaggcaagccaggtggctaatgatgcagtaggcagcataagaacagtggcctcattctcagctgaagagaaggtcatggatttgtacaagaagaaatgtgaaggtcctctaagaacaggaatcaggacagggattataagtggaatcggttttggagtttcctttttcttgctatttggggtatatgcagctagcttttatgctggtgctcggcttgttgaggacaggaagacaacctttcctaaagttttcagggttttcctagctcttgcaatggcggcaattggagtgtcgcaatcaagtacccttacatcagattcttccaaagcaaaatcagctgcatcttctatatttgcaattgtagatcgaaaatcaaggatagacccaagtgaggatgcaggggtaactgttgaggcactacaaggaaacatcgtattccagcatgttagcttcaagtatcctaccaggccagatgttcagatattccgggacctttgcttgacaattcatgctggaaagactgttgcactcgttggagagagtggtagtggcaaatcaacggcaatttcattgctccagaggttctatgacccagatgtaggccatatactactagatggcgtggacatacagaagttccagcttaggtggttaaggcaacaaatgggcctggttagtcaagaaccagctttgtttaatgacacaataagggcaaacattgcctatggaaaagatggacaagcaacagaatctgagatcatatctgctgcagaattggcaaatgctcacaagtttatcagttcggcgctgcagggatatgacacagtggttggagagcgtggagcccagttgtcaggagggcagaagcagcgagtggcgatcgcccgtgcaattgtgaaggaccctaggatcctgcttctggacgaagcgactagtgcgctggatgctgagtccgagcggatcgtccaggacgcactggacagggtgatggtgaaccggacaacagtgatcgtcgctcaccgtctgtcaacaatacaaaatgcagatttgattgcggtcgtgaggaatggggttatcatcgagaagggaaagcacgatgccttgatcaacatcaaggatggcgcctatgcgtccctcgtcgcccttcactcggcagcctcttcatagcaggtgatggtatgggatcctgcatacgtctgctaagacatatatgaacagagcgagctggcacaacctgtgtagcaatccaggtgctagtctctgttcctctatttgatggcatacataattgcttatacctaagcggagaaatgttacaaatagcaaggaccagatgtaaatgcaaggagctggtccttaagataactttttataatctataaatcttaatatgtatatgtagcttcgaacatagaaaccaaatagatgatggttatgctataaaaaaaaaaaaaaaaaaaaaaagggggggcctcga

SEQ ID NO: 17778 - DNA, 1789 bp, Zea mays
cgtttgagaggtggtgaatatggaggtcgaatggtttgatcacccagaaaactcgagcggagcgatcggtgcaaggctgtcagctgatgcggccaaagttagaggacttgtgggagacgcgctccaattggttgtgcagaactcttcgacactagttgctggtttggtagttgcattcgtggcaaactgggagctatctctaatcatcttagctttgataccactcattggcctaaatggatggatccagatgaagtttattcagggcttcagcgcagactcaaagatgatgtatgaggaggcaagccaggtggctaatgatgcagtaagcagcataagaacagtggcctcattctcagctgaagagaaggtcatggatttgtacaagaagaaatgtgaaggtcccctaagaacaggaatcaggacagggattataagtggcatcggttttggagtttcctttttcttgctgtttggggtctatgcagctagcttctatgccggtgctcggcttgtcgaggacaggaagacaacctttcctaaagttttcagggtttttcttgctcttgcaatggcggcaattggagtgtcgcaatcaagtacccttacatcggattcttccaaagcaaaatcagcggcgtcctctatatttgcaatcgtagaccgaaaatcaaggatagacccaagtgaggatgcaggggtgactgctgagacactacgaggaaatatcgaattccagcacgttagcttcaggtatcctaccaggccagatgtccagatcttccgggacctttgccccccagcgtccgctggaaagatgttgcgcttgttggggagagtgggagtggcaaatcaacggcaatttcattgctccagaggttctatgacccagatgtaggccacatactactagatggcgtggacatacgcaagttccagcttcggtggttaaggcagcaaatgggcctggtcagtcaagaaccggccttgtttaacgacacgataagggcaaacattgcctatggaaaagatggacaggcaacagaatctgagatcgtatctgccgcacaactggcaaacgctcacaagttcatcagctcggcgctccagggatatgacacaatggttggagagcgtggagctcagctgtcaggagggcagaagcagcgcgtggccatcgcccgtgcgatcgtgaaggaccctcggatcctgcttctggacgaagcgaccagcgcactggatgccgagtccgagcggatcgtccaggacgcgctggacagggtgatggtgaaccggacaacagtggtcgtcgcccaccgtctgtcgacgatacagaatgcggatctgatcgccgtcgtcaggaacggggttatcatcgagaagggaaagcacgacgccttggtcaacgtcaaggatggcgcgtacgcgtccctcgtcgcccttcactcggcagcctcttcatagctgcaggtggtaggtagcatgggatcctgcaaacgtctgctgaaacatatatatatatatggacagaggcacagagctgccacaacctgtgtagcaagtcaggtgctagtatctgttcctctatttgatgacacacataattgcttattatacctaagcggggaaatggtacaaatagcaagggccaaatgtaaatgcaaggagctggtccttaagatagttaatatatatatatatatatatataatttaaacaattattaaaaaaaccaacaaaaaaaaaaaaaaaaaaaaaaaaaaaaaaaaaaaaagtgcggacgcgtgtg

SEQ ID NO: 17779 - DNA, 1969 bp, Zea mays
cattgggaccctcgaggccggccgtcgcgtcgcgtccctccttcctccctctccatttccaccaccaccccccgccccctctctctctctcttcttcttcttcttcaatcctccctccccgcgctggagttggaggagggagaggggacaagctttccggcgccgacgccgacgcggaccccgcgccgacacgatccggtggatcaagtgcatcacacctttagggaggccccttggacagcagtttgtgctgcaaattctatatagctctgtcgcagcatggcctcggtgggcgtggcacgctcttctttgggatttcagaatggcacaagttctagcagtgacccagatcgtcttcccaacgagttgggcagtatgagcataagggacgacaaggacgttgaagatattgtagtcaatggcaatggggcggagcctggtcatatcatagtgaccagcattgatgggagaaatgggcaggcaaagcagaccattagttacatggctgagcgggtggtaggtcatgggtccttcggaaccgttttccaggccaagtgtcttgaaactggtgagaccgtagctataaaaaaggttcttcaagacaagagatacaagaatcgtgagctgcaaaccatgcgagtgcttgaccacccaaatgtggtggctctaaagcactgtttcttctcaaagactgagaaagaggagctttacctcaatttggtgcttgagtacgtaccggagactgctcatcgtgtcatcaaacattacaacaagatgaaccagcgcatgcctttgatttatgcaaaactgtatatgtatcagatctgtagagccttggcatacattcacaacagcattggagtgtgccacagggacattaagccgcaaaatctcctggttaatcctcatacccatcagctaaaattgtgtgactttggcagcgcgaaagttctggtaaaaggcgaaccaaacatttcttacatctgttctaggtactacagagctccagagctcatatttggtgctactgaatacacaacagccattgatgtttggtctgctggctgtgtgctcgctgagctgcttctaggacagcctctgttccctggagaaagcggtgttgatcagcttgttgaaatcatcaaggttctgggcacacccacacgtgaagaaattaagtgcatgaatccaaattataccgagtttaaattcccgcaaatcaaagctcacccgtggcataagatattccataaaaggatgcctgctgaagcggtagatctcgtgtccaggcttctgcagtactcaccaaaacttcggtcgactgctttggaagcattggtccatccgttctttgatgaacttcgggatccaaacacccgcttaccgaatggtcgttttcttccgcctctcttcaattttaagccccatgagctgaagaacgtgccggcggatttcatggtgaaattggtccctgagcatgcacggaagcaatgtgccttcgtagggtggtgatctctggataagaggatgacgactcgatgattagctgaggaccaagttaatgtctgttagaaactgccggagatcgacattgccagatgtggtgtggtataagataggcaatatgtgtgattattttttgttcgaggttatcaccccccttgccccagaaaagatgagaagatgtcgatgtaacaagccctctgcgcttctgtaagtagatgagtgttgctgcatgccccctgggtacatgtatcggtttgagcagaattctgtttgcctgaatcgtgccatcaccacgcagggatccatcccttgtgtgacgatgttcagcccaacatttgtttatggattcaggctattcgttcatttgtactcctcgcatcctatggatgattaagcaatatttgcaatttttctaaaaaaaaaaaaaaaaaaaaaaaaaaaaaaaaaaaaaaaactcgagagt

SEQ ID NO: 17780 - DNA, 1075 bp, Zea mays
cattgggtacctcgaggccggccggggcgtcgcgtccctccttcctccatctccatttccggctttccgccaccaccccccctctctctctctcttttcttcttcttcaatcctccctcctcgcgctggagttggagggagaggggacaagctttccggcgccgacgccgacgcggacccggcgccgacacgatccggtggatcaagtgcatcacacctttagggaggccccttggacagcagtttgtgctgcaaattctatatagctctgtcgcagcatggcctcggtgggcgtggcacgctcttctttgggatttcagaatggcacaagttctagcagtgacccagatcgtcttcccaacgagttgggcagtatgagcataagggacgacaaggacgttgaagatattgtagtcaatggcaatggggcggagcctggtcatatcatagtgaccagcattgatgggagaaatgggcaggcaaagcagaccattagttacatggctgagcgggtggtaggtcatgggtccttcggaaccgttttccaggccaagtgtcttgaaactggtgagaccgtagctataaaaaaggttcttcaagacaagagatacaagaatcgtgagctgcaaaccatgcgagtgcttgaccacccaaatgtggtggctctaaagcactgtttcttctcaaagactgagaaagaggagctttacctcaatttggtgcttgagtacgtaccggagactgctcatcgtgtcatcaaacattacaacaagatgaaccagcgcatgcctttgatttatgcaaaactgtatatgtatcagatttgtagagccttggcatacattcacaacagcattggagtgtgccacagggacattaagcctcaaaatctcctggttaatcctcatacccatcagctaaaactgtgtgactttggcagcgcgaaagttctggtaaaaggcgaaccaaacatttcttacatctgttctagatactacagagctccagagctcatatttggtgctactgaatacacaacaaccattgatgtttggtctgctggctgtgtgctcgc

SEQ ID NO: 17781 - DNA, 568 bp, Zea mays
cattgggtacctcgaggccggccgggacgcacctgctccttacccgtctgccgtcggcataacataatcgtcgtcgcgtgcaggcgccattcccttttccagtggtctgttgctcgcgcttcgtccagcttccccggaagaggtagcacggcaagggcagaggatgagtgaccccaagtacgcctacccctaccccgcgcaaggttactaccaggggccgtaccagggcccgccggtgatggcgccgccgcagtacgccgcgccgccgcccagaagggagccgagcttcctggaaggctgcctggccgcgctgtgctgctgctgcttgatcgacgagtgctgctgcgacccgtccatcatcttcgtcagctagactagatgatctgtatctagtggtatatatataatatgtatgtatccagttgtactcttagctttattcctgcaaccttcaagctcgagatgatctgtatctcggtcgagttggtgtgtatgtgtcatctgtatcaactatcatcctgtcattgtattgcttctaaaaaaaaaaaaaaaaaaggcccctagggcc

SEQ ID NO: 17782 - DNA, 1012 bp, Zea mays
gccgcccctgccggacgcacctgctccattacccgtctgccgtcggcataacataatcgtcgtcgcgtgcagtccccattcccttttccagtggtctgttgctcgcgcttcgtccagcttccccggaagaggtagcacggcaagggcagaggatgagtgaccccaagtacgcctacccctaccccgcgcaaggttactaccaggggccgtaccagggcccgccggtgatggcgccgccacagtacgccgcgccgccgcccagaagggagccgagcttcctggaaggctgcctggccgcgctgtgctgctgctgcttgatcgacgagtgctgctgcgacccgtccatcatcttcgtcagctagactagacgatgaagcgaggaagaacctattggtatatataatatgtatgtatccagttgtactcttagctttattcctgcaaccttcaagctcgagatgatctgtatctcggtcgagttggtgtgtatcaactatcatctgtcatggtattgcttctaatttgctgctgaatcgagaacatattcgccgctgaaaaaaaaaaaaaaacctgctgcgcctgggaagggaaccatttaccttcaccagtcaccactgcggttgagctttttgaaaagaaggcgaggtgactactgggtggatagagaagaggagcacaagcacagaccggatgcttctcaccttcttccacttgcagtcggcagtcgcaagccacaaccgaaagccccgtgtgtcccgtcaccggaatatatgcgaatccggcgccttttcagtcagacacgtgaattcgggaggaaatggctctaggcgcagccggcgggggaggctgtgatcggaggagggccgggccggggatggagacgaccattttcttgcgcatgcgtgtgagtttgagggctgctaggcggctagctatgatctcggcctcgggtgggtctagcccgaagacaactcgtttgactcttggatggatggatggacggaggatggtg

SEQ ID NO: 17783 - DNA, 770 bp, Zea mays
gccggccgggctcgagacacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcgcggccgcccgggccggcccggccgcggcacctgctccttacccgcgtctgccgtcggcataacataatcgtcgtcgcgtgcagtcccccattccctttccagtggtgactggtgagtggtctctctctgtgctcgcgcttcgtccagcttccccggccggaagaggtagcacggcaagggcagaggatgagtgaccccaagtacgcctacccctaccctgcgcaaggttactaccaggggccgtaccagggcccgccggtgatggcgccgccacagtacgccgcgccgccgcccagaagggagccgagcttcctggaaggctgcctggccgcgctgtgctgctgctgcttgatcgacgagtgctgctgcgacccgtccatcatcttcgtcagctagactagacgaggaagaacctattggtatatataatatgtatgtatccagttgtactcttagctttattcctgcaaccttcaagctcgagatgatctgtatctcggtcgagttggtgtgtatgtgtcatctgtatcaactatcatcctgtcattgtattgcttctaatttgctgctgaatcgagaacaaaaaaaacgcccctataaaaaaaaaaaaa

SEQ ID NO: 17784 - DNA, 1953 bp, Zea mays
aatctactctgtctatatattcacaaattaaatctagtctctttgtctcataaattttataaaaaaaactctttgacgcttttttttgtctcgtgtccagctatatatttgtaaaaaagatattcttaaccgtttaatgctttgtttgattacatttagatcaaaaaaaattaagagaaattaaatccttttctatttaattttgactagggagagatttaatcttctctaacaagccttaagccttaattattggatgaactcagatcaaatttatacatatgcttacggttgagtcatctggcctgtttgtttcaaattttggccagattctagccattggaaacagtttttgatcatcaaaagttttgcttgtgtaaaaattgtctaaatcaaaatgaatgtaaaatccatcgtgacaagaaaaaatcatcactttctaaaatctaaaccaagtagactttctcatcctcatcacttaagcccatcaatatttagataatcgtgataaattaggtttgttcgaaatgtctaaaactaatagttagtagctgaaattatctgaggggtttagaacctgttagctaatgaactaattaattgttagctatccgttgttagctggttcaacattgctaaaattagctaataacttattaactggataataattagcgcaataggtttgaacaggttcttagataatccattctcacaaaagctgttctgacagccctacataggatatgttcgcctttccaaaggaaaaacagagatagaatcctacctctctagcatggcgaccggcgacgaggcggagacggcggtgcgggcgtctgaggagttgcgggactggtccgacatgacgccagtgtgtcttgccgaagcgttctcgcggctggcgctggaggacctgtggcgcggcgccatgccgtgctgtcgctcctggcgggacgccgcgcgctcgcgcccgggactcttcgcggtgcttgacctcgagcccgggtttgctgagtccacacctggcgccgaggcggcagcgtggtggacgccctccttccagcgccgtgtcgacgccatggtgcgctccgccgccacgttcgccgtgggggagctgtgtgagatccatgtccgccactgttccgacgacgcgctcgccttcgccgccgagaggtctccaagacttagtatcctttcggtcaaaactagcccggcagtaaccgatcgatcaatgcttattgtcggagcatgctgccccatgctcacagaactggacatcagcaactgctacgagatttcatacaagtcactccaggtgatcgtctacatgactttgtaggagaatcagattatctgaaatgatgcgtatgcaattggatgcacctccctaagcaaaatttctggttaagttgtttaaattgcagaggcaattctatgtgtgcatctttctgcttgaggtttcgaaattttatcttttcatacaaagtagcgaattccctagagaacccaaaattccaagttctggtcctcgttcatgtgatggtaatggcttgctgcatactctcatttcatgactttttaggcagtggcttgctaggactaatgaattgacagacatgtttatggtaatttgaactgagctaaagcaaagagggatatctttgaaatggaacacttcaaagatggtgagtttatggctggattttattctctaaggatggtgctactaatgtttgtatgttattctgaacatattataaacgataaacgagcactgaagattctagtattattcctcccgtgcagaaagggggtcatcttgtccaaaatctaaaaatccaaaccattttgggtgttgagttgctatcatttcaaggaactcaattgttgggttttgttttggctctttttttttaaaaataaaggaacttaaacaagaacaaacaggcataa

SEQ ID NO: 17785 - DNA, 1514 bp, Zea mays
cattgggtacctcgaggccggccgccattctcacaaaagctgttctgacagccctacataggatatgttcgcctttccaaaggaaaaacagagatagaatcctacctctctagcatggcgaccggcgacgaggcggagacggcggtgcgggcgtctgaggagttgcgggactggtccgacatgacgccagtgtgtcttgccgaagcgttctcgcggctggcgctggaggacctgtggcgcggcgccatgccgtgctgtcgctcctggcgggacgccgcgcgctcgcgcccgggactcttcgcggtgcttgacctcgagcccgggtttgctgagtccacacctggcgccgaggcggcagcgtggtggacgccctccttccagcgccgtgtcgacgccatggtgcgctccgccgccacgttcgccgtgggggagctgtgtgagatccatgtccgccactgttccgacgacgcgctcgccttcgccgccgagagatctccaagacttagtatcctttcggtcaaaactagcccggcagtaacagatcgatcaatgcttattgtcggagcatgctgccccatgctcacagaactggacatcagcaactgctacgagatttcatacaagtcactcgaggtgatcggccaaaactgccagaacctcagggtcctcaagcgcaacgtcttcaactggatcgacccatcggagcatgccggagtagttcccgaggactatctgagagaatgccccgaagacggcaacagggaagccattacgatatccaggttcatgccgaagctgagacacctcgagctgaggttctcgaagctgaccgccgtcgccctcggctccatccctgaaggatgcaaggacctggaggtcctggacctgttcggctgcgcgaaccttacgagccggggaatagaccaggccgctgctagtctgaagaatctggtgacgctggtgaagcccaacttctacatacctcgctcctccttccacatggggaggtacggccactggcagctctacgacgagaggttccagaccaatgtgtttcagatatgatcatagtctcagctcaggtactcaggtcctccctgtgacctatggtttatattctgtgtatgtgggtgcatatagtagccaataatgtgtggtttgaatcgtttctctcgacaacattttgtacagatggttatgctccagctgtttgtggagtgtggttggttttaatataaatgacttattgcctgcaaaaaaaaaaaaaaaaaatcggactctactttggttccaagaacgtgacataacatggttggcttattcgatcctgattgcaaggcatctttggtgcctggccctgggtgtcgtcttcctggccccatgttgcacttgcgcccgaccgtgaccgctcgctcgatggcgttaccagaatgccagccatgttcgtgtcatccgcaccgaaatccgatgcgttgtcgacttgtcgcgcatcactcttcgggcaggggtaccga

SEQ ID NO: 17786 - DNA, 3194 bp, Zea mays
cattgggtacctcgaggccggccggcgggtgggggtctttcgcaacgcaagtagtgctggagattggagagtggagacagaaggcaagggggccgtcgcagaattcgcgccaccgcccgcgatggcttcgtcctcgaaggcctccgattcctcccaacgatccaagcggtcggatcaggggatgggcaaggacgccgctgccgcctctgttgtcccgatccacgcgaacctgacgcagctgatacggcaagtccaatcggggcgcctcgcgtacatcaaggagaaattggaggtgaacaggaaaacgctgcagaggcactcctgctcgctgttcgacgtggcagcggcggcggaggtggcgtcgaggggcaccgatggcggcaacgcgctgtcacagcgcgcggcggagagacagtgtgggtcagacctggcaaacgggataggggagagggacgtggtttccgttcaggaggagaacctggctaccggtacgctcgcgctctccagctcgggcgctaccgcgcagcggacaattgtgcggttcgtgaagctgccgctggttgagaagatccctccgtacaccacttggatcttcctggacaaaaaccaaagaatggctgacgatcagtcagttgttggtaggagaaggatatactatgatacagttggaaacgaggctctgatctgcagtgacagtgatgaagaaattccagaaccagaggaagagaaacactttttcacaaagggagaagatcatttgatatggagagctactcaagaccatgggttaaaccaagaggttgttaatgtcctttgccagtttattggtgcaaccccatcagaaattgaggaaagatctgaagtcctatttgagaaaaatgagaagcactcaggatcttcagataagatagagagccgactttctcttgacaaaactatggatgccgttctggattcttttgataatctcttctgccgcagatgcttggtttttgattgccgccttcatggttgttcacagaatttggtatttccatgtgagaagcaaccctacagctttgaccctgatgaaaacaagaagccatgtggtcatttgtgctaccttcgatggagagaaggatttaaagagatgcatgatgatggtcttgctggtggtgcaacatatactatggaatcgggaactgcctcacagagagttgatgttaatgttatgtatgaatcagaagattcaaaccgacagaaaggcaacattaggtccatgacactagttggaaccagtggatcaaaaataatttcttctgtcagtgcggaagaaagcactactactccttcagcagatatctctgaaacagagaatgtatcctctgatttgcctcccagtagtttaaggaaacacaagatttcaaaacatggacctaggtacagggagcattctcctggcaaaaggcagaaggttttcacttctgacatttcttttgaaggcaatataatgaataaactttccattccggagattcgtgacacaagactagagtccagagaatctggtggtgataaactacgaattcttgacgagtccactaagaagacttcaaggaaagatatgtgtggggaaagcccagctactaccatggaaaatgtgggaagacagagtaataaagtgtattcaacaaagaatttcttggagtccactctttcttgttggagtgccttagagcgagatctatacttgaagggcatagagatatttggaaagaacagctgtctcatcgccagaaacttactatctggtcttaagacctgcatagaagtggcaaactacatgtataacaatggtgcagcgatggcgaagagacctctcttgaataaatccatctcaggcgactttgcagaaaatgaacaagactacatggagcaagacatggctgccagaacaagaatctatcgtcggaggggccgcaatcgaaagctgaaatatacttggaaatctgcagggcatccaactgttagaaaaagaactgatgacgggaagcaatgttacacacaatatagcccatgtgcgtgccagcaaatgtgtggtaaagattgcccctgtgcggacaagggaacttgctgtgagaagtactgtgggtgttcgaagagctgcaaaaacaagtttagaggctgtcattgtgcaaaaagccaatgcagaagcagacagtgcccctgttttgcagccagtcgtgaatgtgatccagatgtttgtaggaattgctgggtgagctgtggagatggttcactaggtgagccacttgcaagaggtgatggttatcagtgtggaaatatgaagctccttttgaaacaacagcaaaggattttgttaggaagatctgatgttgcaggttggggtgcattcattaagaatcctgtaaataaaaatgattatcttggagaatatactggtgaattgatctctcacaaggaagcagacaaacgcggcaaaatttatgaccgggcaaactcatcttttctgttcgatttaaatgaccagtatgtgttggatgcttatcgcaagggggacaaattgaagttcgcaaatcactcatctaaccccaactgctatgcaaaggtgatgctggtggctggcgaccatcgggttggtatatatgcgaaggagcatattgaggctagcgaggaactcttttatgattatcgttatggacctgaccaggctccagcttgggctaggagacccgaaggatcaaagaaggacgaggcatccgtctctcaccgtcgagcacacaaagtggctcgatagctgaagagtcgctccggatgatacaatatgcagtaaacttaatacttaatacatgattcagtcctagttcattggtagataaacatgctatatactatccattagtaaataaactctcattcatcgagttggagaataaatgcgtataaacatatgtggacctcaggtcgggaaggtggcaaccttgttagtttgagcaccaacaggttctcaaacttgagtggctattgctagagtatcaaataatggctgcgactatagccttgtttgtatattttcttggtgagatgaaataatttgtcaaacactcaaatgtacactttattcctgaaagtatttgatgattcattagtagtgttaaaaaaaaaaaaaaaaaaagaaaaaaaaaaaaaaaaaa

SEQ ID NO: 17787 - DNA, 3366 bp, Zea mays
gagacggaagccaagcctccaagggggccgtcgcagaactcgcgccaccgcccgccatggcttcgtcatctaaggcctccgactcctcctcccaacgatccaagcggtcggatcaagggacgggcagggaagccgctcccgcctctgttgtcccgatccacgggaacctgacgcagttgatacgccaaatcaaatcgaggcgcctcttgtacatcaaggagaaattggaggcgaacaggaagacgctgcagaggcactcctgcgcgctgttcgacgtggcagcggcggcggaggtggcgtcgaggggcagcgatggcggcaacgctttgtcgcagcgagcggcggagggacagttcaggctcgctgggtcagacctggcacacgggataggggagagggacgtggtgtacatgcaggaggagaacctggcgtccgggacgctcgtgctctccagctcgggcgctgccgcgcagcggacagtcgtgcggttcgtgaagctgccgttggttgagaggatccctccgtacaccacttggatcttcctggacaaaaatcaaagaatggctgatgatcagtcagttgttggtaggagaagaatttactatgatccagtcggaaacgaggctctgatctgcagtgacagcgatgaagaaattccagaaccagaggaagagaaacactttttcacagagggagaagatcaattgatatggagagctactcaagagcatgggttaaaccgagaggttgttaatgtcctctgccagtttattgattcaactccatcagaaattgaggaaagatctgaagtcctatttgagaaaaatgagaaaaactctggatcttcagataagatagagaggcaactttctcttgacaaaactatggatgccgttctggattcttttgataatctcttctgccgcagatgcttggtttttgattgtcgcctccatggttgctcacagaatttggtattcccaactgagaagcaaccctacagctttgagcctgatgaaaacaagaagccatgtggtcgtcagtgctaccttcgatggagaggaggatttcaagagattcatgatgttggtcttagtggctgtgcaacatataatatggaatcaggaactgtctcacacaaagttgatgttagtattatgtctgaatcagaagattcaaaccgagagaaaggcaacattaggtccatgacactagttggaaccagtggatcaaaaataatttcttctgttagtgctgaagaaagcactactccgccttcagcagatacctctgaaacagagaatgcatcctctgatatgcctcccagtagtttaaggaaatacaagatttcaaaacgtggacctaggtacagggagcgttctcctggcaaaaggcagaaggtttttacttctgacatttcttttgcaagcaatatactgaataaactttcgattccggagattcgcgacacaagactagagtctagagaacctggaggtgataaactacaaattcttgacgagtccactaagaaaacttcaagcaaagatatctgtggagaaagcccaattactactactgaaaatgtgggaagagagagtaaaaaagtatcttcaacaaagaatttcttggagcacactctttcatgttggagtgccttagagcgagatctatacttgaagggcatagagatatttggaaagaacagctgtctcattgccagaaacttactatctggtatgaagacctgcatggaagtggccaactacatgtataacaatggtgcagcaatggcgaagagacctctcttgaataaatccatctcaggcgactttgcagaaactgaacaagactacatggagcaagacatggttgccagaacaagaatctatcgtcggaggggccgcaatcgaaagctgaaatatacttggaagtctgcagggcatccaactgttagaaaaagaattggtgatgggaagcaatggtacacacaatataacccatgcgtgtgccagcaaatgtgtggtaaagattgcccctgtgtggaaaatggaacttgctgcgaaaagtactgtgggtgttcgaagagctgcaaaaacaagtttagaggctgtcattgtgcaaaaagtcaatgcagaagcagacagtgcccctgttttgcagccagtcgtgaatgtgatccagatgtttgtaggaattgttgggtgagctgtggagatggttcactaggtgagccacctgccagaggtgatggttatcagtgtggaaatatgaagctccttttgaaacaacaacaaaggattttgttaggaagatctgatgttgcaggttggggtgcattcatcaagaatcctgtaaataaaaatgattatcttggagaatatactggtgaattgatctctcacaaggaagcagacaaacgtggcaaaatttatgaccgggcaaactcatcatttctgtttgatttaaatgaccagtatgtgttggatgcttatcgcaagggggacaaattaaagtttgcaaatcactcatctaaccccaactgctatgcaaaggtgatgctggtggctggcgaccatcgggttggtatctatgcgaaggagcatattgaggctagtgaggaactcttctatgattatcgttatgggcctgaccaggctccagcttgggctaggagacccgaagggtcaaagaaggacgaagcatccgtctctcaccatcgagcacacaaagttgctcgatagctgaagagcagctccggatgatacaatatgcagtaaattatatatttaatacatgatttagtcctagttcattatacgaggacttcgttggtagataagcatattgtatattcattagtgaataaactcccatacatcaagttggggaataagtgcatataaatattttttaccttaggtcggaaggtgacaaactgacaaccttgttaggttgagtaaagttagtgcttacaggttttcaaactggtgtggccattgctagagtatcaaatagctgagatggctacaactatagccttgtttgtatttttttttggcaagagggatggaatttatttgccaaatgtacacattgttgctggaagtatttaatgattcaggtggtcttcttcagtcaccctcctaaattttagaaattaaactttagtctctaaaatttctgtttaggaggtctcatttagtcatacagtgtggtaatttagaaactaaaagtgactaaattttagtcaaccaaagtttaggaggtgtaaaccaaacacccctcagtacgagtgtttctagaacctaaaactagggtatttgcatgtcacattattggctgtagagagggtgcagactgcag

SEQ ID NO: 17788 - DNA, 1198 bp, Zea mays
atccgactccgtctccagcaaccccattcggctcctccctccgtctccagcagttctccatccaaacaaaccgcgtgatccgtctgaccgctcgctcgctctcgccgggggtccggagctccccacctccagcgacccagtccatccgcgcgtgcagcgccgcggcgccgatggagtacgacttccgcggcggccgctcgagctcgggcccgggcccctacggcgcgcctccggggggcgcgcccgggcggaggctcctcgctctacccgcgcgtcgggcagccctcccacggcgggggcggggcctccacggcgtctccgcgggccgcgccgtaccaccacggctccgggtccggatccggctccgggtcctcggctcccgtcgtaacgccgttggctccaacctccttctcctcgtcctcgtcctcgtcctcgaaagtgggcatacaagttgcgataaagcctgaattccgcattaccccacctcctcaattgccaccagagatggtagagattcctcgcagcaccttcaactttgattttgagtatgagagaatgattcttgctgaggcagagaaggagaaccccaactggactaaatttgtggtagaaagacaggctgcacctcttgtgccacagcaggctagaccagcatcgtcagggtcaggggatccagttgttgacaagtatgtctcaatggggcttgggcgtcaagccgtctcatttgcggtgttgaattatggagataatccaacaaaggtgaaagagttcgtgaaatcctacagcatcctccacgagatgggcttcacatcgccaaacgtccccgagctgctagccatccacgacaacgatcccgacaaagtcatccagcgactgctatcctcgccatcctgatcctagaagaacaagacgcctcgcatttgtgtgccgcatccatgtacagccctgcccctacgctggcaaccatcacagatgatgtatacgcgttgcctgccgttagttctgtgaaccgagtaacacgctttgtatgttgtacttgtataccgtcacccgtttggtgtttttccttcaaaaatgttttcgcatctttttattcacgtttgaattttttgtgagcctatacagtacaacatgattgggttagtgatgattctcgtcgccaaaaaaaaaaaaaaaaaaaaaaaaaaaaaaaaaaaaa

SEQ ID NO: 17789 - DNA, 2394 bp, Zea mays
cttatttattatcaattctaatgaaaggtctggggaggggccatagaaggggggggggagatagagctattgcaatgcgacaaaagtggcgtctttgtgaaattgggcttgaggattattcgcttgtattgttaagtagatacatcaatgctcttgaagctttaggtggatcagcttcacttgcagagggtcttcctacaaatacaagtctatgggatgatgcccttgatgcccttatcattggcataaatcaagtttgcttttcaggttggaaaccaaatgagtgttctgcaatagtgaatgagcttctttcttggaagcagaaaggtctatctgaatttgaaggcaatgaggatggaaagtatatttgggcactgagactcaaagccactcttgatagaacaggaagactaacagaagaatactctgaagcacttctttcaatattccctgaaaaagtcaaggttcttgggaaagcccttggaatacccgagaacagtgtcagaacatacactgaggccgggattcgtgctagtgttatttttcaggtctcgaaactttgcactgtacttttaaaagcaactcgagcagttcttgggtcgtctgtgtgggatgttcttgttcctggagtggcccatggagccttgatacaggttgaaagaatagctcctggatcattgccgtcatccatgaaagaacctgtcgtgctagttgtaaacaaggcagatggagatgaagaggtcaaagctgctggggataacatagtgggcgttgttcttctacaagaattacctcacctatcacatcttggtgttagagctcgtcaagagaaagttgtatttgtaacttgtgaagacgatgacacgattaaaaacatgaggttacttgagggaaaacatgtcaggttgggtgcatcatccaataatgttgatctttcagttgtatcaaacaaagatgactgtgctgccatgtcttcagagccatccgctggaggagatctatttgcacagcaattctcactattgactacagacaagaagttagaattgtctgagcaaaagagctatacttccgtagcaaatggtatgtctggtgtgctcgagctttcagaggcatcgattgaatcatctggtgcaaaagctgctgcatgtggaactctttcggttctttcctcaatgtcaaataaagtttacaatgaccaaggaactccagcagcattcagagttcctgcaggtgctgtgattccttttggatccatggaggacgccttgaagaaaagtggatcaatcaaatcctacactaatcttctagagaggatcgaaacagctcaaattgaaaatggtgaacttgatagcctatcctcgaagcttcaagcaactgtttcacttctttctccatcggaagaaatcattgaatctttgaagaaaacatttgatcagaatgttcgactaattgtgagatctactgctaatgtggaggatttggctggaatgtctgctgctggactctatgaatcaattcctaatgtcagtctctctgaccctagatcctttggagctgcggttggacaggtttgggcatcattatacacaaggagagcaatccttagccgtcgagcagccggtgtacctcagagagacgcaaagatggcggttctcgtgcaggaaatgctgcagccagatctctcttttgtgcttcatacaattagcccagttgaccatgatcccaaattagtagaggctgaggttgcccctggtcttggagaaaccctcgcttctggtacccgtggcactccatggagactctcatgtcacaagcttgatggcaaagtcacaactctagcttttgcgaatttcagtgaagagcttatggtgctcaactctggccctaccgatggtgaaatgagtcgtaggaccgtagactacagcaagaagccgttatctgttgatgcaacctttagggagcagtttggtcagcgccttgccgccattggacagtatctggaacagaagtttggaagtgcccaagatgtggaaggttgcctggttggccccgatatatttatagttcagagcaggccacaaccacaataaacaaaaagttttgtgtggttacctggctagctgaataaaaatggatactggctgaagaaatatatggacttcgtagcacgcgtaggagtgatcgagtcttttttaatatgctatctcaggtaaaataataatttattggcacaggtttagccattcactaacttgtatcaattttgtgaactaaagaacttactattacatgtgggagccacatgccattctatttcgatggtacctattttttcgactgtttgaaaatctatatgacgtataggcctgtttgttttagcttcttggccgc

SEQ ID NO: 17790 - DNA, 2100 bp, Zea mays
cagacggcccagcccacggtatggtctagctttgtggccccccggagcagcggcatttccatcccaccccggtcggctagtcccaaggctgctgccgccgcctgccgctaggggatcgcttgctttcctcggaccactctgccgaccacatctacaccgcatcaacggtccttccaagtgagctccaatcccctgtctgtagatggagagggtgctcaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgttactgttacaaatgatggggctaccattttgaagtcacttcacattgacaatcctgctgcaaaggtccttgttgacatctcaaaagttcaagatgatgaagttggtgatgggacaacttctgttgttgttctagctggagaacttttgaaggaggctgagaagttaattaacatgaaaattcatccgatgactattattgcaggttacagaatggctctcgagtgtgccagagattctttgctaaaaaagaccatggacaacaaagaaaatacagataaattcagatctgatctcatgaatattgctatgactactcttagttcaaaaatactttcccaagacaaggagtacttcgctgaacttgcggttgatgctgtcttgaggcttaagggtagcaccaacttggaatctattcaaattctgaagaaacctggaggatctcttaaggattcctttttggacgaagggttcattcttgacaagaaaattggcattgggcagcccaagcgcattgagaatgccaaaattttggttgcaaacactgctatggacacagataaagttaagatatatggagcacgggtccgggtggattcaatgtctaaggttgcagatattgaagctgctgagaagcagaaaatgagagagaaagtccaaaagatcatagcacacgggatcaactgttttgtcaacaggcagttaatctataacttccctgaggaactctttgctgacgctggcatacttgcaattgagcatgctgactttgagggcattgaacggctggctcttgttactggtggtgagatcgcatcaacttttgataatccagagtctgttaagcttggtcactgcaaggtcattgaagagattatgattggggaggacaggctaatccatttctctggggttgcgatggggcaggcttgcaccattgtcctaaggggggctagtgagcatgtgctcgatgaggctgagaggtccttgcatgatgccttgtgcgtgttgtcccagacggtaaatgatacccgtgtcttgtttggaggcggatggcctgagatggtgatggccaaagaagtggatgaacttgcaaggaagacccctgggaagaaatcccatgctatcgatgctttctcacatgctctgcaagccatcccaacaatcatagctgacaatgctggtttggatagcgctgatttgatctctcagctacgagctgagcaccacaaagagaactccactgctggaattgatgtcatcacaggcactgttggggacatgcaaaagctagggattcaagagtcgttcaaggtgaagcaggccattcttctgtctgcaacagaggctgcggagatgatcctcagggtcgatgagatcataacctgtgccccgcgcagaagagaggataggatgtgatattacacgctgtttctcgatgtagcgggatgctcattaccctagttttgaggggtattatggtttaggggcgctcaagttggtcagatttcgagtgtttttggcccctaagcaactggtacttgttatttggttgaaacaatcagccttaggtttgtgttctattttctcatgctgtaccgtttggtagcaagttacgtcgtacgatatgcttgttccatcatgtttttctattccttttaacgtaagaatgggcttgtctttgtttcaaaaaaaaaaaaaaaaaaaaaaaaaaaaaaaaaaaaaaaaaaaaaaaaaaa

SEQ ID NO: 17791 - DNA, 2059 bp, Zea mays
attctcagtagcagcggcatctccatccagaccccggtcggctagccccaacgccgccgccgccgccgccgcccgccgctcggggattgcctgctttcctctgccgaccacatctacaccgcacaactggtccttccaagtgagcttcaatcccctgcgtgtagatggagagggttctcaaggatgacgccgtcgaggagaagggcgaccgcgccagaatggcatcgtttgttggggccatggcaatctcggatttggcgaagaccacattgggtccaaaaggaatggacaagatcctgcaatcaactggtagagggcgtaatgttactgttacaaatgatggggctaccattttgaagtcacttcacattgacaatcctgctgcaaaggtccttgttgacatctcaaaagttcaagatgatgaagttggtgatgggacaacttctgttgttgttctagctggagaacttttgaaggaggctgagaagttaattaacatgaaaattcatccgatgactattattgcaggttacagaatggctctcgagtgtgccagaaatgctttgctacaaaataccatggacaacaaagaaaatacagataagttcagagctgatctcatgaatattgctatgactactcttagttcaaaaatactttcccaagacaaggagtactttgctgaacttgcggttgatgctgtcttgaggcttaagggtagcaccaacttggaatctattcaaattctgaagaaacctggaggatctctcaaggattcatttttggacgaaggattcattcttgacaagaaaattggcatcgggcagccaaagcggattgagaatgccaaaattttggttgcaaacactgctatggacacagataaagttaagatatatggagcacaggtccgggtggattcaatgtctaaggttgcagacattgaagctgctgagaagcagaaaatgagagagaaagtccaaaagatcatagctcacggaatcaactgtttcatcaacaggcagttaatctataacttccctgaggaactctttgctgacgctggcatacttgcaattgagcatgctgactttgagggcattgaacgtctggctcttgttactggtggtgagatcgcatcaacttttgataatccagattctgttaagcttggtcactgcaaggtaattgaagagatcatgattggggaggacaggttaattcatttctctggggtcgcgatggggcaggcttgcaccattgtcttaaggggggctagtgagcatgtgcttgatgaggcagagaggtccttgcatgatgccttgtgtgtgctgccccagacagtaaatgatacccgtgtcttgtttggaggcggttggcctgagatgctgatggctaaagaagtggatgaacttgcaaggaagacccctgggaagagatctcatgctatcgatgctttctcccacgctctgcaagccatcccaacaatcatagctgacaatgctggtttggacagcgctgagttgatctctcagctccgagctgagcaccacaaagagaactgcactgctggaatcgatgtcatcactggcaccgttggggacatgcaaaggctggggattcaagagtcgttcaaggtgaagcaggccatactcctgtctgcgacggaggccgcggagatgatcctcagggtcgatgagatcataagctgtgccccacgcagaagagaggataggatgtgattagacacgctgtttctcggtgtagtggggatgcttgttaccctagttttgatggtggttctggggcgttcaagttggtcacatttcaagtgtttttggctcctaagaacctagtaattgttatttcgttgaaacaaccaaccgtaggcttttttttttctagattctcatgatgtaccatttggtagcgaagttcttcctctgttcttttttatgtgtcgagttttagtttaaaactagacaacaaatattcgataatggaggtagtacattgtttacgataaaaaaaaaaaaaaaaaaaaagcgccggggggccc

SEQ ID NO: 17792 - DNA, 2081 bp, Zea mays
  misc_feature (3)..(3): n is a, c, g, or t
cgngggggggggggtgggggggggggggcggggggggccgggggcgtgtggggtgtgggggtcgtggggggtgggggggggggggcggggggcggggggggcggggcgggggtgtgtggtcgggccggtggggcggggggtgccgtgggtgtttggcgggccgtcggcccgcgcctgcgcgccgtcgggcccgtttttttgcgggccgctcgtgttgtgggttggggtttgtgtcgctcttgcttcactagcccccccccccccccccccttcttctccgtcagataacaaaaaacaaatcaagcaaatttatttatcttggtcaagagacattgattctcttaaatttctgcaaaattaagctcagagattcacaccgcatctgaaattgtgctcagaggggttccaaatattaccagtcgttaggaagcaatcacgagttgttttaggaattagtgaacgtgataatggctagcaatgagatggaaaaatcgagtaaagagaaggaacctaaaacacctcctccttcttctactgcccctccctcttcacaggaaccttcatcggctgtgagtgctggcatggctactccagattggtctggttttcaggcatattctcctatgccgccgcctcatggttatgtggcatctagtccccaacctcacccttatatgtggggagttcagcatatgatgcctccttatggaactccgcctcatccttatgttgcaatgtatcccccaggtggcatgtacgcacatccttcaatgcctccgggttcttatccctatagcccttatgctatgccttctccaaatggaatgactgaagtttctggcaatactacaggcggcactgatggtgatgctaaacaatctgaagtgaaggaaaaattgcccatcaaaagatcaagaggaagcttaggaagtttgaacatgattacaggaaagaacaatgaacctgggaaaaactcaggagcatcagctaatggagcttactccaaaagtggggagagtgcttctgatggttcaagtgaaggaagtgatgggaactctcaaaatgattcgggatctggactagatggaaaggatgctgaagcagcatcagagaatggtggttctgccaatggtccgcaaaatggaagtgctggtacacctattctaccggtgagccagaccgtaccaatcatgccaatgacagctgcaggtgttcctggcccaccaacaaatttaaatattgggatggattactggggtgctccaacttcagctggtatccctggaatgcatgggaaagtatctacaccagttcctggagttgttgctccaggctcgcgagatggtggccattcacaaccctggttacaggacgatagagaacttaagcgacagagacggaagcagtccaatagggagtctgctcgaagatcaaggttgcgtaaacaggccgaatgtgatgagctggcccaacgcgctgaggtgttgaacgaagaaaacacaaatctcagagcagaaatcaacaagctcaaaagccaatgcgaagagcttaccaccgagaacacctctctcaaggaccaactttcattattccctccacttgaaggcataagcatggacaatgaccaccaagaaccagacaccaatcaaacaggtgccgcagagagaaaggttgattcatacaaagactcaacgtgagaagacatagagcaaaaccaattcctaacacaggtataaaaaagtagcagcagcagcaacaacaacactcggcggttctttgctaacagatggtttgtaggattttaggcatcagagatcgattggttccgaatagtttattgagggttgttggtccagtgtatgtgtgtgtaagttacgaaattagatattgggagaaaaaattccctcgtttaatgttttactttgcctttgctctacttgcagaagcgaatctgaggcaatgtgcttatctgtatcaaaattgttaccctttttattagattttcctatttattttttcttcgaaaaaaaaaaaaaaaaaaactcgagggggggcccggtacccaatttcgccctataggg

SEQ ID NO: 17793 - DNA, 1095 bp, Zea mays
  misc_feature (1095)..(1095): n is a, c, g, or t
aactcctttcccccctccagttccaactttattgtgtttaaacagcgaattgggtaccgggccccccctcgagttttttttttttttttttttggcgcaaatatcatatgaaaaatggttaaattatcctcacaagtttattgctgtaagagagacagacaacatagctaaagtttttaaaatggataaattatccgcaaaaggagactcatgttcatttgctatagcagcagtaacctgaagagataaaagagagtttgatccttgcttcaacgggttttcttcttcgtctttgtctcgacgttgttgttggcaatggcagcagctgcacaaatctttttccagcaacggaaagaaatgagtgaaggtatcaagacccaccaacagttagccccgatgtagcaggagtaatagtagaaagagtttgtggcaaagttgtctccttccaagatagcagtaatgaaataaaccaaacatccgtagagctggcaaaccgaaatcgcaagctgaagcacgtagctatacgacttctccttagcaatggcataaatagctaggagagaagctgggccaacgataacagcagtgatcccttcaacagatacaactgcagaatctctacctacgtatctcgaatcacctttgctatattctttccaaacttcagcaagataagcagaagtgttgtccttgaaaaactcaggggagaaaacgaaatagccctcgagaataacatgagtgagaccagtgaatgtccaccaacacataagcaacttatcaagtttagctttcttcctcccgaagagaagccagacgagggagacaacaaggagggaagaaccgaggtagatagagacgatggaggacattgacattgagattggtacgtatccgggtaggttcagatctctcggaacgtacggatgcgccaactcctccatgtttttctcctttctctgtgggggggggggggggggggaactagtgaagctctcctctcccccgtgccgatttccttgcggcccgggggaacccctatgttctagaagcgccggccaccgccgtgggagctccacgcttttgttcccctttaan

SEQ ID NO: 17794 - DNA, 1126 bp, Zea mays
gcacgagcagccatgtgcagtgctgcgagtggagactagagagaaaacagaagagaggagagggccggccgcggcctggccgaacggaaccggaggtagggtaggcgggccccacccccacaagctctacgctctacgctctgctctgctcttctctcctccggccgcttgggtctctttcctcccgccgggatccagatccggacccgaccgccgatccatccaaatcacccttccccttccccttctcttccaccaccaccaccaccaggccgccgcctcgtcgtcctcaattctcctttcgaatttagaatccccgtgctgagagttgagtgccgccttggttgctccgtactggactcgattcctcatcgcagcagaagcatcccgtcccctccgcttctccttgctctgctctgctaacaaacagacaaaaaaatagcatcatgtcggaggtgaaggactccaatgtgcctgctgcacttgatggaaatcctcaacctatggaccaaactgaagacaattctatgccctcagcacagcaacaggaagaagcaatcaagaagaagtttggaggactaatgcccaaaaagcccccactcatctcaaaggatcatgagcgggcctactttgattctgctgactgggctctagggaagcaaggtgttgccaaaccaaaaggaccgctggaggcacttaggcccaagcttcagccaacacgccaacaacagcaacaacgtgcaaggcgccctatttacacttcgtcagaaaacgaggacggagacggggctggtgctgaggatatgaacatcaattgaagtggactagtggagtggaatgcctgctcagattggttgatgagcaagtcgtcactatatgtcaagtgttgtagtttgctttgcaattattggaggaattaaatgatcgtctgctgggttcatgagtcgaacatttgatatatatggcctattatttactaatatatatttttattatctgtgaaaaaaaaaaaaaaaaaaaaaaaaaaaaaaaaaaaaaaaaaaaaaattggtcaggttgccgtgctcagtggattttacaatccagaacacgaacaagatggcttacatcaaaaaaaaaaaaaaaa

SEQ ID NO: 17795 - DNA, 785 bp, Zea mays
ggaacggaggtagggtaggcgggccccacccccacaagctctacgctctacgctctgctctgctcttctctactcctgcgtaacacacagacaaaaaaaaaatagcatcatgtcggaggtgaaggactccaatgtgcctgctgcacttgatggaaatcctcaacctatggaccaaactgaagacaattctatgccctcagcacagcaacaggaagaagcaatcaagaagaagtttggaggactaatgcccaaaaagcccccactcatctcaaaggttccttgctccaattccctgttcaccaaatcaaatcagccctaagggtgggaagtgctgtctgtcaccagtgttaaaattctcttctgtaactgtaggatcatgagcgggcctactttgattctgctgactgggctctagggaagcaaggtgttgccaaaccaaaaggaccgctggaggcacttaggcccaagcttcagccaacacgccaacaacagcaacaacgtgcaaggcgccctatttacacttcgtcagaaaacgaggacggagacggggctggtgctgaggatatgaacatcaattgaagtggaatagtggagtggaatgcctgctcagattggttgatgagcaagtcgtcactatatgtcaagtgttgtagtttgctttgcaattattggaggaattaaatgatcgtctgctgggttcatgagtcgaacatttgatatatatggcctattatttactaatatatatttttattatctgtggataaaaaaaaaaaaaaaaaaaa

SEQ ID NO: 17796 - DNA, 1106 bp, Zea mays
ctgccagccatgtgcagtgctgcgagtggagactagagagaaaacagaagagaggagagggccggccgcggcctggccgaacggaaccggaggtagggtaggcgggccccacccccacaagctctacgctctacgctctgctctgctcttctctactcctgcgtgcgtggtctctttcctcccctcttcatccagatccggacccgaccgccgatccatccaaatcacccttccccttccaccaccaccaggccgccgcctcgtgtcctcaattctcctttcgaatttagaatccccgtgctgagagctgagtgctgccttggttgctccgtactggactcgattcctcatcgcagcagaagcatcccgtcccctccgcttctccttgctctgctctggtaacacacagacaaaaaaaaaatagcatcatgtcggaggtgaaggactccaatgtgcctgctgcacttgatggaaatcctcaacctatggaccaaactgaagacaattctatgccctcagcacagcaacaggaagaagcaatcaagaagaagtttggaggactaatgcccaaaaagcccccactcatctcaaaggatcatgagcgggcctactttgattctgctgactgggctctagggaagcaaggtgttgccaaacccaaaggaccgctggaggcacttaggcccaagcttcagccaacacgccaacaacagcaacaacgtgcaaggcgccctatttacacttcgtcagaaaacgaggacggagacggggctggtgctgaggatatgaacatcaattgaagtggagtggaatgcctgcctgaattggttgatgagcaagtcgtcactatatgtcaagtgctgtagtttgctttgcaattattggaggaattaaatgatcgtctgctgggttcatgagtcgaacatttgatatatatggcctattatttactactatatatttttattatctgtggggataaacatttgatatgcaagaaaaagccgagctgcccccgggcctgtgagtgaccgcttggtcaggttgccgtgctcagtggattctcaatccagaatacgacaagatggcttacatcatacaccagc

SEQ ID NO: 17797 - DNA, 906 bp, Zea mays
actccatagggcgattgggatcctcgccgccggccgggatccagatccggacccgaccgccgatccatccaaatcacccttccccttccccttctcttccaccaccaccaccaccaggccgccgcctcgtcgtcctcaattctcctttcgaatttagaatccccgtgctgagagttgagtgccgccttggttgctccgtactggactcgattcctcatcgcagcagaagcatcccgtcccctccgcttctccttgctctgctctggtaacacacagacaaaaaaaaaatagcatcatgtcggaggtgaaggactccaatgtgcctgctgcacttgatggaaatcctcaacctacggaccaaactgaagacaattctatgccctcagcacagcaacaggaagaagcaatcaagaagaagtttggaggactaatgcccaaaaagcccccactcatctcaaaggatcatgagcgggcctactttgattctgctgactgggctctagggaagcaaggtgttgccaaacccaaaggaccgctggaggcacttaggcccaagcttcagccaacacgccaacaacagcaacaacgtgcaaggcgccctatttacacttcgtcagaaaacgaggacggagacggtgctggtgctgaggatatgaacatcaattgaagtggagtggaatgcctgcctgaattggttgatgagcaagtcgtcactatatgtcaagtgctgtagtttgctttgcaattattggaggaattaaatgatcgtctgctgggttcatgagtcgaacatttgatatatatgggctattatttactactatatatttttattatctgtggataaccttttgactaaaaaaaaaaaaaaaaaaaaaaaagtcgacgcggccgcgaattcggata

SEQ ID NO: 17798 - DNA, 854 bp, Zea mays
agagggccggccgcccccccgcggaacggaaccggaggtagggtaggcgggccccacccccacacgctctacgctctgctctgctctgctcctgcgtgcgtggtctctttcctcccctcttcatccagatccggacccgaccgccgatccatccaaatcatccttccccttccaccaccaccaggccgccgcctcgtgccctcaattctcctttcgaatttagaatccccgtgctgagagctgagtgccgccttggttgctccgtactggactcgattcctcatcgcagcagaagcatcccgtccctccgcttctccttgctctgctctggtaacacacagacaaaaaaaaaaatagcatcatgtcggaggtgaaggactccaatgtgcctgctgcacttgatggaaatcctcaacctatggaccaaactgaagacaattctatgccctcagcacagcaacaggaagaagcaatcaagaagaagtttggaggactaatgcccaaaaagcccccactcatctcaaaggatcatgagcgggcctactttgattctgctgactgggctctagggaagcaaggtgttgccaaacccaaaggaccgctggaggcacttaggcccaagcttcagccaacacgccaacaacagcaacaacgtgcaaggcgccctatttacacttcgtcagaaaacgaggacggagacggggctggtgctgaggatatgaacatcaattgaagtggagtggaatgcctgcctgaattggctgatgagcaagtcgtccctatatgtcaaggcgctgtagctcttcgcctttgcattaatggcagaaccaaaacgatcgcctgctgggttcctg

SEQ ID NO: 17799 - DNA, 1365 bp, Zea mays
  misc_feature (94)..(95): n is a, c, g, or t
  misc_feature (1186)..(1186): n is a, c, g, or t
  misc_feature (1192)..(1192): n is a, c, g, or t
gttccgggcccccccccgaggttttttttttttttttttccttttttttttttttttttttttttttttttttttttttttttttttttttttnntagtatttagtagttctcggtttattaagattatacaacaaacactggttttacaatttctcacttgaaaaaaaaaaatgaaattgaacactaattgtaatcagattatttaatcacatcaggaggcaaaaaaaaaacacttttcttgaataaacccttcacgtcttatttcttgctccgaccaattctccggcgataacataccggaagctcaaattttccggtaaccattcaaaattcttactcttcttctctttcaaacatttctcagcaattttccttgcatcttctggtaaacattgagatgttgcttccatgagcttagacacatccattgacatgtctttaacataatgttgaaagatctttggcaacaaaatctttgtccctttgtaaacacgaacattacttctgatatactcttgtttcgcttgtcttagatcccggaagattctatccgcggtgtaaactcgaactgtaggatcagtgaatgcccctgaagaaatagcgaaatgagctaaagcctcggggtattccaatgcgtaaatgtgtctaacactgcaagttttcgactttcttgaaggggaaaacagagtttggagtaaaggtgatggtgatgtgtaatgaggtctgattcctaagattgagctttggatgatataagggtttattctatagcctccaatatcataagctgccttcaaaaccgatgtgtttcttgcgcggttgtgagttccataagctaagtaagcatgcatcacaagagcattgtgaatgtttatccaaaacgcgagcttctcttcgcgtttcattctactcgcatcaactttctcaagattttgaaccagtgatccgaagttttgaagcataacagcagcgtaaccgaaactaccatcgtctaaatgtactctacgagcctctatgaccacaacaccacaaggcaaaacattgccttgatcttgaccgtgattcagaaaatgatcctcacttgcgccattcaagctccattcatcttcctaattaaatttggaagagaaaatggttgaggcattggaggaaaccgcagaagccggaaaccaaggggaagaggnacccgntgatcctcctgaaagggtcccatacacaggaagaaaaggaatcgcactgattctttcagaaaagcttataccgggactaatgacggcaggtcatggagcacactattatggagaatgatccttatcactttctccaagaaatggaggaagaaccaaagaagaatacctcctcc

SEQ ID NO: 17800 - DNA, 4869 bp, Zea mays
  misc_feature (500)..(500): n is a, c, g, or t
aaaaaagaccagcccccatcacttgtatatatttttgaaccacgtcgccgctcctaatcagacgtgatctactgattgttttcgtgttgatgaagcgttactcgaaactacatgtgtcgtccgaaaaagaaaaaggatcccaggcgttgccgtcaaaatacaaaaaaaaaaataccggctgctttgttaggctcctctcatcgtctctattaatagtcgctagatcttctataaaaaaaactaacctaaacttatcacttttaacctcacgtataattttcttcatttcaaccaccgtggctttataacgtgaactgagccacacatgtcgttgttttaaataatatgaaacaatcctatattacgcaacttaagttttgtaaaattatatagctagtccgttcggatgtcacttgatgacatccaaataaactagctatctattctttcaaaaaaccgagtgacatattttcgattgactcgaatcataatcccgtgtngtctctcgacaagtcaatttctagagctattaaagccaaacttacctaaaaagacccaacaagtgtcggctaccaaaatattcttaataaccggaaatgattttggaggtgcattggagggtccacgaacccaacagcggcgtgcgtgattgttaatgccgttatggctgaaaataagttagaggccgtttagatctagatgactaaattttagttatatcgttatggatgtttggattctagttagaaatattaaaatcacttgtttggttttatatgactaaactttagtcatttacttttagtctccatgttgccaaataaagagactaaaccagattccccatcttttcttaatatctgcgtttggaaatttagagacaaaaagactaaaaaggaaaggatcattatcctataaaactaaataaaccttaaatataatctaactataaaaataattattcagacacctcctgtatcccttgcccttcctcctccccgcccccagtcaccgccagtcgcatgtgtccaaaagacgcggcagcgacggagcggccagcccgtaccccaggtttctagaaactacaggaataacttcactctgtgtgtgaaagagcctgatgggccccaaaagaaccccggcccccgggttgggacgcggcacgccacccctaggaagatggagggatggatcagcgtcatgccggcgcgcgccaagtatcgtagggcagtacccccacacctcccgacgtgtcccgaagcgctagcccccgccctccacctcgcgctccgcatgcctgacaccttcccaccacgcccccacccttcgccctttttccccatccccacccccaccaggtcgagcgaaccctcactgaccacgggccacccccagatcgtgggcgccaggacttgacggcgttagcttatcggggactccgtcgtctgccttatccacggttagctaaccgcggtcgggcccgggtcaggcgcgcgaccgtccgctttataagcgcgcagcccttgcgcgccccgccctcgtccccaacccacacactgcccaccggtctttctcacacaacacagggatataagctcagtccacgagatctcccgtagaccagtggcgagggaaggaacgaaacagagcccgatcctagcgacaggccagggaagatcgccatgatgatgatgggcgaaggcgtgagcgtgccgccgtggtcccaccacgtccccgtgagcggcgtcgacgccggcgtcggcggcgacgagatgacgccgtacctgctggcggcgctgcggcagtacctgccgtgcaacgacgccggcgccgccgaggcggacgacgaggaggcggcggccatggccgcgggcgtggacggctacggctgcgacgagttccgcatgtacgagttcaaggtccggcggtgcgcccgcgcgcgcagccacgactggaccgagtgccccttcgcgcacccgggggagaaggcgcggcggcgcgacccgcgcaggtaccactactcgggcgccgcctgcccggacttccgcaagggcgggtgcaggcgcggcgacgcctgcgacttcgcgcacggcgtcttcgagtgctggctccacccggcgcgctaccgcacccagccctgcaaggacggcacggcctgccgccgccgcgtctgcttcttcgcgcacaccccggaccagctgcgggtgctcccgcccacgccgcagcagtctagcgccagccccaggggcgccggcgccctgcccgagtcctacgacggctccccgctgcgtcgccaggcgttcgagagctacctcaccaagagcatcgtgtcctcgtcgccgaccagcacgctcctctcgccgcccaagacgcccccgtcggagtcgccgccgctgtcgccggacggggccgccgccgccttccgccgcgggtcctggcccggcgccgggtcccccgtcaacgacgtcctggcctcgctccgccagctccgcctcggcacggccagctcgtccccgtccggcgggtggggcggctacccggcgtccgcggctgcctacgggtcgcccacggcgggcgggctctacagcctgccctccaccccgacagccctcgccaccgcctccgcctcgggctaacatgcccaacctggaagccgcttgacgtcagcttcggcgccgacgaggaagcccgtggagagggtggagtccgggcgggccctccgcgccaaggtgttcgagcggctcagcagggagggcgctgtttcctgctacccagctgccggaaccggtggccccgacgtcgggtgggtctccgacctcatcaactgaggcggcttcggcggcgggtcggtgctgcatagcagtggagaaaaaaggtggtggtaactggtaagccgtaacagagaaggatggcataaaaaaatgttcccctttggttccagataattccgctaattaccctgtacatagatatctatcgccctgtgaatattctcggctggttgggtggagggctgatgctagggggtggatttgttttggggttcttgaggtagcggaaaatttccaaggaaaagaaaatatgtaagcaagtgtagatgtcgtaggcggcggcggcggcggcggtttgtgccctcttgtgtgctgcgaagcatggcgagggccgacggtgacgacgaagactggccggatttccagctttggtgttcctgtgattccgcagcaagttcagtttgatgttgtttcaagttgttccgtcgtctgtgcactatgcatccggccggctagttggcgattgcaacctgcttgtggattactaccccccattttgttgttgatgttgatgtaatctgtttattaagacccagcattcccctacagcttattttgttgtacttactatatatctttagtaggtgccgagatctaagttcacccgctattggaggtgaacttgccgtgtaatatttggatcaagtaaatggtttaatgtcttatcgcccagcgtgtgtttgtcgtcttttggggaagccttgtgtgtgctttgcgactctttgagccgcgctctgctctttgctgctggcgagatcgcgaacgcttgcggacaggaccgccccgagtggcgcagtgcattgctgattgatggttgcaagtgtcggcgacgtggccgtcgatgagttcctcgagcgcgaccggcgggtctcggcgctgcacatgcgccgcgggtccatcggcgcgcacagatgggtctctctcacccaccccccccccccccccccgtctcgatagcttgtagacggagcagtggcgctgtaggcggcctgcgccatatgcatgcatatgcattgctttgcgctttgcttgtttggttcactgcatcgtctgcggattccttccaggcctgcagtgcctggctggagcgggggcagggtggtgtgtggtgtgggggcaggcaaaggcaggggctcgcgatctgcgcggcggtggcgtgtcctgcgtgcagtggagcagcctgtccggttctacgagacaggatatggcggccttcgtctgtttcacgcttctctggctttatctactactactagcttctccaaagtttgctcgtcactctttataactcctcttaacacaacagacaataccacttcaaaccacaagtgcaaatggatgtgtaaacaaaaacagtgtttttttgcaacttcttctctgttttggtttctcttttccacccgtcagtgagacagtgacggtgtgtctgcctgtccgtgtttctgaccggagtggacagccattactgcccctctgatctctgacggtgccgccgtgatgactgatgaagggggtagtgcagagcaaaggcacgcacggaccatgatgagatctgctcggaggagttaaagaccaaccagtgccaatctccaatctcgtgaccagatgcagacgcgtgcgcagaggatatcatcatcatcgaccgcaagcagcagagtgccagctccgggcgcagtgctacgaacgcactgactgcactggctaatcacatgtacaagtctcgtccgtagaccgtagtagacagtagtatacgaccgtactcctacagggaaaaggtgggtcctctgatccgatcacggatggatgagaaaaagcgacccgacagagaagagcttcagagttgagtgcatccatgccatggataggtaggcattccgatcccccgccggaaaagcttgtggcgaactgcatgcagccactggccgcgagtgtttttttttttttttgtttgggatcgatcgctcagactctggctccctcgaaacgaggaacgtggtagacggggccttctgcacgggtcagctgcacggacgagcga

SEQ ID NO: 17801 - DNA, 1988 bp, Zea mays
ccggggtccccaacccacgcactgtcccaccggatctctctcacacaacacagggatataagcccagtccacgagatctcccgtagaccagtggcgagggaagggaaggaacgaaacagagcccgatcctagcgacaggccagggaagatcgccatgatgatgatgggcgaaggcgtgagcgtgccgccgtggtcccaccacgtccccgtgagcggcgtcgacgccggcgtcggcggcgtacgagatgacgccgtacctgctggcggcgctgcggcagtacctgccgtgcaacgacgccggcgccgccgaggcggacgacgaggaggcggcggccatggccgcgggcgtggacggctacggctgcgacgagttccgcatgtacgagttcaaggtccggcggtgcgcccgcgcgcgcagccacgactggaccgagtgccccttcgcgcacccgggggagaaggcgcggcggcgcgacccgcgcaggtaccactactcgggcgccgcctgcccggacttccgcaagggcgggtgcaggcgcggcgacgcctgcgacttcgcgcacggcgtcttcgagtgctggctccacccggcgcgctaccgcacccagccctgcaaggacggcacggcctgccgccgccgcgtctgcttcttcgcgcacaccccggaccagctgcgggtgctcccgcccacgccgcagcagtctagcgccagccccaggggcgccggcgccctgcccgagtcctacgacggctccccgctgcgtcgccaggcgttcgagagctacctcaccaagagcatcgtgtcctcgtcgccgaccagcacgctcctgtcgccgcccaagacgcccccgtcagagtcgccgccgctgtcgccggacggtgccgccgccgccttccgccgcgggtcctggccgggcgccgggtcccccgtcaacgacgtcctggcctcgctccgccagctccgcctcggcacggccagctcgtccccgaccggcgggtggggcggctacccggcgtccgcggctgcctacggttcgcccacagcgggcggcctctacagcctgccctccaccccgagggccacgccgacagccctcgccaccgccaccgcctccgcctccggctacatgcccaacctggagccgcttgacgtcagcttcggcggcgacgaggagcccgtggagagggtggagtccgggcgggctctccgcgccaaggtgttcgagcggctcagcagggagggcgctgtttcctgctacccagctgccggaaccggtggccccgacgtcgggtgggtctccgacctcatcaactgaggcggcttcggtggcgggtcggtctgccatagcagtggagaaaaggtggtggtaactggtaagccgtaacagagaaggatggcataaaaaaaagtgttcccgtttggttccagataattccgctaattaccctgtacatagatatctatcgccctgtgaatattctcggctggttgggtggagggctgatgctagggggtggatttgttttggggttcttgaggtagcggaaaatttccaaggaaaagaaaatatgtaagcaagtgtagatgtcgtaggcggcggcggcggcggcggtttgtgccctcttgtgtgctgcgaagcatggcgagggccgacggtgacgacgaagactggccggatttccagctttggtgttcctgtgattccgcagcaagttcagtttgatgttgtttcaagttgttccgtcgtctgtgcactatgcatccggccggctagttggcgattgcaacctgcttgtggattactaccccccattttgttgttgatgttgatgtaatctgtttattaagacccagcattcccctacagcttattttgttgtacttactatatatctttagtaggtgccgaaatctcagttcacccgctattggaggtgaacttgccgtgtaatctttggatcaagtaaatggtttaatgtcttatcgc

SEQ ID NO: 17802 - DNA, 1932 bp, Zea mays
ggtactcctcgaggccggccggggtccccaacccgcgcactgcccccggtctctctctcaacacaccgataagcccagtccaccggatctcccgtagtccagagactcagttgagggaaggaaggaaaccgagcccgaccctaggtagtcatgatgatgatgagcgaaggcgtgggcatgccgccgtggtcccaccacgtccctgtgagcggcgtcgacgaaggcgacgagatgacgccgtacctgctcgcggcgctgcgccagtacctgccgtgcaacgacgccggcgccgaggccgaggccgaggaggatgaggcggcggcggccatggcggcgggcgtggacggctacggctgcgacgagttccgcatgtacgagttcaaggtccggcggtgcgcgcgcgcgcgcagccacgactggaccgagtgccccttcgcgcacccgggggagaaggcgcggcgccgcgacccgcgcaagtaccactactccggcgccgcctgcccggacttccgcaagggcgggtgcaagcgcggcgacggctgcgacatggcgcacggcgtcttcgagtgctggctccacccggcgcgctaccgcacccagccctgcaaggacggcacggcctgccgccgccgggtctgcttcttcgcgcacaccgcggaccagctgcgcgtgctcccgcccacgccgcagcagcagtccagccccaggggcgccgcctgctcttccccgctcgccgagtcctacgacggctccccgctccggcgccaggcgttcgagagctacctcaccaagagcatcatgtgctcgtcgccgaccagcaccctcctgtcgccgcccaagtcgcccccgtcggagtccccgccattgtcgcccgacttccgccgtgggtgctggccgggcgccgggtcccccgtcaacgacgtcctcgcctcgctccgccagctccgcctcagcagggccaactcgtccccgtcgggcgggtggtgcggctaccctgcatccgcggtcgcgtacggatcgcctacggggggcgcgctctacggcctgtcctccaccccgagggccaccgccggctccggctacatggccaacctggaccctctcgacgtcaccttcggcggcgacgaggagcccgtggagagggtggagtccggccgcgcactccgcgcgaaggtgttcgagcggcttagcagggagggcgctgtttccggcgacgccggtggccccgacgtcgggtgggtctccgacctcatcaactgaggcggcggcgggtccctggcatggcagtggcaatggcaatgggcatgggcatggagaaaggtgatggtgagccgtatcggagaaggatggcatccaaaaaaatatttccctgcatttgatttcgttcctcagttaattccgctaatccccgtgtacatatctatcaccctgtgaatattctcggttggtaagagggaggatgatgctaggcggtggatggatgggtggatttgttttggggttcttgaggtagcggaaaatatccaagaaaattagaagaaaaaaagtgtgtacagcagatgcagtaggcggtggcggtggttgtggcgaagcatggcgggggctgatgtgacgacgaaggcggccggatttccaccacggcttggtatttctgtgattccggcgcctgctacggtgttcgtgcttttttttttaagttagtggactagttggccattgcaacctgcttgtgaattactctcccattttgttttgtaatctgttaagacccagcattccctacagcatattttgtacctacatcttagtagttgccgaaacctcaaaatcacccgctattggaggtgaatttcccatgtaatcttctgctcatgtaaatggtttttttaatgaatcgatgtttatcgccctaaaaaaaaaaaaaaaaaaaaa

SEQ ID NO: 17803 - DNA, 1813 bp, Zea mays
  misc_feature (1791)..(1791): n is a, c, g, or t
ccggccggggtcccagtcccgcgcactgcccccggtctctctctctcaacacaccgataagcccagtccaccggatctcccgtagtccagagactgagttgaaggaaggaagccatgatgatgatgggcgaaggcgtgagcatgccgccgtggtcccaccacgtccctgtgagcggcgtcgacgaaggcgacgagatgacgccgtacccgcgacccgcgcaagtaccactactccggcgccgcctgcccggacttccgcaagggcgggtgcaagcgcggcgacggctgcgacatggcgcacggcgtcttcgagtgctggctccacccggcgcgctaccgcacccagccctgcaaggacggcacggcctgccgccgccgggtctgcttcttcgcgcacaccgcggaccagctgcgcgtgctcccgcccacgcagcagcagcagtccagccccaggggcgccgcctgctcttccccgctcgccgagtcctacgacggctccccgctccggcgccaggcgttcgagagctacctcaccaagagcatcatgtgctcgtcgccgaccagcaccctcctgtcgccgcccaagtcgcccccgtcggagtccccgccattgtcgcccgacttccgccgtgggtgctggccgggcgccgggtcccccgtcaacgacgtcctcgcctcgctccgccagctccgcctcagcagggccaactcgtccccgtcgggcgggtggtgcggctaccctgcatccgcggtcgcgtacggatcgcctacggggggcgcgatctacggcctgtcctccaccccgagggccaccgccgcatccggctacatggccaacctggaccctctcgacgtcagcttcggcggcgacgaggagcccgtggagagggtggagtccggccgcgccctccgcgcgaaggtgttcgagcggcttagcagggagggcgctgtttccggcgacgccggtggccccgacgtcggttgggtctccgacatcatcaactgaggcggcggcgggaccctggcatggcagtggcaatggcaataacaatgggcacggagaaaggtgatggtgagccgtaacggagaaggatggtatccaaaaaaaatatttccctatatttaatttcgttcctcagttaaatccgataatccccgtgtacatatctatcaccctgtgaatattctcagttggtaagagggaggatgctaggtggtggaagtggaaggaggggtggatttgttttggggttcttgaggtagtagaaaatatccaagaaaaatagaaaaaaaaagtgtacagcagatgcagtaggcggtggcggtggttgtgtccctcttctgtgcatagggttagggtgttggtggcgaagcatggcggcggctgatgtgacgacgaaggcgggccggatttccaccacggcttggtatttctgtgattccggaacatggtagtttgatgttgttttttttaagttagtggactagttggcgattgcaacctgcttgtggattactctcccattttgttatgtaatctgttaagacatcagcattccctacagcatattttgtgtacctacgtcttagtagttgccgaaatctcaatcaaaatcacccgctattggaggtgaatttcccatgtaatcttctgctcatgtaaatggttttctttttaatgaatcgatgtttatcgccctgaaaaaaaaaaaaaaaaacccgcggcaaaaaaaaaaaaaaaaaaaaaaaaaaaaaaaccaaaaaaagaaaaaaaaaaaaaaaaaaaaaagnactcatcgttgttacccctgtt

SEQ ID NO: 17804 - DNA, 864 bp, Zea mays
ggccgcttttttttttctttgcctcatgattgaagattaattatagaaaacacaaaacatagtgcatcataaaaatatgacttttccctagcaaaaaaaaagtttcgattccagagaccagaaatatataaactacgcctaagccctagcatctacaacccttggtataagatatccaacatcacggcagggaacaagcttaactagtgagcgtctgctgaactagctagtatagcagccagcgtgtgatcttggctttttttttttttggggccaagagcggcgagctctcaaaccttttcgacgggagcctcgacgacgccacgccggcaaagcgggcatgttgcgtgagagcgcagccacaggtcgatgcactcgacgtggaataggtggccgcacgccggcagcaaccgcaccgtctccccgtcccgcaccaaggcgaggcagatcgcgcactgcgcccacccggcgcccctctggtaagcgagcatagggatcgccgacagcgcggacggcgccagcccgcaccggcttctgccgttggcagcggtggctctggcggcaccgttcgtggccacggcagcggtcgcgtacccgttggcggcgaaggcgttgcggaagcagacggccaccatgaagacgatgagggcggaggcggacgcgaggcagacgaacaccaccgtgtcgcacaccggccggtagctgccggcgggggcataagcttccatctcctccgccgcggcgccggtgggaccgtagaacgacaaggccgggctgctaggtgcttcgtgctctctcgttggttggtgaggcgcagcagtctggggctctgggccaccgtgaccgtccctttttcccggccgg

SEQ ID NO: 17805 - DNA, 918 bp, Zea mays
  misc_feature (43)..(43): n is a, c, g, or t
  misc_feature (55)..(55): n is a, c, g, or t
accccctcaccttctccctttttcccctcactctcaacctatntcaaatttaatntccgaaattgggtaccgggccccccctcgagtttttttttttttttttttccttttttaaatggtaaaacgaattttaatttaggacggagggagtacaaaactttatgtccaaggagatgtgcagtcctgtgtgaccgaggggaaaaaagtgaaaacataacacaacctgatggaagatgctgctgcccacgaggattcttgcagcaaaagaaagaagaaactacaaagctggggggggaaaagatataccatgtcaatagtcagctagccggcactcgccaaccattagtcaaaaggtgggaaaatacaagctcattccaagcatcaggaactcctggaaggcaccagtggctgcaatctagtatggtattaggatgactccaaagtccaatatgagcatcacttctaaaggcccccatcaaagtcacatttagtactgtcacagggacactcatatttgccacaacaccagcaagtatatccccaaattctctcctgtcatttccattggcctcagcggtaggttgttgtgttacttcacacaccttttgatttaagccactccaatgagacggttcatatgtacggaagaatacatgtgttcgccttaaatcaattctctctttcacccatgaagcccaagtttccaatgccattttgaaagcagcgttgatggatgttcccagtttaagcacacctccagcctcaaaatagcaacccatgtcaaataatttgctggcagtccaccaatgccctgagttgaaaataagaacatctgagttcacccattcctgacttaaaccatccaacttatcaagcttcaggatggcacggacccttctgcgcccaggcgaagcgcag

SEQ ID NO: 17806 - DNA, 643 bp, Zea mays
tgtcagcagccatgatgttgcttattggtcaaagagcttcatcctagacttggaaagggcttgtagggaccactttaagaggacatgttggggcatagggttgggttttggtttcagggtggtggccttggacgctcatttcagaaagcttaacatggattcaattgttaatgcttatgagatttcagggagcagggctatattgcttgattatgatggaacactggttcctcaaacttcaatcaacaaggaacctaattcagaggttttgaacatcatcaataccctttgctcagatagtagaaacatcgtttttcttgtcagtggtagagacaaagatatgttaggaaagtggttctcctcatgtccaaaattggggattgcagctgaacatggttacttcttgaggtggtctagcgaagaagagtggcaaacatgcactcaggccatggactttggatggatgcaaatggcaaagccagtgatgaatttgtatacagaagcaactgatggttgcgctgctgcgccgcacaataagaatctgtaaatatgttatcaacttatcatgactaacttggtcaccagccgtttcatcttttcgccaacaaatgtacctgcccgggcgcccgctcgcatagtgagt

SEQ ID NO: 17807 - DNA, 3101 bp, Zea mays
  misc_feature (219)..(219): n is a, c, g, or t
  misc_feature (1000)..(1001): n is a, c, g, or t
ttcatttgaaaagagattaagaaacaaaaccttaatagtgttttatggaattgacaaattattaagggagtattgctacctttcatggttgatggttttaagttcatcaatttggacttcaatttttcatagaggctgttaagttggtttttagtgtttcccctttttagattttatagagtattaacatcacataacctagatattatacaagaagtnaagaacatgaacgtgacagatctgtttgctagttagttaatggcagtaattggtttactcggcttctatcaaattgttttagctagaaaggatctgtgaaataagatttcaaaattttggtaggtggtctagagaagaagagtggcaaacatgcactcaggcattggacttcggatggatgcaaatggcgaacccagtgatgaatttatatacagaagcaactgatggatcctacattgaggccaaggaaagtgccttggtgtggcaccatcaggatgctgacctaggctttggatcctcacaggcaaaggagatgcttgatcacctggaaagtgtactagcaaatgaaccagtctctgtcaagagtggccagttcattgttgaagtcaaaccacaggttcattcatcttttacatttcaaatcctttcttgaagagatgtgtttttcaacttataagttcattatttacggcgaaaggggctctagctgaattggttaggtgttttgagtagcactcctcaggtcctgagttcagctctccatgggagcgaatgtcaagctgtggttaaaaaaatccctgtctgtctcacgccaaagcacaagtctaaagcttggtcccggttcagatcgtttcttacatgggctacaatgccgttgtgtatggatggggcacgggttcaggggttttctcgacctgcgtggggtcttcttcttaatataactcccaggggctgtcttacccccgcaggtcgagtttttttaagttcattatttacgtcnnaaaaacatttcatatattttcacgagtctaaaaggtagagttaaactgtagaccactgacttcagctagcacctattgttttctcacagttaatatgataattagcttcaaaagttggaaggacccagtacaatttttcttgttgcaaatatgttggcttcattttttgtgcagtattaagctagtagctctgctcagttatagatctcatttgggcctgtattggaattttatctggttgtggtgaaagcaactttctaaaaagtatcatggtgatgcctttctgcaggtttttagaatttgttttttcttattagcctagtagccttgtagaaaaacactattttggttgccgtattgcctagtaggctgtagttaccttaccacatttcttaccttctgcaaaaattttcctgcaagtggttagtacccgtggtggtgaagtataatttgattgatacgttttttaccttgcatgatcgacctttacttagtttctggtatttacagtgtaaattaaaatagattcctttgttgtgcactaatctgcagggaataagcaagggaatagttgccgagaggatacttgcatcagtgaaggagagaggaaagcaggctgatttcttattgtgcatcggcgatgataggtctgatgaggacatgtttgaaaatattgctgatatcattgggaggaatttggttgctccaagaacagcactgtttgcgtgcactgtgggacaaaaaccaagcaaagccaaattctacctggatgatacattcgaagtggtcactatgctgagcgcactggcagatgccacaggtcctgaactggagactgattcggctgatgaatctgtcgcatatatctcatcacttgatattggtgacgaacaatcagaatccagtgataaaccagttgaagggtcttagccagttttctcttgcgttttcagaacatgatgattgtttcaatagtcaattctattctacacaattttctgatgggaactcaacgactaacaactggttctacgaatgctccagagtgaagcttctcaatctgctgtgctccaagttctccagttgggcaagatagtacagtctgttgctccaaggcgtagatccatatgttcatagctgacttacttggcacgttctttcactttctcattcctggttgaattaaaatgaaaacctcacagaagacaaagggagcgctgtttggctcattggctgaagtaatctggggggaggtataggagtggcgtatgtgaaaggagcctgtgcgcaggttgtgatatgattccttattaacacgacgttacaaagtggtgtcacttcttgaactaccagtagtaacaatcccaagagtgaggttcgaattgattaattaattgcttcaaagccggatctcggatggttttgctccaacgttttcccctcgtgcggttttttttaataaattttctgggtttacgttgaaagatgccttggaagatagcatatttttaggcctgtctatcagttctgatgaccactgccaatcagcgctggatgcttggcgattgtgtaccttaacacgctaagagcatctccaataatattaatccaaataagagggtattggtgatttcacaattagtgtttttttttttgtaaatattagggaaggtgctcaataatccttcacaatatataagatccacctgttctgtggtaaaaaaaaaaaaaaaaacatgaacatggaggtttgctgtgttatatagaaaactcaatgacagagtgcttcctagtaggatgaccctaggacatggaagtcttgtctcctctggcagaactgttgtttaactcttatcacacatcccttggatgttctccattcaaggccttagatggggttgaacctaaaactggtggcacatctatactcttaactttgcactccagtgactgtgtccgaactggtggagaacagagacttgccccctccaatctctgagacaccatccagcaaatgcccacaacaggatggaaaccatggctgccaagaagcgatctgacctgcagttccaagtgagagatcaggtcttactgaaactc

SEQ ID NO: 17808 - DNA, 3838 bp, Zea mays
ctctgtacgcgacacgttttttctcgctgacaggcgcccacctctatgccaattgcccccccggacgatcacagctgttgatcacgccagcgcggcccaaactgctcgtatctgcgccgtccagcgagcgggccctacatgtggaggtggggcgcgtgacgccagctggcatcggacgcaaccttatcctcttttcccgaggcatctcgtgcctaggcacggttcaaggagcactaaacacaccgacacaaccaacgggtccatatgtcagcgacgactagtccaggacgctgaccctaacgcacccgtggaaaggaatataccgacggcctctcgcttccacccatccggtcgcgtttcccccgttccaaattcgccaacccacaccaccttcctctctctcgccgccgccctcagatcagatcaaagcggaacaccaactcctcctcttcctcctcctcgtagggtttggtgtgttcacctcacctctcgcggcgacagcgaagccttctcttctcttcccctccgctccgctccgctccgctccgctcggtgtttcagccatgatgtcgcggtcgtacaccaacctgctcgacctcgcggagggcaacttcgcggcgctgggcccggccgccggcgccggcggcggcgggcggcagaggcaggggtcgttcgggctgaggcggatgtcgcgggtgatgacggtgccggggacgctctcggagctcgacggcgaggacgagtcggagccggcggccaccagcagcgtcgcctccgacgcgccctcgtccgtggcggcggaccgcctcatagtggtctccaaccagctgcccatcgtcgcgcgccggaggcccgacggccgaggatggtccttcgtgtgggacgacgactcgcttctgctccagctccgcgacggcattcccgaggatatggaggtgctcttcgtcggctccctccgcgccgacgtccccgtagccgagcaggacgaggtgtcgcaggcgttgctcgaccggttccgctgcgcgccggtcttcctccctgaccgcctcaacgaccgcttctaccacggcttctgcaagcgccaactctggcctctgttccactacatgctccccttctcctcatccgcgtccgccgccggcaccacctcttcctcctccgccgccacttgcaacggtcgcttcgaccgcagcgcttgggaggcgtacgtgctcgccaacaagttcttcttcgagaaggtcgtcgaggtaatcaacccggaggatgactacgtttgggttcacgactaccatctcatggcgctgcctaccttcctccgccgctgcttcaaccgcctccgcatcggattcttcctccacagccccttcccctcgtccgagatctaccgcaccctccctgttcgggaggagatactcaaggcgctgctcaactgtgacctaattggcttccacacttttgattacgccaggcacttcctctcgtgctgcagtaggatgctgggaattgaataccagtcaaagcgtgggtacattgaattggattactttggccgcactgtcgggatcaaaatcatgccagtgggagttcatatgggtcaattggagtcgggtctgcgcttgcctgataaggaatggaggctttctgagcttcaacggcagtttcaggggaaaactgtcttgcttggtgtggatgatatggatatctttaaggggatcaatttgaagcttctcgcctttgagaacatgttgaggacacatcccaagtggcaggggagagcagtgttagtgcagattgctaacccagcccgtggaaggggtaaagatctggaagccatccaggctgagattgaggagagctgccagcggatcaatggagactttggccagtcagggtatagccctgttgttttcatcggccgtgatgtgtcaagtgttgagaagatcgcctattatacgatagcggaatgtgtggtggtcactgctgtgagggatgggatgaacttgacaccgtatgaatacgttgtctgtaggcagggtgcaccaggatctcagtcggtatcagaggtgagtgggccaaagaagagcatgctggttgtgtcagagtttattggctgctcaccgtcactgagcggtgctattagggttaacccatggaatatagaggcaaccgcagaggcgatgaatgaggccatttcaatgccagaacaggaaaaacagttgaggcatgagaaacattaccgttatgtcaggagccatgacgtcgcttattggtcaaagagcttcatcatagacttggaaagggtttgtaaggatcacttcaagaggacttgttggggcatagggttgggttttggtttcagggtggtggccttggaccctcatttcacaaagcttaacatggattcaatcattaatgcttatgagctttcagagagcagggctatattgctcgattatgatggaactctggttccccaaacttccctcaacaaggaacctagtccacaggttttgagcatcatcaataccctttgctcagatagtagaaacatcgtttttcttgtcagtggtcgagacaaagataccttgggaaagtggttctcctcatgtccaagattggggattgcagctgaacatggttacttcttgaggtggtctagagaagaagagtggcaaacatgcactcaggcattggacttcggatggatgcaaatggcgaagccagtgatgaatttatatacagaagcaactgatggatcctacattgaggccaaggaaagtgccttggtgtggcaccatcaggatgctgacctaggctttggatcctcacaggcaaaggagatgcttgatcacctggaaagtgtactagcaaatgaaccagtctctgtcaagagtggccagttcattgttgaagtcaaaccacagggaataagcaagggaatagttgccgagaggatacttgcatcagtgaaggagagaggaaagcaggctgatttcttattgtgcatcggcgatgataggtctgatgaggacatgtttgaaaatattgctgatatcattgggaggaatttggttgctccaagaacagcactgtttgcgtgcactgtgggacaaaaaccaagcaaagccaaattctacctggatgatacattcgaagtggtcactatgctgagcgcactggcagatgccacaggtcctgaactggagactgattcggctgatgaatctgtcgcatatatctcatcacttgatattggtgacgaacaatcagaatccagtgataaaccagttgaagggtcttagccagttttctcttgcgttttcagaacatgatgattgtttcaatagtcaattctattctacacaattttctgatgggaactcaacgactaacaactggttctacgaatgctccagagtgaagcttctcaatctgctgtgctccaagttctccagttgggcaagatagtacagtctgttgctccaaggcgtagatccatatgttcatagctgacttacttggcacgttctttcactttctcattcctggttgaattaaaatgaaaacctcacagaagacaaagggagcgctgtttggctcattggctgaagtaatctggggggaggtataggagtggcgtatgtgaaaggagcctgtgcgcaggttgtgatatgattccttattaacacgacgttacaaagtggtgtcacttcttgaactaccagtagtaacaatcccaagagtgaggttcgaattgattaattaattgcttcaaagccggatctcggatggttttgctccaaaaaaaaaaaacaaattcccctcgtgcggttttttt

SEQ ID NO: 17809 - DNA, 4331 bp, Zea mays
acaaaacacaacgaattatacatgtttgggtcgcgagatgcgtaataccctatatcatattttgctttgatatctggagcttacaatgactcaatgagggctagggtttgtatgtttgatgagagagaccggggggaggggtgtgtgtatgaaatcacattccttggaggaagatccctcacttgctttatatagtctggcatggcttgggttacaagtccgtttccttctatatctcctagatggtttagattacaatagagtgcttgtattgtgcgctaagtttattcagccagtcaacccatatagagaatacgtctcatttggatcgagagtctcatttggatcaagaggatatccacccccacaaccttaaatgacggtagaacgtcaaaaaatagtacatcaaagggattatagaattgtcttgagactataaaaataatgcgttcccaaacatgactaaatttgccaacacttcttgaacgagccccaatgccattggaaccatcagcccctcagagcgatcacagccattgatcataccggtgcggccaaaaatgctcgtatctgtatcgtccaagggcccctacatgcctacagatgaaggtgggtcgcatgacgccagctggcatggggggagcgcaaccttatcctcttttcacgaggcatctcgtgcctaggcgcggtccaaggagccctaacacaccgacaaaccaaagggtccatatatcagtgattagtggtccaggagaggcctcacgcgccgagcgcccgagcccaacacacccgtggaatatacgggcgagtctctgccttcaccccctccccgacctctcgcctccctctctggtcgcgtacccattccgaattggccaacccacaggccacaccacctccctctctctcgagccgccgccatcagatcagatcaaagaggaacacccaacccccctccccacaccccccaagagtttggtgacaatctcggtcctgctgatccgaaggggtagccgggccggctagggcgtgctcacatctcgcggcgaagcttttctctccgctcggtgtttcagccatgatgtcgcggtcgtataccaacctgctcgacctcgcggagggcaacttcgcggcgctgggcccggccggcggcagcgggcggcagagacatgggtcgttcgggctgcggcggatgtcgcgggtgatgacggtgcccggggacgctgtcggagctcgacggcgaggacgagtcggagcccggccgcgaccagcagcgtcgcctccgacgtgccctcgtcggtggcggtggacccgcctcatagtggtctcgaatcagttgcccatcgtcgcgcgccgcaggcccgacggccgagggtggtccttctcgtgggacggcgactcgctcctactccagctccgcgacggcatccccgacgagatggaggtgctcttcgtcggatcgctccgcgccgacgtccccgcagccgagcaggacgaggtgtcgcagacgctgctcgaccgattccgctgcgcgccggtgttcctccctgaccacctcaacgaccggttctaccacggcttctgcaagcgccagctctggcctctgttccactacatgctccccttctcatcgcccgcttccgcgtccgccgccgctacctcttcctccgtcgccacttcgtcacccggcaacggtcgcttcgaccgcagcgcttgggaggcgtacgtgctcgccaacaagttcttcttcgagaaggtcgtggaggtaatcaacccggaggatgactacgtctgggttcacgactaccatctcctggcgctgcctacctttctccgccgccgcttcaaccgcctccgcatcggattcttcctccacagccccttcccctcgtccgagatctaccgcaccctccctgttcgcgacgagatactgaaggcgctgctcaattgtgacctcattgggttccacacttttgattacgccaggcacttcctctcgtgctgcagtaggatgctgggaattgaataccagtcaaagcgtgggcacattggattggattactttggccgcactgtagggatcaagatcatgccagtgggagttcatatgggtcagttggagtcgggtctgcgcttgcctgatagggagtggaggctttctgagcttcaacagcagtttcagggcaaaactgtcttgcttggtgtggatgatatggatatctttaaggggatcaatttgaagcttcttgcatttgagaacatgttgaggacacatcccaagtggcaggggagagcagtgttagtgcagattgctaacccagcccgtggaaggggtaaggatctggaagccatccaggctgagattgaggagagctgccagaggatcaatggagactttggccagtcagggtatagccctgttgttttcatcgatcgtgatgtgtcaagtgtcgagaagattgcctattatacgatagcggaatgcgtggttgtgactgctgtgagggatgggatgaacttgacaccatatgagtacattgtctgtaggcagggtgcaccaggatctgagtcagtatcagaggtgggtgggccaaagaagagcatgctggttgtgtcagagtttattggctgctcgccgtcactgagtggtgctattagggtcaatccatggaatatagaggcaacagcagaggcgatgaatgaggccatttcaatgccagaacaggaaaaacagttgaggcatgagaaacattaccgttatgtcagcagccatgatgttgcttattggtcaaagagcttcatcctagacttggaaagggcttgtagggaccactttaagaggacatgttggggcatagggttgggttttggtttcagggtggtggccttggacgctcatttcagaaagcttaacatggattcaattgttaatgcttatgagatttcagggagcagggctatattgcttgattatgatggaacactggttcctcaaacttcaatcaacaaggaacctaattcagaggttttgaacatcatcaataccctttgctcagatagtagaaacatcgtttttcttgtcagtggtagagacaaagatatgttaggaaagtggttctcctcatgtccaaaattggggattgcagctgaacatggttacttcttgaggtggtctagcgaagaagagtggcaaacatgcactcaggccatggactttggatggatgcaaatggcaaagccagtgatgaatttgtatacagaagcaactgatggatcctacattgagacaaaagaaagtgccttggtgtggcaccatcaggatgctgacccaggctttggatcctcacaggcaaaggagctgcttgatcacctggaaagtgtactagcaaatgaaccagtctctgtcaagagtggccagttcatcgttgaagtcaaaccacagggagtaagcaagggaatagttgccgagaggatacttgcatcagtgaaggagaggggaaagcaggctgatttcgtattgtgcatcggcgatgataggtccgatgaggacatgtttgaaaatattgccgatatcattaagaggaatatggttgctccaagaacatcactgtttgcatgcactgtgggacaaaaaccaagcaaagccaaattctacctggacgatacatttgaagtggtcgctatgctgagcgcacttgcagatgccactggagctgaactggaatctgattcggctgatgaattggccgcatctatctcatcacttgatattggtgacgaacaatcagaaaccagtgatacaccaattggagggtcttagtcagttttctcttgaatttcagaatataatgattatttcaatagtcaattctacagaggggaagcttctcaatctgctgcactccaagtttctccagttgggcaagatagtagtctgttgctgcaaggcgtagatccatatgttcatagctgactcgccgacttggcatattctttgactttctcatttctggttgaagtaaaatgaaagcctcacagaaggaaagggaactgtgtggctgaagtaattggggggaagttataggagtggcaatttctaaaggagcccgtgcgcagcttctgatatgatcccttattaacatgacattacaaagtggtgtcactttttgaactatcagtagtaggtagtagcaatctcaagggtgaggtttaaattgattagttgcttcaaaaccagattttggctcctctgtgtctgggttatattttaattacttaggtccagggcccgtgcgttgcaacggaaccgaataataacacgataatttagt

SEQ ID NO: 17810 - DNA, 2266 bp, Zea mays
ctgcagtaggatgctgggaattgaataccagtcaaagcgtgggtacattgaattggattactttggccgcactgtcgggatcaaaatcatgccagtgggagttcatatgggtcaattggagttgggtctgcgcttgcctgatagggaatggaggctttctgagcttcaacgccagtttcaggggaaaactgtcttgcttggggtggatgatatggatatctttaaggggatcaatttgaagcttctcgcctttgagaacatgttgaggacacatcccaagtggcaggggagagcagtgttagtgcagattgctaacccagcccgtggaaggggtaaagatctggaagccatccaggctgagattgaggagagctgccagcggatcaatggagactttggccagtcagggtatagccctgttgttttcatcggccgtgatgtgtcaagtgttgagaagatcgcctattatacgatagcggaatgtgtggtggtcactgctgtgagggatgggatgaacttgacaccgtatgaatacgttgtctgtaggcagggtgcaccaggatctcagtcggtatcagaggtgagtgggccaaagaagagcatgctggttgtgtcagagtttattggctgctcaccgtcactgagtggtgctattagggttaacccatggaatatagaggcaaccgcagaggccacgcgtccggccactttcaatgccagaacaggaaaaacagttgaggcactgagaaacacttgccgttatgtcagcagccatgatgttgcttacttggtcaaagagcttcatcctagacttggaaagggcttgtagggaccactttaagagcacttgttggggcatagggttgggttttggtttcagggtggtggccttggaccctcatttcagaaagcttaacatgcattcaattgttaatgcttatgagatttcagagagcagggctatattgcttgattatgatggaacactggttcctcaaacttccatcaacaaggaacctagtccagaggttttgaacatcatcaataccctttgctcagatagtagaaacatcgtttttcttgtcagtggtagagacaaagatacgttaggaaagtggttctcctcatgtccaaaattggggattgcagctgaacatggttacatcttgaggtggtctagcaaagaagaatggcaaacatgcacccaggccatggactgtggatggatgcaaatggcaaagccagtgatgaatttatatacagaagcaactgatggatcctacattgagagaaaagaaagtgccttggtgtggcaccatcaggatgctgacccagcctttggatcctcacaggcaaaggagctgcttgatcacctggaaagtgtactagcaaatgaaccagtctctgtcaagagtggccagttcatcgttgaagtcaagccgcagggagtaagcaagggaatagttgccgagaggatacttgcatcagtgaaggagaggggaaagcaggctgatttcgtattgtgcatcggcgatgataggtctgatgaggacatgtttgaaaatattgccgatatcactgggaggaatttggttgctccaagaacagcactgtttgcgtgcactgtgggacaaaaaccaagcaaagccaaattctatctggatgatacattcgaagtggtcactatgctgagcgcactggcagatgccacaggtcctgagactgattcggctgatgaatctgtcgcatatatctcatcacttgatattggtgacgaacaatcagaatccagtgataaaccagttgaagggtcttagccagttttctcttgcgttttcagaacatgatgattgtttcaatagtcaattctattctacacaattttctgatgggaactcgacgactaacaactggttctacgtatgctccagagggaagcttctcaatctgctgtgctccaagttctccagttgggcaagatagtacagtctgttgctccaaggcgtagatccatatgttcatagctgacttacttggcacgttctttcactttctcattcctggttgaattaaaatgaaaacctcacagggagcgctgtttggctcattggctgaagtaatttggggggaggtataggagtggcgtatgtgaaaggagcctgtgcgcaggttgtgatatgattccttattaacacgacgttacaaagtggtgtcccttcttgaactaccagtagtaacaatcctaagagtgaggttcgaactgatt

SEQ ID NO: 17811 - DNA, 1750 bp, Zea mays
tattttcccccttgaaaagggcgccggtggccccccccactaaagggggggttgggccccccttagggcccccccgggtttcccctttttattttccggtctaatttgtgggggaatttggagggggtatacattttccccccggaacccggttggccccggtttcccccaactcgaaatttaccctccctaaagggaacaaaaggtggagctcccccccgggggcgggccctttagaaattaaggggtcccccgggttgcaggaatttgggccgagagagagagagagaaagctcattaagtcccccccccccccggggatcgtcgtctctctcctttagttagacaaagcctcctttcccaaaaccctaaaatcagccaaattcaaattccgctaaccaatttccatggcagaggaaattccagcaacagcatcattcactccatacgtccattcacaaactctaacatctcacaatcgcgccgtctcctccgtgaaattctcctccgatggacgtctcctcgcatccgcctccgccgacaaaacaatccgcacttacacaatcaacaccattaacgatccaatcgccgagcccgtacaagaattcaccggccatgaaaacggtatctccgatgttgcattctcttcagacgcgaggtttatagtctcagcttccgatgacaaaaccttaaagctatgggacgttgaaactggttcattgatcaagacgcttattggacacactaattacgccttctgtgtcaatttcaatcctcaatcaaatatgattgtatctggttcgtttgatgaaactgttcggatctgggatgtcactactggaaagtgtttgaaagttcttcccgcgcattctgatcctgttactgctgttgattttaatagagatgggtctctcattgtttcgagtagctatgatgggttgtgtcgtatatgggattctgggactggtcattgtgtgaaaactctgattgatgatgagaatcctcctgtttcgtttgttagattctctcctaatggcaagtttatcctcgttggtacacttgataacacgctgaggttgtggaacatttcgtctgctaagttcctcaaaacatacactggccacgtgaacgcacagtattgcatttcctctgcgttctccgtcacaaatggaaagcgaatagtcagtggatccgaggacaactgtgtacacatgtgggagctaaactccaagaaactgctacagaaacttgagggtcatactgagaccgtcatgaacgtagcatgccacccgacagagaacttgatcgcatcaggctcgctcgacaagacagtaaggatttggacacagaagaaagaataaatcatcactctctctcttcagaaatcaaacatgtaggtacatgccaccttcttcatgcagtaatcatctgttgcttactaagcttgttagattgattctagcctcattatgtaaaagtctaatttttgtttggtgtaagggaagtgcaacagactgttctaaacttgtaatagttctctgtgtgactcagaactatttaggtaggtcttaaggcaaagactcctgcaagtgcaaaggcatttgagagaatgaacacaaatcttcataggtttaccctttaaaaaaaaaaaaaaaaaaaactcgagggggggcccggtacccatccgccttaaggggagccgaataaaattccctggccggcgttttacaccgtcgtgactggaaaaccc

SEQ ID NO: 17812 - DNA, 1507 bp, Zea mays
gacgacttggcttctaacaaacgctgtctgaatcatatttcgattctgatttttcttcatgaattcatatagccaataagttttttcaatcttctaaaacaaaaaccccatcaaaataatctccggaccagtttctcttttgattcagtcggacccggaaaaacaatggcgtctatgaaccctttcgatctcttggacgatgacgcagaggatcccagccagattgttgcgtctaagccattgaaggttgtggctccggttcagactgctaagtctggtaagatgccgactaagccgcctcctccttctcaagctgtgagggaggcaaggaacgctcctggtggaggtcgtggtgctggacgtggagggagttatggtcgtggtggacgtggtggaaacaacagggattcaaggaacaatgatggtcctgccaatgaaaacggatatggtggaggctacagacgctcagaagaaggagatggagctagacgtggtgggcctgttggtggataccgtggtgatcgccgtggaagctacagcaatggtggtgattcaggtgactctgaaagaccacgcaagaactatgaccgtcacagtagaacagcgtacgggaatgaggataaacgtgatggagctggccgtgcgaattggggaaccactcaggatgatattactccggtgactgaagaatccacagctgttgtggacaagaatttgactgttgagaagcaagatggtgaaggtgaagcaactgatgcaaagaatgaaacacctgctgagaaagcagaggaaaagcctgaggacaaggagatgactttggaagagtatgagaaggtcttggaggagaagaagaaagctctgcaggcgaccaaggttgaggaaaggaaggttgacactaaagcatttgaggccatgcaacagctctcaagcaaaaagagcaacaacgatgaagtcttcatcaaactgggaacagagaaggacaagcgcattactgagagagaagagaagacaaggaagtcattgagcatcaatgagtttctgaaacctgcggatggaaagagttactacagaccaagaggtggttaccaaggtggaagggaaggacgtggaccaagagaaggaaaccagagggacggaggaagaaaccagagggaaggagggagaaaccagagggacggaggagctgcagcacaggcaccaacaccggccattggggacagtgcacagttccctactttgggtaagtaaggcaatctctccggtttggtccttcagcttctgtctggactcgtttctctgtaatatctcactcggtttggattttgttcttctgattctatttttattgttatactcttccctttagagagctgaaggttttttgttttgcgaacccaattttgggagttttaagttaaatgaggccaaaaaatcaaccaaaaaaaaaaaaaaaaaaaaaaagaaaaaaaaaaaaaaaaaactcgagggggggcccggtacccaattg

SEQ ID NO: 17813 - DNA, 2094 bp, Zea mays
  misc_feature (1)..(1): n is a, c, g, or t
  misc_feature (2036)..(2036): n is a, c, g, or t
  misc_feature (2048)..(2050): n is a, c, g, or t
  misc_feature (2052)..(2052): n is a, c, g, or t
  misc_feature (2065)..(2094): n is a, c, g, or t
nttatcaaactgatacccaaagacgaaggaggggcacaggggagatcattagaagcgaatgcaaacggtaaaaaggttccccacaataagggagaaaaaggcctttataccccggcgggtggggcgaggtggtacattaagatccagagcgcagacggcggcacaggttttgcccagactcggaatatatccgggctcaggtgagggcgggcgaccgcgagataatagtgggagagaagggtgccctctccatataggggccaccgccccaagcctttaaacaccttataatgctttcccggggcttggtataggttggtggtggaagatttgggaggcgggaataaaccaatttcacaccccaaggggaggccaggttatggaccgattggtttgacgggcaaggctgggggaatttaccccctccggtaaaaaggaagacaaaagcgtgggagggctccgacccgccggtggacgacacgcttttaggaagtaaggggatccgcccgggcttgcaggaaattcgggacggagagaggaggagaggaggggagatctctctggtcccccccccccccaagctcacacaaaaatggcgtctcttctgggaacatcttcttctgcaatctgggcttctccttcactctcttctccttcctcaaaaccttcctcctcccccatttgcttcaggccaggaaaattgtttggaagcaagttaaatgcaggaatccaaataaggccaaagaagaacaggtctcgttaccatgtttcggttatgaatgtagccactgaaatcaactctactgaacaagttgtagggaagtttgattcaaagaagagtgcgagaccggtttatccatttgcagctatagtagggcaagatgagatgaagttatgtcttttattgaatgtgattgatccaaagattggtggtgtgatgattatgggagatagaggaactggaaagtctacaactgttagatcattagttgatctgttacctgagattaacgtagttgcaggtgacccgtataactcggatcctatagatcctgagtttatgggtgttgaagtaagagagagagttgagaaaggagagcaagttcctgttattgctactaagattaacatggttgatcttcctttgggtgcaacagaagatagagtttgtggaaccatagatatcgaaaaggctttgacagaaggtgtaaaagcctttgagcctggtttgttggctaaagctaatagagggattctttatgttgatgaagttaatctcttggatgatcatttggttgatgttcttttggattcagctgcttctggttggaatacggttgagagggaagggatttcgatttctcacccggcgaggtttatcttgatcggttcaggaaatccggaagaaggagagcttaggccacagcttcttgatcggtttggtatgcatgcacaagtagggacggttagagatgctgatttacgggtcaagattgttgaagagagagctcgtttcgatagtaacccaaaggatttccgtgacacttacaaaaccgagcaggacaagcttcaagaccagatttcaactgctagggcaaacctttcctcggttcagattgatagggaattgaaggtgaagatctctagagtttgttcagagctcaatgttgatgggttgagaggagacatagtgactaacagagcagcaaaagcacttgcagctctcaaaggaaaagatcgagtaactccagatgatgttgcaaccgttatccctaactgcttaaggcaccgtctgaggaaagatccactggaatctattgattcaggagttctagtttccgagaagttcgccgagattttcagctgaataggagattcgattctgtgatcatttttctttaactttttctactctgtaaacggtgagaagaaccaaaactataaacaggcaaatctgattgaatatagagtctatgctttattcattaaaaaaaaaaaaaaaaaaactcgagggggggcccggtacccaatcgganttaaaaaagggnnntntttttttcggggnnnnnnnnnnnnnnnnnnnnnnnnnnnnnn

SEQ ID NO: 17814 - DNA, 1439 bp, Zea mays
cttgggagtttgatgggggagggggaggggtggagggggataacaagtatcacacgaggagacagtttaggggcactgaggagggcggaggcggaaagggggcgcccgcctaaggggaacaaaggccgggggcgcccaccggggggcgggcgcgcaagaggaagaaggggggacacccggggggcagggaaaggggccaccaccccgggagagcgcgctcgggcccccccccccccccccgatagcaccgatcataatctactctctttaaaagaaattcgtaagtactatcaagaagcagaagatggcccaaaaggtggaagcacaaggagggaaaggagccaacctatgggacgatggatcgacacatgacgccgtgaccaagattcagctcgcagcaggcatagacggaattcaatatgttcagtttgattatgtcaagaacggacaacccgaacaagctcctcttcgtggtaccaaaggccgtgttctcccagctgatccgtttgtgattaaccatccagacgaacatctagtttctgtagaaggttggtatagccctgaaggtatcattcaaggggttaagttcatctccaacaagaagacttctgatgtcattggatccgatgagggtactcacttcactctccaagttaaagacaagaagatcattggctttcatgggtctgccgggggcaatcttaattctcttggggcttactttgctccgttgactactacaactccgttgactcctgccaagcagctaacggcatttggtagtgatgacggaactgcatgggatgatggtgcttacgttggggttaagaaggtgtacgttggacaagcccaagatggtatctcagctgttaagtttgtgtacgacaaaagccctgaggaggtcacaggagaagaacatggaaagagtactctactcggattcgaagagttcgtacttgactatccaagtgaatacatcaccgcagtcgatggcacttatgataaaatcttcgggagtgatggctcagtcataactatgcttaggttcaagactaataagcaaacgtctcctccctttggacttgaagctggcacagtcttcgaactcaaagaggaaggccacaagatcgttggtttccatggaagagccgatgttctgctccacaaaattggagtccatgttcgtcctttatccaactgatgatggagctctttatccttgattccatgcatctaataagttatcaaatctatcttctaaatttctcatatgaggtctcttcatgcctctggtgaatggtgatctttgataagtgttttacgcgttgtctcttgcgatgttgttttttctttgttcttcttgtgctctattttaataaaggaagtttgttccaatctaaaaaaaaaaaaaaaaaactcgagggggggcccggtacccc

SEQ ID NO: 17815 - DNA, 1336 bp, Zea mays
cccacgagcggcggtggcgccccggactacaacgacgccgcggccgccaagtccccccgcaaaatggatggaggcaaggacagggacgactacgtggagcgcgacgagttcagcttcgggaacaggggcgcgatggacagggacgcgggcgcgggggacgggaaagccgcggcggcgggcggggaccccagcacggtggccgcgccgacggcgatgccgccgacgagcgtcatgacccggctgatcctgatcatggtgtggcgcaagctcatccgcaacccaaacacctactccagcctcatcggcgtcatctggtcgctcgtctgcttcaggtggaacttccagatgccggccatcgtcctgcagtccatctccatcctgtcggacgcggggctcgggatggccatgttcagtctcgggctggtcatggcgctgcagccgcggatcatcgcgtgcgggaacaaggtggcgacgttcgccatggcggtgcgcttcctgaccggtccggcggctatggcggccgcgtccttcgccgtgggcctccgttttttgcttcgccaacggcggaacgagcaggcagctctgcctagggcattgtccccttcgtcttcgcaaaggagtacaacgtgcaccctgacattctcagcaccgcagtcatttttggcatgctcatcgccctgccgatcacgctcgtctactacatcctgctcggcctgtgaccgacccgtgggtgatggcaatggcatgccccgcattgctgtaactgtaaagaccgctgctgccactttccgttcaagggaggcaagtgaggagactgtctgctacgacatttgcttggcgcttcaaaaatgagtggcttgtttctctctctcttctatctattttttattttttctctagaagtaggtgtgaggattgtatggatggaaagtgtgggaggtggacaagtcgcggtagctaggtaggacgacaatggtgaggcaaaacggaccaaaaggaggtgcaagtacaaaagcttgaagggaacaggagatccagtttaagcacgtcacgggatgggttggatatttcaacgggttcagggtattttggttggctgcgctgaccgatgtaaaatcagcgcgccattgtgacaggagatcgatcttgcttgagataaacagctcacctccggagtttgatggcttgagataagggctcaactcaaaatagacagaaatatataccgtatttgtcactgaaacaaatcagtcttttatacacttggtattttaaaaaaaattgaactttcttattcgacttggaaaaaaaaaaaaaaaaaaaaaaaagggcggcc

SEQ ID NO: 17816 - DNA, 820 bp, Zea mays
agtgacgtcctgacggggacgcgagagccgagaggctccagttgtttatataagaaaaaaaaaaggaagaccgaaaattctgattttttgttcccttcaccgacggcgaggagtgagggttgacaacgggatggcgcggagcgtatcgtacgtttcggcggcgaagctggtatccatggcgcgaggcaatccccgcctcgccatcatcgacgtcagggatgaggagaggagctaccaggctcacatcgcgggttcgcaccacttcgccagcggcagcttcgaggcgcggatgccggagctggtgcgggccgccagcggcaaggacaccctcgttttccactgcgcgctgagccaggtacgaggtccaacttgtgctcggatgttctcagactatctatcggagaccaaggaggattcagggataaagaacatcatggtactggagcgcgggtttaacggatgggaggtttcagggcagcctgtctgcagctgcaccgacgctcattgcaaagggacgtgttcttaagcacacgagtttatatctctcttaggccttgaacaaccaaggatcggcatggtctccgtttctcttgtcggtggttacttcacctcattaaaactcattaaaatgattgacacgcgacagattattgggttggcaactcctttgtgggaactgcatgcataactaccaccagaccactgtcagacataagacacttcacggtgtactgccaggtggcagtattcgtttcagaattcacagttttttgcttctgcaaaaaaaaaaaaaaaagccacccccacgcccctcagattc

SEQ ID NO: 17817 - DNA, 1314 bp, Zea mays
gacctgcagaattggagtactcctcagaggtgcatttgtttcccaatgcagtttttttttacttctattctttctcatagttagatcatgagcctttcatcaactagggggttggggcatagtgagaaaacgttagcaaaatcatctataaaaggtgcctatagggagtgcaacatcttgtgattttttaactgaatactggctgcatacttgaaaccctttccccatggcaaattgaataaataaactagagcctatctgcatttatattatttgggatgttttataatgtttacaggttacccaccactggtaaaaaaacaaccattgactaaaaggatattaggaataaaattttgtacctaaaaaaatgcaaagtgtattatggctttatctcgcattatttcattcaaattatattagctggcagttgttattgcggggtcgcgcccgtggcccgccgcagaggccaatgtcagtcccaatagccgtgtctatgtgagcaaggcccatgatgtcatgacaaatgtgattgcaaagggttcagcaatgagacaagacgcagtgaacaaggctaaagcatttgatgagaagcatcaatttagggctaatgcatcagcgaggatcaattcctttgataaacgtgttggcctttcggagaagataaacaatgggatatccgttgtcaatgaaagggtgaaatcagtagaccaaagattgcatgtttctgataaaacaatggctgcattgctggctgcagagcgcaagctaaatgatacaggctctgctgtgaaaaccaacaggtatgtgtctgctggaacaagctggctgaatggtgcttttagcaaggtcgccaaggctggtcatgttgctggctcaagaaccagggagaagttccagttggctgtgtcaaatctaacagccaaaggccctgctgttgttgcctgagggggatgctggttatggaagctctctttctgaggaaattctattggaagtccctgtgcaaaagcatttcctttgattgtgtggacagtgtggaaaataactgtgtttcagtgttatcttgtctgtctttccttagttgcaggctgttcggtgattcttttgaggtttggtgtatagatgcgttcagtttttggtattttagaaccccattcttttagtgttgaagttaaattgattataggtgatagtggcattctattgtattgactcaatctatgtggattcttcttgatcgttgatgcctatgcttcaccgcttctccccacactgttgctccaactgagaaaaaaaaaaaaaaaagcggcc

SEQ ID NO: 17818 - DNA, 1645 bp, Zea mays
ctcgaggccggccgggaaaaaaaaaaaaaagaggaacagagcagtagcatcaagagaccaagctggtggttgaggttagaagaggagctagagcgagagagtcccatcgcaacacacaaaaggaagaggaagaggaagaggaaggcgagaacgatgggcttgctcctgctgctcctcgtcgcggcggcggcgacagctcctgcggccgacgcatggggcaaggaggggcactacatggtgtgcaagatcgctgaggtaatagccgagagctttctgacgaaagaggcctcgacggcggtgaaggagctgctgccggggtgggccggcggcgagctcgcggagacgtgctcttgggcggacacgcagaggttccggtaccgctggtccagcccgctgcacttcgccgacacgccaggggactgcgagttcgactaccccacgcgtccggccacaacaccaaaggggagaagaacatgtgcgtggtcggagccatcaacaactacacggcggcgctgaaagactcatcaagtccatttgatccgacggagagcttgatgttcctggcgcacttcgtcggcgacgtccaccagcctctccactgcggccacaccgacgacctcggcggcaacaccatcgtcgtccactggtaccgaaggaagaccaacctgcaccacgtctgggacgtgaacgtcatcgagacggccatgaaggacttctacggcaacgaccagagcaccatgatacaggccatccagcagaacatcacggaggagtgggctgatgaggagaagaagtgggaggcctgccgtagccggacaaagacctgtgctgacaagtacgctgcagagagcgcgaagctggcctgcacggcgtacgagggtgtcgaccaagactccaccttggaagatgactacttcttcgccgcgctgccggtggttcagaagaggatcgcgcaaggaggcgtcaggctggccgcgatcctcaacaggatatttggtgggaacagcagatcaggcttcagagcagttgattgatcgatccatatccataccagtagtagatatcaaacgattggacatgtggaggagtgggtggggaggggcagacgtgatctgccatctgaattagaataataagaggtatcttgttgccgtctggcaatattgtaacttcagtcttcagtaaccactagctcacgaattttattatttcagaatcgaagcacttgtacgtactgtgcaatagaatagtgacgcggtcacattcgtattcctatatggctcccgcatctttccacatgcgcgcggagtcgaaatggctcgctattgtttatttgcgcccctccccgagacactcaccccgacgccctccgcctccgttccgaagccctagcggtctcatccggcacgcgctgccccccggccactaccccagccccgaccccgccccgtcgtcgcaacctcaccatccgccgtgctgtgtgccccctgtgccacaaaagctgcctcgcctcccttgcactcaactcccgtccagccaggcctcaccgccatcttcccgacaccacccgttcttccgaagccgcgccccgccgacgcccttgtccttccgccttcggcgccgcgactgacaccactcgtcacgt

SEQ ID NO: 17819 - DNA, 1250 bp, Zea mays
ccccgcgtccgcaagagaccaggctggtggttgaggtgagaagctagaggagctagagcgagagagtcccatcgcaacacacaaagggaagaggaagaggaaggcgaggacgatgggcttgctcctgctgctccacgtcctcctcgtcgcggcggcggcgacagctcctgcagccgacgcatggggcaaggaggggcactacatggtgtgcaagatcgctgagagctttctgacgaaagaggcatcgacggcggtgaaggagctgctgccggggtgggccggcggcgagctcgcggagacgtgctcttgggcggacacgcagaggttccggtaccgctggtccagcccgctgcacttcgccgacacgccaggggactgcgagttcgactacgcccgggactgccacaacaccaaaggggagaagaacatgtgcgtggtcggagccatcaacaactacacggcggcgctgaaagactcatcaagtccatttgatccgacggagagcttgatgttcctggcgcacttcgtcggcgacgtccaccagcctctccactgcggccacaccgacgacctcggcggcaacaccatcgtcgtccactggtaccgaaggaagaccaacctgcaccacgtctgggacgtgaacgtcatcgagacggccatgaaggacttctacggcaacgaccagagcaccatgatacaggccatccagcagaacatcacggaggagtgggctgatgaggagaagaagtgggaggcctgccgtagccggacaaagacctgtgctgacaagtacgctgcagagagcgcgaagctggcctgcacggcgtacgagggtgtcgaccaggactccaccttggaagatgactacttcttcgccgcgctgccggtggttcagaagaggatcgcgcaaggaggcgtcaggctggccgcgatcctcaacaggatatttggtgggaacagcagatcaggcttcagagcagttgattgatcgatccataccagtagtagatatcaaacgattggacatgtggaggagtgggtggggaggggcagacatgatctgccatctgaattagaataataagaggtatcttgttgccgtctggcaatattgtaacttcagtcttcagtaaccactagctcacgaattttattatttccgaatcaaagccctggtacgtactggggcatagaatagatgacgcggcccccccttccgtttcctatatggtccgcgaatctttccacat

SEQ ID NO: 17820 - DNA, 2026 bp, Zea mays
ctgcagagctttctgacgaaagaggcatcgacggcggtgaaggagctgctgccggggtgggccggcggcgagctcgcggagacgtgctcttgggcggacacgcagaggttccggtaccgctggtccagcccgctgcacttcgccgacacgccaggggactgcgagttcgactacgcccgtaagcttgaaccctgctggtatccattatgcaatgttgccgtttcatagagaattgagatcaggtggtccgtcgtcgtgtctgtctctccgttaacgcacaacaagctttgctacctgcctgcctggctatccatgtcgtggtcggccattattgatgcgaacacacttcgcttaaagatcgaaagctaataattaaggcattgggcgggcgagagtagctagctagctagcttgagatgcatggaccgtggctttagatggcacgccgctgtcatgccgtgcgtttactcgccagagaagcaaccggctggccggcgtctgccatgcagtgccagtgccagccaacgcaaacggttgggtcgttgtcgttggagttcgaggtccagacgacagtgttcgcgcgacagaggtacggtgttgggcgcaacaagtttcccatcctttgtaggatcgatctcgagggaatatatcctagcacacgcctccttccttgcttgcttgtatggttgggcaagcaagttaggctgcttgcgtcacacatgcatggtaatgcaaagcatataagcaacgaggttagttaggctgtttggttggtagcagaagcgatgtggcgcatgtaggtttcgtgtaccctttttacagatgctatttctgttctatcacaaaagaggtcagttggaaaaaaaaaaccttttctctggtcgatcagctgtgtagctagaacacaagaacagttattagctacacgcgatcgaggcccgcctgatggaaactgctgcatgcttgtgagtaggggactgccaacaccaaaggggagaagaacatgtgcgtggtcggagccatcaacaactacacggcggcgctgaaagactcatcaagtccatttgatccgacggagagcttgatgttcctggcgcacttcgtcggcgacgtccaccagcctctccactgcggccacaccgacgacctcggcggcaacaccatcgtcgtccactggtaccgaaggaagaccaacctgcaccacgtctgggacgtgaacgtcatcgagacggccatgaaggacttctacggcaacgaccagagcaccatgatacaggccatccagcagaacatcacggaggagtgggctgatgaggagaagaagtgggaggcctgccgtagccggacaaagacctgtgctgacaagtacgctgcagagagcgcgaagctggcctgcacggcgtacgagggtgtcgaccaggactccaccttggaagatgactacttcttcgccgcgctgccggtggttcagaagaggatcgcgcaaggaggcgtcaggctggccgcgatcctcaacaggatatttggtgggaacagcagatcaggcttcagagcagttgattgatcgatccataccagtagtagatatcaaacgattggacatgtggaggagtgggtggggaggggcagacatgatctgccatctgaattagaataataagaggtatcttgttgccgtctggcaatattgtaacttcagtcttcagtagccactagctcacgaattttattatttcagaatcgaagcacttgtacgtactgtgcaatagaatagatgacgcggtcacacattcgtattcatatatgttcgcgtatctttcagatcgacgtgatgagaaatgtcttagaaggatatttgaaggattcaaaaaaaaaaaaaaaaaatatccaggccggccgccgggcggaacggcgaatcgtcgtgcgccgggccggtaaagagccgctaccaagggggctggggcgcgcgttcccgcgcccccgggcgcgcgcgcggcgcgccggcccccgcgcccacctcctccag

SEQ ID NO: 17821 - DNA, 1133 bp, Zea mays
  misc_feature (984)..(984): n is a, c, g, or t
  misc_feature (989)..(989): n is a, c, g, or t
gaccaagctggtggttgaggttagaagaggagctagagcgagagagtcccatcgcaacacacaaaaggaagaggaagaggaagaggaaggcgagaacgatgggcttgctcctgctgctcctcgtcgcggcggcggcgacagctcctgcggccgacgcatggggcaaggaggggcactacatggtgtgcaagatcgctgagagctttctgacgaaagaggcctcgacggcggtgaaggagctgctgccggggtgggccggcggcgagctcgcggagacgtgctcttgggcggacacgcagaggttccggtaccgctggtccagcccgctgcacttcgccgacacgccaggggactgcgagttcgactacgcccgggactgccacaacaccaaaggggagaagaacatgtgcgtggtcggagccatcaacaactacacggcggcgctgaaagactcatcaagtccatttgatccgacggagagcttgatgttcctggcgcacttcgtcggcgacgtccaccagcctctccactgcggccacaccgacgacctcggcggcaacaccatcgtcgtccactggtaccgaaggaagaccaacctgcaccacgtctgggacgtgaacgtcatcgagacggccatgaaggacttctacggcaacgaccagagcaccatgatacaggccatccagcagaacatcacggaggagtggggctgatgaggagaagaagtgggaggcctgccgtagccggacaaagacctgtgctgacaagtacgctgcagaaagcgcgaagctggcctgcacggcgtacgagggtgtcgaccaagactccaccttggaagatgactacttcttccccgcgctgccggggggtcagaagagaatcgcgcagggaggctttaggctggccggggatcctcaccaggatattttgttgtcacccccacaacaggggggggggggggggtttgggcggttctcttcccangttanttgtccttacccatagccccctgtcgctaataccgtggtgcatcccgtcggtgaagtttccacacaatagcaaccttgtttactggccggcggccgcgacccgtggggtcgtctccgcccttccgcacggacctcgctcccgcc

SEQ ID NO: 17822 - DNA, 2117 bp, Zea mays
cgattgggtaccgggccccccctcgagtttttttttttttttttttggagtaaagaagataataaccgcagggaaaacattcattcatataacagaaattttaaacagttcaaaatgagaaaacaaataaaaagcaaaaaacaggaagaatgtgtgtgtagatccgccacctccgatcaagaacccaattacgagaacaacgctctgacggggagaaaacgaaacaagaacacagacacgcgaccaaataccaaactattgtaataaaactaacactgtcctttgattcacctgcggcagatagagttttgaggatggttcacttcgcacccttcttgacggcagccttggtaaccttggctccggttgggtccttcttgtcaacactcttgataacaccgactgcaacagtctgcctcatgtccctcacagcgaaacgtccaagtggtgggtactcagagaaggtctccacaaccatgggcttggttggagtcatcttcaccataccagcatcaccattcttcaagaacttgggctccttctcaatctccttaccagaacgcctgtcaatcttggtcaagatctcagagaacttgactgcaatgtgagaggtgtggcaatccaggactggggcgtaaccgttaccaatctgaccagggtggttcatgatgatgacctgggaggtgaagttagcagcacccttggcagggtcatccttggagttggatgcgacgtaccctctcttaagatccttgacagcaacattcttaacattgaacccaacgttgtcacctggaagtgcctcaagaagagactcgtggtgcatctcaacagacttgacctcagtggtcaaccctgtgggagcaaaggtcacaaccataccaggcttgatcataccagtctcaacacgtcccactggcaccgttccaataccaccaatcttgtagacatcctgaagtgggagacgaaggggcttgtctgatggcctcttgggctcgttgatctggtcaagagcctcaagaagagttggtcccttgtaccagtctaggttggtggacctctcaatcatgttgtcaccctcgaatccagagatgggcacaaatgggattttgtcggggttgtaaccaaccttcttcaagtaggaagacacctccttgataatttcatcgtacctggccttggagtacttgggggtagtggcatccatcttgttacaacagcagatcatctgtttgacaccaagggtgaaagcaaggagagcgtgctcacgggtctgaccatccttggagataccagcctcaaaaccaccagtggtggagtcgatgataaggacagcacaatcagcctgggaggtaccagtgatcatgttcttgatgaaatcacgatggccaggagcatcaatgacagtgcagtagtacttggtggtctcgaacttccagagagcaatgtcaatggtgataccacgctcacgctcagccttaagtttgtccaaaacccatgcgtacttgaaggacctcttgttcatctcagcagcctccttctcgaacctctcaatgacacgcttgtcaataccacccaacttgtagatcaagtgtccagtggtggtcgactttccagaatcgacgtggccaatgaccacaatgttgatgtgaaacttctctttacccatggttagagactgtcaaacaaatctcagagatatcgcaagagagtaaagcggctagggtgacgaaaaatgaagcaaggaataggggggggggggggaacaatggagctctctctctctatctccctcgtgccaaattcctgcaccccggggaatccactatttctaaagcggcgccccccgcggggaagctccagttttttgtccctttaagggagggttaatttccagctgggggaaacccgggcccaaccgggttccgggggggaaattttttacccgtcacaaatcccccccaaaaatacaacccggaaaaaaaaaggggaaaacccgggggggccctaaggggggggcaaccccccatttattgggtgtgcgccccagtgccccttttctccagggagaacaccgtgggggcgccctgttgttataataaaaacgcccacaccgg

SEQ ID NO: 17823 - DNA, 3804 bp, Zea mays
atctttgtttactttatgcattagccttagtagtagttttagacttagatgtagttccctaatctacaatcttcgtccctcttcaactctatgtcgtttaggggagttttggttagtctgccgatattaaaacaacatcaagatttttactctcgacaaggttcccaagtgacgaaatcttggtttctcatcgcggatggtcagtgtgcaaatttcaggttcgtttggcgtttggaaaaagaaagcgtacgcggatgaaaacgtaaatactgccgaatccgtcttgcctcccgccgtaattacatcaacaactatatcttgttttctttatttttttgagccagctcacctatatgacatggcatatcatataccagtcggttactatcacagtatcaccacccgtcccgaatcgatatatagccgaacacgaaccggcagtcctcaaatacagttgctgcaccgcaaccccgcgccaaagccagcgcggccaaacgacgtgacgaccaaacgaagcaaccaggcgccgaaaaggatagccgaagtgcgaaacccaacagcaaggagaaggcgaggggaaaaaagaaagaaaaggcgcatcgaaaaggcaaagagcgagctccctctacccgcgatccccgcacaccggccgccggcgttcgtcgccgccgcggatgagatgcgctccccctccggcggcggcagcgtggtggcccgcgcacgttcgtgaggggccctccgccacgcgcccaggttactgtggctccgagtccgagttcgctccccgcgcccgcgctatcgccgcggggcggagcggatcccccaacatgtggcttttctggcgcactaggaatcgcttctcccttgaggagctccggtatctaacagatcagctacaaaaggttcatgttgtcaatgaagctaataaggaatttgtgattgaagcattgcgatcaattgcggaacttatgatatacggtgaccagcatgatgctttgttttttgaatattttatggagaaacagatcatgggtgagtttgctcgtgttctaaggatctcaaagctgtcaagagtgtcactccaattgctacagacaatgagtatcatgatccaaaatctgagaaatgaacattcaatttattacatttttagcaatgagcacatcaacttcttggttacgtacccattcgattttcgaattgatgagatgttatcgtactacatatcttttctgcgggcgataagtgggaagttgaacaagaatacaatttctttgctcgtgaagacgaaaaatgatgaggtcacttcctttcctctttatgttgaggccttaaagtttgcttttcacgaggatagcatgattcgagttgctatacgtaccttgaccctcaatgtctatcacgttggagatgaatctgttaacagatttgtttcccgcacgcctttatcagattatttttcagacatggttcagcattttcagaagcagtgcattgacttggataagttggttgcacgctcctcacgaaagggaaattcttctgtgccaatatcttctattgaagatgcaattgtgcaaattgaagacacactgtattatttcagtgatgttatgtcttctggtattcctgatcttgaaaggttcatcactgaaaatatcttgcgagttctggtatttcgattcttactcccgtcactgcagaggcagagcacagatttggacttaagtgtcactacatccatgtatctactttgttgtatactacacatttttaagaataaggatatggcaagtactgtagctgctgccctttttcatcaacctgatggccctgatgataggaagcaaaggacacctaatggatatacatctgagcatgatagttgcaaatctgagaatcattgcaccactgcctctggtatcgagcaatcaagtgaggagccaaattctttgtcttctgttagttggaaacacttgcccaacaattcatcgcgaagtgattgctgccaaggaaacacaccaagggaacacttgctgtcctatatcacagaaggagatgattcacaagctttgggttcattgtgcttattcgctacattattgcagacgaaagaacttgatgaatcaatgctggatgcccttggaatcctccctcaaagaaagcagcataagaaacttctattacaagctttagtaggtgaagaccttgctgaaacacaattattttcgtcaagcagcagtctaactgatgacagcatttgtagtgattttgatatttatgtaaggaagcttcaggataaatatgggctacaatgtcaccatccacggcaaatgacttccaaagctcacagatatcaggtgctcgatgctttagtcgaccttttctgcaggtcaaaggtttctgcagatgttcgtttggttggtggctggcttttccggcaactgctgccccatggagaggaagagttcactgcttttcatctaagacgactaaaggattcacacaaggattgtagctcaaagctttctgaggaatctggaggatgctggtgtgacatgcttcttcctattgttaaagaagcttggaggaactgcaagaaagcaattgaggcatcttcgccaccaaaaggatccaaatctattattgtacccatggatttgtgttcatttgaaggtgattcttctgttgccatcgcagaggcactctatgagatggttaagggttttgtgctgcagcatcaagttatactcttctgtcttggagaaactttcacagagctacctcctatttaccctctggttgatttgcctataaatactagggcaagcgctgcagattttggtggttcagttcctaaacctgggcttgaagtcaacttagtcgacgctgttccttgtcgaatagcatttgagaggggcaaagaacggcacttctgctttttagccatagctcatggaacttctggttggattcttcttctagaagaattacctctaaaacgggaacgaggaattgtccgtgtcatggcacctttggcaggatctgatccaagaatagatacaaagcatgggaagtggttacatctacgcattcgcccttcttcggtcccttttttggacactgagaagcataaagcgaagacaaagaagtatcttgttgatgggagatggacccttgcttttagggacgagcagtcctgtaaggttgcagagagtatggttattgaagagatgaaactccaacgaggtgctgttgcagagcaattgaagccattggttgaatttgacatgcctgaggatggaatgcagcacccccagacttcacatgaaaccccttctgatgatggatcatgactaaattttcatcaagtgcagtgttgagcttctcaattaaggagacatggcaacagatggccgcaaaagtgccgcattgaacatttcaagcatgctggcaggaaaacccaccatggcaagtcatcgacaattctgtacattacattgggagattagagatgtctccttgttaacacacaactgtagagtttcgggccgtcctgagttgaactagctggataggattctttgtacaatagtttgtttctctccttgcccgttgtaaccttatatatcacatcaaaacccattctttgttaagtttcagggcacagttgtgttgtgcacacgaaatgtttaaagaaatttgcagttagtcatacctgttgtcaaagcaagccttgcctatgtggtaataaaatgtcagatcgataatttttcttggaaaaaaaaaaaaaaaaaagcggcc

SEQ ID NO: 17824 - DNA, 800 bp, Zea mays
  misc_feature (9)..(9): n is a, c, g, or t
  misc_feature (30)..(31): n is a, c, g, or t
  misc_feature (766)..(766): n is a, c, g, or t
ccagtgaantgtatacgactcactataggnncgattgggtaccgggccccccctcgagttttttttttttttttttttgatgtcaaaacacacaaatttcaaatggaaacgtaccaagaaaacaaacaagacagaacattaaaatcactagtgatcatcattataacaatcaagcacacaccaaatacataaaacgaaagtatagtcttcaaagagcacaggcaggctcaaacgcgaagggaccaacagagaagagaacgtagtcgtgttcaccgatgttgattctcttagaaggcttaagcatagcaccggttattccattgttgagctttgacggcacggtgcatgtcatcgttgcagtcgtgggtccaggattcgtaggccaagcccggcacgtgtggaaagcgtaggtggtgagtttttttggggctagcatgaagaagtatccgtttttgtctgtttttgtctccattgtcacacctctctttgtgttgttgcatgcaagctttacggtcgctccttgaagaggagatgcttccaagagagtatcgacgccggaatacttgcatgacttgcaataaaccatgccttcaactgccacaagtctcctgctcatcttagccggcgatgacggtggagtcattggagaagcggatgaaactgcattggtgtagatgaaagtcaaggaaatagaaaggagtaagagatatttgagagcttttgttaccagacccatttttgttctttgttagtaaaaaagatcccncgggtgtttaaacacaataaagtgggaacgtgga

SEQ ID NO: 17825 - DNA, 1069 bp, Zea mays
attgggtacctcgaggccggccggggagttgttcaacgaaccaaccagcctagcgacgccgacgccgccacgtcccaacgaaaaagaaacaaaaaagaagaagaggacagactgccagagtcatggcggccacgagctccgcctgcgcgtgcgcggcggtagcgctcgcgtccttcccgtccgccgcctccacctccgccccttcccgcgtctcggccagcagccaccgcggtcagcggcactccagggccgccaccgtcagatgttccagcacgtcgcccaacgtgtcccagggcgcgccggcgccggcgccgcccaagccgcaaatcgagctcgagttcgtcgggccgaagcccggtgccgacggctccttcccggtggaccgggcggaggcgaccagcggcgagaagctcctccgtgacgtcatgaacgagaacaagatcgagctctacgccgcatacggcaaggtgatgaactgcggtggcggcggaagttgcggcacttgcatcgtcgagataatcgatggaaaggagctcctgaatgagaggacgaacaccgagaatcggtacctgaagaagaaaccagactcatggaggctagcttgccagactattgtaggcaacaaagagaactctggcaaggttgtggtccaacggctgccccagtggaagagatgaccgtgcagtgcagcaccacgttggtggatgatcgatcgtccagttgtatgtcactaaaacgccatgccctgtgcattagagaagagacagaatcacctcgtcatatcgcttgtgaccagttctctgatactagtttgcaagtctgggcttcggtccacagtatatatgtgggatatatatctgtaaacaaaaaaaaaacaagaaggcagggcatgttgggatatatatctgtaaacaaaaaaacaagtttgggcttcggtccacagtatataagctgttttcacaaacggagaccagagtaccccggtgtatgttggtagctttctgaaagaaaaaaaaacaagaaggcagggcactagaattttcaggcccttcaaaaaaaacacccacac

SEQ ID NO: 17826 - DNA, 2117 bp, Zea mays
ctagactttgctacccaccagcaccagtgcaccacggcaccacccgacggtgacggtgatggattccccctcccccactcggcgccgtgccgtcgataccgacgccacggagattgggctgtcctccataattcggactgctcttatttgctcctacgcgcttatagtggccgtccatcatcattaatcatcaatatagatgattggcgctctactgactgtgcctagcgtgcgtggcaattggacccaattttttctcccgaaatggacggcccaatccacgtgctcctgtcgctcggccacaaatatcgtccggggggagccccctggcgcgtacgtttccatatgcactgtacccgtggcataccaaaccataccataccagtggtgcgtcgtgcgtggttgcggccgtcacgtcagcacgcacgttgcatgtctgcccttgggggcgaccacgcacgtcgatgtaacgaccgatacagcagtactcgtcgaccatcatacatacatacacacagttattaactaacaaccatcatacagctagcagtgcatgcgttgatccattcgtcaatctctctgctgtttcccgcacaccaggttggcaagagggcgaggagcaaggaagcggactacgcggtggagagcatcggcgcgctccggcgggccatcccggagatctggggcgaggccgctgaacgctcctccgacaagctgccggtgccggccgtgagcgtggtgaggtcgacgacgtccgacctggactccatcatcatccagcccacgtccatccacgcctaatatataacctcatcgtccctagctccccacccccaatcagaatcagcgggtgcgtgcgtgcgtgtgtgaatatctctctctctctctctctctctctctctctctctctgcctgcctgcctcacaggctgaaaggcgtgtacatttctgatcagcaccaccggtcgcccgtcggtgcgcgcgtgcatgtaaagcaggcaccaccagctgcagcccaagtgcgtgcatgagcatgacgagtcatgcaatgtgttgtacgtattttacatgatgataagaataacaaaccgtgtttagctgcagagacccgagcagcggttttaaccaaaaaaaaaaaaaaaatgtggagcacgaatcggtgcgtgcgtgcgtgctagcttcatcgattcatacgtctatgcggtgcgcgacacgcgcggcgggtgggcgatgacgcgcacgcctgcagatggaatgaggtgcgtcgttgcgtgcgttctacttcaataaactacgccatcgatctcctggctggcaacggtcgccacgcatgcatgtttgtctattctccgtccgtcaccctcgcgctgtcgtcgctatccacacggtcggcctcaccctcgcggatcacgtcgcggtcgccgtcgccaccaagtcatcgtcgcgtcggcgcgacagcgagggcgcacgcgcgccacgctcagctcagacgagggatacgacgacctggccttatcggctctgatagcgtgcctagccggatcgtatagagggatacaactgtcagtcacggttcttgtccgcccgattgcatcccgatagccttctgctcggagcctctgtccgtctgtctgtcgtgtaccagtaaaatcagtgtgtgggcgtcgcgtcctggaccctggacgtctggagtatgtgcgcgcgcgtttctgatggctgctgctgccatcgtcaaaatcggtgtgggagatgttgagcttgagcgtgcacatgcatgtccaggtccaccatgtatttattttgccatcgtcaaacaggttctagagcagttcgattctgtgtataaccgggccgcttaaattttttttaaaaatatttctcgtagctgctgcatctggcagcttccaaaaataaggatattctttatagatgttccatctattctagcggctcagtggctcactaaaatcgacagggcataatgacacgctaccggctactccctcgtcccattcagagcttgttcggttatttacaatccatatggattggaggggattgatacggattggagagaattttgacttactagggattgaaaccccctcaatccatatg

SEQ ID NO: 17827 - DNA, 1478 bp, Zea mays
acgttgagcagagctcgcggcgcaaggaacacgaggccgcgctaaaaactgctcctactccgggttgtagcgtgcttcacgcacgcacgttgctggataggtttgccgcgcgcgcttgcttgccccgtggtccacgcggccggcggcacccgcgcctcgcccgacgctctatttaacattgggggccccccggcccgccgccgccgatctctctctctctcgttctgctcacatcgacgcggttcggttccagtttcactcccactgccgtctcggcaacctcccctgttccacgcttcgtcctcgcctgccaggctgccatggccgcgacgtcccccttcgactgcgtcctcctagacctcgacgacaccctgtacccgggcgacaccggcatcggcgcggccctgaggcgcaacatcgacgagttcctccaggccaagctcggcgtgtcggccgacgaggccgccgccacgcgcgccgagctcttccgcgcgcacggcagctccctcgccgggctcatcgcgctcggctacgacgtgcacccggacgagtaccacagctacgtgcacggcaggctaccgtacgacaggatcgcgcgcgacccgcagctggcgcggctgctgcagagcatcccgcagcgcaaagtgctgttcaccaactcggaccgcgcgcacatggagcgggcgctggagcggctgggcgtggacgaggccgccttcgacgccgtcgtgtgcttcgagaccatgaacccgcacctgttcggcgacgacggtggcgaccggcgcccggccgtggtgctcaaaccggcggtggacgcaatcgtcgccgggctgcgcgccgctggctccaacccacgccggacgctgttcctggacgacagcgagaggaacatcgccgcggggaaagcgctcggcctccgcaccgccctggttggcaagagggcgaggagcaaggaagcggactacgcggtggagagcatcggcgcgctccggcgggccatcccggagatctggggcgaggccgctgaacgctcctccgacaagctgccggtgccggccgtgagcgtggtgaggtcgacgacgtccgacctggactccatcatcatccagcccacgtccatccacgcctaatatataacctcatcgtccctagctccccacccccaatcagaatcagcgggtgcgtgcgtgcgtgtgtgaatatctctctctctctctctctctctctctctctctctctgcctgcctgcctcacaggctgaaaggcgtgtacatttctgatcagcaccaccggtcgcccgtcggtgcgcgcgtgcatgtaaagcaggcaccaccagctgcagcccaagtgcgtgcatgagcatgacgagtcatgcaatgtgttgtacgtattttacatgatgataagaataacaaaccgtgtttagctgcagagacccgagcagcggttttaaccaaaaaaaaaaaaaaaaaaaaaaa

SEQ ID NO: 17828 - DNA, 1276 bp, Zea mays
ctccgatctccctctctctcgttctgctcacatcgacgcggttcggttccagtttcactcccactgccgtctcggcaacctcccctgttccacgcttcgtcctcgcgttcccaaccaagctctcccgcctgccatggccgcgacctcccccttcgactgcgtcctcctagacctcgacgacaccctgtacccgggcgacacgggcatcggcgcggccctgaggcgcaacatcgacgagttcctccaggccaagctcggcgtgtcggccgacgaggccgccgccacgcgcgccgagctcttccgcgcgcacggcagctccctcgccgggctcatcgcgctcggctacgacgtgcacccggacgagtaccacagctacgtgcacggcaggctaccgtacgacaggatcgcgcgcgacccgcagctggcgcgcctgctgcagagcatcccgcagcgcaaagtgctgttcaccaactcggaccgcgcgcacatggagcgggcgctggagcggctgggcgtggacgaggccgccttacgaacgaccgtgtgtgcttcgagaccatgaacccgcacctgttcggcgtcggcggtggcgaccggcgccggccgtggtgctcaaaccggcggtggacgcaatcgtcgccgggctgcgcgccgccggctccaacccacgccggacgctgttcctggacgacagcgagaggaacatcgccgcggggaaagcgctcggcctccgcaccgccctggttggcaagagggcgaggagcaaggaagcggactacctgtggagagcatcggccgccgctccggcgggcatcccggagatctggggcgaggccgctgaacgctcctccgacaagctgccggttgccggcgtgagcgttggtgaggtcgacgacgtccgacctggatccatcatcatccagcccacgtccatccacgcctaatatataacctcatcgtccctagctccccaacccccaatcagaatcagcgggtgcgtgcgtgcgtgtgtgaatatgtatcgtatctctctcgctgctgctgatctcaggctgtacattctgatcgacaccaccgtgtacatttctgatcacaggccagccggcggccgtcggtgcgcgcgtgcatgtaaagcaggcaccaccaccagcagcccaagccaggtgcgtgcatgacgagtcatgcaatgtgttgtacgtattttacatgatgataagaataacaaatcgtgtttaggtgagacccaaaaaaaaaaaaaaaaaaaaaaaaaaaaaaa

SEQ ID NO: 17829 - DNA, 2455 bp, Zea mays
  misc_feature (2401)..(2401): n is a, c, g, or t
  misc_feature (2429)..(2429): n is a, c, g, or t
ttatacccgaattcttagttatcgaactatggattcgatctttgtaaaagaaaaatgtatttagaattcaaagtgaaggatgactttgagacttcgtatcaccgtacgtacagacgatgaaattacgtttcctttctagaaataccggtgctcgctcatgggctataataaccaactatcgcagctcccgttgactttgttgtatagatcacggtggcaatcctgcaaaattgaggcagaactggtggcacctttagatgtagtaagtatgacgatcgacggttgaagtgtcgcttcccacagctaaccctccgtgcccttctctggcgggccgtccccgcatatttatcgcaacaaccccggccccccccgggccaccaccgtagcctgtagcttcatccgttgcgctgcgcccggttccctcgcgcggtgcggaatttaacatggccgtgccggaggtggtggtcgacggcgtcgtcttcccgccggtggcccgcccgccgggctccgccggctcgcacttcctcggcggcgcaggtgcgtcgcgttgcgttttgagggtccattcccgtggccagtctgtctctagttcctgtagtacaagggagcggtacaactgtagttggtggcgcagagtatggcatggcagcttccggttgacctgacccttctttggcttggcccgccgcgcgtgcaggcgtgcgaggcctcgagatcggaggcaacttcatcaagttcacggccatcggcgtgtacctggaggacgcggccgtgcccgcgctggccaagaagtggggcggcaagacggccgacgagctcgcctccgacgccgccttcttccgcgacgtcgtcacgggtgagtgagaggttctcgcgcgtgagtgatggtcaacagtcaacactgctgatggtgttgtgtcattgtgtgcccgtgcgtgtgtgtgcgcgtcaggcgacttcgagaagttcacgagggtgacgatgatcctcccgctgacgggcgagcagtacgcggagaaagtgacggagaactgcgtggcgttctggaaggccgccggcctgtacacggacgccgagggcgtcgccgtggagaagttcagggaggtgttcaagccagagactttcgcgccgggcgcctccatcctcttcacgcactcgcccgccggagtcctcaccgtgagtaccaatctgctgtcccctatctttctctcttttcatttccgtctactctcaagctgctgctgctccgatccgatccgatccgtcccgttccatccaggtcgccttctccaaggactcgtcggtgccagcggccggcggcgtggcgatcgagaacaagcgcctctgcgaggccgtgctggagtccatcatcggggagcgcggcgtgtcgccggccgcgaagctgagcctcgccgcgagggtgtcggagctcctcgccaaggagaccgccgcgcccgccgacgcgccgcaggcggagcccgtctccatcaccgcctgaggcgaggagcgggcgggcgagcgaacgaaccgcgaggagaaagaaagcaaccacgacggttgggcggcacggcgtctcacacctgccgcctgcgcttgcgtgctccggaccggagagatgccgcgcgggtgcagtgcagccgtcgcgtcatgtctgtccgcgctctggcgtcgtgttcctgcctttctggtcgcgtagttgtcttgtgttcgctgttggtcgttctgggtaacatttgaataaaacaagcggatttgttgcacttgcacggttgcaccctctaattccccagcatgtgtggatcaattgactctcagccagagcctgtcggagattgcttattatgacggcgagactaatgacggttcctgctctacgttttcttgtaacgctagggataatcttctctgcttacatctgacggcgacgagaactagaaaaacctgccctcctcaaaaatttacgagctaactccaaaagaagcactaaactaacacgcaaatcaatagtagaggagaaatcatgttttcccccaacagctccctcttctcccccaccccaaaaaatattcaggtcctgcatccgtgtctccccttatattttgcgtgtcttgattgctccttgaatctgtacacccacatttgtctcccgtgttttttttttttgccgtgtgcgaggtgatgccaggctgcgacactcgagcatggtgcccccctttgtggagcttttagcagtggtagaggtgtttttttttaatttgacacattttcagtttttagcatttgtttaaaggaactgttggagtgtgcacgttaagagcacccctgaaatttattaacctgtcacaataatcattttttcgggggaaactttttggcatgcttttggagctgctctaagacnttaggtggagtgaactgttaagaaaccntgatgaagggttatgtgagcaaatat

SEQ ID NO: 17830 - DNA, 786 bp, Zea mays
cattgggtacctcgaggccggccggggcccttctctggcgggccgtccccgcatatttatcgcaacaaccccggcctgccaagtgccacaaccgtagcctgtagcttcatccgttgcgctgctcccggttccatcgcgcggtgcggaatttaacatggccgtgccggaggtggtggtcgacggcgtcgtcttcccgccggtggcccgcccgccgggctccgccggctcgcacttcctcggcggcgcaggcgtgcgaggcctcgagatcggaggcaacttcatcaagttcacggccatcggcgtgtacctggaggacgcggccgtgcccgcgctggccaagaagtggggcggcaagacggccgacgagctcgcctccgacgccgccttcttccgcgacgtcgtcacgggcgacttcgagaagttcacgagggtgacgatgatcctcccgctgacgggcgagcagtacgcggagaaagtgacggagaactgcgtggcgttctggaaggccgccggcctgtacacggacgccgagggcgtcgccgtggagaagttcagggaggtgttcaagccagagactttcgcgccgggcgcctccatcctcttcacgcactcgcccgccggagtcctcaccgtcgccttctccaaggactcgtcggtgccggcggccggcggcgtggcgatcgagaacaagcgcctctgcgaaggccgtgctggaggccatcatcgggggagcgcggcgtgtcgccggccgcgaagctgagctcgcccgcgagggtgtcggagctc

SEQ ID NO: 17831 - DNA, 1177 bp, Zea mays
gcacgagggctaaccctccgtgcccttctctggcggcccggccccgcatatttattcttgggtacctcgaggccggccgggtgccacaaccgtagcctgtagcttcatccgttgcgctgctcccggttccatcgcgcggtgcggaatttaacatggccgtgccggaggtggtggtcgacggcgtcgtcttcccgccggtggcccgcccgccgggctccgccggctcgcacttcctcggcggcgcaggcgtgcgaggcctcgagatcggaggcaacttcatcaagttcacggccatcggcgtgtacctggaggacgcggccgtgcccgcgctggccaagaagtggggcggcaagacggccgacgagctcgcctccgacgccgccttcttccgcgacgtcgtcacgggcgacttcgagaagttcacgagggtgacgatgatcctcccgctgacgggcgagcagtacgcggagaaagtgacggagaactgcgtggcgttctggaaggccgccggcctgtacacggacgccgagggcgtcgccgtggagaagttcagggaggtgttcaagccagagactttcgcgccgggcgcctccatcctcttcacgcactcgcccgccggagtcctcaccgtcgccttctccaaggactcgtcggtgccagcggccggcggcgtggcgatcgagaacaagcgcctctgcgaggccgtgctggagtccatcatcggggagcgcggcgtgtcgccggccgcgaagctgagcctcgccgcgagggtgtcggagctcctcgccaaggagaccgccgcgcccgccgacgcgccgcaggcggagcccgtctccatcaccgcctgaggcgaggagcgggcgggcgagcgaacgaaccgcgaggagaaagaaagcaaccagacggttgggcggcacggcgtctcacacctgccgcctgcgcttgcgtgctccggaccggagagatgccgcgcgggtgcagtgcagccgtcgcgtcatgtctgtccgcgctctggcgtcgtgttcctgcctttctggtcgcgtagttgtcttgtgttcgctgttggtcgttctgggtaacatttgaataaaacaagcggatttgttgcaaaaaaaaaaaaaaaaaagcggcctcgaaaaaaaaaaaaaaaaaaaaaaaaaaaaaaaaaaaaaaaaaa

SEQ ID NO: 17832 - DNA, 1191 bp, Zea mays
cattgggacctcgagccggccattgggtacctcgaggcctgccatgtgccacaaccgtagcctgtagcttcatccgttgcgctgcgcccggttccctcgcgcggtgcggaatttaacatggccgtgccggaggtggtggtcgacggcgtcgtcttcccgccggtggcccgcccgccgggctccgccggctcgcacttcctcggcggcgcaggcgtgcgaggcgtcgagatcggaggcaacttcatcaagttcacggccatcggcgtgtacctggaggacgcggccgtgcccgcgctggccaagaagtggggcggcaagacggccgacgagctcgcctccgacgccgccttcttccgcgacgtcgtcacgggcgacttcgagaagttcacgagggtgacgatgatcctcccgctgacgggcgagcagtacgcggagaaagtgacggagaactgcgtggcgttctggaaggccgccggcctgtacacggacgccgagggcgtcgccgtggagaagttcagggaggtgttcaagccagagactttcgcgccgggcgcctccatcctcttcacgcactcgcccgccggagtcctcaccgtcgccttctccaaggactcgtcggtgccagcggccggcggcgtggcgatcgagaacaagcgcctctgcgaggccgtgctggagtccatcatcggggagcgcggcgtgtcgccggccgcgaagctgagcctcgccgcgagggtgtcggagctcctcgccaaggagaccgccgcggccgccgacgcgccgcaggcggagcccgtctccatcaccgcctgaggcgaggagcgggcgggcgggcgagcgaacgaaccgcgaggagaaagaaagcaaccagacggttgggcggcacggcgtctcacacctgccgcctgcgcttgcgtgctccggagtccggactggagagacgccgcgcgggtgcagtgcatccgtcgcgtcttgtctgtccgcgctatggcgtcgtgttcctgcctttctggtcgcgtagttgtcttgtgttcgctgttggtcgttctgggtaacatttgaataaaacaagcggatttgttgcaaaaaaaaaaaaaaaaaaacccgcccgcgtcgctcaattgactctcagccagagactttcggagattgcttacagaaaaaaaaaaaaaaaaaaaaaccccacacaat

SEQ ID NO: 17833 - DNA, 1030 bp, Zea mays
ccgtacacaaacaaggccgtagcccgcagcttcgtctgttacgctacgtccggttccccaccgcgccgtgtgaaaaaaatggctgtgccggaggtggtggtggacggcgtcgtcttcccgccggcggcccgcccgccgggctccgcgggctcgcatttcctcggcggcgcaggcgtgcgtggcctcgagatcgaaggcaacttcgttaagttcacggccatcggcgtgtacctggaggacgcggccgtgccggcgctggcgaggaagtgggccggcaagacggccggcgagctcgcgtccgacgccgccttcttccgcgacgtcgtcacgggcggcttcgagaagttcgcgccggtgacgatgatccgcccgctcacgggcgagcagtacgccgggaaagtggcggagaaactgcgtggcgtacgggcagccgggccggcctgtacacggacgccgagggcgtcgccgtggagaagttcaagcaggtgttcaagccccatacgttcccgccggcagcctccatccacttcacgcactcgcccgccggagtcctcaccgtcgccttctccagggactcgtcggtgccggttgccggcggcgtggcgatcgacaacaagcttctctgcgaggccgtgctggagtccatcatcggggagcacggcgtgtcgccggccgcgaagctgagcctcgcgggcgagggtgtcggagctcctgaccaaagggaccgccgcagccgcagccgcgctgcgggcggagcccgtctcggttaccgcctgagcggtccagcgaaccgcgaggagaaagagaaccgatcaagcaatcacgtctgccgcccttgcgtgctcctgctccgaacagatgccacgacggacggtgacgctgtcgcgtctgtttgcgctgtggcgttggcgtcgtgtctctgcctttctggccgcatgtgttcgctgtggtaacatttgaataaaagaaaacgcagatttgtttgcactgcacccccttaaaaaaaaaaaaaaaaaagcggccagcggcc

SEQ ID NO: 17834 - DNA, 934 bp, Zea mays
tcttccttttacttttttctgatatttctatcgggtacgtcccgggccgcgagcgagtgccgccccgcccgcgctatccactcgtctctccgtccccatggccacttatctcaacgcaccgccggcagccaccacgacgactgcaagctgccgccatgccttctccggtggcagcctccgtctactccggccgagccgaccgacgctgcacgtgacgtgccaagccgccgcctcctcccagcagccgtcgtccccgtccaggaggtcagcctgcctcctcggcatcgcgtgcgccgtcctgctccgcccacgtgccgcctccgccgccgaaaccgacgacgagccggccaacaacggctggtggctgaccgagttccccttgcccgtgcccaagatcgtcaacaaggagatcaacaacgcggagacgggcacgcgctccttcctcaagaacggcatctacatggcggacatcgggcccagcttcgcggcgcacgcgtaccggctgcgcagcacggccttcgacctgctggcgctggaggacctgctgggcaaggacgcctccaactacgtcaacaagtacctccgcctcaagtccaccttcatgtactacgacttcgacaagctcatctccgccgccgaagacaagccgcccttcgtcgacctcgccaaccgcctcttcgacagcttcgagacgctccaggaggccgtcacagccaaggacgacgccaggatcggcgaccgctacgccgagacaaagctcatcctccaggagctcatggccaagatggcctagcagaaccacaatttttcattcatatatcatgatgtgtaaatgaatacttgaaactcacaaggggtattgcagaattcccagagcagggaaatacaattatcatgtcaaaaaaaaaaaaaaaaaaaaggccccccccccacc

SEQ ID NO: 17835 - DNA, 1370 bp, Zea mays
gattgggtacctcgaggccggccggacaaattccatggtctttttttcttttcattcactgctgcttccagtttcgcgtccgactgctcgctccctgcccttccctctacctctctccctagggtttctacctcgcgcccgcttccgactagcagcgctagcgtcgcctaactccgaccgaggggacaacgagggttttgggacggacggtgggagatttgaaggaggcagcggagggccggagaccagaccatgaggccggtgttctgcggcaacttcgaccacgacacccgccagtacgacctcgagcgcctcttctccaagtacgggcccatcagccggatcgacatgaagctaggctatgctttcatttactttgaagatgagcgtgacgcagaggatgctataaggcgtctcgacaatgtgtcttttggttacaaccggcgcaggctctctgtggaatggtctaggcaagttgaaccggtgccaaagagccgtgataggcctactggggatgtaaagccaacgagaaccctctttgttatcaattttgaccccatacgcactaaggttcaagatattgagaagcatttcgaaccgtatggcaagattgccaacattcgcattcgaaggaactttgcgtttgtacaatatgagacacaagaggaagctagtgccgctgttaagaacactgacaagagcaccatattggacagggtagtgaccgttgaatatgccttccgggatgatgacggcgatagagatgaccgatacgacatccccaaacaaggtgcttatgacaggcgtggtggtagcccctacatgcgctcacctagcccaaggtaccgaagggactacggtccagattatggtcggcgtggacgttatcctggctatggtcgccgtgatggagcaatgtatgaaaggcgaagccctgtatatgatcgctacggcgggggcagaagccccgcttatgatcgctatgacaggaggagaagccccggttatgatcaatactagtccggtcgattctgaggaacccagtaaggaagtagtttccaaggaagaggtggcgagcaacaacatgatttttgccacgccaagtatacctggaggagccgtggtgtcccaagtatgtctgagtgtagtcatggtaacgcgatgctggttccctggttgttgattggaacgaaacctaagcgtctgaaagagattggtttgcatggattgcttgccattgccaccttgcctgttttgaagtgtaacctttgctggtgaatgtaatggctgtcgactaacttgtacaccgtacctttgcgtgcccattttttaggcgggtgaacttttaaaataaaaaaaaaaaaaaaagc

SEQ ID NO: 17836 - DNA, 1941 bp, Zea mays
tcgaggccggccgggccgggaatccgcccagcacccgcacctcgtcagtcgtcaccgagaagcagaagcagcagctgctgcctgctggtcgttcgttcgcctcgttctctccgcctccccccccacccccgcctcgcttcctcctccgcgcttccttcgccgaggcgtaagcgtcagcgagggcgtataaatcgctcccctccgcacattcgccaccgcctctccgctcctcgacaagaccaatggcggctgctgcgtcctctgctctgcacgccgttggcgccgtcgcctccgccaagcctagatccgtcgtccccgcggtggcgacgaggaggagcgtgcgcgtggcgcccgcggccaagcgaggaccaggctcgggaggaggcaggctcgtggctcgcagcgccgttgcagccaaggcggatgaggcggccgcggcggcgggatccaagtcaggcggccatgagttgctgatgtttgaggcccttcgtgaagccttgatagaagagatgaatttggatccaacagtgtgcgtcatgggtgaagatgttggtcattatggaggttcatacaaggtgaccaaagggttggctgagatgttcggagatctccgggtccttgatacccctatcgccgagaactccttcactggcatgggagttggagcagcaatgaaggggctgaggcctgttgtggaaggcatgaacatgggcttccttctccttgcctacaaccagatctcgaacaactgcggcatgcttcattacacctcaggcggccagttcaagatcccggtcgtgatccgaggccccgggcggtgtcggtcgccagctcggtgccgagcactcgcagcggctagagtcgtacttccagtcgattcctggccttcagatggttgcctgctccactccttacaacgcaaagggcctgatgaaggcggccataaggagcgagaaccccgtggtgctgtttgagcacgtcctcttgtacaacctgaaggagaaaatccccgacgaggagtacatctgctgcctggaggaggcggagatggtgcggccaggtgagcacgtgaccatcctcacgtactcccgcatgaggtaccacgtgatgcaggctgccaagacgctggtgaacaaggggtacgaccccgaggtcatcgacatcaggtcgctgaagccgttcgacctgcacacgatcgggaactcgatcaagaagacccaccgcgtgctgatcgtggaggagtgcatgcggacgggcggcatcggcgccagcctgcggtcggccatcatcgacaacttctgggactacctggacgcccccatcatgtgcctgtcgtcgcaggacgtgccgaccccgtacgccgcgacgctggaggacgccaccgtggtgcagcccgcgcagatcgtggccgccgtcgagcagatctgccaatgatcagtgatatcatggctttgttgagtacctgatctgtggagtcagattaccgtggttttgtttctctgtcgcatcgcgactgtcaccgtgccttagacaagacatgtttttgtattttgcaacgcagaagccatactcgtactggatgccgtttgtgggtggcctatttgttcattgtgcaaagttggatgccatactcgtacactattattatcaggtttcagcattcttttgtactttgtagcagcgccgtgttgctgtcggcatgacgttgaattcactcctgcacctgaattttgttggttatattttagatgtttttaattattcctctatgtactagttctacggagagacaaaaaacccactcgggcattgtattttggtcgtcccatcgtaggtttcatttttggatgttgataataaactcaccttgaaagcaactaagagccctgtcaaatacatattagatatgtatttctcgttcaaaatatattagatatgttt

SEQ ID NO: 17837 - DNA, 2151 bp, Zea mays
ctgcaagcctgcaatggaataaatttccagacaagttcatggtctcgtttgggctgaatcctcggtaccggccgccagttctcccgtctccactgggccgtaaaagagcagccgaagcctttctcggacgcgtgacgttactgggccagcccagcccgcgcgagcgaatcagggtccatgcagaacaagagggcgggcgccgggcggaggccgtccgcccgtcccgtcgaccgtcgtcgatggaaccgaggctcgcactcgcacccccgcacctgcacccggtccacgcgcgccactgcgggcccggttagcccgcggcgcgcaagccaagcgggacccggacctcatcggtcggtgcatagaccccgcgcatggacggcctccatccactccgcccagcacccgcacctcgtcagtcgtcaccgagaagcagaagcagcagctgctgcctgctggtcgttcgttcgcctcgttctctccgcctccccccaccccccgcctcgcttcctcctccgcgcttccttcgccgaggcgtcagcgtcagcgagggcgtataaagcgctccccctccgcgcgcgtccgcacaatcgccaccgcctctccgctcctcgacaagaccaatggcggctgctgcgtcctccgctctgcacgccgttggcgccgtcgcctccgccaagcctagatccgtcgcccccgcggtggcgacgaggaggagcgtgcgcgtggcgcccgcggccaagcgaggaccaggctcgggaggaggcaggctcgtggctcgcagcgccgttgcagccaaggcggatgaggcggccgcggcggcgggatccaagtcaggcggccatgagttgctgatgtttgaggcccttcgtgaagccttgatagaagagatgaatttggatccaacagtgtgcgtcatgggtgaagatgttggtcattatggaggttcatacaaggtgaccaaagggttggctgagatgttcggagatctccgggtccttgatacccctatcgccgagaactccttcactggcatgggagttggagcagcaatgaaggggctgaggcctgttgtggaaggcatgaacatgggcttccttctccttgcctacaaccagatctcgaacaactgcggcatgcttcactacacctcaggcggccagttcaagatcccggtcgtgatccgaggccccggcggtgtcggtcgccagctcggtgccgagcactcgcagcggctagagtcgtacttccagtcgattcctggccttcagatggttgcctgctccactccttacaacgcaaagggcctgatgaaggcggccataaggagcgagaaccccgtggtgctgtttgagcacgtcctcttgtacaacctgaaggagaaaatccccgacgaggagtacatctgctgcctggaggaggcggagatggtgcggccaggtgagcacgtgaccatcctcacgtactcccgcatgaggtaccacgtgatgcaggctgccaagacgctggtgaacaaggggtacgaccccgaggtcatcgacatcaggtcgctgaagccgttcgacctgcacacgatcgggaactcgatcaagaagacccaccgcgtgctgatcgtggaggagtgcatgcggacgggcggcatcggcgccagcctgcggtcggccatcatcgacaacttctgggactacctggacgcccccatcatgtgcctgtcgtcgcaggacgtgccgaccccgtacgccgcgacgctggaggacgccaccgtggtgcagcccgcgcagatcgtggccgccgtcgagcagatctgccaatgatcagtgatatcatggctttgttgagtacctgatctgtggagtcagattaccgtggttttgtttctctgtcgcatcgcgactgtcaccgtgccttagacaagacatgtttttgtattttgcaacgcagaagccatactcgtactggatgccgtttgtgggtggcctatttgttcattgtgcaaagttggatgccatactcgtacactattattatcaggtttcagcattcgtttgtaaaaaaaaaaagcgccgggtcccgctgtcggcatgaaaaaaaaaaaaaaaaaaaaaaaaaaaaaaaaaaaaaaaaaaaaaaaaaaaagggcggccggacgcgtgg

SEQ ID NO: 17838 - DNA, 1685 bp, Zea mays
aactccaggcgaatcgacgcggaccgcaagcgcaaacgcatccggcatcccaaacccgctaacgcgaaaccccaacacgtcccggcggccgccgcggagaagaacgacggcggcgacggcgacggcgacgccactgatggagtccctggaggcccttgtggcgcacatccaaggcctctccggcagccccgaggagttggcgcacctccacagcctcctcaaacaggcggacggcgaacccctgcgcgcccacgccgctgctctggtccccttcctcgcgcacctcagcccagagacgcactccctcggctacctctacctcctggaggcgtgcgcgacctccagttccaatctgagcgacttcggcggcggggacttcctggtcaccatcggcggcttcctcaccgcgtgctcggcggaccagatacgcctggcgcccgacaaattcctgaatgtgtgtagggtgctgaaggaccaggtgatgcagcttaacatgcccatcagagggatcgccccgctgcgggcggccgtccctaagatccagtcctcgcccgagcagctgaccccagtccacgcagactaccttctcctgtgcctgctggcgaagcagtacaaggctggactcagtgtcctggaaggtgacatattcgaagttgatcaaccaaaggatctgttcctctactgctactacggagggatgatttacgttgggctcaagaagtttcctaaagctctggagcttcttcacaatgctgttactgccccaatgtcatcgttgaacgcgattgctgtagaagcttacaaaaagtatatcctagtttcactcattgtgaatggacaggtcccaccatttcctaagtatacatccatatcagctcaaaggagtatgagaaatcatgcccagatttatgctgagctatctacaagctatagcaacggtagcaaaactgatttagagacattcatccaatcaaattcagcagcatttcaatctgacaacaaccttgggctggtgaagcaagtgctctcctcgatgtacaaacggaacatccaaaggctgacccagacttacttgactctttcacttgaagatattgctaggtctgttcaacttgaaacaccaagggatgctgaaatgcatgtacttcgcatgatcgaagacggagagatccatgcatccataaaccaaaaggatggaatggtcagctttcatgaagatcctgaacaatataaaagtgttgagatggtggagcatattgacacctctatccatagattgacggcattgtccaagaagttggcttcaattgatcagaacatgtcatgtgatactgcatatttgatgacgggaagggatcgtggaagattcgactacgacgacttcgactctgttccacacaagtatttttgagttgatctgagccttatgtgattctgaagtacgatcgtcaacgtagcagccattccctaaagttataattagtttgatcggccaatggcttttgaaaattgaaatgctgtaaattctggtttaaagaatgggtctgtgaaggcagagacttagtctggaattgctcgtggctttaatctgcatctgcttgctgttctagcatatttctcccccaactctgagacaagatttcgtttcctaatcaatttgctcggtagagtatgaccaagatttc

SEQ ID NO: 17839 - DNA, 1702 bp, Zea mays
  misc_feature (1653)..(1653): n is a, c, g, or t
ctcgaggccggcccctgccgggaagccagagtcggtcgctgaaccgctagacgtgcccgcgccagcctcggagaagaacagtggccacgacggcggcggcggcggcggcgacgccactgatggagtccctggaggccctcgtggcgcacatccaggggctctccggcagccccgaggagctggcgcacctccacagcctcctcaagcaggcggacggcgaacccctgcgcgcccacgccgccgcgctggtccctttcctcgcgcacctcagtccagagacccactcactcggctacatctacctcctggatgcgtgcgcggcatccgcttccaatctgagcgacttcggcggcggggacttcctggtcaccatcgccggcttcctcaccgcgtgctcggcggaccagatacgcctggctcctgacaaattcctgcatgtgtgtaaggtgctcaaggatcaggttatgcagctcaacatgcccatcagagggatcgccccgttgcgggcggcggtccgtaagatccagtcctcgcccgagcagctgaccccggtccacgcggactaccttctcctgtgcttgctggcaaagcaatacaaggctggactcagcgtcctggaagatgacatattcgaagtggatcagccaaaggacctgttcctctactgctactacggagggatgatttacattgggctcaagaagtttcctaaagctttggagcttcttcacaatgctgttaccgccccaatgtcaacattgaacgcgattgctgtagaagcttacaagaagtatatcctagtttcactcattgtgaatggacaggtcccatcatttcctaagtatacatccatatcagcccaaaggagtatgaaaaaccatgctcagatttattttgagctttctacaagctatagcaacggtcgctacactgatttagagacatttgtcgaatcaaattcagcagcatttcaatctgacaacaacctagggttggtgaagcaagtgctctcatcgatgtacaaacggaacatccaaaggctgacccagacttacttaactctttcacttgaagatattgctaggtctgttcaacttgaaacaccagaggatgctgaaatgcatgtacttcgcatgatcgaagatggagagatccatgcaaccataaaccagaaggatggaatggtcagctttcatgaagatcctgagcaatataaaagtgttgagatggtggagcatattgactcgtctatccagaggttaacggcattgtccaagaagttggcttcaattgatgagaacatgtcatgcgacccttcatatttgttgaagacgggaagggatcgtggaagatttgactacgatgacttcgactctgttccacacaagtatttttgagatgatccgagccctacgtgattctgaagtacgatcatcaacgtagcagccattttgtaaagttgtctttagttcgatcgattaatggcttttgaaaattttgaaaaatcttgtttaaagaatgggtctgctagcatatttctcctccaatttggagacaagatttcatttgtagatcattttgttcggtagagtttgagcggcatgcattgcaaactactacctctactatctctgttctcgaaaggcttgcgtncaaagttcagctttgtccaaaaaaaaaaaaaaaaaaaaaaaaaaaaaaa

SEQ ID NO: 17840 - DNA, 1757 bp, Zea mays
  misc_feature (1737)..(1737): n is a, c, g, or t
cggatttccctgggcgtcccacgcggccgctacgcctccggagtggcgcagagcagacgcgggtgaactatagcagctgtccctgtcttccccgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctaagccgtcaccccaacgtcgtgcagctgtccccgaggtgatggcccgcaagagcaagatatacttcgccatggtgtacgtccggggcggcgagctcttcgcccgcgtcgcccgcggccggctcaaggaggacgccgcgagaaggtacttccaccagctcgtcggcgccgtcgacttctgccacagccgcggcgtctaccaccgcgacctcaagcccgagaacctcctcgtcgacgagcacggcaacctcaaggtctccgacttcggcctcagcgcgctcagggagtgccagaagcaggacggcctgctgcacaccacctgcggcacccccgcgtacgtcgcgccggagatcatcaacaagaagggctacgacggggccaaggccgacatctggtcctgcggcgtcatcctcttcgtgctcctcgccggctacctcccgttccacgacgccaacctggtggagatgtaccgcaagatcagcagagccgacgtcaagtacccgcagtggttctcccctgagctccggcggttgatgcccaagctcctcgaaccgaacccaaacaacaggatcacgatcgagaagctggtcgagcacccctggttcaagaaggggtacaggccggccgtcatgctggcacagccgcacggctccagcagcctcaaggatgtccaggtcgccttcagcaacgccgaccacaaggacagcagcaccaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaagccggcgtcggcgatagtgtcaaagctggagcagatcgctgagacagagcgcttcatggtgaaaaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcacaattggagccatcctcttagaccgtctccggcagtttactcacccctcttaatccattgttattttagtgcagctctcttcgaaaaatgaattacaatccatcctccccttctcttcccttttctaaagagctacaaccttggtcgaatggacatcgagctggaagggtcctttgcgattcttttttgtccagttttctttctgtaagaaaaggtgtggtgggaaggaaacttttggtttcttttcccacnattaagtttaagtgtaatcc

SEQ ID NO: 17841 - DNA, 2237 bp, Zea mays
agctcggtacccctgctgcacaccataccataagcagttcccagcaaggagcttcagccaacttttcataacctctactagattactcaacagtcagtcatatgcaatggcgtcttagacaattgatcgtcggtttccatcacgagagacacatgtataatagctgcatcactcaacagtcagtcatcagccagtcagggatcgagatcctacaaatagcactcagtacctcctattcttagccagctagcgagagagaccaaatcctggcctcacatgagatcgactggttcctgggctccttctctcctgcacgagaccattacctagaacgtcctaatcgccaagcacatcgatcagtcgcgtgtctaggtttcctctctcaccatagcgcccgctctgtcgcccttcgttcacctctccttcctctcctccctgcctgccagggagaggggaagtcagaggcacggagtggcgcagagcagacgcacgtgaaccattgtagctgtccctgtcgtcgtcgtcgtcgtcaacgaatccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccggggcggcgagctcttcgcccgcgtcgcccgcggccggctcaaggaggacgccgcgagaaggtacttccaccagctcgtcggcgccgtcgacttctgccacagccgcggcgtctaccaccgcgacctcaagcccgagaacctcctcgtcgacgagcacggcaacctcaaggtctccgacttcggcctcagcgcgctcagggagtgccagaagcaggacggcctgctgcacaccacctgcggcacccccgcgtacgtcgcgccggagatcatcaacaagaagggctacgacggggccaaggccgacatctggtcctgcggcgtcatcctcttcgtgctcctcgccggctacctcccgttccacgacgccaacctggtggagatgtaccgcaagatcagcagagccgacgtcaagtacccgcagtggttctcccctgagctccggcggttgatgcccaagctcctcgaaccgaacccaaacaacaggatcacgatcgagaagctggtcgagcactcctgggcgattgggttcctcgaggccggccgtcatgctggcacagccgcacggctccagcagcctcaaggatgtccaggtcgccttcagcaatgccgaccacaaggacagcagcagcaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaagccggcgtcggcgatagtgtcaaagctggagcagatcgctgagacagagcgcttcatggtgaagaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcacaattggagccatccacttagaccgtctccggcagtttactcacccctcttagtcgattgttatttaagtgcagtctcttcggagatgcaattacaatccatcctctctttcttttcccctttctcaaagagctaggaccttgctcgactgagcatcaggctgtagggctctttgtgatcatcttttgccagttttcttcttgtagcagaagttgttgggcatggaactcctgttcctttcaccaatagaagcacaatgatcagcactgtgaaacattttttcctataaaataaaaaaaaaaaggatctactattgacttgccg

SEQ ID NO: 17842 - DNA, 1037 bp, Zea mays
  misc_feature (1008)..(1008): n is a, c, g, or t
  misc_feature (1019)..(1019): n is a, c, g, or t
  misc_feature (1022)..(1024): n is a, c, g, or t
ccggccgggaaaaaaaaaaaaaccttccttgcgaactccgccaccgcgtccctgcgttatagggccgtcgacgacgacgggttgcgcgtccccgcctcattcgcgcgaccatggacacggacacggacacgacgacgtccaccggctcccgcctccatcccgcggccggacatgtacgctcattggccgcccggggcgccgagagcctcgtcacctgcgtcttcgcgacggtgggcacggtcctcggcgcgatcaccggtggcctcatcggcctggccacggagacgggcgtgctgcgcggcacgggcgtcggcggcatcacgggcgcgctggtgtccatggaggtcgtcgagtcgctgtggcgctccgacgagccggcaatctggagcgtcgtctacgtgctcgatgtcatctggagcttgctcaccggccgccttgtgcgcgagaaggtggaccccgccgtgctcagcgccgtcgagagccagatgagcgcagcggacacaccggccttgcatgcagaccacgccgacatcttcgacacgggcggcaccaacggcatggcgagggtcgccatggacgcgctccccgtcgttaggttcaccgagcgcagcaacgtcgacgccagcggcgagctcatcgcctgttcggtttgcctccaggaattccaagccggcgacagcgcgaggagcctgccggtgtgccgccacacgttccacctgccgtgcatcgacggctggctgctccggcacgcctcctgccccttgtgccgccgcgctgtctaggccgcgcccgttcctctaccctcaaggatagccgccaccagagcttctctgacaagcgacacccgttccttcaggctgtagccgtacgcacactggcagcgtgatttttctgtagctcatcagatgattcagatgggcgttatgtaaacattggttaatttttaacaaatgcaagtggtgcacatggcgatggccccatacaaaaaaaaaaaaaaaaagctgaganaaaaaaaaaancannnaaaaaaaaaaaaa

SEQ ID NO: 17843 - DNA, 1916 bp, Zea mays
gcccctcgcgcccgcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccggggcggcgagctcttcgcccgcgtcgcccgcggccggctcaaggaggacgccgcgagaaggtacttccaccagctcgtcggcgccgtcgacttctgccacagccgcggcgtctaccaccgcgacctcaagcccgagaacctcctcgtcgacgagcacggcaacctcaaggtctccgacttcggcctcagcgcgctcagggagtgccagaagcaggacggcctgctgcacaccacctgcggcacccccgcgtacgtcgcgccggagatcatcaacaagaagggctacgacggggccaaggccgacatctggtcctgcggcgtcatcctcttcgtgctcctcgccggctacctcccgttccacgacgccaacctggtggagatgtaccgcaagatcagcagagccgacgtcaagtacccgcagtggttctcccctgagctccggcggttgatgcccaagctcctcgaaccgaacccaaacaacaggatcacgatcgagaagctggtccactcctatgggcgattgggttcctcgaggccggccgtcatgctggcacagccgcacggctccagcagcctcaaggatgtccaggtcgccttcagcaacgccgaccacaaggacagcagcagcaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaagccggcgtcggcgatagtgtcaaagctggagcagatcgctgagacagagcgcttcatggtgaaaaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcataattgaagccatcctcttagaccgtctccagcactttatccatatggtctccccctcttagtcgattgttatttaagtgcagcctcttcggagatgcaattacaatccatcctctctttctttttccctttctcaaagagctaggaccttgctcgactgagcatcaggctgtagggctctttgtgatcatcttttgccagttttcttcttgtagcagaaattgttgggcatggaactcctgttcctttcaccaatagaagcacaatgatcagcactgtgaaaaaaaaaaaaaaaaaaaagcgcccccaaaaaaaaaaaaaaaaaagaaaaaaaaaaaaaaaaaatttgcggcc

SEQ ID NO: 17844 - DNA, 1369 bp, Zea mays
actgcagtggagctggagcgcgcacgcacacacgagacagaagccgggaatcgaagcatcaagccctttctctgagcgccgatggcacggtatcttctcgcccccacttccacctcctcctctgccctcctccccaaggatggcgtcaagaactcgccgacgtcacggcccctccgcctccgtgcgctcggctccaggaccagcaaggcgcggcacatcatggcggtggcgtccgagcaggccgcgccgccggccaggtaccccaaggtggccgcccctaccaccggcccgatccccgccgccgagctgctcggagtcatcgaggccgccgcaaaagctggggccgatgttataatggaagctgttaataagccacgcaatatccactataaaggtgttgcagacctggtgacagacacagacaagttgagtgaatcagtcattttggaagttgtcaccaagaacttcaaagaccacctcatacttggggaggaaggcggccttgttggagattccctatcagagtacctctggtgcattgaccctttagatggaacaacgaactttgcacatggttaccccagcttttctgtgtccattagtgttctcttccgtggaaagcctgctgcttctactgtggtggaattttgtggcgggcctatgtgctggagcacccgtacaatttctgcatctgctggcggaggagcttattgtaatgggcaaaagattcatgtcagtcagacagacaaggtggaacaatcacttctcgtcacaggttttggatatgaacacgatgatgcctggacgaccaatatgaatctgttcaaggaatttactgacattagcaggggagtgcgaaggctagggtctgctgctgctgacatgtcccacattggacttggtattacagaagcttactgggaataccgacttaagccatgggatatggctgctggcgtcctgatagtagaggaagctggtggggtggtaactcgcatggacggtggagagtttacggtcttcgatcgctctgttcttgtttccaacggacttgttcatggacagcttttggaccggatcggccctcctactgaagaccttaagaagaaagggatcgacttctcgttgtggttcaagcctgacaagtacccgactgacttttgagctgcaccaagggcaccaccaccagccattggccaccataataaagcagccatcatttttttttgggggggggggggtccttcaagaagaaacaataatgtttttagttcaatagcactgtacttgtaatggcaatacgatgtacagttctttgactcgagtttcaagagagccaagctcctgaaagaacagagcttcacaagtg

SEQ ID NO: 17845 - DNA, 2819 bp, Zea mays
tgacgaattttacccaatatgaaggcgggtacgagatgatttctttacccgcaggcacgttaatggacaagaacctttatccattgggtagatgggtatgggtacgagttggtactacccatacccgtgtacccatggataaaatatacccacaccataccactataaccatctagttaaaagaaaatccttctctagctatcatttgtttagctatcaagttatgtaatcatatgatttgtgatattttaacttgaacttttttgtgtgtttatttgatattttgagtgactggtatattagaattttaagacttccctagcgggtacatatatgggtaagaatctataccgttagtgtatatgggtagcccgacagatagaatttttttgatgggtacgagtatgaaatggtactacctgatgtacccgttgccatccctagccctatagccatgacttcgtagtacatgggtattatattgtaacaaatggtatgaggaactgtaccgagcttcattaatatgttgttcacactttgggttaacccttggtttgtaacctcacggggtatgattatactaacacatgctccatgattacaatgacaacatggtatggagacaattgatctaataacaagtagagcccacaagaagcatatacatgtaagcttgacactcctttggactataaaatgggatggtagagcagtcttccaagatgtgagatcaatccatgagccacttattttgtcataaaaatctatagtataagtacggtgatattggatatcttgatctaacctatgcaatagaattcacattaaaataagttaaatgcacgtgtggtccctaaaattgagaattttttaaaatatatttctcaatttaataacttggtgttctataaattcgtactaccctcgtttcttaaaccaaacaatatcaccgcatgtaagtattgtagccatttgcaatgaattgggattgcaactttcttaacttcatctttatgatcatatttgcaaagttcatttatttttacgtagagctgcgaagtttttttttatcttcatttcgggtcgtctttaaacatttgcaaggcccccgggccgcccgcagcgtggtccgaaatcacttaccgccttctccgcactgactcgaggtggaactgggccagccagggactctggcccgacccgagaacctcaaccaaaacctcaccttgccaccgccgcgtcgctcggcgccccgtcgggaactctccgccgccacccagtgacccgccgcgccttgcagcggcgacggagggaccagccagccagccatgacgacccgcatagcgccgggcgtgggcgcgaacctactcgggcagcactcggcggagcgcaaccaggacgccaccacctacgtcggcaacctcgaccctcaggtttctgaggagcttctatgggaattgtttgtccaagcaggccctgttgtgaatgtgtatgtcccaaaagacagagttacaaacttacaccagggatatggatttgtagaattcaggagcgaggaagatgcagattatgctattaagactttgaacatgatcaaactatatgggaagcccataagagtaaacaaggcttcccaggataagaagagcttggacgttggagcaaatctgtttattggcaatcttgatccggatgttgatgagaagctcctctatgataccttcagtgcatttggagtgattgtaactaatcctaagataatgcgagatcctgaaacaggaaattctagaggctttggctttgtgagctatgagtcctttgaatcatctgaccaagcaatagaggccatgaacaaccaacatttgtgcaaccgcccaatcactgtctcttatgcttacaagaaagacacgaaaggagaacgccatggcacaccagcagagagactgctggcagcaaacaatccaggatctcaaaagaataggccacacacaatgtttgcaagtggtccgccgacccaaggtcatccaaatggtggtccgcctgtgccacggccttatggcaatggcacaattcctggacagattcaacacattcggcaaccacctccaccacctgttggacaattcccccctccaatgcagatgcacgggcaaccaacttggcccgctcaacattctatgccgcctcccatgccatcgcaactccagtacaggctcccaatgaggccaccaccaccaaatatgatgccccctccggttggcatggtaaggccgccacctcctcccactggtatgtcagcaccacctatgtggatgccacccccacccccaccacatcaaggtggtggaatgcctccgcctcccatgtctatgccaccaccgcctccaccaccatctagttaaacacatgcaaaggacagtaccgtctggtcaatgtgtaagctgtaactgtagactaaggatgctggttcctttcatgtctccatgtaacttcgtcaacactaggttaagaggaggtttgagagttaacctgacagatacactcaagattaacagctatttattcatgttctgttgaagataaaatgaattttgtgcttgtctacccaaaaaaaaaaaaaaacgagagccgggacacgtttacaacgatcactatgcacgttctgttgccactgaattatcgatggtggaaagttcaacaaagctatttgggccatgatttagccacttttagctcctagatagatcgtggttgtgatgcacttgatgggagggtagaaaaagtgtgcagaatatgcagctctgacgtacgggcgcgtg

SEQ ID NO: 17846 - DNA, 1502 bp, Zea mays
cccgcggcgacccacgcgtgcgcgagaacctcaaccaaaacctttccggggccccgccgcgtcgccccgcgtcccggcccagctctccgctgccgtccagtgaccccgccgcgccttgcagcggcgacggaggggccagcaagtcagccatgacgacccgcatagcgccgggcgtgggcgcgaacctgctcgggcagcactcggcggagcgcaaccaggacgccaccacctacgtcggcaacctcgaccctcaggtttccgaggagcttctatgggaattatttgtccaagcaggccctgttgttaatgtgtatgtcccaaaagacagagttacaaatttacaccagggatatggatttgtagaattcaggagtgaggaagatgcagattatgccattaagattttgaacatgatcaaactatatgggaagcccataagagtaaacaaggcttcacaggataagaagagcttggacgttggagcaaatctgtttattggcaatcttgatccggatgttgatgaaaagctcctttatgataccttcagtgcagtgggtgggagtctggcttcccctatgtgatggcgagtaccctcgaaactggaaattctagaggctttggctttgtgagctatgaatccttcgagtcatctgatcaagcaatagaggccatgaacaaccaacatttgtgcaaccggccaatcactgtctcttatgcttacaagaaagacacaaaaggagagcgccatggcacaccagcagagcgactgctggcatcaaacaatccaggatctcagaagaataggccacacacaatgtttgcaagtggtccgccgacccaaggtcttccaaatggtggtccgcctgtgccacggccttttggcaatggcacaattccgggacagattcaacacattcgacaaccaccaccaccaccacctgttggacaattcccccctccaatgcagatgcacgggcaacctgcctggcccgctcaacattctatgcctccccacatgtcatctcaactccagtacaggctcccgatgaggccaccaccaccaaatatgatgccccctccggttggcatggtaaggccgccacctcctcccaccggtatgtcagcaccacatatgtggatgccacccccacccccaccctcatcacaacaaggtggaatgcccccgcctcccatgtctatgccgccaccgcctccaccaccatctggttaaacacacgcaaaggaaagtaccgtgtggtcaatgtgcaagctgtaactgtagaccaaggatgctggttcctttcatatatctccctgtaacttgtccacgctaggtgaagatgaaattttggagttcacctgacagatacaaacgcgagattaacatgtatttttcttctgttgaagatgaatgtatttttgtggttgcgtaccaaaaaaaaaaaaaaaaaaaaaaaaaattgaaacaaaagcccgaaaaaaaaaaaaaaaaaaggccccta

SEQ ID NO: 17847 - DNA, 632 bp, Zea mays
aaaaaaacaaaaaacaacacaccccaccgccgccgaacaagtacatcaactactactcatatcacccaaaagcagttcctgctcctcgtgatcctcctgctgctcctcctcctcttctccgtcgtcttcttgatccccaccgtctcgttgcccccagctcggcctcggaccatgtcgtcctccgcctccgatgccgcgccgttcgagaagcccagggccgtggtcaagaaggtcctcgcggagtcgcagccagaggggcagggcgccaccgtccgcaggagcatcggcaggcatgagctccgcaacctggaccccttcctcctgctcgacgagttcacagtctccaagcccgccgggttccccgaccacccccacagaggattcgagaccgtcacctacatgctcgagggggccttcacccaccaggacttcgctgggcacaagggcaccatcaggacagggacgtgcagtggatgacggcggggcgaggcatcgtgcactcggagatgccggcgggggacggcgtgcacaagggcttgcagctctggatcaacctctgctgcaaggacaagatgatcgagccgcggaaccaggagctggagagcaaggacatcatccgcggggagagcgag

SEQ ID NO: 17848 - DNA, 1455 bp, Zea mays
aagcgctaccaaacgcagcacgagaccattacctagaacatcctatcgaaaacgtgaactaaccagcacgggcgctgagggctgaggccgcgacgacgacgaccatgatgaggctgaagcagcacatgggcctggtctcctcccctacccctgccatcgtcgtgaggctcggcaacaacacaccccaccgccgccgagcaactcggtctcggatcgtgtcgtcctccgcctccgacgccgcgccgttcgagaagcccagggccgtggtcaagaaggtcctcgcgcagtcgcagcccgagggtcagggtgccaccgtccgtaggagcatcggcaggcacgagctccgcaacctggacccgttcctccagctcgacgagttcactgtctccaagcccgccgggttccccgaccacccgcacagaggattcgagaccgtcacccacatgtttgagggggccatcatccaccaggacttcgctggtcacaagggcaccatcaggacaggggacgtgcagtggatgacggcggggcgaggcatcgtgcactcggagatgccggctggggacggcgtgagcgagggcctgcagctctggatcaacctctcctccaaggacaagatgatcgagccgcgataccaggagctggagcgcaaggacatcagccgcgcggagaccgaggacggcgtggaggcccgcgtcatcgccggggaggccctcggcgtggcgtcccccgtgtacacgcgcactcccatcatgtacgtggacttcaccatgcgacctgggtcccgcctgcaccagcctgtcccggagggctggaacgccttcgtctacgtcgtcgacggcgagggcgtattcgggcgggagacggccacggcacaccactgcctcgtcctcggctccggcgacggcgtcagcgtgtggaacaggtccgccaggccgttaaggttcgtcctcgccgccgggcagccgctcggtgagcccgtggtgcagcacggacccttcgtcatgaactcgcacgccgagatacagcaggccatggaagactactcctacggcaagaacggcttcgagagggccggccagtggagctcctccgcctgatcggcgaggctatcgcgttaaattaaataaatgtgtgtaatacacacagctcaacgcttcccttaagttatgtagcaacgccatttgttggtgattaacgagtgatcgagcaagcttaaaaaagttccactccttttaaacttatatatttatcggtattttagctaatacaatagtttattgagactattgtattcgtgtatcgaaagttatgtagcaatgccatttgtgggtgattaccgtgttttccggtcgaagtatcagctagttcaatcatttaaggaaaaaaaaaaaaaaaaaaaaaaaaaaaaaaaaaaaaaaaaaaaaaaagaaaaaaaaaaaaaaaaaagcggcc

SEQ ID NO: 17849 - DNA, 948 bp, Zea mays
  misc_feature (866)..(866): n is a, c, g, or t
  misc_feature (910)..(910): n is a, c, g, or t
  misc_feature (921)..(921): n is a, c, g, or t
aattagataaacaaagaaaaagtcccgtccaacctcccacgcctctcgtccgtcttccattcctcactgccgccgccgccgcgccgcctgcttccgggagagcccccacctagaggaagctcctccggtcctcccatcctcctcctcatccaatcgtgccaacccgacccatctcatcacccgtccaaggacggagccgtcgttcccgtgcctcccgagacccatccaacccatccgggcttggattgctttcgaatcgaatctcctggatttttccaccacacacatgcatccttttggatttgtttagttcataagcccttcagactggcagatatcaagaggtcatacacatctcgcacctctaagtgggtgtgggtctgcaacaattctgcaaccaccttatccttgcctttgggagtaagcccgacctacatctggaggcttcgtcgagccttggaaggcctttttgttgattacggctaatttccaatggcagctgagatgtaacaaatttgctcagttcagttctctaggaaaagttcccgtggttcagcaatgtgattggtttcataggttttttcgtgtgttggtgatcaaagcaatctggtgtaagcttgcgtagttgacatcagagtttgtttcttatggttaggttcttttgcttttcatcctctactgcacatcacagatccaaggaggttttttccccagcagatgaaaccatgcatgcagcgtcaaagaaggattatcagttgggagtccatgactggctcagttcgttcaaaccagatgacagaagaaaataaccgttcagctgttagtggtcattgtggcagtagcccatcatctcatcaagaatgctngtaggtcagaaacttgaaatagatatgtgtgctctgagaagggncaaggaggttnggcactaaaagaagagtcagtcgcttg

SEQ ID NO: 17850 - DNA, 2323 bp, Zea mays
tggtatgctacttgtccatctgattgcgttctgtattttctgcaggcatctaatgttaatactttcttcctcttcgcagtgcaatgcagtgaccttctcatctgactgcaagctcatggcttcctgctcggcggataccacggttgcgctgtgggacctctatcccccaaaaccccaaagcaaagcggacatcacagaaacagacgaggctccccgatgcttcatgtagtttgggctttcctgatatcttcaggcagaattttggagcttccgtgcaatgaaaatctgaacttgtcgcaacactgcaagcgatttattctttttcgtcaaagaaaagagtaagatatgatgtgccttccacagagaagcgcaaacgtatgcatgtaactgttgttaggaacggttctcttgatttctttatttttcattgaaattctactcggtttcatggaacagttgtagtgtctcaagagcatgaaattgatttaaaggcaaggcagttgaagaactgactctttttttttttttttttttgatttgaacaaatttatgcaaatttccagtacactgtacacctacatttgctactgttcgatccaatggcagtactgaaccgggatgcagttcttgctgttgtgcatgtccaggaaagagggtatcgtatcccaatgttccatttagttggggggttctattgctagaaaagaacattagtccttgctgactcggcgactccaatgcgatgcgagcccatgcccatcaacgacggtcctaaccttcacgcgcaacagccgcaatcgccgctcgttctagttctttggcgtcggccagccacggccgcctcaacgccgccgtatcttcaacgtcacttgcggcatccgacgacggagccgaggtgccatcgaaggtgccgtcgaacggcgcctcgcagaaggccatcgcggccacgagcctctccaccggccgcttcttcgcggctgcggccagcctcgccggtgccgatgacgccacgtctccgccggccccggcctcggggacgttcgtcgcgcaggcgcggcctccggcggcacctgacgacggggaccatgtgccgtcgaacggcgcctcgcagaaggccaccatggccgcgagcctctccatcggccacttcgcggccagcaacgccagcctcgacgacgccatgccatacccgccagccttggggacgttggtcgaagatgagctgttcccggcggcaagcgatgacgcaggcgaggtgccgtcgaacggtgcctcgcagaaggccatcatggcgacgaggctctccatcgccgctttctcgagcctgttcgagttcgatgtcgattggttttggtccaggatgagacgcaggcggcaggcagcgtttatatatgcatatatggacgcccatagctatagtttgttaacctggtttggattcctgctcggacatactccgtacgcctcaatatcgtgcggactgcctaagcaggtccgtagttgtagcaacagactgcgctgctgcagagtttctttcagatttatcacgtttcagttaagttcagattagatcgataggtatagaatcctgtaaggatttagttttagtttgccaggttgtttgccgagtcaattctcggtataaatacctatgcctcgtttccttcagatgacttaaatgattgcaatgatgaagtcactattgtagacttcgctttcatcgcctggcagtcaattactcccactgttttctttttttatttgtcacggcgacaaatattcaagggcggactgtatagagagaggtgcataaggctactctagtgcaagcattgaggggacattttttttggcagagaatgcatacaattatggcactcagtaattcttatgagtagctggggctaaaaaaatgaaatgactgaatgattgagtttgttcgttttatttcctatgatgatgtctattttttagaatgaataacccgttaaaataatttctttctcggtaattcttctttttccgtaatgtcaatttttttaagtgacaacacctaactggcccattcaatttcaagcatttgaatttggaataaaaaagtataaaaaatcgttgatgtaaacttaggcatgtttggttgatataacctacaaactcaccgagattgagcgtctttgatgtgacgacggcatggatgtgcagtgattccttgaggactagtttgggaaccaaaaaatcggaggggattagagggactaaaattctctccttatttaaaattatataagaaggaaattttagtccctctaataccctccggcat

SEQ ID NO: 17851 - DNA, 2830 bp, Zea mays
gcgcatcgagtgcggattttttttctttgattagaagcatgatctatgtttcctctcggttatgtttggatcctcgtctgtatacgtagctgcagatggcccgctgacatgatttggccccacacccacacccactcagaagaacatcgaccatgatgttcggatgatcaaatttttttttttttttttgagaatgatttggccccacacgtcattaccgatgcttcaaacaagttatctaccgccataaaatggctacaaaaagaaatgtacaacaataccctcatttttttacatcgccatgccatcctgcgccaaattctccagatcctcctcggttaacagcgttttcttgccaccgcttcccgccttgtcatatggctgtgccatcctccggagaaactcacgagctatatggagagccatatcagtgctcagatttaggtgcgcatcatgcaaatgcgagagtatccacccaggcaacttggaccgtttatcatgccgactgtatctcttgtcagcaaatatcatcatcccataatcagctttggagcgaataacacgaccgacacattgggccgcttgcctcaaagcatcaaatgttaggaagtcaccctcctttatctgaaaagtttcccgcaggtactccaacctagcaagcaatatccgactcaatgtgtactggaaaggaacaccaaacatgataactaatctgccatagtgccgatcaaaatcaataccttcagcaactttgcccctggcaacagagaagaaaatggcacctcttccacaatcacatgcctttctgtagttatcaagagccaatgttgtctcaacgacatctggtgtttcgataaacactaatttatgttgcatgatgtcctgcagaattcccatttcgtgccagctgttgacaatgccatccatataggaataactgacaaaaaagcaaactatgccatctggaacagcagaagccatttccagcaagaggcggccataattcctcacaacaccaggatcactacgcatatcgaactttgtactcacaggtagctgatcacttcctcgggtcaagaccatgggacaaatacaatctcttgttaaggacatggtgaagcttctgcttatgacaggattaaaattcaagagacgagggtaaagatctattgggctgagagttccagaagtgatcacaaccgtttcgaaacgatcaaaaacaggtcttattgcgagtgaagcatcatggcaactcagctgaataacaggatcacgaatatcaggcattctatcatcatacggctctattataatagaaaagccccgtgtataagttccaatcagtgtggcaaagtcacatatggtctgtatgtgcatgaactcatctgtatcagttatctctaatgtcatcattagggagtgtagccggtcataacaaaacctcagcattttttggtcgattccagcctgggaatggattgaggcaacaaaggaaactggcatttcattctcaacattttctgtttcaagccggccatcaaggaatctcacaagcctccgcaagacagcaagaaaatgttcagccctccttatgtttccaggaacagcttccttcaagatgtcatcaggcaaagacggattcgcgagccaagcatccgatattggtagatttcctcgctgtgccagtccatccaccagtctgttgtattcagcacgaagcctattggcatcggtggccttgaacctgtcgatctcttgcgagatgcgccgcagatttcgctctgcgccttccagcgtctgcttgcggatgctgacgctcagcgcctctatgcagacattgtcaatgttgtgagcctcatcgaacacgaccacacactccttctgcatctccctggacacaatgctggccaccttggggtcgagcaggtactggtagctgtacaccacaacattggcgtacttgaccatctgcctggcaaggaagtaagggcagacccggcgctcccttccgagcgcgcggaggtctgccagggtgtacaccccgggcggcatgaaggaggcaaggtcgccggcggcagcggcccggtcgaacgtctcgtagaactcgcacagcggggtggagtccgggtcggaggaggccttctcgcggacccaggaggccgtaaggcggcggcaggcggtgtcgacggagtcccgggcggcggcggcggacgcctgcgggtggatgcagaggttcttgcgggaggagaggccgagcgcgaggagggagcgggaggccgcgggcgggaggtgggcgaagaggaggcggagctcggcgagggtcttctccatctcgtgcacggtgcgggtgcaatagatgaggcggagcgggcgggccgggttggcgagggagtaggaggtgatgagggagatgagcgccgccgtcttgccggtgcccgtgggcatctcgagcagcgcgtgcccgcgcgcgtcgagggcgcgcttgagctcccccatgtacgcgtgctgctccgggtagatcgccgcgtacgggaagtgcacgggcaggccatccaggtcaaaccgcattgtggcggaggggaaaggcaaccgaggggcaacgccggaggggtttgattcgccggagagcggagaggcggagacggtgctcgcgccgccgccgcggggtggagatcacgtgaggtgctcggtggaatgcccccgtgcagaggagatgctggtgggctcgtaatcgtaacgagtataggcttctgggttgggctggtacagagaacagagtcggctgcgagctacgggatacgaatcccggccggcctcgagggtcccaatg

SEQ ID NO: 17852 - DNA, 2415 bp, Zea mays
ttggtataaaaaaaataagaacaagagagtctttatacctttcctaatttataatttaaggaatagagattttaggaaaaaaataccgtccccctggtttttcacttacatatgtaaatatagacaccctctattccgtatttctcgcgagcctaaagataaagagcgaggatggctctttagatcacgcacaagacataaaaaaagttattggaggatataaagatatagaaaacgattttaatagattttagaaagactcttacagatgttctaagatttagtaaagtttataaatgtatttagggaacatcaagagtaaacaattataactaaacaaacaattttcttttttcaaaaaaaatgcgcaggtcgccctgctagttttattcacttgccgtgttaacgaaagcatacttggattaggtctgaattagatccgctgtccacacatgtagccccagatcgaaggctagaatatttgtctctctacagtcgcccggcagcatcgctgcgttcggatcggccctcttttcaccggcagccacattctcctcaaaattcggcgatcacatcaagagctttagccgccagggtgagttacaggtcgccaaccttttctcttgatcttagcagcccgggtgccccaagagcattcccccgactgattcggtgcctagaccaccatgggcaaacgaattttgtgaagtttcgtgagcaatcctgcccgttgctttcttccccagcttgcatcgatgcgtttgcaacaagacggtgcaagaatatatattgtttgtgcctatatatatagccatcacactatagggcattattagagagagctacaacaagcatgaagctaagactggtagcgctagtgctggcggtagcgtcggtgtacgcttgctcgtcggcggcatcagcgttcgcgggggacgacgtcgtccgtgtcgcgctaaagcatgtcgacgctgggaagcagctgtccaggcccgagctgatccggcgcgccatgcggaggagcaaggcgagggcggccgcgctctccgcggtgaggaaccgcgcccgcttctctggcaagaacgagcagcaaacgcccgccggcgtgctgccggtgcgcccgtcgggggacctcgagtacgtcatcgacctcgccatcggcacgccgccgcagcccgtctcggcgctgctcgacaccggcagcgacctcatctggacgcagtgcgcgccgtgcgccagctgcctctcgcagccggacccgctgttcgcgccggggcagtcggcgtcgtacgagcccatgcggtgcgccgggacgctctgctctgacatcctgcaccacagctgcgagaggcccgacacgtgcacctaccgctacaactacggcgacggcacgatgaccgtgggcgtgtacgccacggagcgcttcaccttcgcgtcgtcgggcggcggcgggctcacgactaccgtcccgctcggcttcgggtgcggctccgtgaacgtcggcagcctcaacaacggctccggcatcgtgggcttcggccggaacccgctctcgctcgtgtcccagctctccatccgccgcttctcctactgcctcacgtcctacgccagccgcaggcagagcaccctcctgtttggctccctgtccgacggagtctacggtgacgccacgggccgcgtgcagaccacaccgctcctccagagcccccagaacccgaccttctactacgtacacttcacgggcctgaccgtcggcgccaggcggctgcggataccggagtcagcgttcgcgctccggcccgacggctcgggcggcgtgatcgtcgactccggcacggcgctcacgctcctcccagccgcggtgctcgcggaggtggtgcgggcgttccgccagcagctgaggctgccgttcgcaaacggcggcaaccccgaggacggcgtgtgcttcctggtgcccgcggcctggcggcgctcgtcgtcgacgtcacagatgccggtcccgaggatggtgctccacttccagggcgcggacctcgacctgccgcgccgaaactacgtcctggacgaccacaggaggggccgcctgtgcctcctcctggcagactccggcgacgatggctccacgattggcaacctggtgcagcaggacatgcgcgtgctctacgatttggaggcagagaccttgtcgatcgctccggcacgatgctgacacgcgcgcaactagtagaaaggccgccgactactcgactactctcactgtatgcaagttagtgttaaccatgcaaatgcatgccaaccataccgggtcgcactttgcacgcagcaaacaaattttttttgtcggtcgaaaaaaaaaaaaaaaagcctgaatattccattaatcgtccgtcataagcggagagggaatcacaaacg

SEQ ID NO: 17853 - DNA, 2097 bp, Zea mays
ttataacttgggtaaaaatattgggcgcaacattggggagtttgtatctctattacacttaagctttcgtatttacactattacattttgttgtgttcttttcttattagcttagttatagactagtggataggtctagaaccaaggttgctacagatagcaacacttatacaaaaaccttagctacacatatgaatgcttggttattctcaaaggttttgattaaataaaaaaattaaggccatagattggtgtgaaacatagttgtcctaattcatccctctcttagacgtcatcattcttttcaccagtgtactataaaatattgtcaagtacaaattgccacaattgttactacctatgttgtgtccaatggtatagacaccattgtccaatgatatgacataacatacctactttcataacaagtatgactgccgctagagaaggacatccctgacaatgtgccatgaccgaaggtatggctttatgtacttattcacaactagcataaggttgtggttgttgggtcaaagtgtctatgttgtcatcaaccgtcaataaactgacgctaggaccatatttcttacaagtattcctctctctctctatatatatacttgtattagccgtccgttttcgagtcaacggtttgagtctgaactctgaaatcagcatgcaagctgacgaaaataacgcgatacagtattccaatctgttaccctgaagacctgaacccaaatctccaatcagatcacagccggcaagccctaaacattaacccagttggcatcggagagcaataaaaacaggctgaggtggaacagagaatttgaaccgaatgcggatcatcggatggcggccgtctaagctagagcgctaggctgtcgccactcgccagtcgcgagctacgagtctacgacacgatgtcgtcggagaagctcgtgctgctcgcgcaagacggcaagacgatatccctggccgtaatccccgcggccgcgtcgtcagaggcaacggccactttccggctcatcgtcgagcagaggtaccgcagcggcggtgcgggaggcgacgccaacgaggtcgacaaaatagaggacgtggtgtgccgcgtcgccgtcggcgagctgtgcgcggcggcggtcgaccgcgcgttcgaggacctggtggccaggctcgagcacccgacgctgcgaccggaggtcgcaacgtcggcgagggacgcgaccgcgcgcgtccgggcgaggtatgcggaagagggggctcagctcagcggcgtcgagttcgtcaactcgttcaagacggacagcgaggagactgggagcgacctggagctcgacgaggaatcctgggcgcacggctggcgcagcggcagtgactgccagtatgaccaggacccggccgccctcatcagcgacgacgaagacggcgcccagttctcggcgcggccgtacgatggcgccctcgctcgggagggcgggccgagcgacgggacgctgctgttatcgggattccaggcgcgctccgacggccccgagctcgcagatcaacacgagctgacgccgcgggacgtgcaacgcctcgtgcgcctcgcgttcgacgggggcgacgtggacagtgacgacgcgtaccagcgggcgctggacggcggcgcaccagtgtctcgtgtcacgcgcgccgtcgtgctcgaccaggggttgcgttcggcgacggctagacagcagcagccaacgccgccaagcgggatgccgcctcggatgcgcaccggatggtggtgagtgatgacgcacgcacggctacacaaactgacaaacagcagcagcgatgggtttcttactttcttttgagcttcgcagcgatgggtaatgtgtttgcgtagtttcaatgctggagctgttttttctcatcagttttcgtattcggatcagctgctatcggaatcatcatttgaatttctctaaaaaaaaaaaaaaaaacaatttctttgttttttggcacattttagagggtcaaattcattcttatcccacgaaattccgaacgtaaaacaattataattattatatttagagatttaggatctttttaaaagcatca

SEQ ID NO: 17854 - DNA, 1649 bp, Zea mays
ttgggaccctcgaggccggccgggggggtgcccccgcgccggccggcgaaaccccagagctttaaagcttttccgattccgcaatgctcaccgttcggttccttctcgtaccgagccgcgggtagccagccaaccgccgacgcagtccacaagcgatgaagcgcttcttccagccagtgcccaaggacggctccccgtccaagaagcggctagcgggtgctgctgaaccgggcgacggccccacatcagccggtgccgccaccggcgctggcggggatgtagaggggaggcccaccgaggagccgttcaagttcctgacgtggaacgccaacagcctgctcctccggatgaagagcgactggcctgctttctcgcagctcgtcgcccgccttgaccccgacgtcatttgtgtccaggaagtgcggatgccggcagctggttccaaaggggcacctaaaaaccccagtgaactaaaagatgacacaagcttgtcacgggatgaaaagcaggtagttctacgtgctttgtcagcttcacctttcaaagactaccgtgtctggtggtctctttcagattcaaaatatgctgggacagctatgtttataaagaaaaagtttgagcctaagaaggtgtctttcaacttggatagaacatcttctaagcatgaagccgatgggcgtgttataattgcggaatttgaatcattcctttttactgaacacttattctccaaacaatggatggaaggaggaggaaaatgcatttcaaagaagacgtaagtgggacaagaggatgctagaatttgttcaacacgtggataaacccttaatctggtgtggggacttgaatgtcagtcatgaagaaatcgacgtcagccatcctgatttctttagcagcgctaagctgaatggatacaccccacccaataaagaggactgtggacagccaggattcaccccagcagagagacggcgttttggcaacatattattccaaggaaagctggtagatgcttacaggcacctgcacaaagaaaaggacatagacggtggcttctcttggtccggtcatccaattggcaagtaccgaggaaagagaatgaggatcgactacttccttgtttcggaacagttaaaggacagaatagtttcatgtgaaatgcatggccgtggcattgaattggatggattttatggaagtgaccactgccctgtttcgcttgagctttccgaagctgtagcagaagaagcaccaggacagcccaagccatccatctaaatataccaccatggtggtcattgttgagacatttccggtccttcattaaacctgactgttccatgcattgcctactctaggtagctgaggtttgattgtaggtattattatgatcccagtaggttaccagttcctgtggtcagggctggtatagtttagggatcattgccatttaagcagtgcaatttggacatctcattctgcttgaaatgttgtttgtctaagagcagccatggactacctaatacctcatggggatcgaagagattaatcccttcgtatccaattttaactagcaagggatttaatccacccctaacaagcacaataaaatcttgttcgttttttctaccacaaaaaaaaaaaaaaaa

SEQ ID NO: 17855 - DNA, 1795 bp, Zea mays
cctggggccagcctcgtcaactccgcttccggttctggcccattggcgttgcttcacatcgacgcgcctgcgccgccggtccgccgcgccttcccctcccttctcccccgcgtgccctcctattccttctctgcggcggcgtggggagctgcatctgccttcgtctggaggagtgggaagaagcgctgccgaaggggtgatttacgaagccagagagcggctgggagcaagagtgcctgggactgggagttgaagctagagaggctagttgcttgtttggtgcgctgccaaaccgccctcaacatctgacccgtctctccctcacttccacggttccagcgagcggcgcaaccgcgcaactgagcagctagcatgggggacgaagaagatgatcctgactggctccgcgcgtttcaggcaccaactgtggcacctgtgatgctttcttctggttcagatacctcccctgaagctagtcctacaagaaccagtacatctagaaaacaaaacaagggagagaagcacgctagtccagatcatgcacgtgatagagatggtgcttcacaaaataaaaacaaaatctcagcagctactagaagaaaaaaccttgtcagtaaaaaagaggggtcaactatggatgaaaaacaagctaatactcctagacgcttgactccaaagaaggatatggtaacactttcatctggttctgatgcttcaccgggaaacagcctttcgagggcccatgaagataaccatgaagagggctcacttagcactgccaagagaaagaatgctcaacaaactaagactaaaaaaacaaaggatgctggaacaaaaactggtgcagaccaagcagggaatggagatgctgaggatgatgtgcaagataaactcacagggaactctgtctcccagaggttaccattaatatttccagataaagttcaacgttcaaaggcattgattgaatgtgatggtgactcgatagatttaagtggagatattggtgcggttgggaggatagtagtttcaaatggtcctactgcaaaacaggatttgttgttggacctgaaaggaacaatatacaaaacaactatagttccatccaggacattttgtgttgtgagtgtgggacaatcagaagcaaagatagaggctataatgaatgacttcattcaactggaaccacaatccaatttatttgaagcagagactatggtggaaggtacccttgatggattcacatttgattcagatgaggagggtgacaaactctatgaaccacaggctaatcaaaacgatctgaataataacgaagatgaaggtcaacctaaggcaaagaccaaaaggaaagcagagaaaacaacggggaaggcaccgaagaaggcgaaggttgcaggaaagggccctaaaaagggcacgaggaaaacccaacctgcgaagagaggtaggaaggctaagaaatgatgacatgttgatttcctcggataagaagaaaaagtctattgagaacctggatagctggcaacaaagatgtgaatttttcaacgcatagtcatggctgtgaggcgcgtcgtcagttcaacatcatgcagtacttgttttagagagagagaacatgtaaagctgtaaacgttgttgtgtactctatgagcgttcagctttggatcattgaaaagaccgagatgttcacgtggaggcgaactgacttctctattttttttcacaaattaaaatctatcagtaaggctttgttcgtttaaaaaaaaaaaaaaaaaaaaaaaaaaaaaaaaaa

SEQ ID NO: 17856 - DNA, 992 bp, Zea mays
gaatatgggtgatccgacgagtttatttttttacaggtatggatatgagatagcattgccaatgccgtctctaatcacagctccaaacgataaaaaccgaacgtctcagagctttgcctgggccaagcagcctttgttccttcgaaaccctgcctggctcgcttttggtagcccacgcgaaccgggccgcttttcagccctccgctcctgcgtcctccccttccactcgtatacaaccacccacctgagccgcacccacgctcaccgtacctcctccgaatccgccgaccgccggcgagcccctcctcctccacgacacgcgcttccccggctatcatggattcagatccatcatcacagaacccaacagatatgactgcatttgtccagaacctccttggacagatgcaaacaaggttcgagtccatgtcgcagaacattgtgtcaaagatagatgaaatgggaaccaagattgatgagctcgagcagagcatcaacgatctcaaagctgagatgggcactgagacgccggtcaagaagcctgatgagccaaagcctgctgactctgcctaacttgggtgtaacccagagattgttgtgtgaagatttgatgatggtgtgacaaatttcagcagtacgtgatcgtatctgttttcatgagtcctggcagttatgtagacacgaacccatcgtatgaaagatgaatccatgtttgggctctccagacatcaacgcatgttcttagcttttctgtcatctttcggcaactatttgtttgactgttataagatgttatgcaacatctactccatttgaagtaattgtcttgtgtagagcagtctgctgctgcttgtttgctgataaaaaaaaaaagctgttgtctgttttgtccaaatgacatcgaacgtacgagtcatatgagctttatgtcggggtgtgccgtttattggcacaatctggcgctgcaataaaaaaaaaaaaaaaagccccta

SEQ ID NO: 17857 - DNA, 719 bp, Zea mays
gaccctcgtcagccctccgctcctgcggcctccccttccactcgtatacaaccacccacctgagccgcacccacgctcaccgtacctcctccgaatccgccgaccgccggcgagcccctcctcctccacgacacgcgcttccccggctatcatggattcagatccatcatcacagaacccaacagatatgactgcatttgtccagaacctccttggacagatgcaaacaaggttcgagtccatgtcgcagaacattgtgtcaaagatagatgaaatgggaaccaagattgatgagctcgagcagagcatcaacgatctcaaagctgagatgggcactgagacgccggtcaagaagcctgacgagccaaagcctgctgactctgcctaacttgggtgtaacccagagattgttgagtgaagatttgatgatggtgtgacaaatttcagcagtacgtgtatcttccgatgatcgtatctgttttcatgagtcctggcagttatgtagacacgaacccatcgtatgaaagatgaatccatagtttgggctctccagacatcaacgcatgttcttagcttttctgtcatctttcggcaactatttgtttgactgttataagatgttatgcaacatctactccatttgaagtaaaaaaaaaaaaaaaaaagggccctagggccttgtttgcttaaaaaaaagaaaaaaaaaggcccctagggcc

SEQ ID NO: 17858 - DNA, 733 bp, Zea mays
gggtaccctccgggtccggccgggagccctccgctcctgcgtcctccccttccactcgtatacaaccacccacctgagccgcacccacgctgaccgtacctcctccgaatccgccgaccgccggcgagcccctcctcctcctccacgacacgcgcttccccggctatcatggattcagatccatcatcacagaacccaacagatatgactgcatttgtccagaacctccttggacagatgcaaacaaggttcgagtccatgtcgcagaacattgtgtcaaagatagatgaaatgggaaccaagattgatgagctcgagcagagcatcaacgatctcaaagctgagatgggcactgagacgccggtcaagaagcctgatgagccaaagcctgctgactctgcctaacttgggtgtaacccagagattgttgtgtgaagatttgatgatggtacgtgatcgtatctgttttcatgagtcctggcagttatgtagacacgaacccatcgtatgaaagatgaatccatgtttgggctctccagacatcaacgcatgttcttagcttttctgtcatctttcggcaactatttatttgtttgactgttataagatgttatgcaacatctactccatttgaagtaattgtcttgtgtagagcagtctgctgctgcttgtttgctgataaaaaaaggcggctgttgtctcgtgcccccaaatgacatcgaacgtatgaggc

SEQ ID NO: 17859 - DNA, 2335 bp, Zea mays
gggtaccccgcgggccccggccccggccggaaaaaacgagaggagagcggagagacagacaggagccaaatctacgtctcctgccaattcgcctttctccaaccagcttccccgcgccgcccgcccgtcgccgctcctccccgccctctctgcccgcatcagatcgtcttccccacgccgtgtgaccgaggtcccgtgatccctcccacttctgcgccggcgaggacccgggaggcgggatgagcggctgagcacgacgatggcacgcagagccacgccgcaggaggccgccgtcgctgccgcggaggccgccatacgatccgtaggcctggggttcgacgtcgtcagcgacgtccgcctcaagttctgtaagcagcggggcgcgcccgacccctggctcatcgaacttgaccatggggaggtccaggatatcgtgctgcccggcggcgtcaccgtcgctggcgtcaccgcttcggttaagtgtgacaaaggggagcggatgaggttccgctccgatgtcctgtcgttccagcagatgtctgagcaattcaaccaggagctatcattgtctgggaaaattccatctggcttcttcaatactatgtttgagttttctggcagctggcagaaagatgctgctaataccaaagcacttgcttttgatggttggtatgtcacactatacagtgttgcgctctcaaaagggcaaattggtctccgggatcatgttaaacagtctgttccatcaacctgggatcctgccgctttggcaaggtttattaaaaaatttggcactcatatagttgttggcctaaagatgggtgggaaagatgtaatttatttgaagcaacaacattcatcaaccttgcaagctgtcgacgttcaaaaacgattgaaggagatgtcagatagtagatttcttgatgccagaccgcgggccggactcgttgggaacaatcaggatttggtgatgatgcttaagcgaagaggtgggagggataaagaatctatatctcatagtgagtggcttaatactgttcaagcagagcctgatgttacctcaatgtcctttataccaatcacttcgctgttgaatggagttcctggaagtggatttttgatccatgcaattaatctgtatctccgacataaacctccaatcgaggaattacatcagtttttggagttccagcttccaaggcagtgggcacctgtttacagtgatctcgctctgggtcctcagaggaaaagacaaggcagtacatcgttgccagtaaatttaatcggtccaaagctttatgtttgcactaacatggttgatgtgggtaaaagaccagttacaggactccggttgttccttgaaggaaggaagagcaacaaattagctgtacatcttcaacatctctgctctcttcctcagattattcagcttgaagacgacccttacaatcaccaaaccccggaatatgaccgcaaatactacgaaccaattggaccgtggaaacatttctctcatgtttgcacagcaccagtcgagtcagatgacctgtgcatcgtcacaggggcacaattagacgtggtccaccaaggcctcaagaaaattttgttccttcgcctacatttctccaaagcctgcaatgccgttgtgaggaactcggaatgggagaattctcccaacatagctcagaaatcaggccttatctcaacactcattagcacacatttctcctcggtagctcagacgcctccgccgcggccagccgatgtgaacataaactcggcggtgtaccctgggggaccacctgttccagtgcagaccccaaagctgctgaaatttgttgatccaacagagatgatgcgtgggccgcaggactcaccgggctattgggtggtttcaggcgcaaagttgaaccttgagaggagtaagatctcattgcgggtgaaatactcactgctgacagctatgatgccagatgatgagtttccacttgatgatgatgaattttagaacctggaacgaaagaaacctgtgtagcaaaggttgaggatccaagatttccgtcatttgggcatttgtttgatgttgtatactttgtggtttctttaaacattatagcataaacgagttctctgccctgaatggagcgagaagaattgttgtaacatttctttgtagcgtgggcgtggcacatagcgatcagcattagatgatagatcaaattatctgtatatatgggatgaataaaaaatattgtttcaaaaaaaaaaaaaaaaaaagaaaaaaaaaaaaaaaaaagggagttttggctccctgccgaaaaaaaaaaaaaaaaaa

SEQ ID NO: 17860 - DNA, 1635 bp, Zea mays
aaactgcctcattcattcgagctgtggcgaatcggaggcaatggcgtggccgcgtgggggtcagcaaggcagccgcggcggcagcagcgtccacctcgcgcacggcggcgcttctctgttcccaggcgctgcgaggtgacacaacaggagtctggcgacagccctctggcaagaaggaacggctcgctctcgactccgatgcgtgggagacaagcgctgcgacggtggatccggcgacccacgggcgtgggagacgaagacgagcggttataaacgtccctcaatgacaaggactcgtcatctgctccactgccactgcccttatcatcattcatcagcggcctgcctgcacgagattccgagggacagggagatccatggccgcgtcagaccaaccgccgcagccagagaagcccccgctgccgtggcgcgcgaggctgcttgtgggcgccgcctccgcgctgcacgccgcctcgctccgccgcgacggcaccgtcaaccgcttcctgctctccctcttcgaccgcgccgcgccgcccaccccgacggcccccctcggcggcgtggcatccacggaccacgccgtctccgaccacctgcgcgcccgcctcttcgtcccggagatccccggcggcggcaacgagctcccggtggtcgtgtacttccacggcggcggcttcgtcttccactccgcggcgtcggcgcagtacgacgcgctgtgccgccgcctggcgtcggccatcccggccgtcatcgcctccgtcgactaccgcctcgcgcccgagcaccgcttcccggctccctacgacgacggcgaggcagccctccggtgggccctagccggcgcggcaggcgcgctgccgtatccccccgccgccgtcttcgtggccggggacagcgccggcggcaacgtcgcccaccacgtcgccgcgcgcctccccgacgccgtcgcgggcctcctcgccgtgcagcctttcttcagcggcgaggcgccgacggggtcggagatgcggctccgcgacgccccgttcgggagccccgagcggctggcgtggctgtggcgcgcgttcctgccgcccggcgccacgcgggaccacgaggccgccaacgtgcccgccgcgatcaggcgcgacgcgggcgcgggcgcggaccggtggcgggcgttcccgcccacgctggtgtgcgtcggcgggtgggacgtgcatcaggacaggcagagggcgtacgcggacgcgctccgcgccgtgtgctccgaggaggtcaccgtggcggagtacccggacgccatccacgccttctacgtgttggacgacctcgcggacagcaagaagtttctgggtgacgtcgcggagttcgtgaaccggcatgcacaacagcggaggaaacccgcactaggccatgccaaggactagtgttatccgcttgcaaggatggcaagaaatcataggactggataagcttccttttgtggaaaatggaggcagcgactgatagattaagctggcagtgtttgtcactccctctatcatattgttagttaccagctggtttagattgattgttagatcactctgccatgtattcctttcgtttctatgtattaaatctacttttaagacaaaaaaaaaaaaaaaa

SEQ ID NO: 17861 - DNA, 1793 bp, Zea mays
gaccgaactgttgtattgatctcatgaagtgtgtacatatatatatacatagtgaggagacacatcgcacccctcggaattagatcacatgaaaggttttctaacagcagcgtccacctcgcgcatggcggcgcttctctgttcccatgcgctgcgaggtgacacaacaggagtctggcgacagccctcaggcaagaaggaacggctcgctctcgcggcccgcatctccgatgcgtgggagtctgggagacaagcgctgcgacggtggatccggcggcccacgggcgtgggagacgaagacgagcgattataaacgcccctcaatgacaaggactcgtcatctgctccactgccactgcccttatcatcattcatcagcggcctgcctgcacgagataccgagggacaggacagggcagatccatggccgcgtcagaccaaccgccgaggccagagaagcccccgctgccgtggcgcgcgaggctgcttgtgggcgccgcgtccgcgctgcacgccgcctcgctccgccgcgacggcaccgttaaccgcttcctgctctccctcttcgaccgcgccgcaccgcccaccccgacggcccccctcggcggcgtggcatctacggaccacgccgtctccgaccacctgcgcgcccgccttttcgtcccggagacccccggcggcggcaacgagctcccggtggtcgtgtacttccacggcggcggtttcgtcttccactccgcggcgtcggccatcccggccgtcatcgcctccgtcgactaccgcctcgcccccgagcaccgcttcccggctccctacgacgacggcgaggcagccctccggtgggccctcgccggcgcggcaggcgcgctgccgtatccccccgacgccgtcgcgggcctcctcgccgtgcagcctttcttcagcggcgaggcgccgacggggtcggagatgcggctccgcgacgccccgttcgggagccccgagcggctggcgtggctgtggcgcgcgttcctgccgcccggcgccacgcgggaccacgaggccgccaacgtgcccgccgcgatcaggcgcgacgcgggcgcgggcgcggaccggtggcgggcgttcccgcccacgctggtgtgcgtcggcgggtgggacgtgcatcaggacaggcagagggcgtacgcggatgcgctccgcgccgtgtgctccgaggaggtcaccgtggcggagtacccggacgccatccacgccttctacgtgttggacgacctcgcggacagcaagaagtttgtgggtgacgtcgcggagttcgtgaaccggcatgcacaacagcggaagaaacccgcactagaccatgccaaggactagtgttatccgcttgcaaggatgacatatggcaagagatccataggactggataagcttctttttgtggaaaatggaggcagcgactgatagattaagctggcagtgtttgtcagtccctctatcattgttagttaccagctggtttagattgattgttagatcactctgccatgtagtcctttcgtttctatgtattaaatctacttttacgtctaatttttgtcgtataagtgttactgatatttttataaatctaattaaaatttaaaatttcaaccggcacaaataccataacatgaccctcattttaggacaaagggaattacatatataactctagtgaccatatgtaaaatgtatcacataaaaataataaaatctctactatattaaagtaccagttttgatgatcgtcctgcgtcattttttataaaaaaacc

SEQ ID NO: 17862 - DNA, 973 bp, Zea mays
ttgggtacctcgaggccggccgggaagagtatacgctccattttataaccaaccggcggtccatctgaggaggaccaagaaacatagagagagcggttctacgtccgagtcgtcgcatcaggtcccctcgattcgccggcggcgccaccaaccaagctcatacatctgaattgactagtcaaactcagtgatctctttggggactaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagctaggccaggtcattcaactgcaaggtgatcagcgtaaaaatgtcgctacttttctagtccaggccggaatcgtgaaaaaagatagcatcaagattcacggattttagactgcaaattttgagtgcttgtgtgtgcctatcatatggtaccatatgataccaggtattgaagcttcggaagcttgttggccttcgtaacatcagtagtcgttattcatctgaatatgtgtcattatttgatttgataagactggtattgatgcaagttgtccttgcagtatgttttgtaagtgttacctgcatgaaagtatcgtttgtctggggaactgtctactactgatattgaataacaagagagattgctgttcgtgttcgtctatgaattattatgatctttccccagacttggacactacaatccgtgttcttttatgatcactttgcttctcatgtgctttctgatatgtatttgaccttcacctcaagttgtatcttttatgatcc

SEQ ID NO: 17863 - DNA, 918 bp, Zea mays
ctaagcaggcaagcatacgctccattttataccctcctggcctccccgccggccggccgcaagaaacagagagagcggttctacgtccgagtcgtcgcatcaggtcccctcgattcgccggcggcggcgccaccaaccaagctcatacatctgaattgactagtccaactcagggatttctttggggaccaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagctaggccaggtcattcaactgcaaggtgatcagcgtaaaaatgtcgctacttttctagtccaggccggaatcgtgaaaaaagatagcatcaagattcacggattttagactgcaaatttgaagtgcttgtgtgtgcctatcatatgataccatatgataccaggtattgaagcttcggaagcttgttggccttcgtaacatcagtagtcgttattcatctgaatatgtgtcattatttcatttgataagactggtattgatgcaagttgtccttgcagtatgttttgtaagtgttacctgcatgaaagtatcgtttgtctgcggagctgtctgctactgatattgaataacaagagagattgctgtttgtaattcgtctatgaattattatgatctttccccagacttgagctttacaatccgtgttcttttatgatcacttcgcttctcatgtgctttctgac

SEQ ID NO: 17864 - DNA, 921 bp, Zea mays
  misc_feature (882)..(882): n is a, c, g, or t
ttgggtacctcgaggccggccgggatacgctctttttctttcggcagggggtcccgcgggccggcgggcaagaaacagagagagcggttctacgtccgagtcgtcgcatcaggtcccctcgattcgccggcggcgccaccaaccaagctcatacatctgaattgactagtcaaactcagtgatctctttggggactaatcaaactcaagaactaagtttcatgtctgatctcgacgtccagcttccatctgcttttgatccgtttgcagaggcaaatgctgaggattccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagctaggccaggtcattcaactgcaaggtgatcagcgtaaaaatgttgctactttcctagtccaggccggaatcgtgaaaaaagatagcatcaagattcacggattttagactgcaaattttaagtgcttgtgtgtgcctatcataagataccatatgataccaggtattgaagcttcggaagcttgttagccttcgtaacatcagtagtcgttattcatctgaatatgcgtcattatttgatttgataagactggtattgatgcaagttgtccttgcagtatgttttgtaagtgttacctgcatgaaagtatcgtttgtctggggaactgtctactactgatattgaataacgagagattgctgttcgggttcgtctatgaattattatgatctttccccgcccttgagctttccattcgtgntcttttatgaccaaaaaaaaaaaaaaaaaaaagccccta

SEQ ID NO: 17865 - DNA, 1906 bp, Zea mays
ccacgcgtccgcttggcctgtgcgtgcgtctgccaagttccagaagccacgccaccgatcgtgattattatccatcaatcgagctccccggtccgatccatccaactcttcataacaggcgacctgagagcagagcagacagagagcgttctggcagccgttgcggagcttgaacctctgcaaccaccaacagctaaactaaaagcagcggcggacggcgcgcggtactggacgaccggccgacgatggctacgccggcgcagcagcagggtgaccagcaccagccgaggctgcagaaggtgatggtggctgtagacgagagcgagtgcagccggcacgcgctggagtgggcgctgcggaacctggcgcccacgctggccccaccgctactggtgctcaccgtgcagccgcacttcccgctcggatacgtctccgccgcgtccttcggcgcacccctgggcaccgtccctccggtggctccggagctcatcaggtcgatgcaggagcagcagagggagctcacgcaggagctcctcgacaaggccagggccatctgcgccgagcacggggttgctgtagaggcaattgtcgaggtcggagatgcaaaggaggtgatatgtgaagtggctgagaagaaaaatgtcgatctgctggttcttggaagccacagtcgtgggccaatacagaggttgttccttgggagcgtcagtaactactgtgtacatcattctaagtgtccagttcttgtggtgaagaaccaaggctgatgaaggattcaactcccagctgctagtcctaatcatgttcgggtatttgtcaacgtatttgtaatgtgtagtacttgctttagccaaacgcattggcgaataaagtagcttgctttgcttcttggaagggccgaggctggactggaggagagttctttttctttttcttttttctggtcagtgtgcctttgctccggaatggcagagttgtaaataagaactacgaactttgtgcgtatttatggttgttgtatttatgattgttccctaaaccctaaaccaatcaatcaagcaaatagagttgtaagctatatttagctaggattttaaataagcaatcaaacaaataaggcagccgttgccactatccatttctcatctctcccagatccgatcgcggccactgccatggcagaagcagccggcggcggacccctgctccccgaggaactcgttatctgggagatcctgacgcgtctgccggcgaagcccctcctccggtgccgcgccgtctgcctctcctggcgccgccgactcacctccgacgctaagttcctcctcgcccaccaccgtcgccagccgtcgctcccgctcctcacccaaggggacaggagcaccgaggacaggaggatcgacgccctggactaccgcaccggcgagcggctccccgtcgcgcggacgacgggccggaccgccgccaacgccgacgacctgaacgtgctcgcttcctgcgacggcctcctcgtcctcatcgccaacggcggcctccacatctgcaacccggcgacccgccagcgcgcgccgctcgcccttctccacggcgcctcctgcatctccgcgctttacccttaccgcccgtccgggtcgtaccgggtggcgggtgctctgctgcttcgagagagccgaggacggccacgccgtgtaccacgtgcacaccgtcgggtcgcgcgagctcaggtgcgtcggagaacctcccgcgctgtgggcgtccggagacgtggcgatggcgatgccgatgatgttgtgctttcacccgcacgtcgtggcaggcagcaggatctactggcagccggtaaagctgcccggcggcaacgggaaggtcaacaacatgctcgcgttcgatacagtgaccgagtcct

SEQ ID NO: 17866 - DNA, 1775 bp, Zea mays
gggatcatttgtgcatataatttatgggtctgatggtaaaatagagaaatccataattgagagtgacaaaatagcaaatagcccattggcgacgatgggcgcccgcgcagccgggcgcggaccgctagtccccgtatccgttcggcttgaaatttccgatttctgccagatccaatcgcggctaccatcatggcagaagcggccggcggcggacccctgctccccgaggaactcattatctgggagatcctaacccgtctgccggcgaagcccctcctccgatgccgcgctgtctgcctctcctggtgccgccgactcacctccgacgccaaattcctcctcgcccaccaccgtcgccagccctcgctcccgctcctcactgaaggggacaggagcaccgaggagaggaggatcgacgccctggactaccgcaccggcgagcggcgccccatcgcgcggacaacaggccggaccgccgccaacggggacgacctgaacgtgctggcttcctgcgaaggcctcctcatcctcctcgccaacggcggcctccagatctgcaacccggcgacccgccagcgcgcgccactcactcttctccacggcgcctattgcatctccgcgctttaccctcacatcccgtccaggtcgtaccgtgtgctctgctgcttcgagagagccgaggacggccacgccgtgtaccacgtgcacaccgtcgggtcgcgcgagctcaggtgcgtcggagaacctcccgcgccgtgggcgtccggggatatggtaatggcgatgccgatgatggtgtaccttcacccgcacgtcgtggcagacagcaggatctactggcagccggtaaagctgcccgtcggcaacggcaaggtcaacaacatgctcgtgttcgacacaatgaccgagtccttccagcaactgctgtcgcccgtggagggcccctttcttgaactgtttcagatgaacagcggcgcccttggattgtaccactgccgcagcggcaaggttgatctttgggtgttacaggatcacgggagctggtcctggtcgatgaaccaccggatcaaattggacgtgatgtttttctccctgctgccggtgctggacccggaaggagatgtgctagtgctttctaaaagaggggaaacaggcatcctgtggcaacatctgcatcacatttctggtgtcaatggcagtttgctggccctgtatcaatggagcgcttatctgaagcttagcaggcataggctcaaagaaagtctagtccaccatgacttcttctcgatggaaggtaatgagggtggtgtggatgaaaaaccattgttcgatggcttgtcaactgtggcattgcttcgtgatgataattctgagccacattgagaaacaaaggtattactcaagctgtttcatctcatcaggatggagtcactcctgcctagtaataacagcactgcagattagtaataacctgaaactatacctcgagtctgatttttcccttttcacatgagtcataaacactgttatgactggtattttattttcccttttcacgtgagtcatgaacactgttattactggtattttattttccattttcacatgagtcaaaaaaactgttatgagtggtatgtatgtgcgctggaaaacgggctatggcggtgttggtctcaaattagttgccatttggttcacgaaatgtaacgtaaatggtaacgacaatataacaattttaaggaaggcaaacattttgcctagcctcaagcgcttct

SEQ ID NO: 17867 - DNA, 3410 bp, Zea mays
gcgccggatcggagcggcgcggacggcaaggaaacgacccccaaggacttaccgccggtggagattgctgccggagcggccctgccggaacatcgagaacgccaatgtcctgctccacggggagacggacacggaaggcaggagacgaaggctgcagacgagaagccagacctgaggagaccggagagttggcggcaccgggagaaggggcggaggccccgccgccagggaaggcggcgccacgagaggccgcgacttgcatatcagacagaaccccaactatggtgtgatgcatgcaattgttaccctaagaaaagatgattcaacttgtttctcattgtcttgttttagaagttcaagctgtaacataaaaaacttctctcttcatctattgattgtgctgcagaagcaacagtttcagctgtttctgcagtatcctataatttatccacaattttattgatggtaatggtagaatcatatgcacgagtaccctgcactaactggtggagttcgtcatctttaactcgaggtgtctcttgttggtcacagatgcattgccattgccacaaaaatagaaatagaaataaaaaaagaatttcagtacccaatggtcaaaatataacataatataatttcagaagtatacaaaagagtagtaccatcattgctgtgagcgaacaaccgccccgccgtattggatttggctatcctagctgtcgtggattcacgagtactgctctccgctcgcctccgcctcgtagacatgtggctgacttcgccaacttggcctgtgcgtgcgtctgccaagttccagaagccacgccaccgatcgtgattattatccatcaatcgatcattccggtagtatccatccaactcttcataacaggcgacctgagagcagagcagacagagagcgttctggcagccgttgcggagcttgaacctctgcaaccaccaacagctaaactaaaagcagcggcggacggcgcgcggtactggacgaccggccgacgatggctacgccggcgcagcagcagggtgaccagcaccagccgaggctgcagaaggtgatggtggctgtagacgagagcgagtgcagccggcacgcgctggagtgggcgctgcggaacctggcgcccacgctggccccgccgctactggtgctcaccgtgcagccgcacttccccctcggatacgtctccgccgcgtccttcggcgcaccccgtacgtaacgtaccgatcgacgcctcattttccttgctctcactcccgtcttcttcgacatgtatgggctgaattgaacgggatggtccggttggtttgctagtgggcaccgtccctccggtggctccggagctcatcaggtcgatgcaggagcagcagagggagctcacgcaggagctcctcgacaaggccagggccatctgcgccgagcacggggtatgtgcagatccggtccccttctttctcccaagtgctagcgtttatctattttacagatcgtcgaagtactttctttttggctaattttcacagagcaggttttagctagaagcctacaactagctgttccttagctagagccatagagggattgaggttaccactcgacccctgtttgaactgcactgcaggttgctgtagaggcaattgtcgaggtcggagatgcaaaggaggtgatatgtgaagtggctgagaagaaaaatgtcgatctgctggttcttggaagccacagtcgtgggccaatacagaggtatacatgcatcttggacccatcaagagttaatcctaagcacttggtcactcgttttctcaccactatccttcatcgtcgctgcaggttgttccttgggagcgtcagtaactactgtgtacatcattctaagtgtccagttcttgtggtgaagaaccaaggctgatgaaggattcaactcccagctgctagtcctaatcatgttcgggtatttgtcaacgtatttgtaatgtgtagtacttgctttagccaaacgcattggcgaataaagtagcttgctttgcttcttggaagggccgaggctggactggaggagagttctttttctttttcttttttctggtcagtgtgcctttgctccggaatggcagagttgtaaataagaactacgaactttgtgcgtatttatggttgttgtatttatgattgttccctaaaccctaaaccaatcaatcaagcaaatagagttgtaagctatatttagctaggattttaaataagcaatcaaacaaataaggcagccgttgccactatccatttctcatctctcccagatccgatcgcggccactgccatggcagaagcagccggcggcggacccctgctccccgaggaactcgttatctgggagatcctgacgcgtctgccggcgaagcccctcctccggtgccgcgccgtctgcctctcctggcgccgccgactcacctccgacgctaagttcctcctcgcccaccaccgtcgccagccgtcgctcccgctcctcacccaaggggacaggagcaccgaggacaggaggatcgacgccctggactaccgcaccggcgagcggctccccgtcgcgcggacgacgggccggaccgccgccaacgccgacgacctgaacgtgctcgcttcctgcgacggcctcctcgtcctcatcgccaacggcggcctccacatctgcaacccggcgacccgccagcgcgcgccgctcgcccttctccacggcgcctcctgcatctccgcgctttacccttaccgcccgtccgggtcgtaccgggtggcgggtgctctgctgcttcgagagagccgaggacggccacgccgtgtaccacgtgcacaccgtcgggtcgcgcgagctcaggtgcgtcggagaacctcccgcgctgtgggcgtccggagacgtggcgatggcgatgccgatgatgttgtgctttcacccgcacgtcgtggcaggcagcaggatctactggcagccggtaaagctgcccggcggcaacgggaaggtcaacaacatgctcgcgttcgatacagtgaccgagtccttccagcaacagctgtcgcccccgcccgtggagggccccttccttgaactgtttcagatgaacagcggcgcccttggattgtaccactgccgcgccggcaaggctgatctttgggtgctacaagatcacgagagctggtcctggtcgatgaaccatcggatcaaatttgacgtgctgtttttctctctgctgccggtgctggacccggaaggagatgtgctagtgctttctaacgaaggggaaacaggcatcctgtggcaacgtctgtatcacatttctggtgccaatggcagtttgctggcccagtatcaatggagcgcttatctgaagcttagagcatctccaac

SEQ ID NO: 17868 - DNA, 1271 bp, Zea mays
gtcctgtctcctccacccttgcctccgagtcacctcctcccttggtctccgccgtcgctgcctccttgccggaaccctaaatggaccccggcgccggcgcacactactccgtccgtaccgcggaagaggttttccgcgacttccgcggccgccgcgcgggcatgatcaaggccctcaccaacgaggggcagccattcggccccccgcgccaccccgaaaaggaaaacttgtgcctttatggctaccccaacgaaacatgggaagtaactttgccagcagaggaagttcctccagagatccctgaaccagctttgggtataaactttgctagggatggcatgaatgagaaggattggttagcgctagttgctgtccacagcgattcctggttactagcagttgcattctactttgcagcccggtttgggtttgacaaagaggccagacggcggctcttcaacatgataaataacttgcccacgatatttgaagtagtgactggggttgcaaataaacaaaacaaggagaagggccccaatagtaccagcaaaagcaacaaaacaagttcaaaaatgacatcaagacccgagtctcattccaaggcgacaaaagtggcagtgccccctaaggatgacgatgatgagagcggtgaagaatatgaagaggaagagcgtgataacaccttatgtggatcatgtggaacaaatgacggcaaggacgaattctggatctgttgtgatagttgtgagcggtggtaccatgggaagtgtgtcaagatcactcctgcacgtgctgagcacatcaagcactacaaatgcccagattgcaacaacaagagggcaggagcctagcgtcaagccctggtgtgaccctggagtgaagtaagcgtcaaatcattgatgtctgcagatatatgcctacttgtctagcttgtagacttgcttttcatttcgcatgaacgctattgattcactcggttgccctctgcagctcatattgctcgggcttaattgtgtttaatgttttataagcggttgttgttgtagtaccaggcagtcttgcagacatgtgatagacgtttttggactcggcttaactgaccgttctacattgctagtctaaaaaaaaaaaaaaaaaaactcgtggccatttgacttttcacaatggcataggtgtttcgatttttgactgaccatgtttaggttttaatcctcaaacctttgatcgattgctttgttcaaagccaatatatgtcccaattatacttctgc

SEQ ID NO: 17869 - DNA, 1121 bp, Zea mays
aaaaaataaaacctcacccctccttggtctgcggccctttgtcctgtctcctcccacccttgcctccgagtcacctcctcccttggtctccgccgtcgctgcctccttgccggaaccctaaatggaccccggcgccggcgcacactactccgtccgtaccgcggaggaggttttccgcgacttccgcggccgccgcgcgggcatgatcaaggccctcaccaacgatgtggagaagttctaccagctgtgtgaccccgaaaaggaaaacttgtgcctttatggctaccccaacgaaacatgggaagtaactttgccagcagaggaagttcctccagagatccctgaaccagctttgggtataaactttgctagggatggcatgaatgagaaggattggttagcgctagttgctgtccacagcgattcctggttactagcagttgcattctactttgcagcccggtttgggtttgacaaagaggccagacggcggctcttcaacatgataaataacttgcccacgatatttgaagtagtgactggggttgcaaataaacaaaacaaggagaagggccccaatagtaccagcaaaagcaacaaaacaaggtccaaaatggcctcaagacccgacgctcattccaaggcgacaaaagtggcagtgccccctaaggatgacgatgatgagaccggtgaagaatatgaagaggaagagcgtgataaccccttatgtggatcatgtggaacaaatgacggcaaggacgaattctggatctgttgtgatagttgtgaccggtggtcccatgggaagtgtgtcaagatcactcctgcacgtgttgagcccatcaagccctacaaatgcccagattgcaccaccaaaagggcaagagcctagcgtcaagccctggtgtgaccctggagtgaagtaagcgtcaaatcattgatgtctgcaaatatatgcctacttgtctagcttgtagacttgcttttcatttcgcatgaacgctattgattcactcggttgccctctgcagcttcatattgctcggggcttaattgtgtttaatgttttataaaaaaaaaaaaaaaaaaaaaaaaaaaaaaaaaaaaaaaaaaaaaaaaaa

SEQ ID NO: 17870 - DNA, 2533 bp, Zea mays
cattatttttagtggaccttcaccagttcggagtattcagatgactatttttgcatagaataaacaggtttatgcttctatatggatgcttgaaaatgtgtggtttgcgtttctccttaacaggcggcgactcttcaacatgataaataacttgcccacaatatttgaagtagcgactggggttgccaagaaacaaaacaaggagaaggaacccaataataccagcaaaagcaacaaaccaagttcgaaaatggtaaagtttagacactaatcatgctacccttcaatgttttcatcactgatgtttttctgtttcagacaacaagacccgagtctcatttgaaggcgacaaaagtggcgccccctaaggatgaagatgatgagagcggtgaagagtatgaagaagaggaagagcgtgataacaccttatgtggatcctgtggaacaaatgacggcaaggacgaattctggatctgttgtgatagttgcgagcggtggtaccatgggaagtgtgtcaagatcacgcctgcacgagctgagcacatcaagcactacaaatgcccagattgcagcaacaagagggcaagagcctagcaccaagccctgctgtgactctggagtgaagtaagcgccaaatcattgatgtctgcagatatatgcctagctgtctagcttgtagacttgctttccatttggaatgaacgctgttgattcactcggttgccctcagcagctcatgttgctcaggcttaattgtgtttaatgttttactagcgaaaaaaaaaaaaaaaaaagtgtgttgcatcggagcgtatattttattatccggtaatcgtacccatagcaaacttgtctatacgttgcaacaggacgtattattgtgcggttatttaaggctagccatttttgtttgactaaaattgagccagccttatttcaaataaatatcaaggccaacacttagaattattgtaagctagctatttttgtttgattaaagctgagccaaccttatttcaattaaatatcaaggccaacactcagaattagatgctgtagctacagtggacttctaacaagttttggcctcgtttgttttagtttttttctagattttggccgacagaagctgtcatggaccgccaaacgtctagctttttacttgtttttggaagaaccgatttgatgaaaacagtcaaaatcaatacgaacacataattgtccaagtcgttttcgtcactttttagattctaaaccctaaatcctaggtgttcgtatctttctacccacataatctctcacaatattcagattctttctaagttagattctcagaaaacctggttcgcaaaaagctaaaacaaacagaccagtctaggatggcggtatcacgtacaaagttagactatctacggcggttttctctatatcatctctctaattttcatttttttcataaccctctaaaagatttcatcccctaaattctaactccaggagcagttacctctaaatccatcaactatacaaattctaactccaggagcagttacctctaaatccatcaactatacacaatacactatatttttaatataagttagatttttcacatatatttatcatagtcttaggggaaaagagagacaacactgtatatttagggacagaaggatctgcccttaaattcagtgtgttctttaccgttggattttagggtacctctaaagctttaggcgatatgtggtggatagctgattgccgcctttttattcctaccacatatatcacaattgacaataaagcaaaatactaaaaaagaaaacatccttttagcactcggtttggttgaatggagaatgtccaataacgtctaaatcttcgtcttttcagtgctgacatgaatatcacaattggcaatagagaaaaaaaaatattggcactcggcttgttggttgaatggagaatgaccagtaatgtcgaagaggcagtgatttagccaattttaaaaattattttataaaacaatgtctttattttcacatagctacaacctatataagaaaataatatatctggacgtgtaattatggttttatttgatgtgtttttaccttcgtaaaatagttatgcaacctagatcttatttttattattagtctagcaagctaaactaggatacacaacctaattaaataatacataaaatatgaaagcttaattgagctagagttgcaaactcaccctgatatttttaacgaggtatcgataagcttacgctttctcttagtacttacaaggaccaagcctcgagtcaggcaacttcgtgaataacctcttgtcttccccatgtgtaagtacatctctaagatggcctctccacatcgtctccactatcgagcttctggccaaaacatcacgtgtttcattttctttggtacatagtagcataaacacaatgcaagttataacttgcatataggatcagtaaccatcatccaactcatcaatatcaagagcataatcatgtctt

SEQ ID NO: 17871 - DNA, 1163 bp, Zea mays
attgccatctctaaacctcacccctccctagtatgcgaccctgtttcctgtctcctaccctcttgcggtcttgccagcgccccttcctcccttcgtctccgccgccgcggactcctcgccggaaccctaaatggaccccggcgccggtgcacactactccgcccgtaccgcggaggaagtcttccgcgatttccgcggccgccgcgcgggcatgatcaaggccctcaccaacgatgtggagaagttctaccagctgtgcgaccccgaaaaggaaaacttgtgcctttatggctaccccaacgaaacatgggaagtaactttgccagcagaggaagttcctccagagatccctgaaccagctttgggtataaactttgctagggatggcatgaacgagaaggattggttggcgttagttgctgtccacagcgatgcctggttactagctgttgcattctactttgcagcccggtttgggtttgacaaagaggccaggcggcgactcttcaacatgataaataacttgcccacaatatttgaagtagcgactggggttgccaagaaacaaaacaaggagaaggaacccaatagtaccagcaaaagcaacaaaccaagttcgaaaatgacaacaagacccgagtctcatttgaaggcgacaaaagtggcgccccctaaggatgaagatgatgagagcggtgaagagtatgaagaagaggaagagcgtgataacaccttatgtggatcctgtggaacaaatgacggcaaggacgaattctggatctgttgtgatagttgcgagcggtggtaccatgggaagtgtgtcaagatcacgcctgcacgagctgagcacatcaagcactacaaatgcccagattgcagcaacaagagggcaagagcctagcaccaagccctgctgtgactctggagtgaagtaagcgccaaatcattgatgtctgcagatatatgcctagctgtctagcttgtagacttgctttccatttggaatgaacgctgttgattcactcggttgccctcagcagctcatgttgctcaggcttaattgtgtttaatgttttactagcgaaaaaaaaaaaaaaaaaacgcgggcccggagcgaataatttgcggcccggtaatcgtacccaaaaaaaaaaaaaaaaaaa

SEQ ID NO: 17872 - DNA, 6904 bp, Zea mays
  misc_feature (5317)..(5317): n is a, c, g, or t
  misc_feature (5543)..(5543): n is a, c, g, or t
aaaaaaaaaccaccaagaaccccgtttttcttcatgaattttattggcgacccaaataaaaataaattcaccttgaacctttcaacttcaatgcaaatgaagttatcacgtgctcactctattctagttttataaatcaatttttttgaaactatttatcattttcacgaccttattattgtgcatcatatttcttaggctgtctgcagcaaatcgagcatatgatcgtgtaaaatattgtcctacactataaactgtcttatttatagttttaaatagaagatatgacgtgacagccttatgtttatatatataatagttggcttaaagcgactaacatcgtttgattattgttaagagtaattgcagctaagtagaccatgccagaattgaataatcattcaactgataacctaccatcatatctagaatcccatgctccctaccggcaatatcgggattttaaaatacagtcaagtaaatctgagtaaaaaaaatcggtaaaatcacctgccctcgcggccggcccgcacgcgcatcgttcaatcagcctttcctttgcctcatgtggtcatgctcttcatccccagatgcatcctcgctctctccccacaccatgtgtgtgcccagattcccctaaataggtgtctcgcctctggcatcagtcccctcttccccttccttctcctcggtccctatccgctgctgcgaacagcagaagctgcggcacggaggtgcgctctccccggcggtggagttgcagctgcagggggaagaagcgagctagagctgcagggatgataagcgccaagtccaacgccgccgtgtacccgtgcccggagtatgcggaggtcgaccccaccggccggtacggacggttcagcgacgttcttggcaagggcgcgtccaagattgtgtacaaggcgttcgacgagtaccaggggatggaagtggcgtggaaccaggtgaagctgcacgacttcctgcagagccccgaggacctggagcggctctactgcgagatccacctcctcaagacgctcaagcaccgcaacatcatgaagttctacacctcctgggtcgacgtctcccgccgcaacatcaacttcatcactgagatgttcacctccggcaccctccgccagtacaggcagaaacaccggagggtgaacatgtgggcggtgaagcactggtgccggcaaatcctcagcggcctgctgtacctccacagccacaatccgcccatcatccaccgggacctcaagtgtgacaacatcttcgtgaacggcaaccagggcgaggtcaagattggcgacctcggcctcgccgccatcctccgcaagtcccacgctgtccactgcgtgggtacaccggagttcatggcaccggaggtgtatgaagaggagtacaacgagctggtggacatctactcgtttggaatgtgcgtgctcgagatggtcacctttgagtacccgtacagcgagtgtacgcacccggtccagatctacaagaaagtgatctctggtactaagccagaagctctgtacaaggtgaaagatccaatgctgaggcgctttgtcgagaagtgcctagtatcgtcatctcagagactgtcagcaagagaactgcttgaggatcccttcctacagggcgatgtcgtggctgtttctttggatggtggagattatcatgtaccgaccaagtacgtacggcagccttcatatctagggcatacctatagcaatggctccatggtgagtaatggattctcagaaagcatggatgaggacgctctgagtgaagactgcgaggatgatgacatgaaaggccaagatggcattgacctgttcaacgagaatgaggatgaacctcttggcaatgtggacataacaatcaaagggagaaagagtgaggatggaggcatattcctcagattgcggatttctgataatgatggtatgcacaatttgtaacgcataaacatctgaagtttggtccatatatgaaaacttatttttgatatttttgcaagctaatttttcaaattgcaggacgggtacgcaacatctattttcctttcgacgttgaggctgataccgcactaagcgttgcaactgaaatgatagccgagctggatataactgaccatgaagttactcggattgctgacatgattgatggtgaggtcagtgcattggtaccagattggaggcctggtccgggcatagaggaagctcctgacacttcatactgccataactgtggatccaacgtctcatcgtgcggttcactttacgcctacatgtcatcaggccgtcgaggttgccaatgtgcagagctacatgggcggtttgaagagatcacgttccaagccgatggagagcagtgtgatttgcaggaatctgcaggcagctctgacgatggaggtggccaaacagagcattatgtcaaaagcaacgagtccactcatgtgaatggcctcgtacagatgggaagaagagatctttctaatcagctttgcttcagttcattccaagagcaatcatgttcatataaccgttacgagaatgacactaaccatcatgtgaatgggttcgacataaagcatgaggtaaagatcgccaagtacaaagcacggaaaatggcacagtttaagagggctatccatccatctcttgacttcgacaatgcatatggagtaaataggggtaagccttcactgaacaagctgcaatctttccatgttggaaagaaccacaatttccgtgtgccaacctgtgatcgaagcccgggtaaagtaagcacagactatcattctgacttgaacagccaagtatggcaaagtaggcaccccgatccgggagcccaaagggcccggcattgtgaggtcaatgcagctgggagcagcacggagtgtatgtttacagggaggcgctactacaccggagctcagctgccgccgaatctcccaagaacaaaatctgtacccctgaatgctgtcgacgcctgaaatgctttcttgccatgtaaatttttatagagtgtacatttgttttggttccttttgtatccattatgaaacatcgttgttgggcaggagagactggatgtggattctggctgagctgtttgtaaatttttaatcttgtgaatccagagaggttaggctgtacaagtgcaatctacatcatttgcctcactgggacaacctgtttttccttccttgatataggcaaagagcctttctttcacatcttcggatttctgagatgcactgttgctaatcaggcagaaacaaagccagtgacagaaccgatcacatgatcaaaaatcatggaactctatccttgccttggtactatatgacacctatgaaagggacacccacctgtcctagttgcagttaacagaatacacatcaaatctgcctcgaaggtgcagacatgccatgcctatgcatttgcactaatcaattggcgcttttgcatggcatggccctgaaggaactataactagtcattaaactatatataattgttagtgtttccgtctgatagggacagagttgcggtcatggaaagcgggtgattaaaatgatgatgtgaagacgagtcaaaagtggcagttttaaggaactccaaaaggccggctagaagtgttccgtagcaataagtgctcctacatctaatcaaccaactttttaaaggtagtgcggatgctgcctagatatattcagataagataggagttgaagcagtcaagcaccgagtgagttaggctgagggtggtaggaagctggaagcgaaaggtgcagcactgcccttcctacaattgttgaatagttcataggggagaaggggggggggggggggggggtgggacgcttctcctgcctgctttgggcgagcatcgcacgttgccctgctgcttgattgggaaacttcagcaataactggccatacaaatttattcacaggataacagattgtccctgcaaaccggagctgcttgattgtctgaaaagaagaagaaaaaggctactagaagcatgatcttgaagaaacaacaccacttctttaatgcggagtgacaagctggtctggctcctcggtggcaaaagcatgtgtggccgtgtgggataggagtagggcatggaaaggctatggccttatccagaaatgcggatgaggaggttgctctcttgagaaccaccaagattccaagaaccggattgttagataggggtggaaaggatagagatgcagtagagtctatagttttgttacctacatctgcattgtccccaaccaagcgttcttttctggtacggcaaaaagacaccatgctttgagaggatatatacaacggagaagctcttcatgccagccgatagagctctgcaggtgcagagtgccagtgtatgtacgtatctttcgcgctttgtttcgtcaaagagatgaaattagcacgagtttcctttggcttcacgaatgtgttctaggcaaagctgcgctgccgccggacctgatgaaaggtacgaggctgccttctgcaaagctgcctcgtcactcatcacttaatcatgagttgaagcggacctgctgagtgccgagtgacgcgattggccgtaaactttggacctgcactgtatgtatcgcgacggtggcaaatgtgacatcgacgtctcgcctaattctgtgtaactcggcggcgtgatgcacatgttcttgtgtgtgctggtgtttgttcatgctcttctgtgctgtgcgtggtccggatcggattcggggtgtgtaaagttcgttggttcggtaggaacggccaaagatggttaacaggaaacgtagcaagtgtagtgaccttgtttgcaagagaaagaaaatgttacactgctttttattttatatagggtaccttaagagggaaatattgtctgcaattttagacgatgcttctattaggacgagaatataaagtactcataaatagattgatgcttcaatcgaccgtacccctcacatatatagccgtggtacatagttattaaggcggtaagacaacataaggccaccgatcccattttatcttttaggagataaagcataagatgagccggcactttagttatataagtaaatataaaaaaaataatcaaatattatttatatatcattaattcaaagttaataaactagctatcacttttatatggcctagtaggcctaatttagcctagtagaagcagaaaaaaaagaaaggaaagaagctcacaataatctacgacattttgggactacatcacttttaaagggtttcntgaatctcgtgcataaatgcataatctggatcttctcttttccgagagggactacatcagagagaaaatattctacaacattttgggatcggcaagacacctaagacgtctaaaaactgtcaaaccggagagagatgaagaatgaggataaggaaaactaatttagactaagttagtgcttctattagggactcataaatagattgatttgattgattgagtgatncttcaatcggccgtacctatatagacatggtgtatggttattaagacggtaaggcgacataagacgaccgacccccttttatcttttaggcgataaagggtaggacgaggtagcactttagctatataagtaaatataaaaatgatcaaatattatttatatgatcaaatattatttatatatcattacttcaaagttaataaacaagctattacttttatatggcctagtaggcctaatttcatactagtagagcccaatacagttttaggttaaaacacaacaacaagctcctagcaacttagcagtcgcctccctctagctacatgactacctctcgccctacctctccccacttctctcctctctccccatccacccgcagctctccactctctccctccccctgcagccctcctctctcaccctcggtccctccaccgcctgaagatgcgccgcctagagccgcgccaccagtggtgaattgagcgtcgccgctgcgagggagcagagcaagcgcactgtcgaggatgtgccatgctcgccccccctcaaaatcctaactccccaaggcgtcgcactgtcgcccaacagcggctcaccgacgtcccatccatgccccgcgaacgccttacactccagagcaaggcgtgttagacaccttaggttccgagcacgccttagcatctaagcgacgctaaggtgacacttcaaggacgacttgataagcatggagtggtggcctagacccgttccaatgcgcttctcaacagatttccgcgtggttagttggataaacatgcgcaggataaggactctcgcatgaattaatgtaatcgcggaccgtctggtttacaaccgtggattgtcggagccacatgagtgaaccgtccgaccgcggccatgtgccaaatctcgcgctcaacgatttcgaccaacatgttataaagaaaaaattaaaataaattggcgatgtaaattgatggagacgattaggacatcgatggtggagggaatgagaagatggttatatgatatcttagctttgtagatgaagatgagctcaagaagctgatggagtttttgagcgtggtgtttaaccgatgataacttgttagttttaattgtctctaatctctactatattaaagcaccagttttcttcagcacctattgatttagctccttctaacatgtagagttgagagttgacattgtcgggtttcatgcttttccttcgcaactcgaaatttctacccgtcgttacttttacaatcaaccctcatccctgactcggtcggatctatattttaacatttagttgataaaatctaaaattatgtataaatgaagatcgaacc

SEQ ID NO: 17873 - DNA, 3027 bp, Zea mays
ctggccgggccctcttccttttccctctcctcagtccctgtctgctgctgctagacagcacaaactgcggtccggtgcgctctcctcggcggtggagttggagctgcagtgcaggggaagaaccgaagaagcgagctagagccgcaagaatgataggcgccaaggccaacgccgccggcccgtgcccggagtatgcggaggtcgaccccaccggccggtacggacggttcagcgacgttcttggcaagggcgcgtccaagattgtgtaccgggcgttcgacgagtaccaggggatggaggtggcgtggaaccaggtgaagctgcacgacttcctgcagagccccgaggacctggagcggctctactgcgagatccaccttctcaagacgctcaagcaccgcaacatcatgaagttctacacctcctgggtcgatgtctcccgccgcaacatcaacttcatcaccgagatgttcacctccggcaccctccgccagtaccggcagaggcaccggagggtgaacatatgggcggtgaagcactggtgcaggcaaatcctcagcggcctgctgtacctgcatagccacaatccgcccatcatccaccgggacctcaagtgtgacaacatcttcgtgaacggcaaccagggagaggtcaagattggcgacctcggtctcgccgccatcctccgcaagtcccacgccgtccactgcgtaggtacaccggagttcatggcgccggaggtgtacgaggaggagtacaacgagctggtggacatctactcgtttggaatgtgcgtgctcgagatggtaacgtttgagtacccgtacagcgagtgtacacaccctgtgcagatctacaagaaagtgatctctgtaagaaggccccctggaggcctggaccctatgagcaattgtgattctggtgtgcagtttgaaatgatcttcctgacttcagctagttgtttgatttggtagggtactaagccagaatctctgtacaaggtgaaagatccaatggtgaggcacttcgtcgagaagtgcctagcaacggcatctcagagactgtcagcaagagaactgcttgaggatcccttcctacaaagtgatgacgtggttgtttctttggatggtggaaattaccatgtgccggccaattatatacctcagccttcatatttagggcatacctacagcaatggctccatgatgagtaatggattctcagaaagcattgatgaagatgttctcagtgaagactgtgaggatgatgacatgaaaggccaagatggcattgacctgttcaacgagaatgaaggtgagcttcttggcaatgtggatataacaatcaaagggagaaagagtgaggatggaggcatattccttagattgcggatttctgatgatgatggacgggtacgcaacatctattttccttttgacattgaggctgataccgcactaagtgttgctactgaaatggtagctgaactcgatataactgaccatgaagttactcggattgctgacatgattgatggtgaggtcagtgcactggtaccagattggaggcctggtccgggcatagaggaggctcctgacacttcatactgccacgattgtggatccatcgtgtcatcgtgtggttcactttacgcctacatgtcatcaggccgtcgaggttgccaatgtgcagaggtacatgggcggtttgaggagatcacgttcgaagctgatggagagcggtgtgatttgcaggaatctgcaggcagctctgatgatggaggtggccaaacagagcactatgtcaaaagcaaggagtccactcatgtgaatggccttctacagatgggtagaagagatctttctaatcagctttgcttcagttcattccaagagcaatcatgttcatctaaccattatgagaacgacactaaccatcacacaaatgggttcgacatgaagcatgatgtaaagattgccaagtacaaagcacggaaaatggcacagttaaagagggctatccatccatctcttgacttcgacaatgcaaatggagtaaataggatgaagccttcactgaacaagctgcaatctttccatattggaaagaaccacagtttccgtgtaccgaccggtgaccgaagcccgtgtaaagtaagtacggattaccattctgatttgaacagccaattatcgcatagcaggcaccccgatccaggagcccaaagggcctggcattgtgaggtcaatgcagctgggagctctgattgtatgtttacagcaaggcgctactatgccggagctcagttgccaccaaatctcccgcgaacaaaatctgtacccctacatgctgtagacgtctgaaatgctcttgccctgtaaagtttatagtgtacatctgttttggttctctctgtacccattatgaaacgtagttgctgagagcaggagactgaatgtgacgaggttgcatgtggattacggctgagctgtttgtaaatttccatcttgtgaattcagagaggttagattgttcgagtccaatccacatcatttgcctcactggggcaaccagttttatcctctttactataggcaagagccgatttccgagatgcaaaattgctgttaatcaggcagaaacaaggcatgggactctatccttgcgttggtactagatgccacctacctctcctagttccagttgaatatacatcaaatctgcattgccagcctatgcatttgcattgccaatgccaactgctgcatggacgctgcactaatcaattgacgcttccatgactccatcctgaccgttcggcatttggcaaccccatgttcctttgccgcttctttcatgacagagctaatttaggaacttcattttctaaaagatttctatttttctaagaaaaatggactaattttctctctaatcctattcggaattggagatgattgatatgaaaaatgaactaattttctctctaatcctcttcaactccgaaggggatttgaatttctaaac

SEQ ID NO: 17874 - DNA, 2641 bp, Zea mays
ggtccctatccgctgctgcgaacagcagaagctgcggcacggaggtgcgctcttcccggcggtggagttgcagctgcagggggaagaagcgagctagagctgcagggatgataagcgccaagtccaacgccgccgtgtacccgtgcccggagtatgcggaggtcgaccccaccggccggtacggacggttcagcgacgttcttggcaagggcgcgtccaagattgtgtacaaggcgttcgacgtggaaccaggtgaagctgcacgacttcctgcagagccccgaggacctggagcggctctactgcgagatccacctcctcaagacgctcaagcaccgcaacatcactgagatgttcacctccggcaccctccgccagtacaggcagaaacaccggagggtgaacatgtgggcggtgaagcactggtgccggcaaatcctcagcggcctgctgtacctccacagccacaatccgcccatcatccaccgggacctcaagtgtgacaacatcttcgtgaacggcaaccagggcgaggtcaagattggcgacctcggcctcgccgccatcctccgcaagtcccacgctgtccactgcgtgggtacaccggagttcatggcaccggaggtgtatgaagaggagtacaacgagctggtggacatctactcgtttggaatgtgcgtgctcgagatggtcacctttgagtacccgtacagcgagtgtacgcacccggtccagatctacaagaaagtgatctctctacctgtttgatttggtagggtactaagccagaagctctgtacaaggtgaaagatccagtgctgaggcgctttgtcgagaagtgcctagtatcgtcatctcagagactgtcagcaagagaactgcttgaggatcccttcctacagggcgatgacgtggctgtttctttggatggtggagattatcatgtaccgaccaagtacgtacggcagccttcatatctagggcatacctatagcaatggctccatggtgagtaatggattctcagaaagcatggatgaggacgctctgagtgaagactgcgaggatgatgacatgaaaggccaagatggcattgacctgttcaacgagaatgaggatgagcctcttggcaatgtggacataacaatcaaagggagaaagagtgaggatggaggcatattcctcagattgcggatttctgataatgatggacgggtacgcaacatctattttcctttcgacgttgaggctgataccgcactaagcgttgcaactgaaatgatagccgagctggatataactgaccatgaagttactcggattgctgacatgattgatggtgaggtcagtgcattggtaccagattggaggcctggtccgggcatagaggaagctcctgacacttcatactgccataactgtggatccaacgtctcatcgtgcggttcactttacgcctacatgtcatcaggccgtcgaggttgccaatgtgcagagctacatgggcggtttgaagagatcacgttccaagccgatggagagcagtgtgatttgcaggaatcggcaggcagctctgacgatggaggtggccaaacagagcattatgtcaaaagcaacgagtccactcatgtgaatggcctcgtacagatgggaagaagagatctttctaatcagctttgcttcagttcattccaagagcaatcatgttcatataaccgttacgagaatgacactaaccatcatgtgaatgggttcgacataaagcatgaggtaaagatcgccaagtacaaagcacggaaaatggcacagtttaagagggctatccatccatctcttgacttcgacaatgcatatggagtaaataggggtaagccttcactgaacaagctgcaatctttccatgttggaaagaaccacaatttccgtgtgccaacctgtgatcgaagcccgggtaaagtaagcacagactatcattctgacttgaacagccaagtattgcaaagtaggcaccccgatccgggagcccaaagggcccggcattgtgaggtcaatgcagctgggagcagcacggagtgtatgtttacagggaggcgctactacaccggagctcagctgccgccgaatctcccaagaacaaaatctgtacccctgaatgctgtcgacgcctgaaatgctttcttgccatgtaaatttttatagagtgtacatttgttttggttccttttgtacccattatgaaacatcgttgttgggcaggagagactggatgtggattctggctgagctgtttgtaaattttccatcttgtgaatccagagaggttaggctgtacaagtgcaatctacatcatttgcctcacagggacaacctgttttatcttccttgatataggcaaagagcctttctttcacatcttcggatttctgagatgcaaagttactgttactaatcaggcagaaacaaagccagtgccagaaccgatcacatgatcaaaaatcatggaactctatccttgccttggtagttggtactatatgacacctatgaaagggacacccacctgtcctagttgcagttaacagaatacacatcaaatctgcctcgaaggtgcagacatgccaactgctgcatgggtgctgcag

SEQ ID NO: 17875 - DNA, 4151 bp, Zea mays
  misc_feature (4136)..(4136): n is a, c, g, or t
  misc_feature (4138)..(4138): n is a, c, g, or t
cggcccgccaacagctcacgagccgcgcgccagcccgccacacaacgcgcacgccacctgcgtgtccctgcgcgtggggcacacgttaacctataccagcagcagcagtatatcctcccaccgcccagctcactgaaagcgggcccagctcaccaccctaagcctgtcagtctcgcctctctcaccgtggtgtcgtggtgtcctgcgtgatagtgcgggtcggaacaaatgacccagcgaaaaaaccccaaccccgaaggcaaggggtgggaaaaaacacgaggcgggggtgggggatagaaatacgagagcgagcgagcgagcgagcgagcctgcagcagcgagagggacgagaggcgagagagataagcaagcggcgcgcgttaaccctagcccccgtctccgctccgctccgctccgctagcgctcccgcccgccgcctcgctcgccggaggattcgtacgcgcgccgggcccgacgacctgccgcgccaccttcgcgccgccgccgccgcgcgcgggcgcgcctcggtcggtgcgtcccccggaacttctcgctccatctccgttcgtttcctgccccccgccgcgtgtggtcgcgcgcggggtcggggtgccgtgtctgggattggtgtcgggtgggaggacgacgacggggtcgcggccactggatcggctgcgggttccgcccttccgatagggtcgcgtcgtcattgggggaggcgtggggggcgatctggagggggaggtgcggggaccgtcggatgcgttgctcccgtgtgttgctgacttaatctggcgtcagccgctcggcgaaggatgcttcccaatccagaattggctgggtgcaactcgattgtgctagcgtctgtcctgattcagtgagatgtggggtgtggtggagtctccgatgagtagatgttcgattcgtggataggctgctcagcttgtgactatctgaatttcctatgctgctcttccatgcatgtgatttgcttacgcgaacatgtgtttgtactcttttcttgcagttgcagttgtccttcaccacagcggagtgatggctgttgtcaacccaaccagcctggctattccgttgctgtcggacgatactcccatttcattcaagaggacgagtaactctacgaagactgccaggcccaccccttccaagcatgaggggtcgtcaggaggtaatggtgcacctgttaggatccccaaacctgtgtctcccaatccgcagaagaacggagccaccggggcttcaaggccgttgcatatgaagccaccgtcatccagtccaaaccatcgtccttctggatctggccagccaaacagtttggcacaacatagttcaaaggctaatagcattgacatgagtaaactgaaaagacctctcgtcaaagatgagagatctgatgactccgacgacgaggtgccgattgggttaaggagaaaggttgaggagaagaagttgaagggagttgatactcgggttcagaagacagatgactcagatgacgatgataagccattgggtctcaagatcaactcatccagaatgtcttccaacagagtgaataagcctgttctgcagagaactgtaccaaaggttgagcagcctgatgaagattcagatgatgataaaccattggcaagcaggttgcccagtaatgccggtccaaaaagtggaggtgatgtctctgaggattcagaggatgagaagccactggctgccagattttcaaaagttgctggtagtggaaacccaaaaatagcttcttccagcaaagggttaaccagtgatacaaatggccaacaaagtttgggtaaaaggcctctagacaatagtaatcaaacaagttcagctcttaagaaggctaaaccttcaaacgtttcagcttctgcaatcgttagaagagaaatcaagacagatgacaacacacctcttgcacaaaggctgaaaatgggagagtcttcgaaaggcaagtcatctgcaaagagtgtctttaagaagagtcctgcttctgtgaagaaggacatcaagaaaatgaaagggaaagggaaattaaagaagaacatgaaaaattctcagttctcaaagataatgaaggtcccccctggatctggtggaggaaagaaatggactaccttggagcacaatggtgttattttccctcccccatacaagcctcatggtgtcaaaatgctttacaatgggaaacctatcgatctgacaccagaacaagaggaggttgcaacaatgtttgctgttatgaaagacacagactatgcggccaagccaacattcattgataactttttcactgattggagaaaagttcttggtaaaaatcatattattaagaacttcgagctttgtgatttcacaccaatatatgaatggcacctcagagagaaggagaggaagaagcagatgacaacagaggagaaaaaaacattgcgggaagacaaattgaaacaagaggagaagtacatgtgggctgttgtagatggtgttaaagaaaaggtcggaaatttcagagtagaaccgcctggcttgttcaggggacgtggagaacatccaaagatggggaaacttaagcgccgcattctaccaagtgatattacaataaatattggaaaaggagctccagtccctgagtgcccgatacctggagaaagttggaaagaagtcaaacatgacaatactgttacatggttggccttttggaacgatccaattaacccaaaggatttcaagtatgttttcctggcagcaagcagctcactgaaggggcaaagtgacaaagagaagtatgagaagtccagaaaattgaagggtcatatacaaagaattcgtgagaattatacaaaagatttcaaaaacaaagatgtgacgaggaggcaaatagctgtggcaacataccttatcgataaactagcccttagggctggcaatgaaaaggacgacgatgaagctgatactgttggttgctgtacgctgaaggttgataatgttacatgtatgcctccaaatcagattcagtttgactttctgggtaaagattcaataagatactttaacaccgtagaggttgaagagcttgtgtacaaggcaattgagggtttccgtgctggaaagaagccaggacaagatctatttgacaagattgatacatctaggctaaatgctcacttgaaggatctaatgcctgggctcactgcaaaagtgttccgtacatataatgcttccataacattggacggaatcgtgcgtggagaagcagctgtcggaccggttttagaaaaaatcgctgtctatcagcgggcaaacaaagaggttgccatcatctgtaaccatcagcgtagtgtctcgaaatcacatgagtcccagatgactagaatgaacgaaaagattgatgagttgaagtcccagatggaggagctgaaagcagacttgaacaaagcaaagaaagggaagcctctaggctatgattcagaggggaagccaaagaggaacttggctcctgaagcgattcaaaagaaggttgcaacacttgaaggcaagatagagaagatggagatggataagaggataaaagaggatctgaagacagttgcgcttggaacgtcaaagatcaactaccttgatcctagaataaccgtggcatggtgcaaacgccatgaagtccctattgagaagattttcaacaaatctctcctcgcgaaatttgtatgggcaatggacgttgacccggaattcagattctaggagaccattggctaccatgtgccagccagtttggtccagtttccagcccttctccctggacactaattgcagctaggaaaggaaagagctcggtgtttgttttttcaaagcccccaccccccctgctcgtggaacgaaggaaagcacccgtcattctctttgtaggcccttcttttttttcttttggttcaattgcgctaagttcaatatgtattctgctgagaaatctgagctcgtttgagaacggttggacattgaattcatagtgagttttaatcttgaatatagatgacttgttgagggaaaaaaaaaaaaaaaaaactcaaataagacccacgcgtccgcggacgcgtgggaaaggntntggggggaaaaat

SEQ ID NO: 17876 - DNA, 783 bp, Zea mays
aattcggcacgtgcggcgtgggaatacgagagcgagcgagcgagcgagcgagcctgctgcagcgagagggacgagaggcgagagagataagcaagcggcgcgcgttaaccctagcccccgtctccgctctgctccgctccgctagcgctcccgcccgccgcctcgctcgccggaggattcgtacgcgcgccgggcccgacgacctgccgcgccaccttcgcgccgccgccgccgcgcgcgggcgcgcctcggtcgttgcagttgtccttcaccacagcggagtgatggctgttgtcaacccaaccaaccttgctattgacgacgatgacgacgatactcccatttcattcaagaggacgagtaactctacgaagactgccaggcccaccccttccaagcacgaggggtcgtcaggaggtaatggtgcacctgttaggatccccaaacctgtgtctcccaatccgcagaagaacggagccaccggggcttcaaggccgttgcatatgaagccaccgtcatccagtccaaaccatcgtccttctggatctggccagccaaacagtttggcacaacatagttcaaaggctaatagcattgacatgagtaaactgaaaagacctctcgtcaaagatgagagatctgatgactcagatgacgaggtgccgattgggttaaggagaaaggttgaggagaagaagttgaagggagttgatactcgggttcagaagacagatgactcagatgaccatgataagccattgggtctcaagatcaactcatcca

SEQ ID NO: 17877 - DNA, 1368 bp, Zea mays
ggccggaaaactaagtcgcaccgtccaggtgtctactgcaagggaaaacaaagagtgtgtgctgtgtgttatccatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactggcaccacaagctcctctgtggcgcgcggagtcggatgccgcggggggtggtgccggcgccggcgatgtcatgggcctcctcctccgggagcgcatagtcttcctcggcaacgagatcgaggacttcctcgcggacgccgtcgtcagccagctcctcctccttgacgccatcgacccggactctgacatccgcctcttcgtcaactcaccagggggatcccttagcgcaacaatggccatctatgatgtaatgcagcttgtgagggcagacgtgtccactattggaatgggcatagctggatcaacagcttctataatccttggtggtggcacgaagggcaagcgatttgccatgcccaacaccaggattatgatccatcagcctgtcggaggtgcaagcgggcaggccctagatgtagaggtccaagcgaaggagatattgaccaacaagaggaatgtcattcggatcgtatcaggcttcacaggccgcactcctgagcaggtagagaaagacattgacagagatcgttacatgggccctctcgaggctgtcgattatggactcattgatggcgtgatcgatggagacagtattatcccacttgagcctgtcccggagagggtgaagcctaagtacaactacgaagagctgtacaaggatccacagaagtttcttacaccagatgtcccagatgatgagatatactagtcgaaaagttgtattttgtgcgaatgttaagtctgttcttcagcaagcagatgtttttcgtcgcttgtagctgtcaaaccaaccatagcactagtagcttattgatcttgtttactgactggatggtgattcgagcaggcaactagaacctgttggttgtgtttctggtgttacattgtggtgttagaatggtccggctgtttcgttttgagtcctgaccatttcaggtgtggtaaaaagagatcagttaactgttcgttttttttttttaaaaaaaaaaaaaaaaaaaaaaaaaaaaaaaaaaaaaaaaaaaaaaaaaaaaaaaaaaa

SEQ ID NO: 17878 - DNA, 2761 bp, Zea mays
ttggttttgttacaccatttcctgtttcaaataataggataggatgtcttcttttactcaaggtgatttcaatttcaatatatgtacagactcaatatatcttggatactcatgttagctttcttgttcacatatatcatttgcctactctggatattgcctccattattttaaactgactggatgaatttttttaactgaagataaattgtggtactgacatttgttttggtgctgaggacctcttggtaggtgcattgggaactgaattttctttaaaaagctcaatgcacataaacatatatgctcgtaataactggtgtattaatttggagagcagtttgagtatgtaagtataacacatccatgtataaaactgatgctagtcacaggttcatattttataagaacacatcgcaggtatcattgtatgcttttgtcaaggcgtattctatgaagttaaatctgatcaaatcatttccgaatttggtatgttttgcttgatttgtgatttctatgctctgctcgcgcgataggatcttgtcatctgccagctaatgccattggtcattagttttgaaatttcttgatgatatttctttccgtcctgttctgatgtctactttctgtattacatacaggcttgcactgctgcccttttcctattgatgacagttgttactagttccctgcactcgagccttcctgcctatgcatcgatgcaaccagttgccaaaactggtggaggaggaggtctcttcacgacagagatactaagcagtggctgggctggttttttagctgggtgcttacataccttgtctgggccagaccatctggttgccctggcgccactgtcaattgggagatccagacttgagagcggactggttggcgccctttggggctgtggccatgatgcagggcaagtcattttcggcctgctcttcttgctactcaaggaccggttgcacatcgaggtgttccgtgcatggggaacaagagttgtaggcctgacccttctgatcataggagccatgggtgtccgggaagcttcggaggtccaagagtcctcgctggtgctggagggcgtggacaccagcagcatgagcagcaacgagcctctgcagcccgcttcagctccccggaagaagaaagtcggtttcgcaacgttcgccacggggatcgtccatgggctccagccggacgccctgctgatggtcctgccagcgctggctctcccgtcgcgcttcgccggcgcggccttcctcggcatgttcctggtcggcaccgtgttctcgatggggagctacactgcctttgtgggctcctgtagcgaggccctgaaagagaaggttcctaggataacagagaaactgacctgggctgcctcgctcgtagctatagccatgggtgtagccctcctggttgggcagttctttgggttcagcctgtactgatgctagcagctacggtacgtgtgttttactcgatcggcgcggtattgtttttctgtaagagcatcgctggcaattagtttgatattatcattatcatagatggttattgtttgtgagactactgctgcaactagacctgtcacctgcttactttacactgattttctgctctgtatcatttgctttttaattctctatttagctgtttgctaagccctacagttctgtagcatctgcttttcagatggaagtcaccactgacaacaataatcagacaatcccgacaggacagaaatcctagcctaaagcgcagaagattcgcgaacacacgcgcgcggctattggcaactgaccaggtccccaattcccatttgggccaggatatactgtattattactaatcacgtcgggtgtggtctctggaagagtttagagcgatccagagggccctgcagccactggatcgtcgaaagcaattccattcatagcacaggaactttctctacagaaacttcactaaaatcagttcaaatttatataaaaaaatacaaaaacacggaattgtctcgtgttccaagcgggccgaaaaagacgtgaaatgaaaaaaaaaacaacaacaacaagagtgacggtagaagctggcggcgctgaaataaacagcagatgctgaacctcttggtatgattcggacttgtgactgttggacgtgacagcaagaatgaaaacgctggcaggcggcctcgactccgaaagcgcgggaagcatctcaagctgtccgatccgtcgttatatataacaccggccgcacgcatcagccatcagactgtcagacatcagcaggtggtacgtcggatccaccgcgatctcaccagagagagagacctcgtcggccaagggcaggcggcacacgtcggctccaccagacacggcacgtcggcagcacggtcgatcaggaacggaatgcaaaaactaatcacgtcgggtgtggtctctggaagagtttagagcgatccagagggccctgcggccactggatcgtcgaaagcagttccattcatagcacatgaactttatctacagaaacttcactaaaatcagttcaaatttatataaaaaatgccaaaacacggaattgtctcgtgttccaagcgggctgaaaaagacgtgaaatgaaaaaaaaaacaagagtgacggtagaagctggcggcgctgaaataaacagcagatgctgaacctcttgacttgtgactgttggacgtgacagcaataatgaaaacgctgcaggtcgactgaagaggatc

SEQ ID NO: 17879 - DNA, 1768 bp, Zea mays
cattgggtacctcgaggccggccgggaaaaatttagaaaaagtctagacgacgcgcttgtgtgcgtggccggacctgaaaagccggttcctcccccgaccccggcgccccaccgcagccgccggctcccaccgcccggcgcaccccgtcacctctccaccaaccggatacccggacggatccgctcccacctggatcctgatccggggaagtcaaaggggagatcgaagcttgagcagagggagccaaaatggtgaaggacacgcggtactacgacgtgctgggcgtggacccgtccgccaccgagtccgagatcaagaaggcgtactacgtcaaggcgaggctggtccaccccgataagaacccgaatgatccgcaggccgcggagaagttccaggaactaggagaagcataccaagttctcagtgaccctacacagcgccaagcttatgactcacatgggaaagacggcatctcaacggaggggattattgatcctgcaacaatttttgcaattctgtttggtagtgagctttttgaggaatatattggtcaactggcaatggcatcaatggcttcacttgataattttggtgaagatgagcagattgatgcaagaaagctgcaagagagaatgcaggctgttcaaaaggatcgggaagaaaaacttgcagagacactgaaaaaccggctacacatctatgtgcaaggaaataaggcagaattcatccagcatgctgaagcagaggtgtccaaacttagaaatgcagcatatggagttgttatgttgaacactattggctatgtatattcaaggcaagctgcaaaagaacttggaaagaaagtgatgtttttgggtgttccatttattgccgaatggtttagggacaaaggacattttatcaaatcccaagtaacagctgccacaggtgcaatagctcttatgcagttgcaagataacttgacgaagtatatgagtgctgagggccagtacacagaggaggaacttgaaatgtacatggaaaaccataagaaagtcatggttgattctctgtggaagcttaacgttgctgacatagaagccacattatcccatgtctgtcaaatggtacttcaagacagtagtgccagaaaggaggaattgcgcctccgtgctaaaggcttaaaaactttaggaagaattttccagggggctaaggtcaaccctagcgagggggaaacatcacaaacgaagaatatagacaacatggatggcaatgacggcagctcccctgactcgtccccaaatagagaggcacagttcactcctaatcagcctcctgtcccgagcccgtatgtggaggcgcctcatgttaacggagtctattgtccgttcccgatgccagcagctccgcctggcgcaaggagggatcgaatcccttgagtccagataaaacctgcttgtaaaatgggctctgtttaacattgcctataatactagatcatttgcatgatgaacctggagcagaggggaacacaggagtctgtcaggtgttctctgcacctccctgttattttggtcgcgtatgcttggtagcagccgtgtcttgtgtacaggtgtgttttgctattgttgatcgatgaagctgtaggtgtacatgttatgatgcccattatattattctgttgtcggcctgctgtattttagcataaacagtggatacatttgcatccatgggaaatgaaatgttctagtcattgtttcccatcaaaaaaaaaaaaaaacggcc

SEQ ID NO: 17880 - DNA, 1864 bp, Zea mays
acccgagcaccaacacaggggccggccgctgccatcacgcacaaggcatgcaacggtctccgcacgtacgtacaaattaatccatatatcctcccgccacaattcgtcatgcccgccataaaatacaacgacgtccgcatcaacgacctctcactctcagtcaccgcgtatctgcgcatatccatgggccgccatacatgttggccgccggccgccgccgttagggccgcagcgatctgcgtgcttctgctgctgccggccgcggccgcgcaggcgcctgtggaagcagcggccgcgatcgaagcgcaaggcgacggcaatggcaccacacgaggcggaggcggcggcagcggcagcggcgcacgagggggaggaggtggtggcggtgggggcacgcggaagctggtgagcggcatcgactgccagatctgcgaggcgacgtgccgggtgaagtgcctcatcaacaacctcttccagtggggcgggtgctaccagcgctgcaagaccgacaactgcaacgactggtgcaggtagcagagagagagccagacacaacaacgggggcgcatgtccatatatggacatggactggccggaatgcatgcaatgtccacacgcacatcggattgaccggatcgatggttagacgacgacgacagggctactagctagccacacatgcatgtaccagctacaccttcctctacctgcaatcacggtcgtatctcagttttttaaggcccggctacaaaacataaaaataagtctgaagacctatagtatatagagataaaaacaatctaaaatatagtatttagtctagtcttatattcctatgctcttatattatctattttaaagtcgagcacaaaataataaacaacctttgcatttttataccatttatatttagaaaactcaaaaaaaaattagagtcacgtgccatcgctccatttacgctggacgtacggccctgccttcatccaacgtatacatacacataaacgcacatactgctgctgccactcatacgtgtattttatgagattacctaagtttggacgatacgtacttgttaacaccggaatagatgattatatattaggagttaggactagatcgttcgagtagccatgcatgaatcgaagaacgaaggcggagatatcacaccttacatgcatgctaaagaaaatggagagtttatttatgagcaaactatcaaaactaatcgtgcttacgtgaaaaagagcgactagttttagaaaaactagcaaaataaccgtgaaagctctcgtctcagaaggagcgaccccgtcgaccgatggggcaatgatgctggcatgtcactctaagtcggcaaacaagctagcctagagcgtcatccatatatatcgtcggatcaaactataaagtggggattgaaagagaggtagcagtagattagtttagattaattttgttcgattgaatattaattacctcaatcccatccggtgttgtatatatcctaagcagcatcggacacatccaatgctaatataatgcggactctcgaacacgctcgattcaatcgctttgcaagttaggttttctctcaaactttttatggactctcttaggtttatctcgcactagtttgtacaacactaccaaaatcgtgttctttaccgagtgtctggctattttacacttggcaagtattttatcggaaaaagtgttctttgccgagtacttttttcgaacactcggcaaagattttgccgagtatcgaaaaacactcagcaaagaaaataactcgacagattaataatcgaaaaaattcaaaaaaaactgcaaaactttttttaaattataggaacaactc

SEQ ID NO: 17881 - DNA, 735 bp, Zea mays
gccataaaatacaacgacgtccgcatcaacgacctctcactctcagtcaccgcgtatctgcgcatatccatgggccgccatacatgttggccgccggccgccgccgttagggccgcagcgatctgcgtgcttctgctgctgccggccgcggccgcgcaggcgcctgtggaagcagcggccgcgatcgaagcgcaaggcgacggcaatggcaccacacggggcggcggcgcacgagggggaggaggtggtggcggtgggggcacgcggaagctggtgagcggcatcgactgccagatctgcgaggcgacgtgccgggtgaagtgcctcatcaacaacctcttccagtggggcgggtgctaccagcgctgcaagaccgacagctgcaacgactggtgcaggtagcagagagccagagacgacaacggggggcgcatgtccatatatggacatggactggccggaatgcatgcaatgtccactccacacgcacatcggattgaccggatcatcgatggttagacgacgacgacagggctactagctagccacacatgtaccagctacaccttcctctacctgcaagctgcaatcacggacgtatctcagtttttttaaggtcccggtacaaaacataaaaataagtccgaagacctatatactatagataaaaacaatctaaaatatatccttttatattcaaaaaaaaaaaaaaaaagcttattcgaaccggtccaa

SEQ ID NO: 17882 - DNA, 981 bp, Zea mays
  misc_feature (876)..(876): n is a, c, g, or t
  misc_feature (892)..(892): n is a, c, g, or t
  misc_feature (900)..(900): n is a, c, g, or t
  misc_feature (936)..(936): n is a, c, g, or t
  misc_feature (951)..(951): n is a, c, g, or t
  misc_feature (960)..(960): n is a, c, g, or t
  misc_feature (963)..(963): n is a, c, g, or t
  misc_feature (978)..(978): n is a, c, g, or t
  misc_feature (981)..(981): n is a, c, g, or t
gatccggccacgctacccttccgtcgctcctccccacgcacgacccctcccggaagggcaaaaggggctcgaaatcggtcccctgatccaagagccaatcttctagttctcccaaatccttttccggatccgaactgcaagtcctccttcgcgaccatggatccacgcgccaggtatccttcgggcatgggcaacggccgcggtgggacccctaactactacggccgcggcccaccgccgcaacagccgcatcagcaccaccaccagcagcagcagcagacatcgggggcgcatcaccaccagcagtacgcgcagaggcagcagcaacagcaccgccacagccacaaccaccagcagcaacagcagcagcaccagagtcagcagcagcagcagcagtggctgcggcggaatcagattgcccgcgaggccgcgggcgcagccgtgaccagcgagccgaaggccctggcgccatccacggccgccgacggcgtcaattcgagttcgcaagattggaagacccaattgaagcttccgcctcctgatacacgctacaggacagaggatgttacagccaccaagggaaatgagtttgaagactattttctcaagcgtgaactcctaatgggtatttacgaaaagggatttgaaagaccctctcctattcaagaggaaagcattcctattgctttaactggtagtgacattcttgcaagagcgaagaatggaactggcaagactgctgcattttgtattcctgcactggaaaagattgatcaagaaaaaaatgctattcaagttgttatattggttcccacaagggaattggctctacaaacatcacaagtttgtaaagagcttggtaaacatttgaaaatnccaggtatgggccccnctgggggnaccagcttgaaggatgatattgttcgtttgtaccanccgggcacttaattnttggaaaanccngccggatttttgatnttn

SEQ ID NO: 17883 - DNA, 7209 bp, Zea mays
  misc_feature (3945)..(3945): n is a, c, g, or t
gtagaagcatagtgaaccagaagccatgcaaattactaaggtcaaacattttcctactattttagttcaagtggtgaaagctgaaatgacaaagatgctagccaggttattaaggcgtcgcttaagcatcgctaaagtgacacttaagtggtaaggtggccttggacatgtaaagcatcctgtcgccttgcccgagagtaaggtgaggcacagcggcggcgtgggggagagggagagagaggagagctgcgagagaggagagcggcggcggcacagggggagggggagagagaggagagcggctgagagcctgagagagagaggagagtggcggcagcaagggggagagggagagagaggagagcggctgagagcctgagagagagaggagagcagctggttgggtttaaccctagtgtgttgggctgggttgtttgtgggcttctcttttttttctgtttctttcttctactagactgaaatgggcctaataggctttacaattgtgcaagcttacttattaagtatgaattagttatatatatatatatatatatatatatatatatatatatatatatatatatatatataatatctggcctattttttatatttatctaaataattaaggcgtcgcctcgccttacgctttatcgtctaaaaggtaaaaaggagggtcggtcgccttactgccttaactatggatgctagaaattcttcaatgtcgatcaattatgtttccaacatcttttctatcaattggttgctggaatgatattgtgttatattatgaatgcttctgttaaacaaaatgtgaaggagccttatgcttttggacttagtggggcatgtaggtagtttgttgtactgcttgtttctcttttctaaccaactctgtaccttttgttttgcagatctttttacaaggggaatagatattcaagctgtgaatgttgttatcaattttgatttccccaagaactctgaaacatatctccacagggtaggattgatttaactgttccttttatttgttttcatttcatttcataatgtaaaatttgagtgtgacatactacgatgcatgactaacattttagcagttttaagtcacttatgaaataaaaaatgcttgcaatttatcttgcttacagattatcctatatttaggagttgaatctatctattgcattctacttgtggcatccatctctggcaattttaacgtccttttttggattgtcaggttggtagatctgggagatttggccaccttggtctggccgttaatttgatcacctatgaggatcgatttaacttgtacgcagatttttctactgcaactttgttgaccttttctattcccacattgttctgactgaatactgtttctgggaacaggtataggattgaacaagagcttgggactgaaataaaaccaattcctcctcagatagaccaggctatatattgccaatgatcaggcagttttcatctttgttcatttctccgtgattaataaggagacaacttttgtaaataccagctcatcaggtaaatcttttctttagtgtctactgtctgtctgcatgatccattaacactcgctactcggttctttaagcataatttaacaatgtcctaaaaatgctgtttgaacacatccttttgcatgctccatagcatgatttggtggttttattgccagaacataaaattgctgaaactcttcgatgttattaagatttgagttgtactcttatattgttatcatttttgtttcatagaagtatatgtgcaaatatgaaataagtggttttaattgccggctaggatgtttcaacctgcggttgactgtaaaatgctacagtattagtttatctacctttttccaccagacgtaatacttggcaattgtgttcggaccattttatccagatcttcaactagccatccactctttgtagctgctttacagatttaatgccttgtcatttgcgtagtggcagagttgagcgtagattgttattatatattatttattcatgaacttcaatggtttaagtctaaatccagacttcaaattcttaacatcatttcacagtaatgttcgattgctggagcctggaggtagcgcatgggaagagccagtatatgaataggtgttgaccctctgttatatgtgcaggttttatggtgttgatctcatttggtgcatcggagacaattctaagttggtggattacgtgagacgaggcacccgacttttcctgatcaccttgtcatgctgacactattatggctatatgggggaaaatgtcctgccacactaggcacaaagtagtgtatattgctaggtgcctattcctagaccctgtcctgctttgagttcgtttgtatttcccttgttttccgtacgccgtgtcgttaagcagtttcacacaggacattttaaccctgttgctggttctgggcgtgtggcctgtgggtgccgcgcacaagggtaaaagacattttagcccaagtggaacttggggatgtgcgcctcagattggttaatgggtgtgacaagtcggccatcgcacttgaggtctggagtctgaacggtagtgaagtggttttaagtttgccaataatcggtggtaagctgcaccgtgctgtgctgtcttttacccttgcaaccatgtccctttgcttcttggcatggtcgccatttagattctgtccggcgaatgtaacgctgggataaaacgttcttgtcgtttgtgatggatttatgtgtttggcacaagcaacttggccaggttatgagtaccagaactgtctacttgtttcttccataataacaaactttgcagctctttttgtaaacaatcttattcgtttcgtgattgacctcgaccccttgtttaagtgatgtttttccgcgccccagcaatggatgccttttattaatagggatgtttgtttatttatataaataagaatggttgactttggagccacgtaaatcatttcgtcaaatgcgtcgtgtttaaatttggcattggttcgctatggtgctgacatggtttgtagctgggtttctctcatctatgcaggtatatgcttgctagaaatctcaacccgttaccgttactagcttggtcctggaaagacgaacataatcgtgcgcatagcatcatgtagctttcgtgaattgtgtctgtgtctatatatatgtatatattaattaattaattcatcttctctgcctggcatttcttctctcgccatggctttggccggggccgcaagggcaaacgacctctcgttccctcgtgacgtacctttgtttggctgtagactgcagtccggtcactcggtcagcatgggaggcgccagacacactaatggctagtaggctttcctcatttctcccggtcgaagcaccatactctgagtgtggtaatggattaggatttaaatatctcttcacaataagttatgatctttaattaattttagtttaaaaatgaatataaataaagtataattctaattcgattagatccttaaattttaaattatatagtataaaatctagagctcattatcatcccttaactgtacctctactcattcttagaatgctttctgccttcactatatatgaggacagtcagaggtgaaatccaaggtttgtttgcgacgcgtatctggccggctcggctcgctcgtgtggtctaggctgaagctaaccggtcccaattgctgcaatatattttgtttgtgcacttgtaccaaataagtctggtccaagtgagctccacacgtaggcagccaggctaagagtcacttttgtttcttgggagcagccatgaacagctagtttgcgccacgagaaaaaatggagcttgcctatgtttcctgggagccaggctgaagagccacttttgcacncgtagaaccgagctccaaagcaagtaaggccacacaaacataagggttgcatcctgggagcatagtcaggccgcgcaaacgtgctccaaatgaacaacaaaactatgctttgccaattgcgcacagggagtgagccgctgtatgcgtttagccgcgaacacaggaaagagctcccatgcaaggaacccatgacagctagttctcgagttccattaataagaatatatatcatcgggaaagcagtaaagtttcttgcatgcatgagctagaaaacctggcagcgcttctggttctcctggaccagagagaaggaaattaccactactgcattatccacgcaggctacagagcctgcacacgtacgtacaagcaccccgtacaaagcagtagctagggctaccaccgtacgtatacgtactgtatgcgtccaccaggtaaactggtaaagtttagccgctaggaaatccagacggttctaaacttcgattgaatgccaaaaaatatatatacattttttaggtgtgtttcagcttagctgaaatcagctggaacatgttctagaatctaaatatatagttccgctaaacttttaggttttgttggtttgtgccggattggtgagtaaagttcagttaaaaagtggattcaaaccgggccatggtactagtgccttacagtaataagagtatatatattaggagaaaaagaaagcgagggcaggagcggagcggtcctgctgtctgctgaggccccgatcgatgtccggccgggctccggctgtatcatcatgatgatggcgatgccccctcgccacgctgcgactgcgactgccactgcagctagcaggcagcaacaacagcggccgcagcgagacaggaactcctctctgaacttggcatttacttcctgccccttgctcaaaatccgagctacactcagtaggccaggctgccaggctgctcattgaaggcccctccgtccgtgcccttcatcatctccctcctcgtcgcactccctcagcctcggcggcgccgtcgatcagtgctgccggccggtacccccagctcaattcatcactgttcctgcggcgatcatatgctattcctattcctatgccaactcagggtccacattgtttttattagtttatgtttatgtataataagtcaaacgagagggcttctagttgacttccttgagttacaccctttgttgagttgacactcaaaagtgtcttgtcgaccaggccaggcgtataaagctagccaacgttaagaggtccgacatgactactactttgcctagattccaaaccgttctatttttcaaattggcttctgacatgagaaacattaagttgttttctactaagagaccactctctttagatacgtattcaacatccaatcgaacaaaaatctatgtactgtctacgtctcaaccgcacattgctattgcatgctgttcaattggctttaacccgaaaagatttctactgtttttatgtttttatagtgttttgtctcaataaattgcatctacaacagtacgaacaattaactttaatctgaagtaaacaacctatttatcacttgatctaatgaccaagaaagatactctaggcttccggacctacgacctcgagaaacctaacaatatccttgccccggcgggggtcccttccgtgcgagagtttcgacggttaatttgcaagaaactaatcgttctaaagtgactagttatcctttgatagtttggtcatgaacctttatattcttcaccatataagtgtgatatactcactacgctctcctgtttagggtagctggacgatctagctctagatgtcgtgtgctccaatacaacgtacgtcatcctaaagattttggacttttacgttgaattaatcttctcgagttggttgtgtaggcaaaatatgacaagctcgctctaagaatatataataaaattaatttagtactcagttccgatggatggaagctctaaatgtatgctactcaagtaccacgtcgtccccttccgtggcatcaccatttcttgcagcttcttcctcgagatgctggttcaatcacgcccccgtgaatgaatgccgcaagtcgagtacgggccgatcggtgttgtcagggagctcccggcctccccccaggctagtcgcaccgccgcggagcccatgccctacagatggctgcgccccatagaggctaagacacagctgcgccgccgggccaagcaagtggcaaccccggccgtctcccaggggcagtcgggtggggctactgcgccgaccagggaggggtggccgtacgaggcaattggaccccctgctggtgttgaaggacgggttggaccgagctatggatggacgatttggacaaagtgaaaaaaaagctagatgcttgcaagcctgctcaagcttgtttagtgtcggtaaagctcgtgagcttaaataaaactactgaacgagccaaactatagtctaatctctcagttgggaagctagagtcgaatcgagcttggctcgtttccagccctagacacgacctcaactttgagaaatgaaagaagaaaaaagtataatgacaatagatttaaattttatactttaaaatttaagaatcggaccatattaagatcagactttatttatatttatttttgaactaaaataaattaatgactcaaacgagtcgtgaaaaaaaatatttggttggtgaaacggtgatccattatcacacccatggactccctgaacgccttgacggttgttaagggatgcaaaacagtcctctatcctatcttttctaattcttcaaacgaaaacataaaagcatggacgattctatctctccaatcaaacaagagacaatttcttatttactactatttttttggttcatttcttgatcctcaaaatataaatttcttattttaacactggatgtaaattttgttttttatatggcactaccattagttctggcctcaagtaatattaactttcatatgaaatgatgattttactccaagttaaataattattcatgaatacttgtattaattattacaagtatttatataaaaataattgttataacattaccagtttttattacaagtattggttgggaacatgtttagattcatgtagagaaccaaaacagtacaacccaattaaaataacatagttctttccctcgatttacacattgtgaagaagtagatcaaggggagaaggttagaatg

SEQ ID NO: 17884 - DNA, 2511 bp, Zea mays
gatccggccacgctacccttccgtcgctcctccggtcctccccacccacgacccctgccggaagggcaaaaggggctcgaaatcggtcccctgatccaggagccaatcttctagttctcccaaatccttttccggatccgaactgcaagtcctccttcgcgaccatggatccacgcgccaggtatccttcgggcgtgggcaacggccgcggtgggacccctaactactacggccgcggcccaccgccgcaacagccgcatcagcaccaccagcagcagcagcagcagaagcagacatcgggggcgcatcaccaccagcagtacgcgcagaggcagcagcaacagcaccgccacagccacaaccaccagcagcaacagcagcagcaccagagtcagcagcagcagcagcagcagcagcagcagtggctgcggcggaatcagattgcccgcgaggccgcgggcgcagccgtgaccagcgagccgaaggccctggcgccatccacggccgccgacggcgtcaattcgagttcgcaagattggaagacccaattgaagcttccgcctcctgatacacgctacaggacagaggatgttacagccaccaagggaaatgagtttgaagactattttctcaagcgtgaactcctaatgggtatttacgaaaagggatttgaaagaccctctcctattcaagaggaaagcattcctattgctttaactggtagtgacattcttgcaagagcgaagaatggaactggcaagactgctgcattttgtattcctgcactggaaaagattgatcaagaaaaaaatgctattcaagttgttatattggttcccacaagggaattggctctacaaacatcacaagtttgtaaggagcttggtaaacatttgaagatccaagttatggtcaccactggtggaaccagcttgaaggatgatattgttcgtctgtaccaacctgtgcacttaattgttggaacacctggccgtattttggatcttacaaagaaaggtgtttgcattttgaaggactgttcaatgcttattatggatgaggcagacaagcttctctctcctgagtttcaaccttccatagaacagttgattcgctacctccctgctagtcgacagattttgatgttctcagcgacattccctgtgactgttaaggagttcaaggacaaatatcttcctaaaccttatgtgattaaccttatggatgaacttacactgaagggaattacgcagttctatgcttttgttgaagaacgacagaaagttcactgtctcaacaccctcttttccaagcttcaaatcaatcagtcaataatattctgtaactctgtaaatcgtgttgaactattggcgaagaagatcacagagcttggttattcttgcttctatattcatgcaaagatgctacaggaccaccgcaatagagttttccatgatttccgtaatggagcgtgcaggaatcttgtttgtactgatctttttacaaggggaatagatattcaagctgtgaatgttgttatcaattttgatttccccaagaactctgaaacatatctccacagggttggtagatctgggagatttggccaccttggtctggccgttaatttgatcacctatgaggatcggtttaacttgtataggattgaacaagagcttgggactgaaataaaaccaattcctcctcagatagaccaggctatatattgccaatgatcaggcagttttcatctttgttcatttctccgtgattaataaggagacaacttttgtaaataccagctcatcaggttttatggtgttgatctcatttggtgcatcggagacaattctaagttggttgattacgtgagacgaggcacccgacttttcctgatcaccttgtcatgctgacactattatggctatatgggggaaaatgtcctgccacactaggcacaaagtagtgtatattgctaggtgcctattcctagaccctgtcctgctttgagttcgtttgtatttcccttgttttccgtacgccgtgtcgttaagcagtttcacacaggacattttaaccctgttgctggttctgggcgtgtggcctgtgggtgccgcgcacaagggtaaaagacattttagcccaagtggaacttggggatgtgcgcctcagattggttaatgggtgtgacaagtcggccatcgcacttgaggtctggagtctgaacggtagtgaagtggttttaagtttgccaataatcggtggtaagctgcaccgtgctgtgctgtcttttacccttgcaaccatgtccctttgcttcttggcatggtcgccatttagattctgtccggcgaatgtaacgctgggataaaacgttcttgtcgtttgtgatggatttatgtgtttggcacaagcaacttggccaggttatgggtaccagaactgtctacttgtttcttccataataacaaactttgcagctcttttggtctcaaaaaaaaaaaaaaaaaa

SEQ ID NO: 17885 - DNA, 2546 bp, Zea mays
ctgggaagtttggcacccgttaggatttaacctgcaagaattcactcgattctgtatatttagtgtgttagtgtgtataagtgcatgaaaagagccagtatgtgaatagagttgaccctataccagctcatcaggttttatggtgttgatctcgtttgttgcatcagagacaattctatgttggtggataacattagatgaggcacccaactttttttattacaccttgtcatgctgacactgttatggctatatgagggcaaatgtcctgccacattaggcacaaagtagtgtatattctaggtgcctattcctaggccctgtcctgcttttagtttctttttctcttattttcatcctattgtgtcattagctgtttcacacaggacattttaaccctgttgctggttctgggcgtgtgatctgtcggtgctcacacaagcttgttgcccgagtcgaacttggggatgtgggcctcagatgggttattgggtgacaggtcggccattgaacttgaagtctggagtctgaacggtagtgaactggttaagtttgcaaataatcggtggtgagctgcatcatgttgtgctgtcttacccttgcagtcatgtcacttttgcttggtgccgtggtcaccatttagatttgcttggataaaacgctcgtcacgtttgtgctgactttgtgttcggcacaagcaacctgtccaggttatgtgtaaagaactgtttacttgtttttttcataataacaaacgttgcagctgtttttgcactctgtttctttccttttcgtgatataattacctgagctgctcaggttagagaaatcttggaaacaaacatctagtactcctatagcccacacggttcatcttaaccccttgggtgctgttcttttgggtgtggcgtgagttcgtgtgtggtgtctctgtaaccctttcttttaatgaaatgataagcaagatcgagaaaaaaagattgcttgacttgagtcacgtacatcatttcgtcaaatgcgttgctcttaaatttgactttggttcgccatggtgctgacattgtttctagttgggtttatcttatctttgcaggtttatgctggccagaaatctcaacatgttactggcttgcccccgaaaaggttgtatgtgtatatatacactaattaattcaccttccctgcctgggcgagccttctctcgccatggctttggccaggtgaactaaaagtggcaactggcaagtgcaaacgacctctcgctccctcgtgacacgccttcgtgccagcatgggagggtaggttttcctcatttctccatgttgattttgcagcgccatatttgtctcgaggcgtgaagctttcccatgttctctgtatttcttttttagaatgttttctgccttccaccatatatggggacagccagaggtgaaatccagatgaacccaaaattatgctttgccaattgcccataggggacaactgagctacagtatagttctcgagttcctttcatacgcgaaatctcatcgggaaagtagtaaaattctttcatgagtgatccagaaaacttggcagcacttctggttctactggaacatctatccttttaagagaagaaaattactgcattatccgcgctgtagtggctgcacacatacaaaaacgttagtaggagaaaaagaaagcgactaagtgaggcaggagcgaagtaggagaaaaagaaagcgaggcaggggcggacccggagcggtccttcactcctgctgtgtgctgagacctgagagctgagcccccgagcacatgtccggctgtatcatcatgatggcgatgcccctcgccaccctgcgagtaccactgcatcgacagcggcagcggccgcagctagacaggaactctgaactctgcatttacttcctgcccttgctcaaaatccgagctacactcgtagggcgtaggctaggctccttgttgaaggccattccatgcccttcacatcttcatctcgtcatcgactcgttgcccctcgccggcgcactcggatcctctgtcgtaacgggcgatgtagccgccatgggtcggctaacacgtgggcccggccgcagactggccccgcactcgccgcgggacgttaggctggctgcagcggttgccgccagccagcactccacgccagcagcgttgcccgttgcccccctgcaggacccttaccggccggtccctttctctctccctgctttagattcaccctgttcatttctgtagcagtgggtttacgatcaattgttagtagataaaaaactgatattagttaaaaagtagatataaaaaataatattttatggttgtagtggggtataatgaaaaatataggggaactgctgtgggagatgaaatttagggggtaaaatgttgatgatatgacacaaaaaatgatatagagggaaaaaatagagaaaaccgctgtggatagacttaaacttgtttcaacgctttactctatacctcccctccccctaatcctgtatcaatttagcgtcaca

SEQ ID NO: 17886 - DNA, 473 bp, Zea mays
aaaaatgaaaactactcatttctcttcctcttcttcttccgatcgcaggatcggtgctctgctccgtcatctcaattccggctcagattcggacaacctgagctctctttatgcatctccgacatcgggaggcaccggtggttctgttttctctcatcttgttcaagctccagaggatcctattcttggggtgacagttgcatacaacaaagatcctagcccagttaagctgaatttaggagttggtgcttaccgaactgaggagggaaaacctttggttcttaatgttgtgaggaaagctgagcagcagcttatcaatgacagaacaagaatcaaggagtatcttcccattgttggattggttgagttcaacaagttaagcgctaagctcatactaggcgctgacagtcctgctattcgggagaatcggattaccaccgtggagtgtttgtctggtactggttctctgagag

SEQ ID NO: 17887 - DNA, 561 bp, Zea mays
  misc_feature (1)..(1): n is a, c, g, or t
  misc_feature (537)..(537): n is a, c, g, or t
  misc_feature (550)..(550): n is a, c, g, or t
nttttccgcaccaggagctcactagtccccccccccccccgtgttgccatccctcaatggaaaattgaccggaatgtctttccgtgttccaaccgttgatgtctcagttgttgatctcaccgttagacttgagaaagctgcaacatacgacgaaatcaagaaggccatcaaggaggaatctgaaggcaaaatgaagggaattttgggatacactgaggatgatgttgtgtctaccgactttgttggtgacaacaggtcaagcattttcgatgccaaggctgggattgcattgagcgacaagtttgtgaagttggtgtcatggtacgacaacgaatggggttacagttctcgtgtcgttgaccttatcgttcacatgtcaaaggcctaagcttacaccggcgagagtttgtgtgtggttgagttcgtactgttctgaacaaaaaaaagaaaaaaaaaaactcgagggggggcccgggtacccaattcgccctatagtgagtcccattacaattccctggcccctcctttctaaaaccntcggcggctgggnaaaaacccttg

SEQ ID NO: 17888 - DNA, 2901 bp, Zea mays
gattctcttctacagtttccttcgtgtgctccgaagtctaaagtttccttcgtcgagagcacccaaccccaccccatcctcccgtcccctcccggcctcccctccccttccgctccgcctctggccaccgcgcccgcacccaatggcgtcggcggcggggtcctctaacgtgatgcttgcgattcacgagaagaaaacgactgccactgacctctaccgcccgctgcgcctctacatcgcctccacctactcggaacgcgaggccgcggcggccgacgacgaccttagcgtggtgcgcgacgcgctcctcgcctacgcgcgggccctggcactcgttgagccccgcttccccatctcccctgaccgcgcccacgtccactccctcaccttcacctggcacgacgccttcaaggggaacaagaagtgcgccctcgcctccatccacctcgagaaggcctccgtgctgttcaacctcggcgccgtctactcccagatcgcggtcgccgcggaccgctccaccgacgtcggaataaagaccgcgtgcggtgccttccagagtgcggcgggggcgttcgcatggctcagggagagcggggtcgcagccaaggctgttgctgcgggaaccaccaccgtggacatcacgcccgagtgcgctggcatgctggagaaactcatgctcgcgcaggcgcaggagtgcttcttcgagaaggtcataggtggagggaagccaccagcgctgtgctccaaggtggcgcggcaggtgggcatattctatgaagaagcatatgcagctctcagtgcacctcctctaagtcagcccctcgcgtccgcatgggtgtcccatgtcctgctgaaagctgctcaattctatgccgatgcttgctataggtattcattagatcttcatcagaaagaagaaattgctgaggaaattgcacgtttgaagattggtatgagtgccttggcagatgctaagaaggctgcgaagggagttgctgcccagcttatggattccgtcaacaagctggaaagtaacatgaaaaccaacttggaaagggctatgaaggagaatgatcgtgtttacctgatgcgggttcccgctgctggttccttgggagccctctctgcagcgtcccttgtaaagcctacctctttgtctgaagttttagatgccagtaaggaaaggctttttttcatcacttgtgcctgatggcagcatgaaagcactttctaaatacacagagatggtagataatattatccggacccaggcagagaaattgcagcaagctagtgagatcactagagttaggttgaaggaaatggacttaccagattctattctttcattggaaggaaatataaccttgcccttggatctaaaggaagacgtagaggctgtgcagataagtggtggccctgctggtttggaatctgagttgcagcagcttagggatttgagcagggtcaatcaggaactacttgttcagactgaagagcttctacagaaggaggcgaatgaagacgctcagtttcgtacacaatttgggagtcgttggactagacctcaatcaagcaccctaactaagaacattcaggatagattgaatctgtttgcttctaatctgaagaaagctgctgatagtgattctctgattgaacgaggcgtgaaggagaactatcccttgatgtctatccttgacaaaagaccgatagagtctgcacttccaagtatttccaggcctatcatgtccttggatgggaatgaagatgccattgttggagccctgaaacaaagcttgagacaactggaatctcttggagcgcatagggcaggtcttgaagacatgctcaaagaaatgaaaagaaaggatgatatactgcctaagttgatggctggtgttggatcacatgatgatcttttcaagaaagagattgctaagtatgatcctatctgtgctgatattgctgataacattgtggcacaggaacaattattgctgcaaatacaggcacaaaatgagcaatttgcctctgtattcaatatagaggattacaaagctgctcgtgagagatgttacaagcaaattgctgctgctgttgctaaataccgggagtttaagaagaatattaacgagggcttaaacttttacgtgactctgcaggaagcaataggcaaaataaaacagcagtgcagtgacttcataatgacccgaaacattcaatgccgtgaaatgatcgaagatgtgcagaggaagctagcgggtttcagcttctcgtcctccagccactcctctatgcagaggaatgcttctgtaccacctgatcagagcagcccgtcaccaccaccgcatgctcaggctccctatgcctctccacctggggtagactcaagacttggatattctcaaacggagccaagacctgcttactcacagccataccccccatcctatggcgcaccaccacaacagccttcatatggcgcaccacaccctggtcagtaccagccgccagcgcaccagccacctcctggccatgactacggtcagccggcatatcctggatggcgtgggccatattacaatgcccctcagccgcagcaatctgcgccatatccacagccaccgtacaatgcccctggggcttaccctccgcaccagagcaactattacaggcctcagtaagctatcttatcgttcctgcaactatttgtttgcttcttttccattggatcttaccgttgtggagtatgcatacgagaatttggttggtgcaatatcagattgattagaaggtatagcttgtatgatttgtacgtataataatgtgctggatgtattgtaatacacggccgtccgcatcgcaacacctaccaaaaaaaaaaaaaagggcggccgc

SEQ ID NO: 17889 - DNA, 3034 bp, Zea mays
  misc_feature (3034)..(3034): n is a, c, g, or t
cctcgaggccggccgggacctcttcccagtttccttccgctaccgctagtgacctttccaggacgacaactcccaggtcccgactcccccaaatttcccccttcccttccgcctcgcctccagccaccgcgtccgcctcgcctccagccaccgcgtccgcctccgatggcgtcggcggcggggtcctcgaacgtgatgctcgcgatcaacgagaagaaaacgatcaccactgacctctaccgcccgctgcgcctctacatcgcctccacctactcggaacgcgaggccgctgcggccgacgacgaccttagcgtggtgtgcgacctccgcgctgctgtcgagaagccctccctcccggatccgtcctccctcgagcagcgccgcgacgcgctcctcgcctacgcgcgggctctggcactcgtggagccccgcttccccatctcccccgatcgcgcccacgtccactccctcaccttcacctggcacgacgcattcaaggggaacaagaagtgcgccctcgcctccatccacctcgagaaggcatccgtgctctttaacctcggcgccgtctactcccagatcgcgctcgccgcggaccgctcgactgacgtcgggatcaggatcgcgtgcggcgccttccagagtgcggcgggggcgttcgcgtggctcagggagagcggggccgcggcgaaggctgtcgctgcggggaccaccaccgtggacatcacgcccgagtgcgccggcatgctggagaaactcatgctcgcgcaggcgcaagaatgcttcttcgagaaggtcataggtggagggaagccacccgcgctgtgctccaaggtggcgcggcaggttggcatactctatgaagaagcatacacagctctcagtgcatctcctctaagtcagcactttgataagacatgggtgtcccatgtccagcttaaagctgctcaattctacgccgatgcttgctacaggtattcactggatcttcatgagaaagaagaaattgctgaggaaattgcacgtttaaagattggtatgagtgccttggcagatgctaagaagactacgaagggagttgctgcccaacttctggattccgtcaacaagctggaaagtaacatgaaaaccaacttggaaagggctatgaaggagaatgatcgtgtttacttgatgcgggttccagctgctggttccttgggtgccctccctgcagcgtcccttgtaaaacctacctctttggctgaagttttagatgccagcaaggaaaggcttttttcatcacttgtgcctgatggcagcatgaaagcactttctaagtacacagagatggtagataatagtatccggacccaggctgagaaattgcagcaagctagtgagatcactagagtcaggctgaaggaaatggacttaccagattctattctttcattggaaggaaatataaccttgcccatggatctgaaggaagacgtagaggctgtgcagataagcggtggccctgctggcttagaatctgagttgcagcaacttagggatttgagcagggtcaatcaggaactacttgtccagactgaagagcttctacagaaggaggcgaatgaagacgctcaatttcgtacacaatttgggagtcgttggactagacctcaatcaagcaccctaacaaagaatattcaggatagattgaatctgtttgcttctaatttgaagagagctgctgatagtgattctctgattgaacgaggcgtgaaggagaactattcattgatgtctatccttgacaaaagaccgatagagtctgcacttccaagtatttccaggcctatcatgtccttggatggaaatgaagatgccattgttggagccctgaaacaaagcttgagacaactggagtctcttggcgcacaaagggcaggtcttgaagacatgctcaaagaaatgaaaagaaaggatgatatattgcctaagttgatggttggcgtgggatcacatgatgatcttttcaagaaggagattgctaagtatgatcctatatgtgctgatattgctgataacattgtggcacaggaacaattgttgctacaaatacaggcacaaaacgagcaatttgctgctgtattcaacctagaggattacaaagctgcccgtgagagatgttacaagcaaatcgctgctgctgttgtgaaataccaggagtttaaaaagaacatcaacgagggcctaaacttttatgtgactttacaggaagcaattggcaaaataaaacagcagtgcagcgacttcataatgacccgaaacattcagtgccgtgaaatgatggaagatgtgcagaggaagctacccggcttcagattctcgtcgtccagccgctcctctatgcagaggaatgctgcttctgtgccacctgacgagagcagcccatcaccgccaccgccgcatgcccaggctccctatgcctctccaccaggggtagactcgaggcatggatattctcaaccggaggcaagacctgcatactcgcagccataccccccatcctatggcgcgacaccgcaacagccgacgtatggtgcacaacaccccgggcagtaccagccgcctcctggccatgactgcggtcagccggcatatcctggatggcgcgggccatacccatactacaatgccccccagccgcagcaatctgtgccatgtccacaggcgccgtacaatgccactggggcttaccctccgcaccagagcaactattaccgacctcaataagtgctgcaactatttcttattattttgcttcttttttttccattgggtcttaccattctggtgtactactactgcatacgagagagttcgggtagtgtaatagcaggtatagctttgtatgatttagtggcggacccagaaagacccggaccgaagcgaccataaactataatatagtagcatataaaaaattgtacggttaaacaatgttgtcatagatgttaaagatgacatacaagttatgatgtaaaaaaaaagcggccan

SEQ ID NO: 17890 - DNA, 2189 bp, Zea mays
tgtgtctgacacttatatattggatccttgcacaggcacaaaatgagcaatttgctgctgtattcaatatagaggattacaaaggtaacctttctggattgttgtcacagttgtgatggatgcatttacatttacttttgtaacttgctttatacattgagtcgaaatgttacaacatgttttctaggtattctaattttccttatgccaacatgattgtacagttaatctgttattgcttcaggggtatctgtgctaacttttcagaaaattgtccgcttgaactatccatatgatgtaccgctgccttttgcattttgtattattataatttaacaacttttaaaaagtttgtttgccttgtggatggtagctatcatgcagtatgttattttggtagtgttctttccattcttgagcacatcaattacagtggtccctacatcacgctgactgcttggattgttattggttcatgggcatttttgtacaaatttcagcaattagcctgcttcagttgttcataagcttccttagcaggctaggtgttgcttgtatgcatgctttttcctgcatgtgcaccattttctggagtaacttcaagttgatactgctctgcttaatttctactctgttccaaattagaggtcgcttcagctttctcgagtcaggcttctctaacttcgactaagtttttagaaaaaaaaatgaacatctacaagttgaaatagatgcactgtcaagacatttgatggagagcttaatggaactaatttgattttgatgtattttcttgtaaagtcaaagttagagaagtttgatttaggacagaaaatgactataatttttgaatggagagagtaacctgtgatcattgttaagcgctaacatggaaatgttatcaccgtcaagtgctattatttttagatctgtaggacaggagtcagatgttccgaacgaagtaatgtgtaattcttttcctttgtgcaaagctaatgtgtaattttgatttgttacactcttttttttcagctgctcgtgagagatgttacaagctaaatgctgctgctgatgttaaagcctgggagtctaagaagaatagtaacgagggcttaaacttttacgtgactctgcaggtgtgattgcatttccattttcatattgttccatttgcattgaacataggaatgctgatgtttcctctcgaatgtgctactgattttggggtgatcgctgtgtacaggaagcaataggcaaaataaaacagcagtgcagtgacttcataatgacccgaaacattcaatgccgtgaaatgatcgaagatgtgcagaggaagctagcgggtttcagcttctcgtcctccagccactcctctatgcagaggaatgcttctgtaccacctgatcagagcagcccgtcaccaccaccgcatgctcaggctccctatgcctctccacctggggtagactcaagacttggatattctcaaacggagccaagacctgcttactcacagccataccccccatcctatggcgcaccaccacaacagccttcatatggcgcaccacaccctggtcagtaccagccgccagcgcaccagccacctcctggccatgactacggtcagccggcatatcctggatggcgtgggccatattacaatgcccctcagccgcagcaatctgcgccatatccacagccaccgtacaatgcccctggggcttaccctccgcaccagagcaactattacaggcctcagtaagctatcttatcgttcctgcaactatttgtttgcttcttttccattggatcttaccgttgtggagtatgcatacgagaatttggttggtgcaatatcagattgattagaaggtatagcttgtatgatttgtacgtataataatgtgctggatgtattgtaatacacggctatgcatattgcaacacctaccatttgccgttacctatcttgagtgcgtcctaaattgtaattgcagccaagcagcgaaatgtgtagaactaaagaaccctgagcgtcatttatcagttgcaaaataattttcgtaaggactagtttgggaaccatattttttcaagggattactattttcccaaggaaattagttcatttttttcttagaaaaatagaaattccttagtaaaatggagttcccaaactagatcta

SEQ ID NO: 17891 - DNA, 627 bp, Zea mays
  misc_feature (1)..(16): n is a, c, g, or t
  misc_feature (20)..(21): n is a, c, g, or t
  misc_feature (24)..(25): n is a, c, g, or t
  misc_feature (27)..(27): n is a, c, g, or t
  misc_feature (31)..(31): n is a, c, g, or t
  misc_feature (34)..(34): n is a, c, g, or t
  misc_feature (36)..(38): n is a, c, g, or t
  misc_feature (40)..(44): n is a, c, g, or t
  misc_feature (46)..(47): n is a, c, g, or t
  misc_feature (58)..(58): n is a, c, g, or t
  misc_feature (71)..(71): n is a, c, g, or t
  misc_feature (82)..(82): n is a, c, g, or t
nnnnnnnnnnnnnnnncaanntgnnanctcnccncnnngnnnnncnnttttcccctantggatcccccggnctgcatttttncagcaccaggagagctcactagtccccccccccctcttccttcacctccaaattcgccgatgagctgattgctaacgctgcttacatcggaacacctggaaaaggtatccttgcggcagatgaatcaactggtactattgggaaacgtctcgctagcatcaacgttgagaacgttgaatccaacagacgtgctcttcgtgagcttctcttcactactcctggagctcttccttgcctcagtggtgttatcctctttgaagaaactctttaccagaagagctctgatggtacgccttttgttgatatgttgaagagtgcaggagttttgcctggtattaaggttgataagggtaccgttgagcttgctggaaccaatggtgagactactactcaaggtcttgatggtcttggtgaccgttgcaagaaatactacgaggctggtgctcgtttcgccaagtggcgtgcggttcttaagattggtgttaatgagccatctcagttagctatccatgagaacgcttatggattggctaggtatgctgtcc

SEQ ID NO: 17892 - DNA, 639 bp, Zea mays
  misc_feature (590)..(590): n is a, c, g, or t
  misc_feature (639)..(639): n is a, c, g, or t
tcacaaccttcaccactcgttcagagctaaacgagagaagccgtctggatcggcgctacgcttccgaactccaaacatggcgagaggtttaaagaagcatttgaagaggctcaatgcccctaagcattggatgcttgacaaacttggtggtgctttcgcccccaagccatcttctggaccacacaagtcgagggagtgccttcctcttgttcttatcatcaggaacaggttgaagtatgctcttacctaccgtgaagtcatctccatcttgatgcaaaggcatatccaggttgatggcaaagtcaggactgataagacctaccctgctggtttcatggatgttatctctatccccaagactaacgagaacttccgtcttctctatgataccaagggtcgtttccgtcttcactccatcagagatgaggaagccaagtttaagctttgcaaggttcgaactatccaggtcggacagaagggcattccttacctcaacacatacgatggtcgcaccatccgttaccctgacccgttcatcaagcctaacgacaccatcaagctcgatcttgaggagaacaaggtgggtgagntcatcaagtttgatgttcggcatggtgtcatgggtaccggaggagaaan

SEQ ID NO: 17893 - DNA, 764 bp, Zea mays
  misc_feature (762)..(762): n is a, c, g, or t
tgctcattttatgctcaacagtgccttcatgttctttcaacctcacgctgagatgcctccaatctctcaatccatcagaggctaataaactcttcatgttgttagatttaaaaatcttacaacaaaagcaaaacactttatcaatatgcttagaataaatcgaccattttctatcatgtacctctccattctttagtactttggaataatgagcatacgaaaaatgccttgagttgtcatctaaagggaattcaaggttatgttctcttataggtcctttttccactaatacatcccttgctttgttatcaagtttatcccaatttctaggatcataaatatcgatagaaaaaatggttgttcgtcaacacatgcagatgcagattccggttccacaccaattggattctcatgaccacttacattgttgttagtgtcaatattttcttgtgaaatcctttcacctggttgcttccacacaactatcgccaactcctgctcctcaatattccttgaaggcactctagtctgaagaaacttatgaatggcacctctctgtgatgcattgaactcctctatatgttttctttttttcctttttcactaccagatgcgtgccttctagtggatgacatgtggaatgtggtgctaatcctaccaaaacacaataacaatataacatatagttagaaataaaataatatttaactagtaaggattggtctgggacaaaaaaatgataaatggaagcaggagaacccncc

SEQ ID NO: 17894 - DNA, 549 bp, Zea mays
  misc_feature (536)..(536): n is a, c, g, or t
tcactagtccccccccccccccccccagaacttttctatgggtgcatatatggtggagttttaaccaaatctatagaatctatatttttaggggcgcatttgtaccccctaaacataacctagcttcgcccctggccaacaggttgggtagaagggagactgatgaaggcttgcgtggtaagtgctccctcgaactatcgtgtggcggggtcctagccatgtattatcttgtctcttcagaggggtgttgtcaacttgacccacctcaaagctagggcccatagcctatcctctccggataggccaagttttatttgtgacgtctagggtattcgtatcccaaggcactgacatttatcatttagcacttgaattaatttctatgctcctttaaagcaccagttttgtgcatcatgcgtgtaggtctgttcctctcccccacttctcgtctaacagtggatctaataggttgttacgccactgatgagccatgaaaaaccactcaagcctaacatgacaaagaagccccacgcagnacaacgcctccca

SEQ ID NO: 17895 - DNA, 616 bp, Zea mays
  misc_feature (567)..(567): n is a, c, g, or t
  misc_feature (571)..(571): n is a, c, g, or t
  misc_feature (578)..(578): n is a, c, g, or t
  misc_feature (585)..(585): n is a, c, g, or t
  misc_feature (605)..(605): n is a, c, g, or t
  misc_feature (615)..(615): n is a, c, g, or t
cgcaccagctcactagtcccccccccccccaatcgccataggtttcatcgttggagctaacatcctcgctggtggagctttcagcggagcttccatgaacccagccgttgctttcggaccagccgtcgtaagctggacgtggaccaaccactgggtttactgggctggtcctcttattggtggtggactcgccggaattatctacgactttgtcttcatcgatgaaaatgcccacgagcaattgcctaccaccgattactgaagacgtcaaattcaacgttgttaatctgatgaatttttcgtgatttgcttttttaatttgcatcgtaatgggtttctggccgttggatcatttttagatgaatctttgtctattgattgatcatttatgtgtctttgggtttgttgttggagttgtaatatctctggaaggcttttgtgcaattgtattgtacggtttaataactataattgagaaaaccagggaatgtgaattatgaaaatgattttttttgtcaaaaaaaaaaaaaaaaaaactcgaggggggggcccgggtacccaattcgncccnatagggnagcctantacaattcactgggccgtcnttttacaacnc

SEQ ID NO: 17896 - DNA, 1790 bp, Zea mays
  misc_feature (1790)..(1790): n is a, c, g, or t
gccgggaacaaagtctggcgctgaacctggaagagtttttccggctatcgttgtgcttatctcttcccaaggagagacccaccgcccattatccaaccctactacttgcttttgtctccactctcagtctcctctccaaatctccaaccctacttgttccagaaaagaaaaagaactatccatcccgctgtgagccaagccagcccagctccggcgactggcagatgtttcagggtccccgtccgtttgccgcaggttccctgatatcggtggccagcagccgactttgtggttagtccattctcttccggcgggatacgttgcggaccacttcgctcagctgctcgcgacggcggcttgtaccctgatttgggtgtggttcttgtagagcggtcgtgtcgtccgagcgttgatctgaaccagcgcagtttatcagggacgtagcactgtagcagtgagttggggaggatgcctgatatccagctgggatgccacactataaggtcccatggtaccaaagtggcaacattacacatgtatgactggattatacttttatgtcttgctgtacttgatggactgttaaacataatcgagccctttcaccgctttgttggacgcgacatgatgaccgacttgagttatcccctcaagggcaacacaatcccattttgggctgttccactgattgcgatcgtgctacccttggttatctttgctgtcatttacttcaaaaagaaaaatgtctatgatttacaccacggcatactagggatcttgtattcagtgcttataactgctgtgatcactgatgcaattaaggatggtgttggtcgccctcggccagatttcttttggcgttgttttcctgatggcaaacctaattttaataatataaccaccgatgtgatatgccatggagaaaagagtgtcatcaaggaaggtcataagagtttcccaagtgggcattcttcatggtctttcgctggtctaggttttcttgcatggtacttggctggaaaacttaaagcttttgatcgcaagggtcacattgcaaaactgtgcttagtttttctgcctctacttgtcgcgtcacttgtggctgtttctcgagttgatgattactggcatcactggcaagatgtctttgccggcggcatcataggtcttacagttgcttcattctgttacctgcagttcttcccatatccctttgacaatgatgccctatggccacacgcatacttccaacagctagctgagacacacagtaatggtaatgcaaactcaatcaacataagacctacagagtttgaagatgaaccagatgaccatggtgacattgtcctgagggacaccagccctatcttggagtcaatggagtctggcaggagaccatgaagaagcatgccactgtgggtttgtccaaggtgcccttcaaattctggaagcgtgatgagttttgtggtttcatcatgtagccgtccaacgtaaaaacagtatggaggtatatctaccaccacctgatgatttgatgatccacagactgtcgtggttagctgtaaatgacagcgaatgtttatgtttctagtgacaatgtgaatatttggttttgcacggctgtgatatggaaagtttgtttcgaggttaccctttggctgtaatgaaattgtccgacgacctgcagatggattgcaaacggtctttagggggcaatcactccatccaagataatatgagttggtgtattatgggtctattccttaaaaaaaaaaaaaaaaaaaaaaaan

SEQ ID NO: 17897 - DNA, 1210 bp, Zea mays
cctggccgggccggctatcgttgtgcttatctcttcccaaggagagacccaccgcccattatccaaccctcctccttgcttttgtctccacctctcagtctcctctccaaatctccaaccctacttgttccagaaaagaaaaagaactatccatcccgctgtgagccaagccagcccagctccggcgactggcagatgtttcagggtccccgtccgtttgccgcaggttccctgatatcggtggccagcagccgactttgtggttagtccattctcttccggcgggatacgttgcggaccacttcgctcagctgctcgcgacggcggcttgtaccctgatttgggtggggaggatgcctgatatccagctgggatgccacactataaggtcccatggtaccaaagtggcaacattacacatgtatgactggattatacttttatgtcttgctgtacttgatggactgttaaacataatcgagccctttcaccgctttgttggacgcgacatgatgaccgacttgagttatcccctcaagggcaacacaatcccattttgggctgttccactgattgcgatcgtgctacccttggttatctttgctgtcatttacttcaaaaagaaaaatgtctatgatttacaccacggcatactagggatcttgtattcagtgcttataactgctgtgatcactgatgcaattaaggatggtgttggtcgccctcggccagatttcttttggcgttgttttcctgatggcaaacctaattttaataatataaccaccgatgtgatatgccatggagaaaagagtgtcatcaaggaaggtcataagagtttcccaagtgggcattcttcatggtctttcgctggtctaggttttcttgcatggtacttggctggaaaacttaaagcttttgatcgcaaaggtcacattgcaaaactgtgcttagtttttctgcctctacttgtcgcgtcacttgtggctgtttctcgagttgatgattactggcatcactggcaagatgtctttgccggcggcatcataggtttgctagtatttgatgctcttttgtatttagcatttcgaacacccttcacaatcaaaagtcaatcatggagtgtcattctcttatttcttttcaggtcttacaggtgcttcattctgttacctgcagttcttcccatatccctttgacaatgatgccc

SEQ ID NO: 17898 - DNA, 1464 bp, Zea mays
caaccctactacttgcttttgtctccactctcagtctcctctccaaatctccagccctacttgttccagaaaagaaaaagaactatccatcccgctgtgagccaagccagcccagctccggcgactggcagatgtttcagggtccccgtccgtttgccgcaggttccctgatatcggtggccagcagccgactttgtggttagtccattctcttccggcgggatacgttgcggaccacttcgctcagctgctcgcgacggcggcttgtaccctgatttgggtggggaggatgcctgatatccagctgggatgccacactataaggtcccatggtaccaaagtggcaacattacacatgtatgactggattatacttttatgtcttgctgtacttgatggactgttaaacataatcgagccctttcaccgctttgttggacgcgacatgatgaccgacttgagttatcccctcaagggcaacacaatcccattttgggctgttccagtatgttctgctctgctgattgcgatcgtgctacccttggttatctttgctgtcatttacttcaaaaagaaaaatgtctatttacaccacggcatactaggtatcttgtattcagtgcttataactgctgtgatcactgatgcaattaaggatggtgttggtcgccctcggccagatttcttttggcgttgttttcctgagcgcccaccgaattttaataatataaccaccgatgtgatatgccatggagaaaagagtgtcatcaaggaaggtcataagagtttcccaagtgggcattcttcatggtctttcgctggtctaggttttcttgcatggtacttggctggaaaacttaaagcttttgatcgcaagggtcacattgcaaaactgtgcttagtttttctgcctctacttgtcgcgtcacttgtggctgtttctcgagttgatgattactggcatcactggcaagatgtctttgccggcggcatcataggtcttacagttgcttcattctgttacctgcagttcttcccatatccctttgacaatgatgccctatggccacacgcatacttccaacagctagctgagacacacagtaatggtaatgcaaactcaatcaacataagacctacagagtttgaagatgaaccagatgaccatggtgacattgtcctgagggacaccagccctatcttggagtcaatggagtctggcaggagaccatgaagaagcatgccactgggtttgtccaaggtgccctgaagcgtgatgagttttgtggtttcatcatgtagccgtccaacgtaaaaacagtatggaggtatatctaccaccacctgatgatttgatgaaccacagactgtcgtggttagctgtaaatgacagcgaatgtttatgtttctagtgacaatgtgaatatttggttttgcaaaaaaaaaaaaaaaaaatttgcggcc

SEQ ID NO: 17899 - DNA, 1906 bp, Zea mays
  misc_feature (29)..(29): n is a, c, g, or t
cccaggtttttcatcagcgtgttaaacgncgccagggaatgttatacgcctcactttaaggcggctgggtaccgggccccccctcgagtttttttttttttttttttaaactgtttggagagtttaaaaggtaagaggaaaatcgtagaatcaactttttttcagatcgagccagtcaacaaaacaaaatacgtgcagctcaaacgctcgctcgtaatggcgagaagttaattgttccaagcaatcatgcgcgctgcagcagcgttcacgcatgctcgctcgctcgctccacatcaccggccgtgctgataacatcaccaccgtttgtaaatcttaatagctccggtagggaagatggcgtcggcgattctcatttagttaactgaacggaattcagaaaaatgataagcaccaccttctaaatgttgatgctccagtcgtaattttggtacatgactttcagttgagtgctggcgagcagttccaagagctgctctgactctgcgggctcaagatagttcgcagcatgctttaacacttctatctcgttcttaccaaaatctgtgctataccatttcaaaatcttgcttgcagatgcaattttggcttcaggatcaacaatcagtcctccattcctcacgaaatcacgtgcagcttccatcaattctctatcgatatcccctggtgagtaacacctaagtgcaggtccagatttggtgccacataccaaagcaaagtgaacaagaggttcatggtatggaagggccaccttggatcttcggtctttctgcccgaaaggtttggcaatgttgtatggtggcctttggttgccacgtagaatgccattttggattgctgacagtgaataagcacatccaccaatgatatacttaaaatctccaaaaaacttttttctgtccaatggtccagcaggatggccacatgtcactaatgcatggatagccatcatattgtagagatttatgaagaaagcaagtttttcttcacgtgataaataatcaatttccaccctctggagctcctcaactgttctaatatatcttttaaattcctcagaacctttgatgctttggtagtcaacatgtctaccatcggctgatacataagcttcaaaaatggcacaggatagcaacctcagccttgatgctacttcagcaatgggctttggtgcaacatcgatgatgcccctagggatgttgtaacattgagtcataactatgggatcatgatccaggaaacgatatatgtggtttccatcttcaaagacattttcatctagaacatgacgaaagaagtattttcttgcaagcttccttccaaattccactgcctcatctctctccaaatattgatcttctgatatgaaatccacagcttcactaccaagaaagcagttgctaaatcttctcatcttatagaatctatccttaggagtgatcgactctctcatttttttgacaatggttgccagctcatcaatcttcccacttcctgattcatcatcttctccaagtaaggggggtaatggagcagaatatggggattcctcattgaacagaacatcggggggggggggggggggaatagtgagctctctctctctctctctctctgcaaccggggggaaccactaattctaaagggccgccaccgcggggaacctccgcttttgtccccttaaggagggtaaatttcggcttggcgaaatcagggcaaagttggttccgggggaaattgaaccccccccaattcccccaacaaccagccgaaacttaaagggaagcccgggcgcccaagggggggctaacccacttaatggggtggccccatggccgctttcaaggggaaaaccgggggccacttgataaaaaaccgccccccgggg

SEQ ID NO: 17900 - DNA, 2877 bp, Zea mays
gtcgcgtatgttctcgtctataccccacagccggccaccccccgcagccaggcaagtgaccgttgcatcctcttccccttccccttccagagccctcttcggcgcgggggtaaattcatccgtccatccaccgacccagagccctcgatcccctaaaaaaaacccagagccctccattccacagccatcctcccctctgcagtgcactgctgcttgaccaagcaacaacaagaagctaccagcgcgctacctgcagattgcagcacacgcaagtgagagggcaggcaactccccggacgcaaggagttagagggcaagcatggcttcccttggtgacataggcctcgccgcgggtctcaacgtattgaccgccgttgccttcttgctcgcatttgcattccttcggctgcagccaatcaacgacagggtctactttcctaaatggtacctcaggggaatgagagacaatccaatcgtatctggtgcagctgtgcaaaagtttgttaacttagacgccagatcctacttgaagtttttaaactggatgccagctgctctcaagatgccccaggatgagctcattaaccatgcaggccttgattctgtggtctacctacggatatacgtaacagggctcaagatatttgttccaattacagttctggcttttcttgtactggtcccagtcaattggaccaatgacaccctaggacgcatcaacgtagtctacagtcctattgacaaactttcgatatctaatgtacctaatgggtcgaagaggtttatagctcacttgggcatggcttatgccatcacattttggacctgttatgtactgttgaaggagtatgaaattatttctaacatgaggctgcgctttctagcttcagagaaacgccgaccagatcagttcactgtccttgtgcggaatataccaccagatcctgatgaatcaatcagtgagcttgtggaacatttcttccttgtcaatcatcctgatcattatctacaacaccaggtggtttacaacgcaaataaacttgctgatctggttgaaaagaagaagaagatgcgaaattggcttgactattacctactaaagtatgagcgaaattcatcattgaggcctaccacaaagactggctttcttggatgttttggttccaaggtggatgctattgactattacaaatcagagatcgagaaaatcgggaaacaggaagctgaagagcgtaagaatgtcatgaaggatccaaaatcagttgtgccggcagcctttgtctcatttcgctcccgatggggtgcagcagtctgtgctcagacccagcaaacaagcaatccaacactctggttgacagaatgggctccggaacctcgtgatgtttattggaataatctgtccatcccatttgtgtcccttacaattaggagattgatagttgctgtggcattcttcttccttaacttcttttacgtcatcccaataacattcgtacagtctcttgcaaaccttgaaggaatagagaaggcacttccatttctaaaacccttgattgacttgccattcattaaatcattcatccaagggtttcttcctggaattgctttgaagatcttccttatagtgcttccaactatactgatgtttatgtctaaatttgaaggactgatatcgcagtcatctctggagaggcgatctgcatctaagtattacatattcttgttcttcaatgtatttttggggagcgtaattgcaggatctgctctggagcagcttaaaacttatctccatacatcagcaaacgacataccaaggatcattggtgactccatcccaatgaaggcgacttttttcataacatatgtgatggttgatggttggactggaatagctggtgaaatattgagactgaagccgcttatattcttccatctgaagaactttttcttggtcaaaaccgaaaaggacagagaagaagctatggaccctggcagtatctgctttgactcaactgaacctagaatacagttgtacttcttgcttggccttgtttatgctgcagtgacgccgttcttgcttcctttcatattggtgttctttgggttcgcatatgttgtcttccgccaccagataataaatgtctataatcagcaatatgagagcgccgcacagttctggcctagcgttcatgggcgtataatcacagcgttgattgtatcgcaactgctgctcctgggactgatgagcacgaacgactttgagcagacgacacctgtgctccttgttcttcctgtgctgacctttgggttttacaagtactgcaagaaccgctttgagccggcattcgtgaggaacccgctgcaggaggcgatgaagaaggacaccctagaacgcgcccgggagcccaacttggatctgaaggcgtacctggccaactcgtacctgcacccggtgttcaagggggacgaaggcgacgacaggtactcggtgatggacgacgatgggtggatggaggaggaggtgatcgtgccgacgaagcggcattcgaggaggacgacgcccgcgcagagcaagcatgaagggtcggactcgctctctgtgctcgagagttctctacagcggtagtcacagtaggagcttagcctgtacagaatggatgaaaatgatcacggccctgctccattgcttttgctttggttgttggttgttcatgtcacaggggacacacacacacagatagaattcaagagagctgtggggaggactgaggggagagatagtttactgtagcttggacaaagaatctgaatacagcagttacattatctgatgaatctgttagcaccatccaaaaaaaaaaaaaaaaaaaaaaaaaa

SEQ ID NO: 17901 - DNA, 863 bp, Zea mays
  misc_feature (844)..(844): n is a, c, g, or t
  misc_feature (847)..(847): n is a, c, g, or t
  misc_feature (852)..(853): n is a, c, g, or t
aagggggctattgggttgggggggcccttttttgtgttttttccccccacgctggggaaaaaggtgtgggttttgtttccaaaggcggattttaagtgggggtaaccccccaggggtttttcccccgtccccgggcgtttttaaaaagggggggcccagggagcgcggggttaattggggcttcactttttggggggaaattgggtttccggggccccccctttgaggttggacgggatttggataagctttttttttttttttttttggggaggactgaggggagagatagtttactgtagcttggacaaagaatctgaatacagcagttacattatctgatgaatctgttagcaccatccatctctagctagagttctctacaactgcagttacatacatcacctggcctgcctgctctccctaccattctggtaaccggagaacaagcaagcaagaagaaaacaaagaatgctatgctcagacgtcaaaattcttgccggatcagtgagtcagtgcatagagatcagtcatgccacctgaggagcatgacgacgcatctcatggcgatgtacaccttggccctctgctccctgagagatctgccgaaccctccagctccagcggctgctcggctcccagccgccttggtcttcatcctcaggcttccttactaacttgtgcgacagaagcggcaatgacagaataggttagcttagcttgctgcgatatgttggttttttccgaatgggatgtctaggtcttggtgtttcctcttttgaaaagggaacgggaggggggaaatgagtttcttttttctcacaaaaaattcatttgcggggtnggngggtnngggccccctt

SEQ ID NO: 17902 - DNA, 650 bp, Zea mays
cgggccggcccttactcgcagaaaccctagcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggccgtttcagctgctgcccctgctgctggaggtgctgctgcccctgcagctgagtcaaagaaagaagagaaggtcgtggagaaggaagagagtgatgatgacatgggcttcagtctgttcgactaagttgtggggcaccttgtgtctgaagtatctatccttggccaggaaactagagtcaatgatgttttagcctttatttagctgagttgtgaaacactggcaagacaatgttttgatatgtaattcagcccctggttgctggttgatttactggtgaaccatacctttgctatccaatttggtcctttaaccaatgcgttgttttgatgttctgcag

SEQ ID NO: 17903 - DNA, 773 bp, Zea mays
ccgggccgggaaaaccttagacgcgaacgcacctcctcccctcctgcccccgagcaccgcagccgccgccgccgccgccgccgccgccgactgcagccatgtcgctgatcgcgggtgaggagttccagcacatccttcgtgtgctcaacaccaacgtcgacggtaagcagaagatcatgttcgcgctgacctccatcaagggtgtgggccgccgcttctccaacatcgtctgcaagaaggccgacatcgacatgaacaagagggctggagagctttccgcggaggagatggaccgcctgatggcggtggtgcacaacccgcgccagttcaaggtgccggactggttcctcaacaggaagaaggattataaggacggcaggttctcccaggtcgtctccaacgccgtggacatgaagctcagggatgaccttgagaggctcaagaagatcaggaaccatcgtggtcttcgtcactactggggcgtgcgtgtccgtggtcagcacaccaagactaccggcaggagaggaaagactgttggtgtctccaagaagcgataagctgcttcacaaagatcccgcatagctttgctactactgtgttggtccatttccacaatcttaaggagtgttcttgtttagacgattaccttggatgatgttttgccctagataatgttttggttctggaacctttaatatattgtatcttgaattccttgttgaactcttcagagtttgttttgccatgggctttaagtcgtttcaatggttggc

SEQ ID NO: 17904 - DNA, 502 bp, Zea mays
  misc_feature (484)..(484): n is a, c, g, or t
  misc_feature (502)..(502): n is a, c, g, or t
gtcacctcattgtaaatctcctgcgatctgtaaccccccgaaaatagtgatattgttgttgtccggcgctcgtggttttttccccttctctttggagtggttttccacgttaaatctgtgtcttctctgtgtttgatctactttgtgtcgtattgattcataacacaagtggagactcgtctcatcctgttgatgcagcaaggtagtatcatgccattttgtaatgttttcatatttatcaattcattgttctatcatgcaactaattttttaggcaattttttcagcatggtgcttctagctttaggaggaggaacccccaaatctgtatggagccgatgcagcagttgatgaaggaacaaatgtagtagtagccccaagtacccacaagcaaataaaactaactccaaaaaagaaaactatcgtctagtcttgtagctgctctttttatcatgtcattttggacttattttcgaggggggangctggacctgaatgccan

SEQ ID NO: 17905 - DNA, 554 bp, Zea mays
aaatccaaacgcgaagtagcaacaagcaaaggcccagatcgataatacgatggggcggtcgccgtgctgcgagaaggcgcacaccaacaggggcgcgtggaccaaggaggaggacgagcggctggtggcctacgtccgcgcgcacggcgaagggtgctggcgctcgctgcccagggcggcgggcctgctgcgctgcggcaagagctgccgcctgcgctggatcaactacctccgcccggacctcaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacatccggcgcaagctgctgggcagcggcatcgaccccgtcacgcaccgccgcgtcgcgggggcgccgcgaccaccatctcgttccagcccagccccaacaccgccgtcgccgccgccgcagaaacagcagcgcaggcgccgatcaaggccgaggagacggcggccgtcaaggc

SEQ ID NO: 17906 - DNA, 2211 bp, Zea mays
tatatatatatatatatatatatatatatatatatatatatgtgtgtgttattttttgttgcggctttcgagctaatcgagctatctcgagctcgcaaacgatgcgagctagctcgatatctagccataatcatatgtaccagcttaactttgttgtgcaaccaagatcttaaagactagggttaaggaggcccaggccccatggatttgtgaagaccccgtgacaacaacaaaataaaggttagaaaggattcgccggatcgtatcaccatttttaaattaggcgctgaccgaaatgaacatttttttaaataacggaacatagtattgcttagcaagtttgggacaaaaaataaattctaatgcaaagtctcatttgcgtacacaacatagttacacatggcaacgtttacaatataatggcatatataaccttgtttaatatcttgtttttcgagaagtctctataaagttaaatttaaaaaaaaaatacaagagactcttcacacaaaatgcgtctatacacgactttccattctcaaccgtatttatgatatgaccgattttaaaaactcttcgttgtatgatgcagtttcttagatatctttagatatcttttctacgtagcaaaccgatcaagagaatctaggttgttacatactctaatacggcaacaagcacgcagtatcccatcggtgacaggccaaacggaagctgcgactagttgctggtggtgagatcaagtgtagattaagtcacgtgttggtagcccgtgctaaaaacgtggccgacaattttataatccccgcaaactgttcgtcgtcgttagcattagcattagcattagcattagcaattgagggtcgtgtcgggccgtttccgttccagtccacgtccacccacacccagagccacccaacctggccagtggccaccaaccttcgtcatctcctcacaccgcgaccaaccaaccaaccgcctagaaaaagaaagccccgcgcccactcgctgccttctcaaatccaaacgcgaagtagcaacaagcaaaggcccagatcgataatacgatggggcggtcgccgtgctgcgagaaggcgcacaccaacaggggcgcgtggaccaaggaggaggacgagcggctggtggcctacgtccgcgcgcacggcgaagggtgctggcgctcgctgcccagggcggcgggcctgctgcgctgcggcaagagctgccgcctgcgctggatcaactacctccgcccggacctcaagcgcggcaacttcaccgccgacgacgacgacctcatcgtcaagctgcacagcctcctcgggaacaagtacgtgcctgcctctgcctctgcctctctcaccgcgccccctgacctgacccagccaaaccaagcaagcaagctgaagaacgtcctccggttgttgccttgcctctgcctgcaggtggtcgctcatcgccgcgcggctcccggggcggacggacaacgagatcaagaactactggaacacgcacatccggcgcaagctgctgggcagcggcatcgaccccgtcacgcaccgccgcgtcgcggggggcgccgcgaccaccatctcgttccagcccagccccaacaccgccgtcgccgccgccgcagaaacagcagcgcaggcgccgatcaaggccgaggagacggcggccgtcaaggcgcccaggtgccccgacctcaacctggacctctgcatcagcccgccgtgccagcatgaggacgacggcgaggaggaggaggaggagctggacctcatcaagcccgccgtcgtcaagcgggaggcgctgcaggccggccacggccacggccacggcctctgcctcggctgcggcctgggcggacagaagggagcggccgggtgcagctgcagcaacggccaccacttcctggggctcaggaccagcgtgctcgacttcagaggcctggagatgaagtgaacgaaacgaagcccacacgtcctttcttctccttttgttgtcggttgtagtcttggcttgttggatttggatagagctagttggttactagttgttagttagaagatagtgcaggatgatcactagctactggctacctcaacacagtagctgctcccttcttctcttccattctatgtaaaaaagaaaaaaaaatacttagggggtgtttggtttctagggactaatgtttagtccctacatttt

SEQ ID NO: 17907 - DNA, 1080 bp, Zea mays
gggtacctcgaggccggccggacgttgggtctgtccccactccccatttctcagcgtgcgcgctctttctctctcctttgtggtaactggcggcggccgacgccgacgccctagctcacgtcttcgtcggtcccttcccagccttcgtcgcgtccttcgccgtcgacgagaacaaacgaggaattcaaggaaacacttgcaggactgaagaatagagaaacatgtcgtctggtggtgtgaaagatttttaccggcagaaaaagaaaggaggcgtggcgaagacagcttcatcctcaaagaacaagacacggcattacactggtggggcttctgttggtgcctcagatgcagctcagacatcagctctagtgtctcatggctcctgggatctcaaagatgactttggtgatgaagaagagcagctgcgacagtttgacgtggacatgaagtttggtccttgcatcggtgttactcggcttcagcgctgggagcgagcctctgccatgggcctccagccaccagctcatctccgggacctcctactgcacgcggcatcgacaaagaatcgcggtgacggtagcccctctgtcgagtgcctttgggagggtaaagtctagaagaaatatcttctcatcccccatcccaggtcaacttcaggtggttaactggagacgcttgttgtaccatgcagcctcttgttgatgtatgttggcactcgtttgtttctcttgcatgtgttcggtaacagtatatagatggctacttgtgcgtatgttggcgcacttcatgccgaattctcttctcgtagtgagatcctgttgcgttgtctgtatctgagtgcgtcaagcacgcacatgaacacatctcctatgtgctgccagttgcattgtgatccaccgttttgggtgctgcgatttgacgctcatttggccgtctttgcacgtgggtagcggtccatctaccccacgagtgtttttttcccggcctccctggccgggccgcatttagcagcaacattggctacgttgccgtacccatgctgagaaaagtctccgtccagagcttttacacacacagggg

SEQ ID NO: 17908 - DNA, 960 bp, Zea mays
ttgggtacctcgaggccggccggggatccgggcggaagaattggctcccgcggggccggccgggggcggcgtctgtccccactccccattttctcagcgtgcgcgctctttctctctcctttgtggtaactggcggcggccgacgccgacgccctagctcacgtcttcgtcggtcccttcccagccttcgtcgcgtccttcgccgtcgacgagaacaaacgaggaaacacttgcaggactgaagaatagagaaacatgtcgtctggtggtgtgaaagatttttaccggcagaaaaagaaaggaggcgtggcgaagacagcttcatcctcaaagaacaagacacggcattacactggtggggcttctgttggtgcctcagatgcagctcagacatcagctctagtttctcatggctcctgggatctcaaagatgactttggtgatgaagaagagcagctgcgacagtttgacgtggacatgaagtttggtccttgcatcggtgttactcggcttcagcgctgggagcgagcctctgccatgggcctccagccaccagctcatctccgggacctcctactgcacgcggcatcgacaaagaatcgcggtggcggtagcccctctgtcgagtgcctttgggagggtaaagtctagaagaaatatcttctaatcccccatcccaggtcaacttcaggtggttaactggagacgcttgttgtaccatgcagcctcttgttgatgtatgttggcactcgtttgtttctccaaggcacgtgttcggtaacagtatatagatggctacctctgcgtatgttgcgtatgttggcgcacttcatgctgaattctcttctcgtattgagatcctgttgcgttgtctgtatctgagtgcgtcaagcacgcacatgaacacatctcctatgtgctgccagttgcattgtgaaaaaaaaaaaaataagcccctag

SEQ ID NO: 17909 - DNA, 894 bp, Zea mays
  misc_feature (853)..(853): n is a, c, g, or t
  misc_feature (858)..(858): n is a, c, g, or t
tacctcgaggcccgccgccggccgggccgggccccactccccatttctcagcgtgcgcgctctttctctctcctttgtggtaactggcggcggccgacgcccacgccctagctcacgtcttcgtcggtcccttcccagccttcgtcgcgtccttcgccgtcgacgagaacaaacgaggactgaagaatagagaaacatcgtcgtctggtggtgtgaaagatttttaccggcagaaaaagaaaggaggcgtggcgaagacagcttcatcctcaaagaacaagacacggcattacactggtggggcttctgttggtgcctcagatgcagctcagacatcagctctagtgtctcatggctcctgggatctcaaagatgactttggtgatgaagaagagcagctgcgacagtttgacgtggacatgaagtttggtccttgcatcggtgttactcggcttcagcgctgggagcgagcctctgccatgggcctccagccaccagctcatctccgggacctcctactgcacgcggcatcgacaaagaatcgcggtgacggtagcccctctgtcgagtgcctttgggagggtaaagtctagaagaaatatcttctcatcccccatcccaggtcaacttcaggtggttaactggagacgcttgttgtaccatgcagcctcttgttgatgtatgttggcactcgtttgtttctcttgcatgtgttcggtaacagtatatagatggctacttgtgcgtatgttggcgcacttcatgctgaattctcttctcgtagtgagatcctgttgcgttgtctgtatctgagtgcgtcaagcacgcacatgaacacatctcctatgtgctngcagntgcattgtgatccaccgttttgggtgctgcgatttg

SEQ ID NO: 17910 - DNA, 1249 bp, Zea mays
gcacgagctcgtgccgttttttttttgtctttgaccatatgggcgcctgcgggtagcagcagccagcaggcagcagattcatgattgataacactgatatcttgtcatcggcatctctttctcctttctgagccgctgtctccctcgtcccccggccccgctcaggtttctcgtttcaggcacgcagctcatgactcctgagcggcgcaaagccgtctgggcgatctacgtgtggtgcagaagaactgacgagctagtggacggtcccaacgcgtcctacatcacgccgaccgctctcgaccgctgggagaagcggctggaggatctctttgagggccgcccgtacgacatgtacgacgccgcgctctcggacactgtgtccaagttccccgtcgatatccagccgttcaaagacatggtccaaggaatgaggctggacctgtggaagtcgaggtacatgaccttcgacgagctctacctctactgctactacgtcgccggcaccgtcggcctcatgacggtgcctgtcatgggcatcgctcccgactccaaggcctcgaccgagagcgtgtacaatgctgctctggctctcggcatcgctaaccagctgacgaatattctcagagacgtgggcgaagatgcgaggagggggagaatataccttccgttggacgagcttgcgcaggcaggtctcacggaagaggacatattcagagggaaagtgaccggcaagtggaggaggttcatgaagggccagatccagcgtgccaggctcttctttgatgaggcggagaagggcgtcacccatctcgactctgctagcagatggccggtgctcgcgtctctgtggctgtacaggcagatccttgatgccattgaggcaaacgactacaacaacttcaccaagcgtgcgtacgtcggcaaggccaagaagctgctgtcgttaccgcttgcatatgcaagggctgcggttgcaccatgaaccatccgtagatcacatcttttttttcttttcttttccaaacccaccttgttttgccccacccttccttttttttttgtatataatcagcttcagctgcctgcatggcataagccttgcctgttcagggtgattccatgtccctaaatactcaatcagctcttgttacaaggaatggagaattagaattcgagaagcgtatacatttttgtcgaaaaacggaacaatatagaaaaaaaaaggcttgtacctagggcgggaccacgc

SEQ ID NO: 17911 - DNA, 2934 bp, Zea mays
ttggtccgtactgtcatcaatatttcaaccgttgatttttggagatcagggcagaaatcaggaagctgtggttccagtgcttatctaaactaaagttgcatgcttgatgttgttagtatggaactgggtttagacatttataatatgaattcgaaaatgaccaacccaccctttcgagttttttttggtaatttgtgttttctgcacaagccaagtcatcaggtatattttagacgtaggattatgccattttgtttgccagtctttgaacaacttgttagatgcttcagaggctgggacaatgacgttgggagaagaatgtaactagctgttctagaggcttatttgcaagtgaattgctgggcatattcacatcttcatgatttgaagcctcaaggatgttcatatagcatcgatattggagctgtctcctgtgcaatgtgagacattccaactactacttggtatacttgtaagctgaagttgcttttacagtcgagaaacagaaccaaggtgattggtgtggaacaccactttgtagcattcacagtaacatagcattcctggtgttttaccttttcccagttcaggttggaagttggaactcttcgagtaggtcccagtggggattagcttcgtggcacttggtgctttcttaatcttgtgcagtcatgtggagggagaagtattcggtcttgaagcgacctccttgattctaatatttgagatgccatcaagaagctgttgcagtggtctatatgtcattgacctgtcaaatgtttgtttgagttaacttgcaaatggaattgtgggatcctacattggctaaaggaattaagattttcttagcaacatcaactccactctttggacacgtagctactaattacaccgtgaactaccagaaggccgctagtttcattcagttgagctgcagtggcaatggtatttccttctcagaaatgtggaccttgcaattataacttcgttcagcatatgaagagtagctcttctgaaagtagttctcatgaagtggttgcctgtttcagttccatgtgactggtgtaagcatttcttgctgaatgttagttggctttatcttttagtgcttatttggaatttttatacttgtttttcaggatatggaatgcatgcaggcccttcgccaccacgcagagcagaagccagcaaatttgatgatgatgttagtccacgttacactcatggatatcaagggggtggtagaggaggtgcaaggttccgagagggtcctccaccatatggaagaggtagatcatatgggagaggttatggtgctccacatggaaaggatttgattaatattgatggagaatatgttcaccgaaatgacccaaatctgtcgccaagagaaggtgattggatatgccagaaccctaagtaagttgctttttagcctgtcaagtatgcttattagtctcttaaatcttggttttctgattttcgtcttgcattttgtcagttgtggaaatctcaattttgctcggcgaactcactgtaacaactgcaacaagttccgctattcagcacgtgaagcatatgaacctaggcgcagccctcccttcaggagttaccccagccctccacgagggcctccaaggatggttggtccacctggtgatcgagcccctgcaagagagatggccaggtacagatccccacctcatggttggggagcaagtgatcccagggcatatgcaggtcgatcccctccagaacgtgcaggacggtttacagatccatcaactaagggaagaatgggcttccgtggtgagcgtgacccaagggaccgtgtgaaatatgagtggtctgccactgatgactacgttcagagggagcgcccatatgatggttatcttgacaggagtcggcgtcgctcaggatctcctcgtggtaactggggaaatgatctgcgtgacagaagccgctctcctgcacggaacaggcctatgaagagttccttcaccggaagaggtcgacctgacgactatgctgctgatccatatggcagccgagggagacccaatggtatggaggccggccgtgggcgtgggcatgcttacagagcaggcagtggtccgtaccctggtgagactcgaggtgaccaacgcgctgctccacgcgctaggaacgaggatggctattagatcttcatgaagctgagtgacgtcattttgtctttgttggtcaggaaaggagaaccttagtcaagctggagcttgagaatatctgcagcttgtaatattaaagatcgtgcacacatcctgttcctgcatgttgtggagttatggttggcttctcatgctcagtggtgggatctattaaagggacatgggtggacacatatacacccaataatttctgcaaaaaaaaattagtactcatcaagtagcgaaataacgttctattgccgtgattctaagcgtctgtttagaagtatccagtttttaagaaactggtttatgtaaattgaggtggtttatagaaattggattcccatttcttaaaaaccaagaagctggccacttctaactaaaaaataaaattgcttccaaataggaccaaaatattttgaccttaccatttgtgatcatcaatgattgccttttcaaaaaccacaatcagcatgcaggtgtacaatgatggcatttgcgatccaaatttattcagtggacgttaactcatcttgacaaatagattaggcaattcaagaggatgatggcatggagttggtagcaattgagaattctcgctgaacaatgaaaattgcaacttatgcttagttgttacactatgtttctcttctctgtaagcatatcatatattgtcagacccggatttaagggataaagccggatgcgtctcatatatatgctaaataagaatatcaaatat

SEQ ID NO: 17912 - DNA, 1247 bp, Zea mays
gcacgagaccattacctagaacatcctaatcgaaaagccgagcagcaaaccaaccagcccacccgccggttggtcacgctcctccccgatcccgaattcccgatctccggccgacgccatggcagccccctccgcggccgtcataggggtgctcgtcctcctcgtcgtgggggcctcgggcgcgcgcctcccaggccgcggcagcaccacccggggagctgcgctgccgcgcgggggagcgccggccacggcggtgttcgcgctgggaagcttctggcggtcggaggcggcgttcgggtgcctccacggcgtgatccgcacctccgtcggctacgctggcggctccaagtccaaccccgagtaccgcaacctcgccgaccacgccgagtgcgtcaaggttgagtatgatccccggttgattcactacaggcaacttttggatgtgttctgggcaagtcatgacccacgtgaggtgtttgggcaagggccagatgttggcaaccagtatagatctgtcatcttcactaatggaaccatcgaggccagattggctggtcttagcaaagaaaaagaacaagctaaagaccgtagcagcgttgttaccacacagatccaaccattgggggtctttcatcatgctgaaccagaacatcagaaatttgaactgaagcgtaaaccgttcctcttgcaattgattgggaatttgccggaggaggagctcctgacatcaacactagctgcaaaactgaatgcatatgccgctgagctctgccctgtgaatacccaaaagagaattaactccaagattgatgaggtcacaaagaaaggatggcccattttaagggacatttaactctttctagcttttggactgaaaccgatcgatgcaatgtagacacagaagaggtgcatgattttgcaaagaagatttttaggaatatttcagctgttcgccactgccatgatgacctcaatcatccattcttcattttgctcacaaagattatatagttggtcataacatgtcgttgtgttacgatatttgtaacgcatattcatggttcgaagcttactcaacagacaactttttttcgtattgtttgtttttcatttatgaaaatatagatgttttgtttttattgaaaaaaaaaaaaaaaagttgtgactgatgttgtactagtaaattgctcgcgcaaagtactgttaaattgaagatcatgctaacatgtgtaccaactatttcgctg

SEQ ID NO: 17913 - DNA, 1733 bp, Zea mays
gagaagttgaacttgtttttatatgtttatttaatattttgagtgattgatatattggaatttaagactttcctagcgggtatggttacccgacagttaaaattacccgtgcggggtaagggtattgataagattttatacccacaaacatatatggataaccctactgtagaatttttttaattgatacggatatgaaatgatattactcgatgggtatgtacctgttaatatcctactactagaaggagaaagaagagaagaaattatgcatggtcatggtctcatggacccaaagtcgaccgcacgaccggaccgagccagcccctgacccggcccacccgctacgaacggtcggtgctcggcccgtccacgcggctgaggaaacggcggcccgctccttcgcccccgcccgctttcccgtggccccgacgccactcccacctctcttcttctctttcccttcgcattaatggccgctctctccctatcccctttcgtctcgctctcggagtaggacactcgcccgcttccggcttaaccttcaagattctccctcctcctcctacttcttcccgcttgggcgggcgcggcaccttccggttctgggcctcctatatatatacgcgcgcgaccgtcccccttccatactccctagcatgctcggctcgcaccccggattgatcgagctcgcccgtcgccgcgatggattcggtgccttccccctcctcttctacccgggccaccgctgctcccggtccctgctgccgctttgacgcgctgcggagggcgtgcgccaggcacgccgccgccgccgcgcgggccgccgggtgggcgctcggcgcgctgctcacctgcgtcttcgccgtcgtgggctcactcgtcggaatcttcattggtgccttcatggggatgtctacagaaagcggcatgttccgcggggctggtgtcggagcagtctcgggagcagtcttctccattgaggctgttgagtcctgcatcgagatttggaggtccagccattcgggaaaatacagcattctctatgtgctggacatcatctctagcctcttcagcggaagaattgtgtgggagaaagtcagtccagcgctacagcgtgcagtgcaaagccagatgagtctaatgagcacaccgttcatcgacaacaatgacctttttgaaactggcagtacaggaggcatgtcaagggctctgattgataggatcccaaagatgaggttcagtgctgcaagcaattgtgacaaggaaactgatagcagctgctgctcagtctgcctgcaggattttggagcacagcaatttgtgagggccctgcctcagtgccaacacatattccatgtgcggtgcatcgacaattggctccttcggcacgcatcctgcccactatgccgggccggcgttcatattgaccatatacatatgtaaataaactcgcagggtggcacctggtgtattttcatagtgaatacccgtgctcctgttggatatcacaagtatagctggatgtatacataggttttctccttttttttttgttacttctccggtcttatgtggggctatgctttcagctgcacgtttttgtcgaagtaatacctggattggctggatatgtacatcttgagaacggattgactaacaagctccctgaattatggtcctgtgtgcttcaaaaaaaaaaaaaaaaaaaaaaaaaaaaacacccaaacccc

SEQ ID NO: 17914 - DNA, 1051 bp, Zea mays
  misc_feature (11)..(11): n is a, c, g, or t
cttctccatanaggctgttgagtcctgcatcgagatttggaggtccagccattcaggaaaatacagcattctctttgtgctggacatcatcttgagcctcttcagcggaagaattgtgtgggagaaagtcagtccagcgctacagcgtgcagtgcaaagccagatgagtctaatgagcacaccgttcatcgacaacagtgaccttttcgaaaccggcagtacaggaggcatgtcaagggatttgattgataggatcccaaagacgaggttcagtgctgcgagcaactgtgatcaggaaactgatagcagctgctgcccagtctgcctccaggatttcggagcacggcaattcgtgagggccctgcctcagtgccaacacatattccacgtgcggtgcatcgacagttggctcctccggcacgcgtcctgcccgctatgccgggccggtgttcacatagaccatatacatatgtaaatgaactcgcagggtggcacctggtgtattttcgtagcgaatacccgtgctcctgttggatatcacaagtatagctgtatacatagggtttttttgctctctctttttgtcacttcttgagacttgcttgtgtggggctatgctttcagctgcacgtttttgtcgaagcatgatgccttgatatgtacatctggaaaatggaccgactaacaagctccctgaattctggcactgtgcttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaagggcccttgggtttttacccctgttaaagggcaaattccaacaaactgggggccgtaacaaagggatccaactttggacccaattttggggaaataagggaaaaagcgtttccctggggaaaagggtaacccgttaacaattcccaaaaacaaacaacccgaaagaataaagggaaaagcctgggggcccaaaggagggaccaaacccaaata

SEQ ID NO: 17915 - DNA, 4167 bp, Zea mays
gtaccgggccccccctcgagttttttttttttttttttggttttaaaatcttaacaacttaaaaacggaatgctaagatagtatggtccctgtacagtaatgataatttacaaatgcagcaaagcacctctcttaaggacaggcctcgcgcaaattagcggccaatttcctttcagacctttttttttagcaaagcacatctccatctactttggtgctatagggataccacacaacaagtacagtgacacttcgagcggcatctgtctcggatgatccccagctcccatatgcctataacttgttcgcttcaaagcatggccctgttcactcctacatcctctccaagctacgtcaatcaaaggtctgtacaacaatgtagctcggattccaaattccaatatgccaaatagagctccactggtcacaacctcctagcacaaagcgctaactagatgactgccgatgactgtacacttctcaactctttcagagggggggtcccatgaaagtacaatgcggcaccaatctgtttccctagttgaccacaaatgtgcaatgccacatgaaaacacagtgatcaataacctagtcctctcctggaaatctgatatggggtgccagcatagatcagcccaaaactgacctatgcaatcccatggtttgctccaaggatacaagaaaattggtttctgaatgaatccgttgctcctgtggggaaaatcataaaattccattcaatactctctggtagtaatcatattgccgagtgcgccaagcatccatgctgctactgatcagtgagagcaccagggatacacattgctcttcagttagactcaagtggaacctcttcctcaagttttgtattgtgcgagggccacctttgaaacatggaaagccagaatcctggtaagggaacgcaatataacacttgtaagataatttgtaacaatttgcatactagctaaatcaacacaattataagtaaacagcataccacatcccagacatgcaggggtaacattataccatataaaaaaggttaactcaaatcaatttatatgcttcaatacaaggaaacaacttcactttttgagagaaaaaaagaaaacaacttcactgtagtagctcagattacaaggcacagtgaaaaaacttgagttcgtattggatgaaaattgagaaactggaacttttggccaatatagaagacctgtcaaagaatctaatgcgataattctttactgatatacatcacaaaatgttgagccaaaaaaaacgtttggattaaacaaatatttgcccttagaaattagttgtatgacatatattaggcaacacagataaagtacgttacctgcaacatttccacaagaagtataatacgttctgcatgcttccggcaagtaaggaaaccttgaatgcatagcaccttaaagtaatcaaagaactcactgggagttccctctgcatcagaatccatcacttcaaggagttccctcgttagcttaaatggtgcactctcgaagtttacacctccaggagagttcgacagtatgaaaccaaaatcaatatgaataatatgcccttcctcatcaattagaagattcccattgtggcgatctttcacctgaagtaggtagcacagaattgaatatccagccatactttcaacaaagtttctctgcaaaaaaataagttgactttctgagtccaaacagtactagatttcatattaaccctcctaggttacaatagaattaccacatgaagatctcactgcacaattttcttgcagttgcttatcaagaatcagaaaaaatggtagcataagcatgaacaatattcttataaatgacaattaagaagcaaatccaactaactgcatcctctgcatagacatgcatagcatgagagattgacaagtcggtataatggttactgaaatacaactatattttgcattcaagaagcaaatgaataaatgtccacatcttgtttttctcggacaaatgcaagcatgagcggctgagcactgcatgtcacctatgcgagtaagggtgtgtttggttgcgggacagctaggacaacaggggacagctgcgtcctccgtcgtcccctctcatccatccaattctgacggactgttgaggacgacactgggatggtcatgtcccaacccttgaccctgaaccaaacaaccttatctaagtaatcgtctcatcccgtcccattccgtcattgcaaccaaacgcaacctaagagtacagaggagagcccaacaggcccaacctccagtcacgaggatatcatttgcttctaccccaaaaggtgtcattctcacctgtgcgagtttaaaatttggagatttctccgcatacttggctacatagtagtctcggagacttgaaatattgggaaacctacttttgacggaatggattgatgcctgcagtaacaagaaataaacttgtagtagaaccaaacatatataaagaccaaaaggtattaatgatggtaatagttaagaagataaggtacccaccgtatcagggatggtctcaattagtgctgtataagctgaagtaacaattacttcataaggccgcagccatagtggtaaaccagcttcttgatatatatctgacatcagcagtttaaataagagcagaaacaaaaaattagcataccaatgaaaaaatattccctccggtgtgtaatagtgcatacaagcattcaaaaatttgagactgttatattaattatgttccatacacaaatatgacaacgaataagagtggtgctatttctgtgtgcaagaaactggcgctatatctatgtacaacagtacaaaagttcaaaaaccttctcatatccagatatatgttgtttagtaatcatggctttacacacacacggacgcgtgcacgctatataggttgcatctgcgcagtttggttcatgacgtttgaattttgaaatatttgcatgcatagatggtcaaaacagcaagttaaatgcttaagcattgagatatctgaaatctgataaaaacaacaaactagagcatgacaaaatgatagtccaaaaggcctttttctgaaggacagcatatatatcagatgcaagaggcacagtgcgcaaaaatgacaaatcgttataagaatgagaatcagctttcaccatagaagtgtgcaacaagctgtacggccaagtgttcctgtcggcaatcatcaccactcttgacaataatctacattggagcaaatgtttcagaagtatggcagtaattgaagatgtttcagaaccaaaaacaatgggaatggacaagctgtataatctttggagtctggaatgaaaggaacagaaccaaaaacaatgctaacaggttacatgaattggtcctatgttcttagtacataaaaaggatcactgaaacaactattcttgaaacacttgagatttagctgtcactttacttctcgtcagtatttaaattcttcaacagtcaacagagttaagctagtgctccagagataaatggaaatagagatgaaagcaaggattgaagattccgttcattgggcgatgtttccgtaatagcgatatcacttatgactgtttctgataattatcgcatattcacaattcaagttttaatttttctaatttcatgtaccatattgatgttgtaaataaatagttagaatgaaaacatggtgagtttctactgaccaggaaccatttccaaattgtaaatatcataaccaaccatttctgatcattttcatacttagaaggacaccattattcattgagtttatatgaaacttttttccttgaatacaaagaattcccattgcattacaaacatgaattttttgccaaacaacaggagagctgcatatcattatatcaagaataaaaaatgggaaataagccttacaacacacacacacacactgactcaccaaaatctatactatacttaaagcaccagtttcaacggttgtcgtgcgtcatttttttacaaaaatcaccctcagtttttctcaggttaacccgcagtccctcatcccacgcctccctccttatctcaaccgcacgcaaaaccctagcctctctcacgccatacctcctctctcgcgatccccgcgcaaggcg

SEQ ID NO: 17916 - DNA, 821 bp, Zea mays
  misc_feature (1)..(4): n is a, c, g, or t
  misc_feature (6)..(8): n is a, c, g, or t
  misc_feature (18)..(20): n is a, c, g, or t
  misc_feature (25)..(25): n is a, c, g, or t
  misc_feature (28)..(28): n is a, c, g, or t
  misc_feature (54)..(54): n is a, c, g, or t
  misc_feature (612)..(612): n is a, c, g, or t
  misc_feature (626)..(626): n is a, c, g, or t
  misc_feature (634)..(634): n is a, c, g, or t
  misc_feature (677)..(677): n is a, c, g, or t
  misc_feature (681)..(681): n is a, c, g, or t
  misc_feature (697)..(697): n is a, c, g, or t
  misc_feature (708)..(708): n is a, c, g, or t
  misc_feature (713)..(713): n is a, c, g, or t
  misc_feature (741)..(742): n is a, c, g, or t
  misc_feature (761)..(761): n is a, c, g, or t
  misc_feature (764)..(764): n is a, c, g, or t
  misc_feature (770)..(770): n is a, c, g, or t
  misc_feature (772)..(772): n is a, c, g, or t
  misc_feature (784)..(784): n is a, c, g, or t
  misc_feature (789)..(789): n is a, c, g, or t
  misc_feature (810)..(810): n is a, c, g, or t
  misc_feature (812)..(812): n is a, c, g, or t
  misc_feature (816)..(816): n is a, c, g, or t
nnnntnnngctccccccnnnggggnccnctctataactaatggatccccccccncggcgagttcgcaccaggagctcactagtcccccccccccccccccgactctcaccagtcacaaccaaaaaaaagaaaacacaaaaacaaagattataatggcttcctcaaccatggctttgtcctcccctgccttcgccggaaaggctgtgaagcctgccgcatcagatgtcctcggaagcggccgtgtgaccatgaggaagactgtcgccaagccaaagggtccatcaggcagcccatggtacggatctgaccgagtcaagtacttgggtccattctccggcgagcccccgagctaccttaccggtgagttccccggtgactacggatgggacaccgctggtctatccgccgacccagagaccttcgccaggaaccgtgagctagaagttatccacagcagatgggccatgctcggagccctaggctgcgttttccctgagctattggctaggaacggagtgaagttcggagaaagcggtttggttcaaggccggttcacagatcttcagcgacggaggattggactacttgggccaacccgagcttggtccacgntcagagcatcttancccatttnggctacttaaagttaatcctattgggagctggtgaaaggcttnaaantcccccgaaaatgggncatttgggaanaaacnaaagaattggctttaaccaaggtggganntttgaaccaatttgggccntgnttactnancccgaagctttncaaantttgaaggggaaaggaccttnanaacngaagg

SEQ ID NO: 17917 - DNA, 778 bp, Zea mays
  misc_feature (636)..(636): n is a, c, g, or t
  misc_feature (660)..(660): n is a, c, g, or t
  misc_feature (678)..(678): n is a, c, g, or t
  misc_feature (687)..(687): n is a, c, g, or t
  misc_feature (726)..(726): n is a, c, g, or t
  misc_feature (734)..(734): n is a, c, g, or t
  misc_feature (762)..(762): n is a, c, g, or t
  misc_feature (776)..(776): n is a, c, g, or t
ttcccggctgcaggaattcggcgcgagctcactagtcccccccccccccactctcactcacaagttagtcataaaaaaaaaaaaacacacaaaaaagtttcaatggccgcctcaacaatggctctctcctcccctgctttcgccggaaaggctgtgaacctttcccctgcggcatcagaagtccttggaagcggccgtgtgacaatgaggaagactgttgccaagccaaagggtccatcaggcagcccatggtacggatccgaccgagtcaagtacttgggtccattctctggcgagtcacccagctaccttaccggagagttccctggagactacggatgggacacagctggtctatccgctgaccccgagacattcgcaaggaaccgtgagctagaagttatccacagcaggtgggccatgctcggagccctaggctgcgtcttccctgaacttttggccaggaacggagtcaagtttggagaggcagtttggttcaaggctggttcacagatctttagcgatggagggctcgattacttgggaaaccctagcttggttcacgctcagagcattttggccatttggccactcaagttatcttgatgggagccgttgaaggctacagagtcccangaaatggccgttggaaaagccgangacttgctttaccccggnggaacttcnacccattgggttggcttcccgacccaaagcattcctganttgaaggngaaggacctcaaaacggaaaatgggctnttgtctttttgttnga

SEQ ID NO: 17918 - DNA, 1005 bp, Zea mays
atggaaaacgcttctcgttttccggcctgcgccgggtgggaagcctctctccaagagtggcactcgtatcagaactcctcaacagattgctcatggatgcaaacttagcaaccatatcatcgtggtaccacttgagaaagtgataatgccctcgtctttgaaacatcatcggtaactcccttgcctgagaaacttgtggagaatagagcccaccactcaatccatgaaaaaaacttttaactggacttccaaagaacatagcatccccactgaacagctctttcatggttgtgacaaagtcctgttgctccatgtccgggaggtaggctgctagacggagtctatcatcttccgtcaggcatgaattccatgtctccaaagaaagaacctcggccaagccaccatgcaggtcataaatcccataggggatattgcacatctggcctctcgacgatgcaagctcacagtccacctccgcctggtcagagccaagagattctggatcaggaaagctctggagaagcattctgtcctctcgtgtaaggtcctcacctccacaactgtaaccactcctcgctgcaggctcacggcttcctatcttgacaattcccattggacgaaaagagctggtccagtagtccaattggatcagatgtagtcaaagtagaggatggtgagtggagttctgataataacgccacattatccaatagaagattccgtgccgaggatcgggtcgggccgacgtcgcgtcgagtcgaggtggggaaaggcgggcgccgggcggcgaggatggattggggaatgaaggcggagttgtggagccttcggttgcgctactgtgccgccgcgctgttgcggtgcagtacagtagtgctgcagtgcgttgcttggcaagttgatcgcttgcccctgctgccattcggttccgcggcttctccgtgaaaaccacgcgggcgggcagagccgaaagcacgagggtttttggtcccgagcccggccggc

SEQ ID NO: 17919 - DNA, 1188 bp, Zea mays
agacggctgagagcctgagacgggcgatgaccgcacgcccgcacaagctgctccgggctccgctgctaggctagggtttggactttggattggagccgcaccgccgcaccggcaccgcagccgccgcagtgccgcacagccaccactcccatcttggtcttgcggctagtcgccctcggacctcggccatcgaccccttgcccgcttgccgagacgccgagtaagcgtcgaccgtcgtcgctgtcgtcaccgaggtccagcgcccaacagcccggcttcaagcctccagccatcggcgcccgccctcctccgccgagacgccgagtgccaagcgcccaagcaccccagtccccagcgcccaacaggctagcaggctgcaggtatgcactctttgttgatgcgtccaaggagttgagctcaatgcccagcaggctgcaggtatgcttcgattatgtccaaaccttccttctagcacttaggaagttgggaactttcttgttgtatcagatttggatatactattagcatgttattagcagtttagctatcttagactacaaatattgtgactacataatctaaaatcctttttgtttattatatgcagaaactgaaggaaaaggcggcattcaggaacccggatgagttctattttaaaatgatcaacagtaggactgttggtggaattcatagacctaagcctgaagataataagtatactgaagatgaacttcttctgttgaaaaataaagatatgggatatatccttcagagcgctcaaagtgaaaaaaggttactgaattggaacggggaaaaatccataaagtgctgaagactaagtggatcgagcgcgcgcgagggttgtcgtaaaatgtccaccgttattaagagggctaatgaattcccggtcgattagagctacatgcatggaggagtgcacacacatgcctatgttgtttgaattaatcaaattgttgtttgttagtaattattaccgcctccaactatgctctatacgtccacaggttcgtcagctatttcatgcaaaaaaacgcacaagtgtcccactgttaaatggtattgtgttctgaaacttgagacttttattatgactatgtatgagaaattgtctcttattaggactggatgagatgtgtcttatttatgattatggatgagacttctgtg

SEQ ID NO: 17920 - DNA, 755 bp, Zea mays
cccagcgtccgcggccgcgtgggcgcacgcccgcacaagctgctccgggctccgctgctaggctagggtttggactttggattggagccgcaccgccgcaccggcaccgcagccgccgcagtgccgcacagccaccactcccatcttggtcttgcggccagtcgccctcggacctcggccatcgaccccttgcccgcttgccgagacgccgagtaagcgtcgaccgtcgtcgctgtcgtcaccgaggtccagcgcccaacagcccggcttcaagcctccagccatcggcgcccgccctcctccgccgagacgccgagtgccaagcgcccaagcaccccagtccccagcgcccaacaggctagcaggctgcagaaactgaaggaaaaggcggcattcaggaacccggatgagttctattttaaaatgatcaacagtaggactgttggtggaattcatagacctaagcctgaagataataagtatactgaagatgaacttcttctgttgaaaaataaagatatgggatatatccttcagagcgctcaaagtgaaaaaaggttactgaattggaacggggaaaaatccataaagtgctgaagactaagtggatcgagcgcgcgcgagggttgtcgtaaaatgtccaccgttattaagagggctaatgaattcccggtcgattagagctacatgcatggaggagtgcacacacatgcctatgttgtttgaattaatcaaattgttgtttgttagtaatt

SEQ ID NO: 17921 - DNA, 1190 bp, Zea mays
agcggctgatttattttctcctttcctcccggcggccggcgctgctctctccttcgacatccgcggcagcgaagactaggccacaaaatcgcggtagcaagcagcagacaggtggggaagatgtcgtcgctgcggaatgcgatcccgcggcgcgctcacaaggagcgcgcccagccggaggcgaggaagaagtttgggcttttggagaaacacaaggactatgtcgtcagggcgcgagcttaccacatcaaggaggcaaccatcgctaaactgaaggaaaaggcggcattcaggaatccggatgagttctattttaaaatgatcaacagtaggactgttggtggaattcatagacctaagcctgaagataataagtatactgaagaggaacttcttctgttgaaaaataaagatatgggatatatccttcagagcgttcaaagtgaaaaaaagaaaatcgaaaagctaagctcaacactccatgaacttgataacaagcctcaaaacaagcatgtttattttgctgaagacagagaagaagcaaaagaaatacaatcaaggataggacaaagcagcaacatgcctgatcttgacaacatcccttctcgtataaagaagaaaatagcctcttcgtacagggagttagaagagaggaagcagcggcttcaaaagcttgagaaattgtatgcagacatggccttgcaaaaagaattgaagaaacctggacgcaagaggaaactgaaactccatgaagatgaagagacggacaatcaaacatcacggcctgtttataagtggcgagcacagaggaaacgatgagatgatatgaatgggctatggagggagtaaaaggcaacatgttagtagtggaagtactggtcagtggaaccgctccttcggaccttaaaatacttccctgtagaagtagccctccacaagaactgtgtctttgtcaaactattgggcttaaagatcagattctgtatgattcaatcatgtgcatcatatatcaattcattgttctgtattatgttgaattcgcctagggatgggctatttttgtgatccattttgagatcagcaagtaatgccagatacaataggatagatccaacacaatgtatccctatacaatgtatccctatacaataggatagatcagcaagtaatgcctagcgttgggcttgacc

SEQ ID NO: 17922 - DNA, 687 bp, Zea mays
  misc_feature (665)..(665): n is a, c, g, or t
  misc_feature (680)..(680): n is a, c, g, or t
gcacctagtccccccccccccgaccaaacacctctcgtccacatctttctcctttggtggcaaacacaacgacagatagagagaaacgatggcgtcgaactcgcttatgagctgtggcatagccgccgtgtacccttcgcttctctcttcttccaagtctaaattcgtatccgccggagttccactcccaaacgccgggaatgttggtcgtatcagaatggctgctcactggatgcctggcgagccacgaccagcttaccttgacggttctgctcctggtgactttgggtttgacccacttggacttggagaagttccagcgaaccttgagagatacaaagagtcagagctcatccactgtagatgggctatgctcgctgttcctgggattttggtaccagaagcattaggatatggaaactgggttaaggctcaggaatgggcagcactaccagggggtcaagccacttacttgggaaacccagtcccgtggggtactttgcccacaatcttggccattgagttcttagccattgcatttgttgagcaccagagaagtatggagaaagaccctgagaagaagaagtacccgggaggcgcatttgaccctcttggatactcgaaggaccccaagaagctcgagggggggcccggtacccaattcncctatagtgagcgtntttacaa

SEQ ID NO: 17923 - DNA, 1499 bp, Zea mays
ccacgcgtccggattccttttcaccccgccccgcccgcgcagtcgtcctccccaccccaccggccccaccccacccggtccccactttccactcccaaccccaccagaccttcaaccgctacatttccgtcactaccggagccgccactcccacgaacgcgggcggcggagcggaagcgaaccagttatctagtggagttgcctccttcaagctactctaatgtcctttctattcaagtctagcaatggcggcaccactgaaaaaatcccatccccagaagaacagcgagaaaaaataaatgaattacgcaaggagcttggtgaacactcatcagcagccattaaagacttcctttcagatgcctcgttagcgagatttcttcgagcaaggaactggaatgtgcagaaagctagtaaaatgatgaaagcagctgtgaagtggcggcttgcattcaaacctgaaaacatctgttgggatgatattgcagaggaagcagagactggaaagatatatagggcggattataaggacaaacatggcagaactgttcttgtattgaggcctggcttagagaacactacctcagcaataggacagatcaaatatctagtctactctctggagaaagcaattatgaacctgacggaagatcaagagaagatggtatggctgacagatttccagtgctggacattgggaagcacaccactgaaggtgacccgtgagactgtcaatgtcttgcaagactgctatcctgagaggttggggcttgcaatcctttacaaccctcctaggatatttgaatcattctggaagatagtgaagccgttcctagaccatgagacccgcaagaaggtgaagtttgtgtactccaacgacaaggagagccagaagataatggcagaagtctttgacatggaggagctcgactcggcattcgggggaaagaacccagcgacatttgagtacaacagctacgcagagcagatgcaggacgacgacaagaagatgggatcttcgcacggctcagccaatagcttgcttggatcagctgggaaggaggctaatggcgcagactcggacgcctcaagcgaggcctccttctacagtggaactgactctccgacacatgagaacggtgaacacagcatcgcgaagaagaatggttgagctgagttgaactgctttgattgctcaaactgagggagctgactaatgtagttggtcaacataacagttatatctagcttgaacgattgtcaggaccgatggcgatgacagattccaggctggttagatcaccttgtcgggtctaggcggaatgtatatttgctgctcatgatattatagtatgtaagaccataaacggtgagtttgtgatgcgctatatatcttggaataaagttcaacttcttcgttttcttaaaaaaaaaaaaaaaaaacaaaaaaaaaaaaacgcggccacaaaaaaaaacggacgcgtgggcagacgtgtggg

SEQ ID NO: 17924 - DNA, 731 bp, Zea mays
aaaaacccgcacggcctcaccgcccctccggcctccgccgcgtgctcgtcccaaccctgtcgccggcaagccatggcgtcgcgcttccgctccttcactcgcccggccgccgccgccttcctccggtccactgccagccgaagcccctccgcttcccttccccgcaccctcgctcctgtccctagggcttcggccacggggcggcgcatggctctggcgcggtctctgcaaccgctgcacagcgccgtctcggcggcccggctgacgtcgcggctgggggcggaggtggaccgggccgtgtcgcagggtacgctctgcagttcctacccgggagtctgagtctgatacagtgtactaatctttgcaacgctacaagacaggtctcagtgtccctcgataatgaaaggaactgctccagatggcagcaacatcagcagcagatagttgtaagacttggtcatcataataatcattcttgttaaacggttacgttgtttatttagtggccactttttgctatgcgctaacggcgcatgtttgacctcttaccataatacattcctggtaagggcttttcttttgaattctatgtgtggtcaaggttttaatgagcatagtcatgttcttgtacgcctgtctccatttatatatgtggagatatgggcatcagttcaaagctgggatcaaatttctgggtagcatcccggcaaaatgtgacattttgttgcaaa

SEQ ID NO: 17925 - DNA, 772 bp, Zea mays
ttgggaccctcgaggccggccgggggcagcctgcgcggcctcaccgcccctccggcctccgccgcgtgctcgtcccaaccctgtcgccggcaagccatggcgtcgcgcttccgctccttcactcgcccggccgccgccgccttcctccggtccactgccagccgaagcccctccgcttcccttccccgcaccctcgctcctgtccctagggcttcggccacggggcggcgcatggctctggcgcggtctctgcaaccgctgcacagcgccgtctcggcggcccggctgacgtcgcggctgggggcggaggtggaccgggccgtgtcgcaggagacaggtctcagtgtccctcgataatgaaaggaactgctccagatggcagcaacatcagcagcagatagttgtaagacttggtcatcataataatcattcttgttaaacggttacgttgtttatttagtggccactttttgctatgcgctaacggcgcatgtttgacctcttaccataatacattcctggtaagggcttttcttttgaattctatgtgtggtcaaggttttaatgagcatagtcatgttcttgtacgcctgtctccatttatatatgtggagatatgggcatcagttcaaagctgggatcaaatttctgggtagcatcccggcaaaatgtgacattttgttgcaaaaaaaaaaaaaaaaagttgacaggtgtttttttctcttgaaatatagcgaagattgaattgcaaaaaaaaaaaaaaaaagcggcc

SEQ ID NO: 17926 - DNA, 2189 bp, Zea mays
ctcgaggccggccgggaagcaacaaatacatttgcgtagcagacatcgctgcccgtgtctccattcacctcgctgctcagtctgacacggaaccgagcagaaaacccaggccagctcccgataagttgcgctcgagtcgagtcgccccggtcgcataggccgtagaccgccatggcgaaccgcagcaagcaggtcgttaccaccgcactgccgctcgcggcagcagcagcttcgctcgccgtcgtgctcctgctgtgctccacgggctcatcggaagacgacggatacctcgggcgcgtgggtgcgccgtggggccgtaccctcacggtcctcccattcagccccgcggacctgctgcccctcctgccgcggggcgtcgccatggccgcgctccgggcgctccgcggcgtctcggacatcttcccggtgttcgtcggcgccgcgtcggccggcgggtcggactcggtgcccggcagcgggggcacggtgagatggaagggggcctgcttctacgagaacgaggcgtggctggtgttccacaacgagaccgggtccaagtacggcggcggcacgctccatatcaagacatccaaagcacacagctggacttgcatagatctgtatgtatttgcaacaccatacagagttacatgggattactactttttggggcgagagcacactcttgatatcaaagaatgggaaagcgaggctgagtatgagtatgtgaaacgtaatggtgtgtccatcttcctcatgccatctggaacaattggcacacttcgagcactctgggatgtcttccctctgttcacaaatactgcatggggtgagaacgcgaatcttgcttttctcgagaagcatatgggtgccacctttgaggaacgcccaaaaccttgggtctcagagttaaatcctgatgatatccactcgggagatttcttggttttatcgaagattcgcgggcgttggggtggttttgaaacactggagaagtgggttactggcgcttatgctggccatactgcggtttgcctgagggactccgatggaaagctttgggttggggaatctggtaatgaaaatgaacagggagaagatgttattgctatcctgccctgggaggaatggtgggagtttgaagtgacaaaggatgactcaaatcctcagattgcactgcttcctttgcatccagatctgcgggcaaaatttaatgagacagcagcttggatttatgcaaaaagcatggaggggaaaccttatgggtatcacaatatgatatttagctggattgataccatcagtgataattatccaccaccattagatgctcatgtggttgcttctgttatgactgtatggagcaagcttcaaccagagtatgctgctaatatgtggaaagaagcccttaacaaacggcttggaactaagggtcttgacctttctgaaatcatagtggaatcagagaaacgtgggataacatttgacaagttactatctgttcctgagaacgatagctgggtctatgaagatggtcagtcagcatcttgtgtggctttcgtccttatgatgtacaaggaggctggactctttgaccctattaccagctctattgaagttactgaattcacaataaaagatgcttatatcctcaacttttttgaggacaactcgacccgacttccggagtggtgcaacaaggatgacgatgtgaagcttcccttttgccagatcaagggcaagtaccggatggagctgcctggatacaacaccatgaaaccctatgcccacatgaacgagagatgtccatccctgcctccagattacaacaggactaagggctgctagtgctaaccagatatgcgtgtgcattttattcacgctcccttgtagccattgcttcagctgtaaatattatacatttatactagtataatagtactatgggggtatgtactgcttgcccttgagaagcgtgtattgattgtaggcaacttatgtgagacttcctcgaataaggaagaacatgaatcacacaaatgtacagtaaccatgcttgatctttttatcagtgtttacttatgtaacagtaaaaaatgtataatgtatgtgcgcctttggactgagctgattacatgatccccatgcccaactcgagactagttctctctctctctctctcctcgtgc

SEQ ID NO: 17927 - DNA, 1960 bp, Zea mays
aattcggcccgacgcgtggttagggggggagcgcaagtgcctgaagtaagcctaatcctaaccgccgccgtcatgacggcgcccaagctcaagctcctagctcttcctactctgctggtcctcatcctcctcctcctcctctccgccgcccggcggcgcgtccttctggagacgctcctcctccgcgccccggtcctcccgggcgacctcctcccgctcctgccctggcccgtggcgcagccgctgctccgccgcctcgcgctgcggggccccgccgacctgctcccggctttcgtcggggccgcgcgcgcgccggggtccgacgacgcctacccggtcgccgagtggaagggcgcctgcttctacgagaacagggcgtgggtggagttccgcaacgggaccggcggggggctcggaggcggcgtagtccatgtggagacatccaaagcacacagctggacttgcatagatctgtatgtatttgcaacaccatacagagttacatgggattactactttctggggcgagagcacactcttgatatcaaagaatgggaaagcgaggctgagtatgagtatgtgaaacgtaatggtgtgtccatcttcctcatgccatctggaacaattggcacacttcgagcactctgggatgtcttccctctgttcacaaatactgcatggggtgagaacgcgaatcttgcttttctcgagaagcatatgggtgccacctttgaggaacgcccaaaaccttgggtctcagagttaaatcctgatgatatccactcgggagatttcttggttttatcgaagattcgcgggcgttggggtggttttgaaacactggagaagtgggttactggcgcttatgctggccatactgcggtttgcctgagggactccgatggaaagctttgggttggggaatctggtaatgaaaatgaacagggagaagatgttattgctatcctgccctgggaggaatggtgggagtttgaagtgacaaaggatgactcaaatcctcagattgcactgcttcctttgcatccagatctgcgggcaaaatttaatgagacagcagcttggatttatgcaaaaagcatggaggggaaaccttatgggtatcacaatatgatatttagctggattgataccatcagtgataattatccaccaccattagatgctcatgtggttgcttctgttatgactgtatggagcaagcttcaaccagagtatgctgctaatatgtggaaagaagcccttaacaaacggcttggaactaagggtcttgacctttctgaaatcatagtggaatcagagaaacgtgggataacatttgacaagttactatctgttcctgagaacgatagctgggtctatgaagatggtcagtcagcatcttgtgtggctttcgtccttatgatgtacaaggaggctggactctttgaccctattaccagctctattgaagttactgaattcacaataaaagatgcttatatcctcaacttttttgaggacaactcgacccgacttccggagtggtgcaacaaggatgacgatgtgaagcttcccttttgccagatcaagggcaagtaccggatggagctgcctggatacaacaccatgaaaccctatgcccacatgaacgagagatgtccatccctgcctccagattacaacaggactaagggctgctagtgctaaccagatatgcgtgtgcattttattcacgctcccttgtagccattgcttcagctgtaaatattatacatttatactagtataatagtactatgggggtatgtactgcttgcccttgagaagcgtgtattgattgtaggcaacttatgtgagacttcctcgaataaggaagaacatgaatcacacaaatgtacagtaaccatgcttgatctttttatcagtgtttacttatgtaacagtaaaaaatgtataatgt

SEQ ID NO: 17928 - DNA, 987 bp, Zea mays
tttttttttttttttttatttttttttagatttaaagatataaatattgatatataaactcagttgaattcaaacagataatttcatcataacacctaatccatcgacttatgtttattgggagcgctcctatcacagtaacagaatcattaaattctccagactcccgggggccctcgagggctcaaaaccacacaattcaacaactgggtggagaagcaacaaatacatttgcgtacgagacatcgctacccctgggccctggctccattcaccttgctgctcagttctgacacggaaccgagcggaaaacccaggccagctcccgataagaaatcctcgagtcgactcgagtcaccccagtcccccataggccgtagaccagagcagtagaccgccatggcgaaccgcagcaggcagctcgttaccaccgcactgccgctcgcggcggcagcagcagcctcgctcgccgtcgtgctcctgctctgctccacgggctcatcggaagccgacggatacctcgggcgcgtgggtgcgccgtggggccgtaccctcacggtcctcccattcagccccgcggacctgctgcccctcctgccgcggggcgtcgccatggccgcgctccgggcgctccgcggcgtctcggacatcttcccggtgttcgtcggcgccgcgtcggccggcgggtcgggctcggtgcccggcagcggggggacggtgagatggaagggggcctgcttctacgagaacgaggcgtggctggtgttccacaacgagaccgggtccaagtacggcggcggcacgctccatatcaaggtacgggcctcctcccccgaccgaagctgagcacaattttgcagtagcacggtgtgcttgtgctgccgaacaaattaagatggatccagagagagagagagagagtggtcttggctctacaggcttggtagacagacactggagacagtgacacggacacgccccacgtcc

SEQ ID NO: 17929 - DNA, 832 bp, Zea mays
gattgacacccttcagtcataattatccaccccccattagatgctcatgtggtgcttctgttatgactgtatggagcaagcttcaaccagggttgccgcctatttgggggaaagaagcccttaacaaacggcttggaactaagggtcttgacctttctgaaatcatagtggaatcagagaaacgtgggataacatttgacaagttactaactgttcctgagaacgatagctgggtctatgaagatggtcagtcagcatcttgtgtggctttcgtccttatgatgtacaaggaggctggactctttgaccctattaccagctctattgaagttactgaattcacaataaaagatgcttatatcctcaacttttttgaggacaactcgacccgacttccggagtggtgcaacaaggatgacgatgtgaagcttcccttttgccagatcaagggcaagtaccggatggagctgcctggatacaacaccatgaaaccctatgcccacatgaacgagagatgtccatccctgcctccagattacaacaggactaagggctgctagtgctaaccagatatgcgtgtgcattttattcacgctgccttgtagccattgcttcagctgtaaatattatactagtataatagtactgtgggggtatgacgtactgcttgcccttgagacgcgtgtattgattgtaggcaacttatgtgagacttcctcgaataaggaagaacatgaatcacacaaatgtacagtaaccatgcttgatctttttatccgtgtttacttatgtaatagtaaaaaatgtataatgtatgcgcgcctttggactg

SEQ ID NO: 17930 - DNA, 1308 bp, Zea mays
cctcgtggccggccgccctcccaaaccaaaccaaaccaaacataatacgatgctgcggcgccttgttgcgggagccgccgccgtgcgttcgccgctgccgccgctgttctgtcgggtgcttcacaacggcagcggaggtagtgggtgtagctcgggggatccggagagcgtggcgtaccgcatgtcgatgctgcggcgcccctctaccgtccgcaagaaggggctcacctggaactgctgcagcctcatcggtcgccttgccgcaccggtgaggccgttcgacactagctttcttgaagtccccagtgcgtacaccttcctctccgtcaccttctcgtcgcccgcgacctcttcgagctcgtccaacataaatgtgacattgcagctgactggtgagctggcaaatgttggcctaaagcatctgaagcatgatgacctcgtttatgtatctggtcatctgggctcttatcataaagtcagtccaagtggtgaacggcacattgtctataagatttatgtcagagagctgaattatgttgttgatcaaaataagaagcctcagaatgatgcagactcaacaagtccaccatcaatgacatctgtcacccctcaaatgctaaaagagaatgagtgtataggcaggcttcgcttgtggcaggtcttctttgcgaacccatatgagtggtgggacaaccgacaatccaaaacatgggccaactatcctgatttcaagcacaaggacactcgtgagaaaatttggcttcgtccagatgaccctccttgggtacgaaagcagcttgaattatatgacctggaagtagcagagaatggccataggtgtaaaagtcgactgtcaaaaaaacaaaattggaaaacccaagattttgactactttgatgatgaagaagtacagtattcagcggaagcatgaataggacgcatggcattgtctgccaagaatgaagaaattcaccaggccatttgggtggtttgggggtgggggcggctgtttctttgctcagtgatcttactcaattctatagatgtatgcttggtatgatgtggatatgttttgagtctgctaactattgggatggcaaggttatgtgtagtttgtaattttatttatgcgtattttgagatgcaagtgtgagggaacctcgacatattagcgaggccctatcaattaacatgcctcgaagtttgctaaaaaaaaaaaaaaaaagtgatactgtcaactcacagaagccctgtatgtattcttagaattgctctcagttttttactatcatgaatctgttttgcagc

SEQ ID NO: 17931 - DNA, 459 bp, Zea mays
  misc_feature (454)..(454): n is a, c, g, or t
agaggacagtttagttggtgctggtgctggtggaggaagaagcagcgcagaggtggcagggatgggtcgcggcggcgggatggggaaccagtcaacgtgggcatcgcggtgcaggcggactgggagaaccgcgagttcatctccaacatctccctcaacgtccgacgcctcttcgacttcctcctcagattcgaagctacgacgaagagcaagctggcaagtttgaacgagaagctggacatcctagagcggaagctggaggtgcttgaagtccaagtgggcagcgcgacgaccaacccttccgtcttcaactaggaatcgcgggtttatatgtttaaataaataaatgtaggtatgaatgttgcttgtaccaacgaattctggtcgctatcaatcatgtaatgtaatgtaatggattttgttattattattgtggtatgtgtaaagaaaaaanaaaaa

SEQ ID NO: 17932 - DNA, 1949 bp, Zea mays
ggtaccctggcgggccagaggacagtttagttggtgctggtgctggtggaggaagaagcagcgcagcaggtggcagggatgggtcgcggcggcgggatggggaacccagtcaacgtgggcatcgcggtgcaggcggactgggagaaccgcgagttcatctccaacatctccctcaacgtccgacgcctcttcgacttcctcctcagattcgaagctacgacgaagagcaagctggcaagtttgaacgagaagctggacatcctagagcggaagctggaggtgcttgaagtccaagtgggcagcgcgacgaccaacccttccgtcttcaactaggaatcgcgggtttatatgtttaaataaataaatgtaggtatgaatgttgcttgtaccaacgaattctggtcgctatcaatcatgtaatgtaatgtaatggattttgttattattattgtggtatgtgtaaagatgtgcagaattgaaaagaaaaaaaaaaaaaaaaaaagaccgggcctggggcaagaaatgaaaaaaaggcaagtggtcctggtgctgtatcgccttgccaccacacaacaataactatctttcctccctttggtttggttggtttctttctctcctctctcctctcctctcctctccccgtggccacaccacagccgccggaagctcctcctcctcctcctccttctccatgagagagatctagcaaagcatagcctccttcctgctggcgggatctccttttgattcgtaacttgtaccgtctctctctgctactttatagtatttttttcgttttaaggatcttgcttattattaatttttaggatcttcaactcttcatgtatgcgaatttcatatgctgctagtcgaaagatgcaaaaaaaaaaaacaggggcattccgagaattgaactcgggacctctcgcaccctaagcgagaatcataccactagaccaaatgcccagctggtgctgtacgtatgcatgcagagtttcagaaacgaagaaaggggcaacaaattcagacgattcagaaaccacctccgcagccgcagggcctctctgaagtctgaacgatggacttgggacccttcaagagtccatgcatgggtttcatgtcacggaccactgcaccgctcctctgcgcgtcagcattgcattgcaagccattggggccgccggccgtgggcggagccatgcccgcagatcgagacggacgacgcgcgacaatgagggagccaagccatgcatgcgtccgtttgttctcaaaggtgctcccgctaactgcatgcatgcattttggctcttgttccgcagtcgacgacgatgagcaagcaaaagcaagcgaccccgcgcccctactgacaacaactgaactgaatgtcaccggccgggcggctaatgctgtgtgtgtgtgtctggttcaggttcagcaacccggtctatatatatacttccacgcgagctcatcgatcatggtccatgtccatctccttctttttgtcctcgacgtcgcctggtgcatgccgggcatgcaggcgccgtggctaccgctgccggcgctgtagccgacgtccgctatgtatggtccatgcagtgcagggacgttggctggtgttctccatgcatgcatggcagccagtcgctgtgcttgctgtgcggcggaagatactgcttccatagtgtttttgtgtatataaattgcagctgtaaaaacaggtgtcagcatggctgaggaaagatggtgcctctgccgaggagagataataaaaagatggtcctacataactgtggcgcccagcccagactgacgtagtgaattcaagacaagagcctgcaatgcaaaaggtcctgcgcggtaaagaacaggtaaggtgaggtgaggtgaggtgagcacgggttatttaatgatgctgcgtctgcgagcaacccagatcagcaccc

SEQ ID NO: 17933 - DNA, 448 bp, Zea mays
agtttagttggtgctggtgctggtggaggaagaagcagcgcagcaggtggcagggatgggtcgcggcggcgggatggggaacccagtcaacgtgggcatcgcggtgcaggcggactgggagaaccgcgagttcatctccaacatctccctcaacgtccgacgccccagcttcttccacccctggtgccggttcttcctccgggggtgcctggcgtaccgccggcctccgcttcaacgaatcgccgccccgtgaatcatccctgagaaaaaacttggagctgtactgtgttgtcttttacatttacacgcacgtacgtacgaactgccgtcagctgtaattttcttgttcgtcatcatcaatctgagctgtaattttctactctaccaaaaataaaactattcactatataaagcactaatttccatcgtcacaaaaaaaaaaaaaaaa

SEQ ID NO: 17934 - DNA, 2169 bp, Zea mays
ctgcagcgccgccgccgtggctattgattgcataattgcagttgctgcccatctccaggcccactgggtatctcaggcacttgggctttgtatcggctgagattgcgagaagggcccggcacaacctggcccactcacaccaaccatccagcctggccttccaagacagaagaggcaagcaacagccgaggcagaggacagtttagttggtgctggtgctggtggaggaagaagcagcgcagcaggtggcagggatgggtcgcggcggcgggatggggaacccagtcaacgtgggcatcgcggtgcaggcggactgggagaaccgcgagttcatctccaacatctccctcaacgtccgacgcctcttcgacttcctcctcagattcggtcagctcctcttccattccatttccccgcggcctgccctctctcgatctggatctccaacttttggatctggtccgccgccttcgtgcttcataccataccacgcggagcttaattgtccttgctacccgcatattaccttgccctgcccgagcttatgtttagtcattgtgggatggcagacaattgctcaaactacccatgagaccggatgctttaactagtcattgtgggataatcaatattccggcgacgtttgaattgatgtcagacaacacatcctaacagccatccatctacatagcctgcctacctactcgttcggcctgttgctacttaccagcctcatgctcgttgtcaattaggctcgggttttgcatggaatggctgtaacttgcggtcactaagtaccttttaaaaaatagttgatagttgaatcccacacagcaccaacatgggattcagacctcacaaccacttgttgatagttggatcttttgatggtatgtgaatccctttcgagttgctgtgggagaagcaattgttgtacatgaggatgcagcaagagctatgggaaggaaacgcttatgaacaatagatacctggtcgtcctaatttcatgaagctacgacgaagagcaagctggcaagtttgaacgagaagctggacatcctagagcggaagctggaggtgcttgaagtccaagtgggcagcgcgacgaccaacccttccgtcttcaactaggaatcgcgggtttatatgtttaaataaataaatgtagaagaggaggaggcacagcaccttgtcaaatgatgaactctcagaagctgcagctgcccgttcaggatctgatgagtctgagagggagatcattcatcatcagcaaggtgatgatgcaccagtgcactgcagctgcttcgtcgtcgtcttcacctgctcctgctgctagaggcctgcaggttgctgcccatcccagtcccagcaggaggcggcgtcctcgtggcctcgttgccgcggccggcagtgacgacgacgaatgcgcttcagatggtggtgagtccgagtcgtcgtcgtcgggcgggaaagacgacggcggcggattgtcccgagaggatctggaacgcctggtcgggagtgacgacgatgccaagttcaatgggttggatcttgcaaacctcatcaggaagaagtacggtagatcgtacgatgtgacgctgataaagaaagagttcatggggaggaatctgctggccatgaatgtgatgtggaagtacagggagcaaagatcgttcccgctgagcgaggaggagtacctgctgcggctggacgatgtcgccaacacgctcaagtgctggggagccgtggcgcacgtgcgcaacacgctggagaagctcaaggagaggccgcgcatcggcaaggccgtcagcatcttcatcgacatggaccagaccggaggccgctccaacgaatggatttacaagtagcttcccactccatcgatcatgtatatgcatccatcgcccatgaacaaacacattcatcaggtgtatggagaatgaatgtgggtaccaatttcatctccaacaatcaagcacatcgcaaagatcataccatcacatgatcttattgattcttagatcgcacctaagcatgtctcttgatattctcacatatgacaccatgcatgtatacaacgagctccttcatcaatactagttaagtattgcaaaaaaaaaaaaaaaaaaaaatatcgataccgcgaccctccgagggggggcccgg

SEQ ID NO: 17935 - DNA, 1200 bp, Zea mays
accagtctaactcatattatttcgttccggactatgttatagcctcctgtttttagtccatgctcgtgcttaaaaaaaagcccccatgcatgcataaatctgggggccccgcggccgggcgctgcagcactgccgcatgagaagatagcaccgcccgctgcaatgaaccgcgcttcttggttgctccttgttctggtgcagctctcttgcttgcactgctactcagccacccaccatggcggcggccggaagcacggacgcccactactacccgcgcccgccaacgtcgtcgtcggctccgttgtcgtcgtccactccggcagctccgaggctaccaccaccgccgtttcttcaggcaccctggtcggggtccgctgccacgacgggaacggccggacggtgttccggaaggacggcgtcgtgacggaccgcagcggcaggttccgcgtgcacctcgcgcacgggccaagcagctcaagcagcagcagcagccaccagctccggtccgtcacgtcctgctcggtggcggtgcacctcccgcaggcgtcgccgccgtgcgtcgccaccgccagctccgctcgcgggctccacctcgtcgcccaccacaacaagcacgaccacggcggcggcactcgcgtcttctccgccggcgccttctccgtccgcccggagctctgcagcaacaagggcctgttcttcccgccggtcccgctcgtgccggagccacccaacgtcggcggcgtgcccatcccgcccaacccggtcacgccagccccgccgtccctcgtgccgccgctcctgcctaccccgtctccgccgtccgtcctgccaccgcttgtcccacagccaccgccgtcgtcggtaataccgccgttgttgccgttggttaagccgccgccgccgccaccgccgccccagcttcttccacccctggtgccggttcttcctccgggggtgcctggcgtaccgccggcctccgcttcaacgaatcgccgccccgtgaacgtgaatcatccctgagaaaaaaacttggagctgtactgtgttgtcttttacatttacacgcacgtacgtacgaactgccgtcagctgtaattttcttgttcgtcaatctgagctgtaattttctactctaccaaaaatgaaactattcactatataaagcactaattaccaatcgtcgctcctcgagggaggggc

SEQ ID NO: 17936 - DNA, 1189 bp, Zea mays
ccggccgagacccacaactacaactatctttcctccccctggggtctcggccgtcgctttctctcctctcttctcttctctcctctccccgtggccacaccacagccgccggaagctcctcctcctcctccatgagagagatctagcaaagcatagcctccttcctgctggcgggatctccttttgattcgtaacttataacagaagaggaggaggcacagcaccttgtcaaatgatgaactctcagaagctgcagctgcccgttcaggatctgatgagtctgagagggagatcattcatcatcagcaaggtgatgatgcaccagtgcactgcagctgcttcgtcgtcgtcttcacctgctcctgctgctagaggcctgcaggttgctgcccatcccagtcccagcaggaggcggcgtcctcgtggcctcgttgccgcggccggcagtgacgacgacgaatgcgcttcagatggtggtgagtccgagtcgtcgtcgtcgggcgggaaagacgacggcggcggattgtcccgagaggatctggaacgcctggtcgggagtgacgacgatgccaagttcaatgggttggatcttgcaaacctcatcaggaagaagtacggtagatcgtacgatgtgacgctgataaagaaagagttcatggggaggaatctgctggccatgaatgtgatgtggaagtacagggagcaaagatcgttcccgctgagcgaggaggagtacctgctgcggctggacgatgtcgccaacacgctcaagtgctggggagccgtggcgcacgtgcgcaacacgctggagaagctcaaggagaggccgcgcatcggcaaggccgtcagcatcttcatcgacatggaccagaccggaggccgctccaacgaatggatttacaagtagcttcccactccatcgatcatgtatatgcatccatcgcccatgaacaaacacattcatcaggtgtatggagaatgaatgtgggtaccaatttcatctccaacaatcaagcacatcgcaaagatcataccatcacatgatcttattgattcttagatcgcacctaagcatgtctcttgatattctcacatatgacaccatgcatgtatacaacgagctccttcatcaatactagttaagtattgcagtgggggaaaaaaaaaaaaaggcggccccgactaggag

SEQ ID NO: 17937 - DNA, 2658 bp, Zea mays
  misc_feature (1435)..(1435): n is a, c, g, or t
  misc_feature (2242)..(2242): n is a, c, g, or t
gacagcttgttctcgcgaaaataaaattagggtacaccaccttttaggctttgcaatgtgtttctaatgaacctgtgttcatgaatatttccacctctcatcgagtcattggacatcattttacagcaaaaatatcctcagaagattgtattataactattattttgttcgccaagaaaatctctggcgccaaaatgccctgaagactttgcctgtcctgctgaactcgtcagatatgttagcatgtggagaggaccttggccttatccctgcttgtgttcaccctgtatgaccccttttctggacactcgaagttgttaactaacccactgttaatgataacgatgaaaacttctatgcaggttatgcaagaactggggttgattggattgcgtatccaaagaatgcctagtgaaccaaacttggaatttggtattccttctcagtatagctatatgacggtgcgttcccatccattacagtgttgcattaagataatttgggaatataatgaaaagagcgttctgattgaaaatggcacggagattcagagaggctgtgttgattgatgacagtcattgttttttgatgtttcaggtttgtgctccctcatgtcatgactgctctacattacgtgcttggtgggaagaagatgaaggaagaagaagtcgtttctacaagactgtagttggcagtgatgaggagcccccatctcgttgcaccccggaagtagtgcacttcattgttcagcagcattttgacgctccatcaatgtgggcaatctttccacttcaggtgcgaaacttgaacttgcatcatagatcaaggatttcttgtctgaaataagctgatgggtctacttcggacttggcatttttcaggacctccttgcactgaaagacaagtacaccacaagaccagcgccagaggaaacaatcaatgaccccactaacccaaagcactattggagattccgtaagtcaatttccatcattgtccacctctttatgaaataagacgttttcaataataaaactattttaatgttactcttcaaatgtcgccttctttttaggaaaagcctccctcccattagccatgttttaattggtgtatggtttggtagtcatggctataggtgagtggcatgatgtagccgctgcctgaaacttaaacacttcagcctgtgtgtttgctactgtctacttatccatttgatctaggctcgtcaagagaggtggcacagtagctgaattcaatatctggagcatgatgcgacgctagcctgtcaaatttgaatgattgagtaaacaacaccaaacttttaggataccatcgttttcatatgggccactggcatacctttctaagctaaaagtgaatctcaatctccacatgcgattcacactcctgtcgtgagcttaatccggacaanccgattcttttccttggatctaactcctccccaacatttttcaggtgtccacgtgacattggagtccctgctgaacgacaaggacatccaggcaaccatcaaggacctggtcacaagcagtgggaggtccttccccggaaagaaggcggaaggtgccgacgagagcggggagaagctgtccaaggtgcagctgaatggtaaagcttaggaaaggattgcgagagctgctggaagtgaccacggttacaagtaaataaatagaataaggcgacagattgcatcaccgtgttgatccaggtgatgctgtttctggtaggaaattcttacccatgtgatgttctttcaactctggaaataagaagcaccctctaccaagtcagaaagtgaaataatccatccagtgtcggttttcattaatagaattttcgttgaccgcccagttatttcttgagagtaattttgcatgagcctgattcaagccattgaaataggcctccttctgttgtttgtgatgtcctaaactcataagcaaccgaaatccgtgaataaatgctgctagtagtggggaggggggggcagttccatttattattttggtattgagcagaagaaaaggtcacggctatgtgtggttctccagctgccttacctcgcagcctctactcgtggagcttgtttatttatgcccgatgccaattcacaagaacattaggttttgcttgctactgatgcgatggcccaaggtgtcggttacaccaaatgccaattcataaacacatcagcagcagcaacccctttagtcgatgntgtggtcctgtgggtgcgaagatttcttcctcgatttttctaactggctgggcgctgtcgtctgaaaggacggcttgggcacccttctttcttgcgtctctgcaattggcatgcaccttcgtactagcagccgcattgaaaagggcaagcaactgaaccaatgggcttttgaccagcagctccctggcgtttcaggtcactcttcttctagaatccagagtcaaaagagcttgttttccccgggcaagaagcctaaaaatattctctttcctttttttttcttctggcaacgaggatgaagtctaaagtttctgttcctagttcgaccacaagtctaaagagagatatttgattgggtgttcatgggggtagaatggacgtccgcattcgcaatcagtaccgtctgtatcttgaaa

SEQ ID NO: 17938 - DNA, 1266 bp, Zea mays
  misc_feature (1258)..(1258): n is a, c, g, or t
aagtgctgaaaagtcactgtgggtagagaaagaggacagtatccgccgtggccttttcgatttactacagaatattgtccttatcagagatccagaggactccacaaaattctatccccgtttcaacctggaagacacatcaagttttagggaccttgatgaacacagcaaaaatatcctcagaagattgtattatgactattattttgttcgccaagaaaatctctggcgccaaaatgccctgaagactttgcctgtcctgctgaactcgtcagatatgttagcatgtggagaggaccttggccttatccctgcttgtgttcaccctgttatgcaagaactggggttgattggattgcgtatccaaagaatgcctagtgaaccaaacttggaatttggtattccttctcagtatagctatatgacggtttgtgctccctcatgtcatgactgctctacattacgtgcttggtgggaagaagatgaaggaagaagaagtcgtttctacaagactgtagttggcagtgatgaggaggccccatctcgttgcaccccggaagtagtgcacttcattgttcagcagcattttgacgctccatcaatgtgggcaatctttccacttcaggacctccttgcactgaaagacaagtacaccacaagaccagcgccagaggaaacaatcaatgaccccactaacccaaagcactattggagattccgtgtccacgtgacattggagtccctgctgaacgacaaggacatccaggcaaccatcaaggacctggtcacaagcagcgggaggtccttccccggaaagaaggcggaaggtgccgacgagagcggggagaagctgtccaaggtgcagctgaatggtaaagcttaggaaaggattgcgagagctgctggaagtgaccacggttacaagtaaataaatagaataaggcgacagattgcatcaccgtgttgatccaggtgatgctgtttctgctaggaaattcttacccatgtgatgttctttcaactctggaaataagaagcaccctctaccaagtcagaaagtgaaataatccatccagtgtcggttttcattaatagaattttcgttgaccgcccagttaaaaaaaaaaaaaaaatttgcatgagcctgattcaagccattgaaatggcctcctgttgtttgtgatgtcctaaactcataagcaaccgaaatcggtgaataaacgctgctagttattttagttatttaatttatctgttnctgagaat

SEQ ID NO: 17939 - DNA, 2577 bp, Zea mays
ctgcggctgaggccccgctccccatgacgccgcgctttggtcgggccacgaggcaaccatggtgcgagggagccggggcggcaggcatgggcgtgcttcagagcacgcagagccttgaggcggaggtagacgagctgcgcgccgcgctcctggcgggcgggtggcgccgctcggcgggccacgcggacgccaagcgctctctggggcgacgctggaggggccacgacgcgcgtcactggcggcatctccttcatcgggttcgccgtcatcgactgcctcctccggcacgggtacaccgtctgcctcgcgccggagacgcaaggtaccagccgtcccgtccgtcctcccccaccccgaccccccccgcgccggggcaagcaccctctagaagcctccgggtcgctcggtgtgggttgctaactactcgcagcagccagaggccagatccagccgccaaccccccaaacaaaaccctaggccaccattctgaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgcctttgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagcttgctgatcccatggagaatgctggtgcttccttgattcgtgaagttgctagcaagacgaatgactcggctggtgatggaaccacaactgcctctgttctcgctagggagatcatcaaattgggcatgttgagcattacttcaggggcaaatccagtgtccgttaagaagggcattgataagactgttcagaaattggtggaggaacttgagaagaaatcaaggccggtcaagggtagtggggatattaaagctgttgctgccatatcagctggaaatgatgaatttgttgggactatgatcgccgaagctattgacaaggttggccctgatggtgtcctctcaattgagtcgtcatcgtcgtttgagaccacagttgaagttgaagaagggatggagcttgacagaggatatatctcccctcagtttgtcactaaccttgaaaaatctattgttgagttcgaaaatgctcggattcttgtcactgatcagaagatatcatcgataaaagaaattattcctctgttggagcagacaacacagttaagagcaccacttcttataattgcagaggatgtaagtggcgaggcgctggcaacattagtcataaacaagcttagaggaattttaaatgtggctgcaatcaaagctcctggttttggtgagaggcgtaaagctcttcttcaggacattgccattgttacaggtgctgaatatcaatccaaagatcttggtctactagttgaggatacaacagtggagcagcttggcatagctcggaaagttacaatctcaagttcctcgacgaccattatagcagatgctgctagcaaagacgatatccaggccagaatcgcgcagctgaagagagagctttctcagacggactcgacgtatgactctgagaagttggcagagagaattgcaaagctttctggtggagttgctgtggttaaggttggagcatcgaccgaggcagagctagaggaccgcaagctccgcatagaggacgcgaagaatgcgacttttgcagcaatagaggaaggtattgttccaggaggcggtgcagcatatgttcatctatcgacattcgtaccggctatcaaggagacgttggatgatcctgaggagcgcctaggtgctgatatcattcagaaggctttggtggcacctgcagcgctgatagcccataatgctggggtggaaggtgaggtgattgtggataaaatccgggaaagcgagtgggagttcggttacaacgccatggcggacaagcacgagaacctggtggaggctggtgtgatcgaccctgccaaagtgactaggtgcgccctgcagaacgctgcctccgtggctggaatggtgctgactacccaagcaatcgttgtggagaagcccaagaaggctccagcagcagctgctgcagcggcaccatagggttctttcaccatgtaataatactttctagtgaaaaacaattttactaggcatggaacaggcacgttagagtgacgaggagaaaaaactatttttgtcatgcgtgggccggaataaattgagtcaggaattgcatggattttgggccaggacgatttgcaaattggttggattagagtgtggatggctgattggacattgtatcctatctgcattctgttcactcagttggctaattcacatttctctccaaaaaaaaaaaaaaaaaaaaaaaaaagtactctgcgttgttaccactgcta

SEQ ID NO: 17940 - DNA, 3645 bp, Zea mays
gcccccacgaaaattaataaaatcagtggtttagaccaaattttcaccatatatgcaccacctatatgttagcactatgcaccctcaagatatttgcacactcctctgattcactctagctccgccactaacgtaagcgtatggcacaggatgctagtgcggagtgtggcgtgaagaattctaagatgaaggatggatcccttgctgtggtgatggagatggaagatgatctttcgttgatggtgggttactggggtcgcatgttcagccacccaatgagactcatggcggtaaactgcatagggttagggaatgacccaatagttttatgagtgatgtgtacatataccaaattaaggtatcctaatatggccccaaaagcccattctaagagaagagcacaacctaatgtggtcctaactaggacaaccctcgactaaaactgctttgacctagtcacatctaccaggtcgactttgaccagatttgtcccgacctgatcattccaacctcggtcgtcccaagtgacctcggcctagtcatcccaaccaagcagatctaaccgatgtcgccctaagctagatcagtctagatcgtataaccttgataaaactctatgtcgtcgcggtctagaggtaccatgaatctctacgcatggctgacacatttatggccctctgaccacttgatgcacactcgtagttagacgtacaaggtaggtacaataagaaggactttagagatgtccaaccacctgccccttccaaggacaacaaggacccacgagccatgatccatagacgtaaggcggtcaaatgttctagacaagacatgtgaaggaggagagaactcagaggctaacacttcctaaggactagtttgggagctaaaatattagaggggattaaagggactaaaatccccttcttagagcatcttcaagagctcaccagaaaatgactcctcaaaatcaattttagaacaccgacacgagagctcgctacaaattggaccaatataatcaaacaaagaaacacaagtgttcgaaagacattttcgaataaaaaaaatgaaaattaaaaatagctatttgcactattaattgcgcggagatacctatattttaatagtttgcacacctgtcggcagacagctagctgttaaaattctggcatattgttatctatcatatgatgatgatttgcattgcatgcaggaacaatgtcaactacaactcaagctagctagcagatgattttatttcaatatataatcaaagcgcaactccctagctagtgataaactagtacacatcatatctacatgtttgataaagatgagaaacgaatcacttccgatagcaaggccgatatgctcatatgaataaattctgtaacccctttcggccagacaccgatgcccagcccagcgctgccgaatcatcagagcctctggagtcggcgatcagacgacgacgcacgcgtgccacgcgccgatcgagcttaattaacatacaatatcgcaggtcagccgtttgagctgtatgcgttctgattgagctcgatcgcaacgtgcagcgccgcgaagaacgggatcggacatccatccgaccctcccggcagctgcaggcagtggcaaccccatgcacgcacgttctggtccatgacaggaggagctagcgctggctgctatataaatcaatctatagcaacattccaagagcataggagagcttgcaagagcacacgatccatctgcaaccagcagagcgagtacgttgcacgagcgaaaaaaatggccaaggttgccgccctgacgatcaccttgctcgggctcctggtgtccgtgacatgccagggcagcacttaccctgctcagcagcagcaggaggcttcgtcgtcgtcgtctagccctggctgcattctgcgagggtggatcccgttcttgcctccttgccgcgacgaccaagccccaatgccaaaccctctccctcctccctcaggggcagggctcaccgtgggctactacaagaactgccctggcgctgaaggtatcgtgaggaaggccgtggagaaggccatggacaacggaaaccgcggtattggcgcaggactcgttcgtatcttcttccacgactgctttgttcgggtacgtacgtcatctcatctcatcttattatatgggaatgggatacacatgctgcaactattgcatgcttccatttccaggggtgcgatgcttccgttctcctgaggaacaccagcggctccagcaaccagacggagatgttcggcctgcccaacataaacagcctccacgggttccaggtcatcggcgacgccaaggccgagctcgagaaggcatgcccccgcacggtgtcgtgcgcggacatcgtcgccttcgccgcacgcgacgccacgcgcaacctcagctacggcgccatcgacttccagatgccggcgggacgcctggacggccgcgtgtccctcaaggaggaggccgagaagaacctcccggggccgttcgacagcctcgacgacctccagaagagcttcgcggcccagggcctcggcttcaacgacatggtcacgctctccggcgcgcacagcatcggcgtggcccgctgcaggttcttcaccaaccgcctgccgcctaacccctcggacatggaccgcgacctcgccaggagcctaaaggcgacctgcgaccaaaacggactcgactccaaggttgtgcaggaccccgtgacgccagttgccctggacaaccagtactataagaacgtgcacaacggcaaggtgctcttcacgtcggacgccgcgctcaactccacggacgacgcaaggaaggtggtggatggcttcgccaacaacgcggtagactggtaccgcgcgttcgccgatgccatggtgaagatgggcaacatcagggataggaccatcaacagacccaagcccgagatcagggagaagtgcttcatttacaatacctactgatcgacacgatatcaacattaagacgtaccacgagatcctggaggagtgtgtttgttttgatattttcctcttgcattcattatcatgcgattgatttccttttatttgcatccaaatgtcatgctgacatttttgttgtaaaaggactttgaattcaagcaatccatttcatttgttcacacaagacttgttctatgttaggttttagactaactctgacccaaaagtaagagaagctacagctcttgaatgtgtgtgaggagagctcgtagaagtggagacaaagcccatgtgtgcccacatggaggtcgttgtctttctagacccggagctccttgagtcagacatctcttgtcatgctaattattggattgcgagtagtctacttcattagtgaggtcttccatgataccaaaactaggtattgaaagatgcaaatattgctctatgtgatccttgtcgcattccaaaagctccaacaattttcaggcgcatacaatctcaatggttactttccatatcgcaaaggatttagtcattctagctaggttctacacttgtacactagccaataactttgctaggaagataaagcacacaatcaaggtaaaacacatataatgtggaagctaaaagtacgatagaaata

SEQ ID NO: 17941 - DNA, 1034 bp, Zea mays
ttttcctaacactaccactttgagtcttgaagaaggtcaacaacttcgagaataatggcttctctttgtgcttcttctgccatcgccgctatttcttctccaggtttcttgggagggaagaaactgaggctgaacaagaagttgaatgttccaactgtttctaggtccggtacgtcggtgcgcgctgtcgcagcggatccagatagaccaatttggttccctggaagcacacctccagagtggcttgacggtagcctccctggtgacttcgggtttgatcctcttggtctttcatctgacccggatagtctaaagtggaacgcacaagcagagctagtccactgccggtgggcaatgctcggcgccgccgggatttttatcccggagtttctaaccaagataggaatcctcaacacgccgtcgtggtacacggcgggagagcaagagtatttcaccgacaaaaccacactcttcgtcgttgagctcatcttaataggatgggccgagggacgtagatgggctgatatcattaagccaggtagtgtcaacactgacccaatcttcccaaacaacaaactgacggggacagacgttggatacccgggtgggttatggtttgacccgttgggttggggatccggtagcccggctaaaatcaaggagctgaggactaaggagataaaaaatggaaggttggctatgttggcagtgatgggtgcatggttccaacacatatacactgggaatggtcctattgataacctttttgcacatcttgctgatcctggccacgccactatcttcgctgctttcacacccaagtgagacgtcaaaaacgtcgaaaaaggatgggcttgtgtgatcatgtttgtacaaatattgtttttgaacttaaaactattatgtacttatataaactgtggtcgaatgcaaattagagtaacactgctcttttcttgactaaatgcgcatatctttctttttaaaaaaaaaaaaaaaaaaaaaaaaaaaaaaaaaaaaaaaaaaaaaaaaaa

SEQ ID NO: 17942 - DNA, 1775 bp, Zea mays
  misc_feature (1591)..(1591): n is a, c, g, or t
  misc_feature (1638)..(1638): n is a, c, g, or t
  misc_feature (1723)..(1723): n is a, c, g, or t
gagcactcgcgtcgcggggcacctgcgatccgaagcgagtccgagtcgcccctccacgccccttgggctcctcgaccgcttgcggcttgcctttttcgggccgcctccgctcctctctctctctctggctctctccctctccaatggcccgccccaggaagccgccgccgccctcgccgcctaaggcggcggcgccgtccatcgctgacgcgctgctgctggccacggtctgcatggtgggtctgcccgtggaggtgcgggtccgcgacggatccgcctacgccggcgtcctccacactgcctgcgtcgacgccggatacggtgtcgtgctaaagaaagcaaagaagattgcaaacgggaagggagatgtgaatctctcgctgggatcgtttgtggacactcttgttgtttgcccagatgaccttgttcaagttattgcaaagggtctttcactcccccttaaaggtgtctgtaaacctcttgattccaacgtggttgctgccagtggatccttgaagcctcaaatttcacatgcaaatgacccaaaaatgtctaataaaactgaaaatatgtctccacttatgcaagctgagaaatgcacctctgtgggtcaggagaaaaatacttctgttaagagaaatggtcaagataatggtattactacaagtttaagttcttcaaccggacatgtgggggcatgtttatccaataattgggattctaggtctggaagtatggtgcctaaagttgatgttatcacaagttcagcttcagctgtgcccgtggtggcttcaggtgttaaaccctctcagccagtcaataattcagttgccaagattgtcatgtcaagcaaaactgctgctaaggaattcaaactcaatccttccgcaaaggtcttttctccatcttttgcaagttctaggcaagtacttgcagctgcggcccctgttgacacatactacatttcacactctgcccctgaagtaccaatgggtgtgcctgtatatgaaccaaaatctgtgtcaggtgtttcacctctatccaacaaggtttattgtagtaatctatctcctgcaaactatgccatttcacctcagtatgtgccgtctgtaagtgcttcgatctattcttatgtgcttttgattgcttcatttgtttcgccttcattggataatactattttatcctcttgatatttaaaaaggctattggatgacaacttgcaacatgcctttggttcaagctgataacttgctgcatatggcttaggcttactccgttatcatttgctctatatttgaggccatgcacgtactcagttactcctatgtgctttgcctttgcagttgagctattcaagccattcttacctgttagctgcctaatttacttgtctgttggattaaatgaataaattgaacttgtaaactgattcttcatgtcaacttacagcttatcagctttaattcaatctctgatgcaagaaaaaaaatctttttactccgaactgaaaaacctagctcacatgtaaatgtattttttatgtttgaaagcttcttttaacaacttgccttttatgttctattactgnactttgtgcaagcatattttaatacacttaaatttggtcttgcttgntgcctctatcatggatgtctaacattaccatgcttctggattctggtactacttaaccttttgggtcatagatcatgggccatantgcatcaaggctagacccatccagaattggcacaccataccatcctatgcag

SEQ ID NO: 17943 - DNA, 1007 bp, Zea mays
cattgggtacctcgaggccggccggggggctccgcccctccaggccggccgggtctctctctctctcatggcccgccccaggaaggcgaaaccgccgccgccgccgcctagggcggcggcgccgtccatcgccgaggcgctgctgatggccacgatctgcatggtgggtctgcccgtggaggtgcgggtccgcgacggatccacctactccggcgtcctccacaccgcctgcgtcgatgccggttacggtgtcgtgctaaagaaagcaaagaagattgcaaacggaaagggagatgcgaatctgtcgctgggatcgtttgtggacactcttgttgttcatccagatgaccttgttcaagtgattgctaagggcctttcactccccgttaaaggtgtttgtaaacctcttgactccaacgtggtggcttccaatgggtccttgaagcgtcaaaattcacatgcaaatgaccccaaaatgtctaaacctgaaaatatatctccacttatgcaaactgagaaatgcacctctgtgggccaggggaaaaatacttctgttaagaaaaatggtcaaaatagtggtagcgctacaagtttaagttcttctaccggacttatggggccatgtttctccatgaatggggtttctggatcagcaactatggtgcctaaagttgatgctgctacaagttcagctatagctgcgcccttggtagcttcagatgttaaaccctctcagccggtcagtaattcagctaccaagatgattatgtcaagcaaatccactgctaaggaatttaaactcaatccttgtgcaagggttttctctccatcttttgcaagttctaggcaagtacttgcagctatggcccctgttgacacatactacatttcacactctgcccctgaagtaccaatgggcgtacctgtatatgagtcaaagtctgtgcctggcgtttcacctctaaccaacaaggttcattgtagtaacctgtctcctagcaactatg

SEQ ID NO: 17944 - DNA, 801 bp, Zea mays
ttaggggcgaatgggtaccgggccccccccccggaaggggcgtcgcgttccgttaagcttttttttttttttttttggtttaaaaacgatcaccgatcgaaatggatggattgagattataaagtatcaccatgttgtagagtaatggactacgtgagacttgataatgtagagcaagctttgctctctcctaaccaatttttatttttttttaagaaaacaaacagatggtggaacaataaccggagctgagaataaatatcgtcagccacacccgaagaagctgacaaaaaaaagtcactctttgtttagtactttaggtactttcaaatacacctcatcaaagcttggaatcgaagctcttatactttccctgttctcaaatgtttcaggagcatcctctcgcaaattcccaccttccatctctgctctaatcgctggctccacactgctaacatcaacttgctgaagctgaccaaaccagtcgatgacttgacgaatcttagctccacattcctcaatctcggaaggagtgagagagattcgagctgtctcagctagacgggatacgtcaggcggctgaagaacggaggggttcgtgtccgacgagaagcatcgacctattgttgtaatatgtctttggaacttgagacttgaagaaaaggttgaggctttgatttggatcatgcgtggtggtgaagcagttacgacggcaagcaaagctctggtcgccatggctttaattgaaaactctccgaagactagctactgaacatttttccgtttaggtgggctagggaa

SEQ ID NO: 17945 - DNA, 1019 bp, Zea mays
  misc_feature (998)..(998): n is a, c, g, or t
aacaaaaaaccaacagtccaccattacccgcccccccccaccctccataagccccccgccgcccccgagaagaagccacccgccgccgcccaccacccggaaggtcgctcggtggcgaagtttcacacggacgttcctccccgcaaactcccttcccgtccatgttttctgcagcactctttgcatcctcgcccctggcgaagctcacaaacccaaaccctctagaccttccagtctctctgtcagtgataacacgagcttcaacgacctcaccaaagctttgaaacgcctccttcagcgaatgatcatcagtagcccaggcgagaccgccgacgaaaagcttggagccatcagcaggctggccggcgcacatgaagcgggcagcgttgaacagggcaggagccgagccggtcgaggcactgctcgccacagcactctgcctaagaaggcttccgagcttgatgagggccgccatggaggaagactaaaacctctggagggcgagctgggacgagacggcgggggaggggggaattttttttttttttttttttaaataggatgaaatccatgagtgacaataattacacaaaaatgaaacacattttttttgttgcatccatcaacattaaagacaatcccaaaatgaaataaatctcaaaagaacacacaagtgcaaactgtacagcatccatccacagccaccccatatgcagaccattcagttttgatgaagacaaatggataaatccggcaggtgacacggaactagtctttcttcttgtcagctggggagcagaacctctcaaagatcatggcgaagaagccaaggaagtcgattctgttcttggggttgtctttctccacctcccgttttacttgctcaggctcgtctccttcagcagcagcctggactggaacttgagtttcatccccggttgtttcctgctgctgcacagctgccacaccaacaaggatttcttcccacggcctggtcntaggatgttgagtctgatctc

SEQ ID NO: 17946 - DNA, 1378 bp, Zea mays
  misc_feature (1374)..(1374): n is a, c, g, or t
ttttttttttttttttggctggattgtgtgcatcttatttgccttcgggctatcaatgaaaaatcggaaaaataaagggtacaaagcctcctaatggaaactaatgttttcatgcatttatcagaaaactctttgaacaatataagagcgtgaatgaatacaattgcaattatctctcagattgtatagaagtgaacatcgtttggagagccgagtattttggatctttatcttcaccatcatctttcttttcagccacatcagacacaacaacctccatccctttctttactctctctagctccttgtctttctcttccaatttatcttgcagtattatcaccgtttcgtttgatctttcaacatcgttagttagttcttccatgtgtttgtacagtccttcaaattgctttctaagttctgcgttctgagacttctgcatcgacagcttcattgctagttcatgaatctttccttcagcagcttggtgtccaatctcctcgttttcctcttgcagggttttgcacttttccataagcatcttaccctttaaactcagaggggtaaaagtaaatgctgtaagactatcctgtagttccttgaccttcttgtctttttcctcaactagattcttcaaacgtgaaaattcttcatgaatagctggatccagtaacagcctcctcgcttgcattgacgccggcttgagctgagatttcaaatcacgaacagcagacttcaactctgccatttcctgttcccgttttgcatattgtacaatgtacgaagcttcttttctctttgcaatttccaactgttctttcaaagatctctcagaagattttagattttggatgtagtcaatcaaaaatctaggctcaggagattttccagcaggtatgaaagactcgttctgaaacgctgatttccatttgagaatctctgcttttgctgattcaagctcattctgagatgaagcaagatcatctttacagttctgaagactctcacggagtgacaggatcatgccagttgcaacaccaggggcagcttcctcagctttcgtacgaacctttttggatccgaagatgtcatcctcatcgtcttcaagatcaccgaaacttcttttgctgcctgaagcagctctggtggcgttagaagcggagaaatcgccgccaaagtcgtcgtcttgtaaggaaaactccattagcgccaaataagatctgagatttgtgtcaatgacgaatcggcagttgagaatcttagggcttagttagttcccagcggtctcgctctcgataccagtttttttttctttttttctttttatattattaaaggccaaagcatacacttttccgattaggatgttctaangtat

SEQ ID NO: 17947 - DNA, 623 bp, Zea mays
gcctcatagtatcgaatatagccataccagctggtaactgatccaccaggagagttcacatacataacaatatccttagtaggatcaacagcatcgaggtaaagaagctgagctacgattatgttggccatatcatcatccacagcaccaccacaacgaataatcctatattggaagagctggcttatgatactctggaaacgctcttgcaccataggaggtggtccttgtccttgagcgtacacaggaaaatacggcgaagaagggacttgtaaatcatctctgatggaccaaactccttgaggcgaaggagtctccggagtccagacattgccggagtatacagccttcggagccgtctttctgccgctaaccaacttcttcgtctttcttgaacgaagaggctcgaaagggagggaaagcttctgagaatcgaaagaggaggcgttgggactcgcggagacgaatccggctgtgaacctgagagaggaagctgatgtggagacgcaagcgtgagccatcttgttgttcgatgaaaccctgatttcgtcgccggcgaggcttatccgaaatttggggattttttttttttttttttcttgcgaagagtgtgactaatcttt

SEQ ID NO: 17948 - DNA, 735 bp, Zea mays
acgttgtaaaacggccggcccagtaaccccgggtaataccattcccttatagggggaattggggtaccgggcccccccctcgaggtgggcggtatcgataagcttttttttttttttttttaattaaaaatcttgaaattcatattacgtttgtttgagaacacaatacaaacaaccagttaatagggtcggcataatataaaaagaaaagacaggaaaatagaaaacatccattcgaacatcttattaaatatatattctcatccatttcatagcatgggaattatccactcaagcttcatccgaacgctgcttatttcacgccgttgcagttgatgctagtgctaatggggaaaggaacattgactccacatgccttaggaagtccagctgcccggccagcgttgagaccagagcctaaggcgctcgcagcagttttaaggcaacgacaagcttgctgacggtcgggagttgtacgggcaatactgttaagcttactaacaccggtgcagcacgctctgggaaggggtccaccttgggtcaagtagccaatgcatgccgccacgttggtgttaacggtgccacagctcaaagccgcctttgatgtgatgggacctgccacaatcatgcaggccaagaccaagcatgccaatttcactagaccggccatttgttttttctcttagcgtttttgcggatttgcaaaagtagatgtgtgtaattgtgatactgagt

SEQ ID NO: 17949 - DNA, 642 bp, Zea mays
tttttttttttataactttcaaatctgattttcatataacgtggttcgataacatagtacaaacgaccagttcataggaatatatgatattgatcgccatattaaaaaagaaaagaaattagaaaacatttttaaaacatccattcgaacatttcttatttaatattctgatccatattataatattcggaacgtcccctaaagcttcatcacactgtcgctcatttcacgttgttgcagttggtgttggtgctgattgggaaaggaacactgactccacatgccttgggaattccagctgcacggccagcgttgagattagggcctaaggcgctagcagcagttttaaggcaacgacaagcttgctgacggtccggggttgtacgggccatgctgttaagcttactaacaccggtgcagcacgctctgggaaggggtccaccttgggttatgtagccaatgcacggtgccacgttgctgttaacggtgccacaggtcagagctgcgttcgctgtgatgggacctgccacaatcatgcaggccaagaccaagcatgccaacttcatcaccccggccatttttctattagtgtttctgttggtttgcaaaagaaaatgtgtttaagtaagatatttgggtggt

SEQ ID NO: 17950 - DNA, 1069 bp, Zea mays
ttttttttttttttttaatcatattcttcgcattaatcaacattattttggattaataaaaggatttaacagagtaaataattaggaggcggacttaaactgaaaataacgtttaggggagtagaggcggaagaggctgaaggcggagatgaaggagaggatgatcatgagcaccgctgcgatgtagtttaagatgatggcacttccgatctgaaagcagaaccttgtgaacttggagcaccacttcatccactgaagctccctggaaccagtcaccaccagcaatgagtgttgtgccgccgcagatgccccggcgaacaccacgtacaccgccgtctgatccaagaggtaagagagccatttagaattggaggttttttgtgcaacaccgtaccaaccaaaccctaattgaacgatattatatgcagcagccacaacatttatgtacaactcaatctctagagcaaacaagtatctgaaagtgactctcttgtggatataagcaatatctttggtctgagaatccaaaccaatcagaacagaactgagtataagaagagcgacgatacagagtctcaggatcacttctgattctctcaatctcaccatctcttttctctccttctaagaggaatgtccagttctcttataatctgccctctgttttggttattccccgttttgtagatgaatctacttgtgggaataaagacttttcgattaggatgttctaggaaagggtccgggggaaatttccggaaccccgggggaacccccttaatttttaagaggggccgccacccccgggggggggaggacttcccaccctttttttgtgccccccccttttaggggggggggttaatttttgccgcccccttgtggggaaaaacatggcggggaaaaataacgggggtgttttcccctgggggggggaaaaataatttttttatcctctcgcgccgcccttcctttttcccccaaccaaccaaaaacataatgagtcctcatacccccggctaaaaaaacaacaaactttatgatgggaaggagacccgtagcgggcggg

SEQ ID NO: 17951 - DNA, 848 bp, Zea mays
  misc_feature (797)..(797): n is a, c, g, or t
  misc_feature (829)..(829): n is a, c, g, or t
aattccaaaaaaaaagccatggatcatctcctctttttctcattcaaatcagtcatgaattcaaaatccgctttccttctgatcgtggtggcagttagcaccacggccatggtgcacggccaccctgccgctagcactccagcggcacggttctgggagcaggccctctccggcacgccgatgccggaggtgctagctgattttgttcagaaaggaatggatctgtcaccgctcgtggagcactactctgcacagcctaatatcggcatgtgcacactcttcaacactatctgcaacgcgcgcacggtggcggagaccggcatcttcttccacgaggcggagctacatccgggcagcaccatgaccctgtctttcccagcggaggcggagacagccatcctcccgcacgacatcgccggcaaggtccccttcgagaacctaagcgacgtcctctccacgttccacatctcaccaggctccgctgaggcggcgcaagtggaggacaccctgcgcaagtgtcagcagccgccaatcgccggtgagataaaagcctgcaccatgtcgctagagagcactgtaaaggccgccatggagatgctcggcaccaccatccagcagggtggtggtggtggtgaaccgtgtggggcggccacgtcgacgctcccccgcggtggcctgctaccacaccgggagtacattgtccaggaggtcaccaagctagagggcactggctacgtggcctgccacaaggtgccgttcccatacgccgtcttccattgtcacatcgcacatacggnggtatatagggtacaaggtcaccctccacggncgcggcgacacgaggggcc

SEQ ID NO: 17952 - DNA, 986 bp, Zea mays
atcccccgcccgccgcgatcggaccctctctcgccgtccgccgctactcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgctgtcttcagtatttttgctcttatctatggttgtcagtcgactctccaatgttggtgtcagtaactgtcagatgttgagtgtcttgaaaactttctgataattgtgggatttgctttgtaatggtaatcgtgaaattggtgtggttgtgttttggttgaatcaagagattctgccctgttattcaaaaaaaaaaaaaaaagaacaagcttatccaggggctcctttgggcctgccagcggcggccccggagttaaaacaaccgccatagctagttgtgagcgcctggagggggccgtaccgccccccttgggaaacccccaccgggcagcccccaat

SEQ ID NO: 17953 - DNA, 892 bp, Zea mays
cgggatattctcatgagatcaaaaaagaaatgtgagaatggcgggccgggctctcgccgtccgccgctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgcggtcgtcagtatttttgctctgctctatggttgtcagtcgactctccaatgttgtgtcggtaactatcagatgttgagtgtcttgaaaactttctgataattgtgggatttgctttgtaatggtaatcgtgaaattggtgtggttatgttttggtcaatgcctcggcttttactcgccgcgatcacgcgattttgccctggtattctgagaaaaaaaaga

SEQ ID NO: 17954 - DNA, 681 bp, Zea mays
accaagcaagagcataaccaatcaaccacaagtcgatttgcgaagcactctccgatcacaacccaagaccaccatggctgacaagtgcggcaactgcgactgcgccgacaagacccagtgcgtgaagaagggcaacacctacggcatcgtcatggttgacaccgagaagagccacttcgaggtgcaggagaccgcggagaacgacggcaagtgcagctgcggcaccagctgcacctgcaccaactgcacctgcggccactgaagaagccctccccgctgggcctctcgtcacgtacgcgtctacccgtactagtaacccgtgccaataaaagtctgtacgtgtgtgtgtgtgtctacgtctcttctggtgtcgtgcgaaaacctgaaggttaagctgatgatgtgcgcataggataccggatcggcctcgatcccgtgttccccgtgtaaccggtggctgagcttcaggttgtactgctatgggggttgggacttcgcagctttggggccatgggacttccatttccgggacctttgttgcagggaagagaattaaggggggggtttttcaaaaaaaaaaaaaaaaaaaaagttttatcgacccggtcaacccccaggggggggcccgggaacccaattcccccctaaaaggggcccgaatttacggggcgccccttggcc

SEQ ID NO: 17955 - DNA, 722 bp, Zea mays
cctagaacatcctaatcgaaaaatcccaaaaaacattcctagaattttctatggctcctaaggctcttgcagttacagctcttcttctcacacttaatcttcttttcttcagttttgtaacttccacaaaatgtccaccgactactcctaaaaccccaaaatctccaaaaaagatccctccggttaaacccacttgtcctaccgacacacttaagctcggcgtttgcgcagacctgttgggcttaattaacgttcttgttggttctccaccaaagactccatgttgtgcacttcttaatggtcttgctaacgttgaagctgcggtttgtctttgcaccgctcttaaagccaatgtcttggggattaatctcaatgttcctgttgatctgagcttgttattgaactattgtgggaagaaacttccttatggcttccaatgtgcttgaagagattttaaaaagagaaatctcttggttatgctttgttctgttgctttctattgttatctatttttttgtttgtgagaaaaatgcaaatcttacaacctttgttatttcatattgaacttgttaatgaaatcgtttattgtaatgtcttagcatctctcctaatgtaaatgtgtggttgttaaaaaatatcatttcaatgattccttaaaaaaaaaaaaaaaaaagcttatcatacccgcgcaaccccctcgaggggggggcccggtacccaat

SEQ ID NO: 17956 - DNA, 676 bp, Zea mays
ttttttttttttttttcaatgttcaacagcttacatacttaaccaattatcttattacacacagcaggagacgatagtcctgagaaaatcaccaacccaccatataataacgactatggtagaacaacaaggatcaacccaaggtaggactactagcttacgagctccaatcattacgatttacgacctcccttcaagatgacttcgcagagacaagcttgtcgatgagcgtggcagcatcttcaactgtcgcaattgcctgcgcactcgtctcctccacactgatctggaactcctcctcgaggcccatcacaatctcgaccgtgtccagtgaatcagctccaaggtcagagaacttggtggtaccgcaaacttcagtgccttcaggaacagcaagctgcttcttaacaatttcacaaaccttctccactgtatcctgctttgctgagcagcaaacagcaaatctcatcggcactggctgcaggcgaagaaatgcattgcccctccttggaccagagaaagagagcgagttcgtgttgattgccttgacgggcttggcgaaggacacggcagatccggcgatggaagccatgaggcagcacgcgaagggaggcggcgagcacgaagagcgtgagggcgacgggggatggactgggtgggtggggtggggtgcggt

SEQ ID NO: 17957 - DNA, 1110 bp, Zea mays
ttttttttttttttttgctactgaaggcaatgatgtgctatagaagaagcaagagttcagacagaacaaaaaaaaaaatcaccaaagagtgtaagaatctcgtctaaacaaaatggaaagagataaagagaggcacaagagaaaatctcaatccttaaaatccacgccttggacgttcctccgcgacattcactctgattgctctaccttccatgttctgtccatcaagagcagcgatagcgtcattgagttcagtctcgttagacattgtcacaaaaccgaacccacgtgaacgacctgtctcacggtcgtagaccacacgagcttccacaactttgccatgctcgctgaaaacttgttctagacgaccgttgtccacatcccatggtaggtttccaacatagactctgaatgcaggttcgtatacccgaggttggcgttctggacgtgatcctcttggtgctgccttgtttactgtcagaagccgtccgttcaaatcataacggttgaacttctcaacagcagtctcggcttcctccaccgtactcattgtcacaaatccaaacccacgactctggtctgtctctctgttgtagataacctcagcgatttcaacggtaccagcttgctcaaagagcatagccaaggcttggctatcaacgtcgtacgccaagtttccgacgaagagcttcgcttcttccggtggctccgggaagtcacctccttcgctcacatctccttcctcttcggaaaacgtcgcctctggctcgttctcctcaacggcgacggaagcgctcacgtccccaccttcttccccctcccaatcagaagtctgagcaacgaaggagacgaaaggcgacttctttaggttggttttggctttgagagatagggagacgcgggagaacgagagcgggaggttagtgaggaaggagcagcgaggggagatggtggagagtgaagggtgggagaagatggtggaagaggaagagtctgccatggctaagggcttgaagcttgaggttactattgaagaagccattgcagaggaagaggagtgggagagagatagggataaggagggacaagacagcttttcgattaggatgt

SEQ ID NO: 17958 - DNA, 1031 bp, Zea mays
ttttttttttttttttgaaaatgataattatatattccattcagtgaaaagaacaaatacgacaatgaaaagcagtacacttcgattcctcgtattggctctgaaggctaaaccgcgaggctaacttattcaatcttattacaactgcatgcgagcttagctagaagcttgaatacgtgtcttctgctgaacaattattaaatctcattggcatgcatatatcaaattatatactcatcatttcagggcaagctcccagggattaagacccaccagcgaacttggacttgagaagttcgacgaccccggcctccacccttagtgccttggtgagcaccggcgtggggattggcgggttggaaccgaagagcatgagcggcacgaaaacgatgccggggttctggctgttgaaggaaacaaccatgtaggcctctgtcttaccaacgttgaactggaagtgcatgagcccgcgtgggatgaggaacgtctctccagcacgcaccaccctagagtagagcttgtttccggagtcgaggcttccgaggattccaacgaggagctcacctttcatcaccatgccgatctcggtcccgcgcgggtggacatgcggcgggttggtgcctcccggcgcgaagtccacacggttcatggacacacccagcgtgttcgtaccgggccactcggccacgtcgagctccgtcacggccgagccattcggggtggacgtgttgccggccttggccagcttggtcgagaagaggaagtcgtcaccggcctccgacatgggcttgcatggatgcccgttcacagagaccgccttgccgtcgaggtcagcaacgcagaagtcttggagagggtcagggtcggaggccaggacggccggagcaagcagcagcatggcaaacaggctagcccctaggtttttggagtaacccatggcttgctatgtagcaagcttagctagcactgatcagctagagtttgttgatcaagagtgcttcactggtggttgcagcaaagctgtggtggat

SEQ ID NO: 17959 - DNA, 905 bp, Zea mays
  misc_feature (905)..(905): n is a, c, g, or t
cgataagcttttttttttttttttgcttgttcatcatctatatatagatgtaagcatgcattacagaattccaacaaaggacacgaggtcccctcaggagtacaagatcacagctctcgtggcaacaacatcggccacaacgtatgatcgaagcagcagcagtaaaactaatttattagggaaacagtagaactagtaaagcagtaaatcaaacggggtggagccatgcagcaaggacggctggcttccacgatttatttcgctctcaccatgcatctgaaatggttccggtctcacgcttaacgcaccttggagcaatcggttccttggctgatggcgtaggggatgttgacgccgcacttgccggggatgccggcgacgaggttgggcttgatgccgcccatgccgctcgcctgctgcttgagacaggtgcaggtggtcttgcggtcggcgggggtggcagcggccgcgttaaggccacgcacgccgctgcagcagccgccgccaggcacactcaccctgcccatggcgtaactgatgcacggggccaggtagctcaccacctggccgcagttcgcaaccgcaccctccgccggcgccggtgccgcagacagcacgagcgccgccaccagcagggccaaggccgccgcggcgtgggcacggcgagctgccatggcagaaactagctagtgtgcttgctctgtgggcttagttggtgtgtgagtgaaggccgagggactgtgagtgttgcgattaaggatgttcctggggaaatggcctccgggcgaattcctggcagcccggggggatccccttaattttaaaaacgggccgccacacggcggggggaggctccacctttttgtgttcccctttaatggaggggttatattggcccccctttn

SEQ ID NO: 17960 - DNA, 678 bp, Zea mays
ttttttttttttttttagagattaatgttctagacaataacaatagaggtggaagaaacatagataagagaatacattaggtagcttgagatacgagtacaacaatatacataaacaagggagagaatcagccaaagaagctaggatcgtagccattgctagaagtggccaagacatagtaagcaacgatgtgaccaatagaaccccaagcaagaacatcgacgatgttgaatccaacagggtcgttcgatttcaagaggctaacgtattccttggcacgatcatctccggcttcgaaatgggttttgccgttctgctccggaacctgtttggccacattctctctctggaagttgaagaagacgaaccggccaaggaagagggagagaccagtgctgaggcttataacgacggatgggctgagctcggctctcacgacggcggaggaagatcttcttccggcggtggtggatagcttgggtaaggaggaggaggaggagccaccgaggcggagaggacggaggccgtggaatgagatggagttcgggtttttctgggagattacagtggagaaagttgagggtgtgagcaaagcagatgcgcttgtcgacatgttatcttcttcttcttttggagagctttagcgaaagagagaatgagtggttttagttcaaaaaa

SEQ ID NO: 17961 - DNA, 858 bp, Zea mays
ttttttttttttttttgcgttgaaattatagaccatactcagggtaatgagaaaaatatctgattccataatagtattagtacaaaggtttttgcttctctgcctgactgatgataaatagagaaaaactcacaactgaaacttgagtcgtgacaaacaacaaaaacagtttctttacttcattccttcgctgaggccaggtggcatgcctaagctctgcgcaaggtcactcattctttctttcatagccacgacactcttcgcgtgcgcgtccttgtaagcctccgtgaccaacagtgaaagtttctcagagcctaactccattgctgcctctgttatatcagttcggatcggttgctggttacctgataacgtaaccttgacaagctcgccttcacaataaccatcaaactctgcggcagctaactctttttgaacacgaaccgcctcaacttgaacaaccatttgagctttcttgacagtctcatacatattctgcatattaccaaagattcctcctgcctttgactgtccatcctcagtattattattatctttgttgtttccacctccgaacaacccgttcacacgaagagacctattgggcttgtgctgattcggccatgtcgcgttcttgttctgtctgctacttcctctctgggaattaaagccatgttgggagaagggagatagtaaagactttgtgaaatcggtggttgaagccatggttcttctaccgcaggagataagagaggagagaaagggcagagaaaaaacggaggagaaaggaaaattttcgattaggatgttctagtgtttaaacacaataaagttggaacgggaggggggaaaggagtt

SEQ ID NO: 17962 - DNA, 1512 bp, Zea mays
ttttttttttttttttgtacgctgtcgttaagtctgtgaattaacatttaaagacaatctagagtatgtactaatagcaaggcagaaaagaattacaaactaaaggacgagacaaaatctcaaaaagatctctaaggcctgccctgcgagtgcaggagtatcagtctccccacacccttgttcccatgggcttgtgcatgtattcagaaacaacctgctttgtcttactgcggcgctccgtcgtcaaactcgttcatgtggtctaacaggtagtttgcggccagggtctcgtccttgttgcaggcgaagtacacctccagaacaagcgcccggtcaaagcccattccttcaagacgaagtatagcttcattctcctcaggagtgacagctatggtctgaggcacaccctcagcaaaactgctctaggagattctcgtcttcatcgccctcagctggctcattgattaaacgaaggaactctgcttggttgtcctgaatcagctgcaaaatctgagggttttgctttcccagctcttgaagcaatggctgtaagatttgagggttggcctgcactaaagaaagtaagcttcggaattgtgcattgttacgcaaaacatccagatttccttcaccagcagcatttgctgaagcatttggcagggcttgagggaagaggtccaaggggctagcattaggaccggaagaggcaactgcaggttgagctgcttgcgaagccagggcaggatcagctggctgggcacttggtggtggtgcaggaatctccatcggctcaggaataccagaatataaatactcaacagcccgctccgggttgttgaatgcagcacgtagggcacgcagcacagtgtctctgtcccatgttccaccacccatttcaagaattgactgaattgttgcctctagggtgcctcctgcgacaaggtttgaagcagcctgaccataagtttctgcttcagtggagacagcaacagcaggagctggggaggcggtggcagctggaccaggagcactgacaggtacaataggtgctggcgcagccactgcttgaggtgctggtgtggctggtgcttgagaggcaggagtagcaggcactgtctgagtagggggtgcctgatttgagggttccttggatttagctggagctgcacttgatgagcccttattctgtctaagcattatcacaagaaagttgttttcaacaactttgttttcctccagcatagtctcgtccttaagaactgacccttggtatatgagcatttgttgatcagctgggtacacattctgcccttgtgaagtctcaatgagcttctttacatcagaaaccttgtcggcggggttcacttcgatctcgaatttggagcccttgagcgtcttcacggagaccttcatctcgccgccgcgcgcgcgtgcgtcggtcgcggcgctcgacgagttcgagaggcggaggcggaggcggagggggggagagggagaggggagagaacaagg

SEQ ID NO: 17963 - DNA, 756 bp, Zea mays
  misc_feature (12)..(12): n is a, c, g, or t
  misc_feature (23)..(23): n is a, c, g, or t
  misc_feature (47)..(47): n is a, c, g, or t
ctcactataggncgaatgggtanccggccccccctcgaggttggaancgttgataagcttttttttttttttttatcgtttaacatagcataatgaaaaaaaacagacaagacgatggtagtggtttgaagatggaggaaaagtttggacaaaattacacagaaacagcaaacaacaagtaataatgacccacaattttgtttcagtatcctaaaaaacagatgagattattcaggctgtagcctcaacttcatcggtgcttagagctgcaccattaggggtgtcttctgattttagctgagaggacacatcgtcgatagcagagttgagctgagcaattttgtcagccaataccttgcgagttttctccaaagctttttcctcatcatatatgaacttaggcaatttcctcatgagatcctttcggtctgctccagctatagccttgctgatctgtggtgcatacacacatccaagagcaccgactatgagcccgcccaaaatgaaccctcccacaaacaggccagtgctgcctgaactgtcatcatctctgtatgctgatgggatggttaggatccttttgcctctaggagcagaaagctggatctttttagagggattcagcccgaaagaaacgttggcacgacgagcaattggcttcagagaaaagccagatgaaggatggagttgctgagtattcctggaaagagagagagatgtcgaaagagccgccatcgatggaacaagtgagaagaa

SEQ ID NO: 17964 - DNA, 872 bp, Zea mays
  misc_feature (849)..(849): n is a, c, g, or t
  misc_feature (866)..(866): n is a, c, g, or t
ttttttttttttttttatccaggagacaacaataacgaccaaaagcaaattacaattcagtaaaaaaaatgttacaaaggaaaattttattaaacaaaaaaaaaagatgaaattccccaatttgttttcgtgttcattactttcacatcaccggagggtttcctccgtcgccggaactccgactcataccttcagtaatcgacgcgagcttctgaagattcagtttaatcacagtatcagcaaacaaacgcgtatcctcctccgtgttcccctccggcacatccacgacgtacgattcaagaacaacggtccagatccgtccatctctctcgaatccatgaaccgtcgtcaccgacttgtaattcctcagcctgtgctcgcctccggtgatgctaaaccccgtcaccctccgctcgtcgtcgaggagatcgagcctctccctcgacgtgttcgccggaaggccgctgatcacgtccacgtagcgcgtgcaccccactcgcatctcgaatccttcttcgacggagcatcttttgatgaagtgtttgtaaatctggggacgatcgaagcgtctcacgacggaccagacggtttcgggaggggactggatgcgttgggcgaggagggaggagcagcgaccgggaccgagttggtaggtgtggaactcggtgattgagtcggttagctcggcgaactcgtcgtgagtcagctcggaaggaatcatttggtgatggagagtagtggttgtgtgagtctcttgttccccttctctgattggctctgaatctgccattggtgtcgaatttaaacttgcttccaatttggggtcgaatcgaagagttttcgaataangatgtctaagtaatggntctcgg

SEQ ID NO: 17965 - DNA, 988 bp, Zea mays
ttttttttttttttttactcaaaggtttgtgaatcagaaatgtgaacaaaaactaaaggcttaataatccagaaccaaaacaaatcaagcaacaagagtttataagagattacaaacaaaatagatttaagcagcagcagaagttcataagaagaagactacacccaaaactagatttaagcagcagcagcttccagaagcccttgatcgaaatgccatgttccatgtcctttgccgagtcttctgagctgagctacatattcagagattttcttaattgcttcaacctgttcgttcaaaaactcgctctcaatgaaatctgccaactgcacatcatcgttcttggaagccacactgtgcacgttaaggagcttctcattgaccagcttctccaatgacagagccagctccatggcatagagagcatctcctttctcagcgtgatcaaactcagtttgaggcatcaccataggctgtaacttaaccctcccaccacgtttgttctgatactccatcaacatctcagcatggtcacgctcttccacactcgagtccttgaaaaacttggcaagacctttgagagcaacgttatcacgatcgaagtaagcgtacaaggcgtgatacacataagacacgttgtactccacattgatctgctcgttgacggcggcttcgcactcgggagagtacatgtggcgagcgagcgagagctgcggactcgaagggacgagatcgagttccttcttcacctcctcaaacggctcgaaaacgacgccgctcagggtttgcgtggaggcagaaacagagaaggagaggtttcttgattttcccgaagaaacgggaagactcaatgaggaggaggaggaggaggagaggggagagatgtccttcttgactcctccatggatgttcacgagcgagaaagtagaagcggatttgagaagcatttttgtatgaatctcggacagaggagaagagggtttttgtt

SEQ ID NO: 17966 - DNA, 2902 bp, Zea mays
gcacacgtacaccaccacacccatagccattgtcctcacatgtgcgccccgccacagagggcaccaccccctgcccttgtgtcgccggattttcccgctaggtcctcggcctcggcgacccggatcgatgccgctgccatctgctgggcatggacaccagtgcgccgtgcatccggtcctgagactgaattttggaccccagacaaggaagcagccatgggcaccgtcctggtggcgcctgagccgccgcagcgacagcatacgacagatccataccaagggccatcggacccacactcaaggatggcagaatccattccgctggcgctagagccaatgatggcaatgtcccggcaggccggcatagctgcgcttgcgtgctctcatcgtgacccccagcctttggtggcatgctccggcggtggcgagggggaggggtagggaggaggctcaacggtgcgtgcgatgggcttcgctctaaccgtctaggcaggcaacgcaggggttggggggggaattgcgatgctcatcacaatatatacacattatggactttaattttcgtaataatgcttctgtgttttctttgaactatttttgtccccccccccccccccccccagcttactaaaggtgcagctgacaattaccaccgatcttggtggaaaagacatggagttgttcttgatggagagatcgcagctctgttctttaagcatggaaattatgacctggctgtgaaatcctatgagaaagtttgtgctctctattctgcagaaggctgggaagagctgttggcagatgttcttcctgatcttgcagaatgccagaagattcttaatgatgaagctggttatttggcttcttgtgtaaagttactatcgctggacagtggcttgttttcatctaaagagcggcaaggtttccagtcagaagttgttcgacttgctcacagtgaaatgaaacatcttgtgcccctagatgtctcgtcactaattacatttgctggaaatgctggtccaccactagaattatgtgatggagatcctggtacactatctgtagcagtttggaatggcttcccagatgacatcacactggagtctctcagtttaaggttgtcagcttcttctagtgcagatgaaggtatcaaggcaattaaaagttcagattctcatgttctagtaccaggtagaaatatcatctcttttgacattcctcgtcaaaagcctggctcctatgtgttgggtgctctcactggacagattggcaagctgtcattcagatcacatggattttcccaagatggtccagttgaaactgatgaatttatgagctttgagaaaccgacaagacctgttttgaaggtgagaaaaccaagggctttagttgatattacacctgctgtgtcctctgctttgcttatgaatgagctccaatggattggattaatcgttaagcctatagactattctttaaaaggtggaatattgcatatcgatgctggcgctgaactgaaaattgaggagtctcagatgattgaaatagaaatttacggaagtgatatggagtgtgctaattctgccaacagctccatcaaagctggaaaggttgaaaaggtacctattgaaaatggaaagatagaacttcctgattgggctagtgatgtgactactcttgtttggtttcctgttcgtgctattgatgacacagttgcaagaggagaatccctagtgtctcagaaacagagcgttgtagatgggatgagaatgattgctctcaagcttgagtttggagttttccgtaaccaagtgtttgaaaggaccattgcagttcattttactaacccattccatgtaagcacacgcgtcgtggacaagtgcaatgatggagctctacttctacaggtgatattgagttccggagtgaaggccacactgcatgtaaaggatgcacggttagatcttcaatctggatttgagcacttgggcaaaggagatggaccgccagctttgagtttattccctctggttattgctccttcttccaaagctggaattttattcatgttacggttaagtggtacaaaggatgtggacgacgcagaaaatgcagacagcacgctgaatatcacctacgggatatctggtgacagaaaaactggagcacattctcctatacctgtcaaatctggtgattctgaagaacttgtgttcaagattgcactcagactgaagcgacctgtcctggatccatgtgtagcagttggattccttccattttcaactgactgcctgagggttgggcagttagttaatatgaggtggagggtcgaaaggctgaaaaccccggaggatgcatccatatccattgacgaaatactttatcaggttgaggcaaacccgcagaactggatggttgctgggaggaaatgtggtcacgtatcgttgtcaaatgagcaaggttcaaggatggagatcacggtgacatgtgtgccactggtgtctgggtacgtccacccaccgcagctggacctgccggaggtgggtgaggcaaacattagctgcaacccagcagggcctcacctggtgtgtgtccttcctccagccatcagcacatcctactgtataccagcgatatgattcttcctgggctgacagtttgctgccatttacacatagatgagccatagtatgtttttgccgagacgtgttttttgtgtgtagacatgtttcactggaatgtgtttcttgtaattctgttgtgccatgatcagtgtacaattctgcattgactgatggtacatgaaactggttccccagtattccgtgaaactgcaagccggatttgctgtgttcaaaaaaaaaaaaaaaaaaaaaaactcgagggggggcccggtacc

SEQ ID NO: 17967 - DNA, 987 bp, Zea mays
agccgaatttgttttggaaaggaattgagtattgagggagagcccaggagggggaagggcgtattggtgtaggcatattgggttatattccagctgtggggaaaggtgggttgttcggaaggggcaattcactgggtgagaaaaggggtttttcccagcggaagcgtggaaaaagcgggcaagggggggggcgttaattcggctcccaataggggggaattggggaagggccccccccttgaggtcgggggggatggataagttttttttttttttttgatgatccagctcatgggttcaaaccctcactctccaaatcaaagatacagcaaagggacttcgaacccacgacagcaatacaacatctaagaagtacacaaggttaaataacagccaagaacaagtcttttacaaagacacgggacacagatcacttgaaaacaacacacacataagccataacacaatactgctaaactagagcaagcaagaagcttactctctaccaccacggtagaatgctgcacctgcatggctctaaagagcaatcttaaacatcaagacaccaagacagacaacaacacgatcagggattggcagcaccatgaatgccgaccacgccactgctgccggacgagccactagtgccagggaaggagctagagcccggcatcccgccgaagcctacctgtggtgtgacgccgtttggccccggaaacacccagttgacggacgggccagggtagaaaccaccgaacccaaagacgttatggggacggtaggactcgggctcagttgctgggatgtccctcgcaccatggcaagcaacggtggtggcgagcaggaggccaagaacaaggctcacgctcacgccgctacgcctctccattgttgctactgcttttgcttgccgaccttctggtttgttttcgattaggatgttctaggaaacacaataaagttggaacgggaggggggaaaggagtt

SEQ ID NO: 17968 - DNA, 959 bp, Zea mays
  misc_feature (690)..(690): n is a, c, g, or t
  misc_feature (959)..(959): n is a, c, g, or t
ggaaagggcaatccgtgggggccttttcctttttctccaccttgggaaaagggggattgttccaaggcgcttaatttgggttacccccgggttttcccattccggccgttttaaaccgcgggcccggaacgcgcgtaattgggcccccttttagggggaattggttaccggcccccccctgggggtcgacgtattcgttagcttttttttttttttttttagatcaaactgaaacacttaaataagacaaaacaaaatgccgaatccacagcttattacgatcaaaagaaaacaacagtttcattattcatcaatatcaaccatcagttttgaaaaaaaaaaaaaaaaaggttttcctttagatcaacaataatatcaatccaggagaatcaagaagaaaaaaaacaagacgtgcaatgctcagtcaccaacatcgcagaaaccaacatctggagatcaatggccaccgtgctccttggcatgctgctggtgctcgaggtggcgacgctcgttggggagagcgacgaggtaagagaaggccatgcctccgaagcagatatggaggagaggctggacggagctggtctggatgtacttgtcgttgtagttatcgagacctttcttcacatacgtcttcacggactgcgttgaaaacgacgatttgaattaggcaggaagctccttcacctncttcggcttgatctcgctggatactctccccatcgccattttttttatctccattccgtgttgcccgacaagatgtataaaagttaaacctatccctttccaataaagatgttctaggaatgggccccggggaattcctggacccgggggaatcacttattcaaagaggcccccccccggggggagtcccgttttggttcctttaagggggttaaatggcccttggggaaacaggcaaaaaggttcccgggggaaatgttatccgcccn

SEQ ID NO: 17969 - DNA, 1102 bp, Zea mays
cgagtggggaaggggatagagttagttctctgggagactagtctgttgggttggaattagagagaaatgatgaggtgggtattagggaggagagaaagaaaagggtagggcaataaatataggtggtgaaggacaaacactagggggtgatggttgctgggcagggtgaaaaaccagagtgcgcgctgtctacacggggtagagagcctgcaatatgggagggaaagagtacggcggggcgggcggggtgggccgctgttttggtttagttataccccctacgccgggggtaaaaggggtgggtgtagtgtatcaaagaggacggatttatggccggatggggaaaccgaccaggggtaattttcacccggcgcacggagggttgttaaaaaagggcgtgtccaagggagcgcggcgttagttggcgggcccagtttaaggggggatgtgggtttccgggggcccccgctaaaggttcggcggtatcgataaagctttttttttttttttttttagatcaaactgaaacacttaaataagacaaaacaaaatgccgaatccacagcttattacgatcaaaagaaaacaacagtttcattattcatcaatatcaaccatcagttttgaaaaaaaaaaaaaaaaaggttttcctttagatcaacaataatatcaatccaggagaatcaagaagaaaaaaaacaagacgtgcaatgctcagtcaccaacatcgcagaaaccaacatctggagatcaatggccaccgtgctccttggcatgctgctggtgctcgaggtggcgacgctcgttggggagagcgacgaggtaagagaaggccatgcctccgaagcagatatggaggagaggctggacggagctggtctggatgtacttgtcgttgtagttatcgagacctttcttcacatacgtcttcacggactgcgttgaaaacgacgatttgaaataggcaggaagctccttcaccttcttgcctttgatctcgctgtatactcttctcatcgccatttttttttatctcgattcgttgtttgcgcgacgagatgtataaaagttaaaacctaatccttttcgattaggatgttct

SEQ ID NO: 17970 - DNA, 1029 bp, Zea mays
ttttttttagtccaatgatacttgagagtactttcaagaactctgtttacataaacttttgttttcaagatggacatcattacattacacaccaataaaagctaaagcaaccagatcaagaggacgagaaggtgtcgatgatggtggtgtgaagcgggtcactaaggtgagtcgcccagttgttgagcggtcctttacccgttgcagctgcctgaaccgcaaatcccaagaaagcaaccatcgctaaacgagcgtgtttgatctcagccagctgaagctgagccttcttctccgggtcagaagctagcccgagcgggtcgaagaacttgcctcctggatacaaacgcttctctgagtccaactcagcgtttctttggaactcaatgtaaccaatcaccaacacttcgatccaaatcaatgtcgagatagagaacggtaatggctgtcctaaataggacgatccatccactagctctaccttgccggcgtcttgccaagtaacaccggtgagccactcgacggagagagcaccgagagttgcaagcatagcccatctcccgtggatcagctcacactctctgaacctctggagcccaaagacctcactgtacggctgaaacggcgttgacttggggtcagcggcctcggtacgggtcccgatcacgtctccggctatgttcttggctaagttctggtccagagagtcaagatcaaactggagatactccgccggtttgcctaaaccgaaagggtcaaaaccgtagtctccgaccagcgaaccgtcgagatactcgggagatttcgcgcctgggaaccacagaggccggtctgagataaccgtcttagccttcttgggagctgcggccttcttggtcccgaatccaaaccgggctgtgaacctgcttgaaccggagttgatgtcggaaaccacccgagtacccatgatggaagaagcagcagcggctgttgaagtggcggccatctcgagagtttgtttgtgtttagcacgtttgtgagttggggtgttct

SEQ ID NO: 17971 - DNA, 944 bp, Zea mays
ttttttttttttttttgattatttcttatattttgatatagaagaacaagttacacagactttcaatatcatcttcatcaaccaccatgaagaaattataatggaagatcaacaacaactatagtacgtatagtatactattatagacgacgtttatacactaattatacatttgtagtggtactcagacgaaatctataaacagatttagatttcgtcggaccaatcactaggcttggtgtcgtagaacaacccatcaacgatctgatcgaccaacgagtcaataaacgagttgcaactcacggtaaagatccgcccaactctcttcctcgaaatcgttagccacgcgaacaccgctgcgcatcccatagctccaagtcccgctccaatagcttcactcaacccttccacgtcaagtttcttgaacagcgagttccccgtaacaacctcctccgccacggtcgccgcgaaaacgatcatggcgagacggccggagatggtttcaaagtcctgactcttcttcgagctctcgatgtaatcagtgagcgtctcaaaaaacggcgacgctaactcgacctcagatccttcatctccgcctccgccgccgtcttttttagcgacaatcatctcagatccgtaagatctcagcgtgcagagcctcggctgaagcacgatcttcccgttctcggctagatcgcctcctctcggtcgctgctggatctggatctgcttaataggttccgaggattcgcatctggtaacaagagacggtagctggcagcggatcgcgcgcgtagccatagccattgttgatgatgatgatccgaggaatcttttgaggaggtgaagtgagaagtgatgggaaactttttcaataagaagttctagggaatgggctccggggaattcctgacacccgggggattcacctagtctaaaggcgg

SEQ ID NO: 17972 - DNA, 2033 bp, Zea mays
ctggacggcacggtaggtcggaagtctgaacatacacgcgctccgttccgttggattcctccgttgtcctagtgccgtgctcctagccgtgagcccgtgacagttcaccccgtcgtatagccaaccgtcgccgtcccatcgtcgtcgccgtcactccgcggtcgacttgtcgtacggtggtcgctatcccttcccgtcccttgaaacgaaagccaaatcgatgccccccccccccaatgccccatccccacctttcggcttgtttacgctacgcctttttaatcccttccgccctctccgctccccggggcccccacccagaccaaacccaggcttcccgttccctcgcttttgtccggcggccatggcggaggagcagcagcatcagagatggcaggagggccaccgcctgtgcgccaacaattgcggcttcttcggcagccccgcgacgctggacctctgctccaagtgctaccgcgacctataccagcagcagccagcaggcgcggcggcgggcccctccgctcccaccgcgtcggccttccagcattcctcctcggcagtctccggcgcggcggcggtctctcccgatctcgaacctcccgcgacggcccctgctggcgccaaggcgggcaggtgctccagctgccggaagcgcgtgggcctgacggggttcgcgtgccgctgcggagctaccttctgcggcgtgcaccgctacccggagcggcacgcgtgcgccttcgatttccgggccgccggccgcgacgccatcgcgcgcgccaaccccgtcgtcaagggcgataagctcaaggacaagatctgaggagcaggaaccgccgcctctcgcttcagagttcatgtcttccccccgtcagcggaactccggaagagcaaggacgaccgacggccagaagggacggatcgtcggattgtacgaattactcccgtgtactctacgattggtataaaacccaagcccgtcggttcgattgtgtaaagctggcggtgaaatcgctggccgtttactgaatgaaaaaaaattcaaatagaaaaatatttacttttccaaaaaaaaaaaaaaaaagcggccctcgcgacgaagggtagcgtgggtgctcggtttcttcttttccaatcctctgccgcgactcggagattgttgcgtggtgtgtgaagcactgaatcagctggtaccctggaattggaccgcttcctcatttcaccccatctttctttcgagtagctctacaactactgacgggcggaccaacccaagagagagcgtactgggtctggtgggtgggtcaaccgatcgatggaaaggtttcggataagcacgggggacggtgtccgtccggtccccgtgacaccaacgtctgagctgctctcgagctcgtgctgtcgctgctccccgcccatgctgaccgctgacagaatataaaccaccccggacttcattttaagtattaagcgatcgtaattcgtaaagctggattaggttggaagctggcaccatgcgaatgtgaagcagttgagcgcttcaagtccgtgctgcaaatgtaagcatgtcctaatgttcttttggccaatgcaacgggatttttccttttcatcaacgaggaagactggatcgaaggtaaaaaaaaatcatctgcggcgaaactccgtattacataacagagcaaccatatagaaaaataacaatacttctatattatgtatacataaaccatgttattggttcgaaggcgatgaggatagtggagaaaacagaaaaaacagaatcattctgcacgagatgaaaaaaagcgcatacgatgtgtgtggacctgttcacaccggtttgtttgtttcattcgtttctttattcgacaatgaaaaagtaaaaattataaggtcttgttcggttattcccaataccgatggattgaatgagattgtaaaaagttaagaagtttgacttatttgagatttaaacccgctcaatcccattcaatccacattgattaatagctaaccgaacaagccctaag

SEQ ID NO: 17973 - DNA, 712 bp, Zea mays
agaccattacctaggacctcctaatcgaaaaaccacaagagcaaccatccacatccacgagacacacacagcacagcatcggcgtaaagggaacaccagcaagatgtctcagctcgcccgcgccagcctgactgcgatggcgatgctccttctccttgccgctgctgcggcggcggcggggccggcggccggcggcgcggctgtggcggacccagcaggctgccaggacgacgttgtggcgctcaacgaggcctgctacaagtacgtgcagaagggcgcgccgacggtgccgccgtcgcaggagtgctgcgacgccgtgaagagcgtggacgtgccctgcgtctgcagctacctgggcagccccggcgtgagggacaacatcagcatggagaaggtgttctacgtctcccagcagtgcggcgtcagcatccctgggaactgcggaggatcgaaggtctgaagcaagaacaggccggctgaatggcaagcttggataatgtaagcagcgcagttagcgctgctgaaataaataagacgtcctggtcaacttataggtgacgatgccggagcacagggaatgtattgccattcagttgctggaattatttacagtattgtactttgactacgttgcaacctgttgcaagatgtattgccattcagttgctaaaattattatactttgacaaaaaaaaaaaaaaaaaagcttatc

SEQ ID NO: 17974 - DNA, 1357 bp, Zea mays
acgatattataattacatcaaataataaataaataaggtatgtggctgcgagtcatcactctgatttaaggccagtggttttggcatctgctcgttcagtggtgataaagcgcctcgtttccaactacccgatctgataagcatttcacgcttcaccaatggcttctctcatgctcaacggggccatcaccttccccaagggattaggcttccccgcttccaatctacacgccagaccaagtcctccgctgagtctcgtctcaaacacagccacgcggagactctccgtggcgacaagatgcagcagcagcagcagcgtgtcggcgtcaaggccatctgcgcagcctaggttcatccagcacaagaaagaggcctactggttctacaggttcctgtccatcgtgtacgaccacatcatcaatcccggccactggacggaggatatgagggacgacgctctcgagcctgcggatctgagccatccggacatgcgagttgtcgacgtcggaggcggaacgggtttcaccacgctgggaatcgtcaagacggtgaaggctaagaacgtgacgattctggaccagtcgccgcatcagctggcaaaggcgaagcagaaggagccgttgaaggagtgcaagatcgtggaaggagatgcggaggatctcccttttcctactgattatgctgacagatacgtctctgctggaagcattgagtactggcccgacccgcagaggggtataagggaagcgtacagagttctcaagatcggtgggaaagcatgtctcattggccctgtccacccgacgttttggctttcacgcttctttgcagatgtgtggatgcttttccccaaggaggaggagtacattgagtggttcaagaatgctggtttcaaggacgttcagcttaagaggattggccccaagtggtaccgtggtgttcgcaggcacggacttatcatgggatgctctgttactggtgtcaaacctgcctctggagactctcctctccagcttggaccaaaggaagaggacgtggagaagcctgtaaacaatcctttctccttcttgggacgcttcctcttgggtaccctagcggctgcctggtttgtgttaatcccaatctacatgtggatcaaggatcagatcgttcccaaagaccaacccatctgataacaacttgtgatttgtaatacactcctatgttagacgcttttttttttgtcctcgtgactatgttgagcccttttcaaaaatatatctatcactctattccaccaaaaaaaaaaaaaaaaaagcttatcgataccgtcccacccgaggggggggcccggtaacccaatttccccctatagtgg

SEQ ID NO: 17975 - DNA, 753 bp, Zea mays
agaacatcaatcgaaaaaacggccgggccgggctctcgcatcccaccaccaagctccagacgcctcctcctcctcccccgccgccgccgcactctccagagaccgcaggcatgggcgtcttcaccttcgtgtgccgcgactccggcgccgagtggtcggccaagcagcacaagggcgagctcgaggcctccgccgccaccccctacgacctgcagcgccagctcgtgtccgccgcctgcgccgaggacaagtccggtggcgtccagtcctccttcaccatggtctcccccaagtccgccatcttccaggtggtcattggtggcgcctctgctggtccgatcggtggtggtgctgctgcaggtggtgccgctgcatcaggtggagctgccgccgaggcccccaaggctgaggagaagaaggaagaggagaaggaggagagcgaggatgaccttggcttctccctcttcgattagatcttctttaccctgttgcttgccagaaatgacatggtcctattgccgcagtaattttgatgccatgcccacagggtttgtgaacctgcctagtttgattgtcaagggatgtatgtggtactttctgttcatgtgaggatttggttatgttattatgcaggaatatcctaatatggctttagtcttgccagttcacaaaaaaaaaaaaaaaaaaacttatcgataccgtcgacctcggtcctgaaatgcttgagggtatcattgccttgatttgctttac

SEQ ID NO: 17976 - DNA, 716 bp, Zea mays
gtatcgataagttttttttttttttttgcgcgaaacgcatagtatcatgatcattaatttgcgaacttattgaacaatagcaaccaccgtatcatggcaattatccagcaaacatagtaacggcagaatttctatcagcgtcagatctccataataaccctactaacagtacataaaagagcccagacccgaaaggggaaaaaggaggagatggcgggcgtgaaacctctccctggtgtcgctcactgaatcttcatctccacaacgctcttggccttgggcgcgtacagagagtacaccagcacttgccgcttggccacctccagctgctgcttcccgtccgcgaaagccgccgccgcggccggcgcgtcggcgagggcgcggttctcgcggaaggcgtccgccgcgcggcgccgcgtgtactcgcggatgttgtagtcggagaactgcctcgccgtgcggaggaaggcgcggaagagggacagcacctccgtcttggctgggcccgccgccgccattgatgcctttcgtgcgatgaaaggctggagaagaaatctggctttggggaacgagggctttttttttcgattaaggaggttctaagtaaagggtctccgtgcgaaattccctgcagcccctgggggatccccctagtttttaaaaggcggccggccaccggcgggtggaaacttccagattttttggtttcccttttt

SEQ ID NO: 17977 - DNA, 987 bp, Zea mays
ttttttttttttttttgaattttgtctctttataaaacaacaatatacaaataattaaattcataacaataacgtaactgatactatacaccaaagttataacatcatttggttgcttatacagccataagaaaattatattcgccgcaaactaatctcaatcaacgtgatcattgtgatgtaaatgctgagaagacgttgcagtgaccaggatcagcgagatgagccatgagattctcaattggatcttgactagcactgtagttagcttggaaacaaaacccaacgaaagcaagcatcgctaaccgtccgtttttaatctctttagtcctcataaccatgaccggatcaggagaacctcttccccacatcatcggatcgaaccataaacctcccgggtaaccaacatccggtttaggattcaccttgtgcggatactgaggctctatgtccaccgaacccggtttgataaaatcagcccaacgtctaccttcggcccagcccattaacactaactggacgacgaataaggtagtggaatccgcgaaatactcgcgcgagcctgcgtcgtaccacgagtaattctcgatgaaacctaaccgctccagacattccggtattaagataccggtcacggctagcatggcccaccggctatgtatgagctcagcttgggcaaaccatctgagggtttccggatcagaccctagaccaagaggatcgaaaccgaaatcaccaggaagactgccatcgagccactcaggtggagaagtaccggggaaccacataggacggtccggagtaagtggttcacagacactagaaacttctttaccggcacgaaccaccaccaaacgctcgctcgttcttccaccaacacgtgatgagaaagctcctcgtgcattttgtactctgcttgtggataaagcgagtgtggtggaagtgagagcagaagcaatggcaagagccatctttgttaatgttctt

SEQ ID NO: 17978 - DNA, 888 bp, Zea mays
  misc_feature (884)..(884): n is a, c, g, or t
gtacactaataatttactagtacttccaagcaaagatggcgatggacgcagcataacggcgagctagcgggctcgctgactgccggtgccggtcgccatacgacgagaggcaaaggcctgctagttaccagcatttacaggcgaccagtacaactcggccgctaagcacttgattattcgcttagctaatcactaggaacgaagaacgtaacacgtacactggccatcgcgcgcggctccggctcgttgacggtcgttattgtgaaatcgacgatcctacacagttatccttggtcaataaaaatcgaagcagattattaattcttgtcgaagttccaagaggccgatcgagctgtagccaccggagcttttgtcatcggcgacgggcgggccggcgggcgcttggcaagaagagatcgaggggtgcatgtgtagcgtagtgtagctcgttcttgagctctcagctgtagagggtgacgagccggcggaggcagcgggtgcaggagtacttgcgcttgctctggaggcacagcggcaggccgaggaagcggcgctcgctctccacgtcgacggccaccacggccccgccgcagcgcgggcacgccccgggcgccttgcgcgtgcccaccacccgctccttctccgcgccgcacagcacccgcaccgcgccgcccatcgccgccatcatccttccccttcgatctcctgcgctgcgccggccttggagcagagcgaggaagaactgcaaaaaaaaaggcgacctggtactggcagaggatggaggagcgtcggcgtcgactgatagtgatagatacggtggaactgggattctggtggtggccggttttttttttttttttttttccccgccgaacccgagggtnaccc

SEQ ID NO: 17979 - DNA, 752 bp, Zea mays
  misc_feature (752)..(752): n is a, c, g, or t
tttttttttttttttggcatgtaaacaaatgctttagatttcttctgacggcataagacacaagattctctcttccaaaaagaaagagagagatgacaaacatatgactcttaaggtgacggctagtaaaccagaaggtaagactcaaatagacacttttgcattaaagaaatgcttatttgttgacagatattgaaaaagaaatcagggtagtggcaccggaggaacttggccgttgtttccagcgccagctccagtggccggggttggagtttcaaatccggggtttgggacaagggtatcatcgccaccagggagctgggtgcgagctccgcctccttgtccaccaccaaatgatgggatttgaccaccgatagacccgccagtaaggggagctccagtgacgggattgtatgggtagaatggtttcttacatttgggaggaagcaagaaccttccaacaccggggatgagaatagttggtttgggctcaatggtgacaagaaactcagggtgtttgacatcagtggtcttatgggacttgggaatatgacgcagtccgctaacttgctctgcaggtccaagcagtaggctaagaatcatgacagtgactgctgctgctgcgagtgttagcagggacgaagccatttgtttttttttttaaattgtagtgagaaaactcggggaaggtagtgtggttgtttttttccgattatgatggtccagggaatggccccccggcgattcctgcn

SEQ ID NO: 17980 - DNA, 734 bp, Zea mays
ggccgggacgataagcttttttttttttttttgtaaaataaaaacgagtgtttcaacgcacacccgaatagtccattattattaagtcgagaagcaagagtatgcaacgatacattgaaaaagcaagaaacaataccaaaaacacacgaactttattgggaaccaacagagaaaagtagcgattcataaacctgatcatggatccagccatagtcccttatagaattaagtggatggtgcaaggagagggcgaatcaagttaggaacatgagcctggtgatcctcaagacgacccttaacactgtctccatcccagcgaacaagtgttggcactccagtgaccttgaagcgaggatcgactctccacggatgcatcggattcctccacgtcggcctatctcccgcgtaagcccgaataacattcacttcctccgctgattcctctagagtcttgtatatcacaggctcagctctaacgcaatcaggacaccagctgcggttggtggtgggatcattgttggcgaggaagaggatgaaattgattttgttacggtttgattcatcagatttcaattcttccaacaccttctccaaggttgagggatctgcgtccaccttcttcacactcatttttattcttttctctacaacactctcgatttcgatttcgatttcgatttctttaccaattttagttggactgctctccttaaattgaggcccgtgtttgattc

SEQ ID NO: 17981 - DNA, 730 bp, Zea mays
ggaatgcaacgcaatacccatatatcaaatatagagcagcagattttttttttttttttgttttaccgcttggatgcccaagcacaaggagataacttcagttcacacaaacaaggttcccaagatacaaatctcaaaactgtaaacaaccaaagactagtttggtagatgcttaatgaaacctgcactcaaccactcatgacacatcttaggcctcatagatccagttgtgctggctgctcctccactctgcaatgccctcagggaaccacagggcgatctccttcctcgcactctcaactgagtcgcttccatggatgacgttcctgccgatgtcgacggcaaagtcaccacggatggtgccgggctcagaggccagggggttggtggcgccaattatcttgcgtccagtggagacgacgctcttgccctcccagaccatagcgacgacagggccggagacgatgtactccacgagcccagcgaagggcttggaggacagatcggcgtagtgctgctcggcgaacgacttctccacgttctggagcttcagacctttgaggtagaagcccttcttctcgaagcggctgatgacctcaccgatgaggcccctctggacgccatcaggcttgatcatgatgaaggtctgctccgacgccattggtgctgtgctaagcttgagatttctgattgggtttggacggcgagggagggtgagagcccggcccgc

SEQ ID NO: 17982 - DNA, 702 bp, Zea mays
ctcgaggtcgacggtatcgataagcttttttttttttttttttgtcttttaatttcatctcaacaacattgaataccgtttttgtacatagaaagctcaacattttacttacatttataatgtctaacaacgcagagatgacttgttaatacaaaaacgaaacaaataatgtagccactcatgcggtattgttgacatacaagtaaagagctgctaaagctagaaccccaacagcaattgctataggcaaagccttcccaatggcttcgtcacgttggagctcagcttttctagcctttctcacatccttgtcgttgacgttcttgctcacatcaggcatgtacggtctaaaccgccgtttaggagcagcacacactggacagaagtaattgtcaggcaacttatcgaatggagttctgtcattgtatatatacccgcagtcacggcagatataggcttgcttggaggagacacgcatagagaatcttggagcagaggaggataatgaagatttcgaaagagacttcgtcttgttgttgtcgagtatcctcaacgagtaatacggcaagaaagatgatgatctctggaggtttgaagtaaccggagagaagactgctgacggttttccggcgttaagcgtcgccggagtaacgtacatcgtcgtcattgagaaaaagtaatacttttcgattaggatgttct

SEQ ID NO: 17983 - DNA, 722 bp, Zea mays
tcgagttagccgcggccggccgcgattgcatccccctttctgctcctgtgctgcgtccaccagcctcgtcgttaggacgtaaggtaagacacccaggggcgagccagtgagtacagagagtagccttacgtagcgaagctcagagcaagcgagggtacggtcaaggggggtgatggcgctgtctcgacgcatggcggctcccgtcctcgtcctcatgctcctcctcgtcgccacagagctggggacgaccaaggtggcggaggcgaggcactgcctgtcgcagagccaccggttcaagggcctgtgcatgagcagcaacaactgcgccaacgtgtgccagaccgagaacttccccggcggcgagtgtaaggcggagggcgccacgcgcaagtgcttctgcaagaagatatgctagtagtagcctcggctttgctggcacaagcaggtcgtcggcacgcaacgcaattcaagcatcatatcggtcctcctcccgcgttgctgtctactcgaccccgttttctctttcgatcgatttcgttgtttcctgttgctctcttcttttcccgcgaataatatgctccatgggatctcactgttgtactttctgcatccgttggtagtcaggacgatccttcttcccgctgtcacgtgtgattcaaaatggatgtactaatgcaactgttcgttcttccaaaaaaaaaaaaaaaaaaaaaaaaactcga

SEQ ID NO: 17984 - DNA, 1106 bp, Zea mays
ggtcgacggtatcgataagcttttttttttttttttttggtccaattacttaattattaccctgctaattctcatctcaaagtgattaaacagtagaggaaacacttcgaacaatacgaaagtgaacgagagtcgagataaaaacgaaaactacttgatccatttacaatcgcgtgcgataagaggcatacgcaaaccaaaagtacgtcctaacacgtaaaaacaccaacgctttcatgttatttaaaacacccactcttattagctttccttgtcacttttagtttcagtttctcctcttcttcttcttctcctctttatctgccgagttcttcagcattatgatgagaacacggacaaacacagccacaaaatcggtgaaaagggtcaatgcatgtttcacatagtccatgtcccctaggtgtgctttctctataatctcttgtgtgtccaccaccatgtatcccacaaagatcaagagtccaaagtagagctcgaacttaaagatggacgcagagccaccaaagatggaagaagcaaactgaagccacataagcatggacaagccagaagagagaagtcctccgaggtagagatactctctgcgtcttgccagcatcgctgctcctgagaaacagataaacgctatcgcagttccgacaaacgcagtgataaggatgcttgggtcaaaatcaacagccactttgatcaaggggccaacagaggcaccttcaagaacggcagacatgaagagaagtgagagcctcttttgttgttcataaggagggcatgagagaagccaaatcatggttccacaacatgcaatggttgtgagaataccaccgatgttccagagcacgtggaggtaagctccaaaggcagacgcaacaagggcatagcataaagtgaggtaaacccgcttgagatgattctggacggacggggagatctgatggaggttcttgagagaatcatagctccagcttctgctgcctggctgagaatcgaagaaggacgagaacgaatccatgtctttttgttttcttttgcttccagagagagagaatcaattaaccgcgtcgatattattaacgaagatagataat

SEQ ID NO: 17985 - DNA, 803 bp, Zea mays
  misc_feature (1)..(1): n is a, c, g, or t
  misc_feature (13)..(14): n is a, c, g, or t
  misc_feature (16)..(16): n is a, c, g, or t
  misc_feature (26)..(26): n is a, c, g, or t
  misc_feature (31)..(31): n is a, c, g, or t
  misc_feature (36)..(36): n is a, c, g, or t
  misc_feature (45)..(45): n is a, c, g, or t
  misc_feature (56)..(57): n is a, c, g, or t
  misc_feature (83)..(84): n is a, c, g, or t
  misc_feature (86)..(86): n is a, c, g, or t
  misc_feature (107)..(107): n is a, c, g, or t
  misc_feature (122)..(122): n is a, c, g, or t
  misc_feature (132)..(133): n is a, c, g, or t
  misc_feature (147)..(148): n is a, c, g, or t
  misc_feature (157)..(157): n is a, c, g, or t
  misc_feature (172)..(172): n is a, c, g, or t
  misc_feature (175)..(175): n is a, c, g, or t
  misc_feature (178)..(178): n is a, c, g, or t
  misc_feature (180)..(180): n is a, c, g, or t
  misc_feature (203)..(203): n is a, c, g, or t
  misc_feature (210)..(210): n is a, c, g, or t
  misc_feature (214)..(214): n is a, c, g, or t
  misc_feature (221)..(221): n is a, c, g, or t
  misc_feature (228)..(228): n is a, c, g, or t
  misc_feature (238)..(238): n is a, c, g, or t
  misc_feature (241)..(241): n is a, c, g, or t
  misc_feature (281)..(281): n is a, c, g, or t
naaacacggcaannantttaaacccnccttnagggnaatgggccnggccccccccnnggtttttttttttttttttgttaagnntncccaggttttattttcattgngccaaattttccaancgcataaaanntttccgaaaaaacnngtttccatntaaaaccaacccccnacnaantnatccacgcattcataagagaacncttgacncctntttggcntccaaancaaaaaaccnccncttcatcagtttaacgacatttgtttaagggggggactcnggttcttcttctcttctcttttccaagacttgtgttgtgtgtagagatcaccatgccgtaagtaggaggagagctccttggtccagtctctgatcctcctgctgccttctcgaacgcatccgacgtcgaccgtctcctaaaccgaaagggttcctttcccccagagaacggagacagcggcggagagaaaggtgatagcggcggagttgaaccggcaggcgaagctggagctgaactgccttggtaacccggtggtttaattatcatgatactacgtgtaactttcactgcttcttccggtagcgaatcctcaccgtacgatctcgcacttccagcttccgattgatcattgccggagctaggtcggaaactgaaggtatggtgtttacgaagcttgccaaggccgttctctggccgtggaccagcgacagtatcatcccagagatgatcaagtaagcccatagggttgaaattgttaagaatgtaaagtttttggggttttttaaaatctgttgttgtaga

SEQ ID NO: 17986 - DNA, 784 bp, Zea mays
tttttttttttttttttatttgaaacgtttcacccagtttcactgtttatttatctttagtctttctttactactccaaaagtcaaaccaaaacgaagtaattgttgataacttagaaagaagcaaaactaaaagcatccaatgattaaaaagcaaacgcacatagacattttattcgtagaggaactctgaagctaaacggttggagaatagagaatcaatcacagctcgtcagctccatatgtgtcgtctacatcttcttcttcttgttcttgttctccaccagctggtttttcatttaccgcgataagctctgtgtcaaatatcagtgttgccccaccggggatggttggaggagagccctgttcaccatatccaagtttagcaggtatctttaacttcctcttctctcctacacacgcacctagcaatccttgatcccagcctttgataacctgaccacttcctaactcaaactcgaacggttcatccctttcaaagctcgaatcgaatactgttccatcagtaagtttccccctgtagtgcaccttgatcatatcacctttgtgagccttcacttcacacgttgctggcttaaacttaacaccgatctgcaattccgacacatctcctgtcttcttggcaaaaccttggagtgaaatgagagagaataagatcaagcaaagggagtaacggagacacatcttaactctctcgccaaaaaaatcgcttcgtttagttccgtttgatttttttttcgattaggatgttctaggatatgccc

SEQ ID NO: 17987 - DNA, 862 bp, Zea mays
gaaaggaattaaaaacacttttgccttatcatctaaaacccatcgagagttgataagaaaaacctttcaaaatggctcttgttcaatccagaactcttcctcgcgtcaacgtcccgttctcgccgattctgtccacactccaagctccgtcgtctctctttctccggagggaaattcgaccggtagcctcgccgttctcgtcctctaccgccgggagcttttccctctcgccgctgacgcatccaaggaagattctctgccctccacctcgcggcaagtttgttagagaagattatcttgtgaggaaactgtcagctcaagaacttcaagaactggtgaaaggagagaggaaggtgccgctaattgtggatttttatgctacttggtgtggaccttgtattttaatggcccaggaactcgaaatgcttgcagtagagtatgagagcaatgcaatgattgtgaaagtcgatacagatgatgagtacgagtttgctcgcgacatgcaggttcggggattacctacgttgttcttcatcagccctgacccaagcaaagatgcaatcaggacagaagggcttatcccaatacagatgatgcgtgatatcattgacaacgatatgtgaagtcttgtattgatgaaacactttcttgcttaaggattgaatagaatcgcggaaatgtaggattgaagaatctcatctaggtttcatggatgaagaatgaaattatgaaacgagatgaatataacctaagtaagaatcttatttgtatgcactatgcagtgttggttttggtgctgcctttctttttaaaaaaatttatcaacaaaacaaaaaaaaaaaagcttatcgataccgtcgac

SEQ ID NO: 17988 - DNA, 763 bp, Zea mays
ttttttttttttttttagttaaagctctcttgagactcatcgaatgatttttaaccaaaacagtattacagagatacaaatttgatacagaggtaggaaacattgagaagtagtgaaaagattgaaacatttagcatgggttctctcttgttttgctttttgtttaggacatactgggaaagacgaagaaaccctagtgagcagcatcttcctcttcgcagaacttggtgtattcctttggacccatcaaggattccagctctgcggggttgcttggtttcacctttatcatccaaccatcttcgtaagggcttgagttaatcaagccaggtgaatcagcgagctttgtgttaacctcgatgacttcaccagagattggagatataatctcacttgttgccttcacactctccactgctccaaagtttttttctttggtcactgaacttttttcttcaggcagctccacaaacacaacttctcctaaatgatcctgggcatggtcactgatgccaatagtagccactgagccttcatgtttcacccactcatgtgaatttgcatacttaagtccttccaacactgaggagaagcatctggagatggagaaagctggaaggagatgagatctggatgcagaagaagagagcttgagagcgtttgctgtagaggaagcccacattctcagtgccatttgtttctgtttgctttctttctttttctttgttctgttttctttctcaaagggaagtgggaagatggt

SEQ ID NO: 17989 - DNA, 978 bp, Zea mays
ttttttttttttttttagaactggtaaacattttattacattccaaccccatcaataaggtcttagaacaaagaaaaagccaacaaacataagttttcaaagcctaaaatcccaaaacaaaagctagacacttgctttctcaaaagacaatgagagtttaacaaacgtttctaactctcttttattaaatcttgtgcatctcaaggaaactcttactggagactctggtggcttaaccaaacaacgaaaagagcttaggggaaatgttgcttcaatgggtcaagagcgagtgaatactcttgatagtatggtaaagcgcggccaatgcagtaaccgaggtgataaccggaagttgctgctgtacatggtaatgaacttggtagaaagccgggtaagtgaggcagatcatacccatcttcaggtagagaagatagccgccataaaagactccggtcaagtaaatccccgagattctgttgaaaatggataacattgagttcttctgaggctggtaaaccgtgaggtgaggagatagagggcgaaagctttggggttttggagaagtctggtcctcctctgtcatcttgataccctcggcgattgtagacaacacacgtcttggtgttcccacaccaagagctctcagatgagctcccatagcattcacagtagcttttgaatgctctctctcctctctaacggcattgcttatgttgctagttccaaaaccagtcccaacattttcattcacaccggctctcgatccgaaagctctacacaaacttacatagttctgaccagtgtacgaacccaatgaaggttgagcattaccagcaagagatttgtagacggaaagaggcgcagagacgacgtcgcgtcggcggatcgatcggagaatagctgtggcagccatcgtatgaatcaaaaccagtatctctctctactagctttcctgagaaaactcgaacaagggaaaat

SEQ ID NO: 17990 - DNA, 816 bp, Zea mays
ttttttttttttttttttagttgaacttgaataaggtacaaatgtcaacgctacatagcttcgttcttaaaatactatacaataaaaaggcttacatttgttattattttgtaccgcgacatccattagtaaaataatatttgaaaatttttctatccccacgtgaagttgttatttattttttaaaagttggattactcttttttccatgtatccagttttccatatcaacctttactcatgcccaccacttcttttcatatactcggtggggctgctggcttaggtgctggtggggctgctggcttaggtgctggcgcagcagctggtgcggctgctggcgccgcagctggtgcggctgctggcgccgctgctggagcggctcctggagcggctgctggtgcagctgcagcacctggtattatctttttcaagactttttctaggacttttggcggcgccttgcccgttgctcgcttgtagagccacaggatgatggtgacagcagttgcgccggcgccaccggcggctgctaaacccgtagtcagtaaaccagtggtaataccagctggtacgagaatcggactgaatactacgaatagtggcatggtagcgataaatgcggcggctgtgccggcgagggatacaccggcgatcaacaagaggaatgttgcggcatgtgtagctaatattgcggttaaaacactcttaaacgacggctttcgctcgtgttttttcttcctgagtatccccattgtttactagtttgaatggctagaaaggaggggtatgattctttggtccgatggtcgtggg

SEQ ID NO: 17991 - DNA, 1942 bp, Zea mays
  misc_feature (80)..(80): n is a, c, g, or t
  misc_feature (230)..(230): n is a, c, g, or t
tgtgtcatcctggtggtcaccagtgggtttaagataagtggaatttattgtgccagcctagttaaaggagctgttattcnactgcactagcaatatgtactactgtaggagtactatatatttcacatacgtaggcagtctaattctatagttcttattctaaacgtcattgaattcactgctgaggaagcgatgggcaacaatgaattgtcatgcccgctctcaacaanacatgtatgtagctcctctggtactagattgtaaatacacggccggctccatttttttttggatagtagtactccagtaataacagttatgctgggtgcctgggtgggtcacaaccaaccgcgcatcagtgcacttatttttggtatagccatggaagcttgtacagcttgcagccacgctttcccggcttctctataaaatgcaggcactgcatttccatattctcaccccaagccgcgtcctacgtggtcgaggactacagcaagaaatgggggtctacaagtctgcagttctgcttggtgtggttttggcctcagtccttctcggcttcctggacgttgtgtacgcaagggagctcactgaagccaatggttgctaatccgtctctctccctgtgctttgtgtgttgtgcactactgttacattactgcatgaattaactagctagaaccattttaaagaaggtatatctttttgtgcttcattctttcttcatgcaggctctggagtgaagaataatgtgaagcctgcaggagagcctgggctcaaggatgagaagtggtttggtggtggatacaagcatggtggagggtatggaaacaaccagccaggatacggtggcggaggaaacagccaacctggatacggcggcggaggaaacagtcagcccggatacggtggaggatacaagcgccatcaccctggtggcggctacgggtctggacaaggagggcctggatgtggatgtggaggagggtatggaggtggcaatggtagtcctgggtacggcgatgacaatggtggtggcagtggcactggtggcggaaatggcaatgctggtgggtacggaggaggaggcggcggttatggaggcggctacggcagtggtagtggtacagcaccaggaggcggatatcatggcggtggtggtgcacaacgctacgctgggcagaactagcaagaacaaccccttatgctagtttatgttaaataaacgatccattgttcatgtgactgagcaatttaagcagtgaaggatcttgactcgtgttatttgtgttaccatatgtattggttgttttatgtttaagatgaatgtacaccgctatttgtatgtcgaactcgttgcatggagatgaaaaaaaggcacaaaaacatcagcaaaccatgctttccttccggtcgaccagatttgggctggtatttattgagtaaaaaaaatgtatctctgggagattgtttcaagtaaaagctagagcgtgacattttgtagcggaaaatcggaacgaaaacatgtccaacgtcgaaattattgtatatattctaatggatatatataacgtaacagaaggaaaattgtttccaagtcattttttcacaatgcaacagtcaaacatggatgcggcgagcgaaggatgcaggtgggttcccctgccgctccaaatcctatagagccctcctaaagactcccctaaaattagatcttatgtttctcattatgtgttttaagattttcattattcatggatgtttcgatataagactattttgaattatcatatttgtctattgtgagtcgtttaggccccgtttggttctattagtcttaggatgtgtcacactcggatttaagggacaaatccgggtgcatctcatacatacgccaaataagacaatatatataataacagagtgtatagagataaatgtc

SEQ ID NO: 17992 - DNA, 840 bp, Zea mays
accccaaggccgggtcctacgtagtcgaggactaccgcaagaaatgggggtcaacaagtctgcagttctgcttggtgtggttttggtctcagtccttctcggcttcctggacgttgtgtacgcaagggagctcactgaagccaatggctctggactgaagaataatgtgaagcctgcaggagagcctgggctcaaggatgagaagtggtttggtggtggatacaagcatggtggagggtatggaaacaaccagccaggatacggcggcggaggaaacagccaacctggatacggcggcggaggaaacagtcagcccggatacggtggaggatacaagcgccatcaccctggtggcggctacgggtctggacaaggagggcctggatgtggatgtggaggagggtatggaggtggcaatggtagtcctgggtacggcgatgacaatggtggtggcagtggcactggtggcggaaatggcaatgctggtgggtacggaggaggaggaggcggcggttatggaggcggctacggcagtggtagtggtacagcaccaggaggcggatatcatggcggtggtggtgcacaacgctacgctgggcagaactagcaagaacaaccccttatgctagtttatgttaaataaacgatccattgttcatgtgactgagcaatttaagcagtgaaggatcttgactcgtgttatttgtgttaccatatgtattggttgttttatgtttaagatgaatgtacaccgctatttgtatgtcgaactcgttgcatggagatgaaaaaaaaaggcacaaaaacatcagcaaaccatgctttccttcaaaaaaaaaa

SEQ ID NO: 17993 - DNA, 3816 bp, Zea mays
ccgcgcctcgaccgcaacaaagactacaggggggagacacatctctccccacctcgcttcgcacctctccagccgccgcctcctccttcgccggcgtcgacgatgggtgactatggccacggcggggggcagatgcggggcaacccggactcccgccccaggggccagggccagcgccctaacgtccagcagctcaagctcatggggcagatccacccgacggggctcacgcccaacctgcttaagctcttcgaaccgcgtccaccgctcgagtacaagcccccgctggagaagcgcaaattgccggcctacaccgggatggcacaatttgtgtcgcactttgctgagcccgaggatccagagtatgctccgccagtacccaagtgtgagaccagggcagagaagaaggctagaattcgcaataataagctcgagcaaggcgcagctaaggttgctgaagagcttcagaagtatgacccacaaagtgaccccaatgctactggagatccatacaaaacactctttgttgctagacttaactatgagacatctgagcagaggatcaaacgcgagtttgaaggttatggtcctattaaaagggtaagtaatgtggtaattcctgtgcaggtgaagttattgcactttggtaaggtttatggatttttcaatcattctaaaatgtaaacaatcattggacaaaactgtggaaaagttgcctcattagtttatggcttccttttaagctcctccgacaagtgtttgcaacaccaggggtccttataaccgctttcttgctccatttcatatctagaatcaaaatctgcagtttcttcatttcctttctggtttctgaaaacttctctggaaatgctttcaaagaaactgggaactctcagtttcatagtcatttttggtaaacttagcatcaatgttttaattgaatttttgtttttggagccaacaacttgtttgctctgtttcacgcacatgtatagtgtttgctctagaatgtattccatgacaactttttttttatggttttgagctgtgaatttgatcatttagctgtaattcattttatttgattacttaattatgaaattggttctagaataaaatattttcagtagttttatacagttcaatgcaatgatgtaaaattttacctagttaagggtatttaaacatcagacaagaaatttttcatggggaggggtgtggagtaactcttggcagttgtgttgtcctaaactaaggaaataacaatcatttctgtggcacagaaggtctacaactcttcacaatctctctttttaagcgatctttataccttttggggcttagatggaatacatttcaaatggaaaattatatagggttcaggcatatgtatgctcgctggtaatttagttaaatcttttggactttcattggaaagccattttactatgtgcatggttggtacaaccaattaatgacaaggcatctctgggaacacaaatatgcgtaaacaggtaattatggctgcacctgtatgtggcccaggttctctatttcctagtacttttttgtcgtcagcaagaaatttcttgagaagagcaaattgcttctaacgaaggtagtaaatggttgagctgttctctcattccacagatttgcatctaccataatggtcaactgggggtaaacaagcttgaaaaatgctgacagtggcacaaattagcatagatcactttgtatttttcaaaaagcagcttgtctgtagacagggattttctactgtatgtaggcttaattgggtaggcttgctggtgagtatagtatttatagttccttcagattagctatgaaagctatcactgctaccaaattttggttgtggagcaatcagcaaccttacacaatactaattgcatctctcaactcctagagtcgaagatccatcgattttgtgcataaggggtatacatcactcacttggtatttatcacctttctgttaacttcgttatcattctgtttgtttggaaaacgaaggctgaacaaatttcaccgatggagggcaacttggtatagtatttagttctatcgtacaccctttcctttagtataaaattccctggtaaggggatatccaatttatttcccaacgtatgccaatcggccagacagcgcttttcctccaactgtgttgatctgtgctggatttcactcctcgtgtggaagctctacatgtgcaaggttagcacggctgttttaggctttatgcctgtctgtcgtgcagcataaaatatgctaaaaattaaaagaacaaacacaattacaactaaaaatataacatattcttaacttcaggggaactttcttattgaatattgtttcattactaaatttgatctttccaggttcgtcttgtaactgagaaagatactagaggatatgcattcattgagtatgtgcacacacgagacatgaaaaatgcctacaagcaagcagatgggagaaaagtggacaacaggagggtattagttgatgttgagcgaggcagaactgttccaaattggcgtcctaggagattgggtggtgggttgggatcaagcaggatgggtggtactgatactgacaaaaaggattccactagggagcaacaacaaggtggacgccctagatcagaagagcctcggagggatgatcgtcgtgccgatagggatcgtgaaaaatctcgtgaaagggtacgggaaagagaccgtgaggagaggacccgtgaacgttcgcatgaccggactcgtgatagagatctacgagatgagaagcatcaccatagagaccgtgagaggactcgggatagggagagaggaaaggaccgtgaaagagaccacggccgtgaccgggagcgtgatcgtcgtgacagggacaaggatcgtggtcgggactatgatagagaaagggaccgtggtcgctctcatgatcgccatcgtgagagaggcagggaccgtggtgaaagagattatgagcgcaccagccatgaacgtgaccgtggtcacatgcatgagagggatgcagactatggcaatggtgggacaaagcatgacaaaaatctgtctagttatgggcaggattatggctatggtcagtatgagcaacacaaaggtcatgatgcatatggttacagtcaagatgtacgtggacatgaaactgaacactcaaagcggcatgagcacgaatattatcgtgttgactcgtatggtaaaatggaagctaactatcagatgccgccaaacaatgctgagccagaaggccctgaggaaggtgaggcatatgaggaaggcgactaccagtatcaccggtctggtgaacacatgaaggaagcttgattgcagcgatgagatttgcctgcagctttatactgatacacaacgatggtttcaatgttggttctttgtatgaattagtttcagctgcatagtgcctgtcagttgtgttcttccatgttggggaattctcaaaaggaagcaaaatcttgcccaactgcgtggatttttgaatttgaagcctatggctgccaatatcttgtggaataagatatttgtgtaatctggttgtggagatccatatgatctgccgttatccatctactcttctgttaagaagttttgtatgacagttccttcaaattatttgttccaacattttgcagaacttcagaattgttgttctatttggccttctaacaaaaagttgcttggtaccaactgcgcccttggtcctctacatccaagcacataggtttcatcaataaaatggaatcatttttttt

SEQ ID NO: 17994 - DNA, 2006 bp, Zea mays
ccggccggcaggggggagacacatctctccccacctcgcttcgcacctctccagccgccgcctcctccttcgccggcgtcgacgatgggtgactatggccacggcggggggcagatgcggggcaacccggactcccgccccaggggccagggccagcgccctaacgtccagcagctcaagctcatggggcagatccacccgacggggctcacgcccaacctgcttaagctcttcgaaccgcgtccaccgctcgagtacaagcccccgctggagaagcgcaaattgccggcctacaccgggatggcacaatttgtgtcgcactttgctgagcccgaggatccagagtatgctccgccagtacccaagtgtgagaccagggcagagaagaaggctagaattcgcaataataagctcgagcaaggcgcagctaaggttgctgaagagcttcagaagtatgacccacaaagtgaccccaatgctactggagatccatacaaaacactctttgttgctagacttaactatgagacatctgagcagaggatcaaacgcgagtttgaaggttatggtcctattaaaagggttcgtcttgtaactgagaaagatacaagtaaacctagaggatatgcattcattgagtatgtgcacacacgagacatgaaaaatgcctacaagcaagcagatgggagaaaagtggacaacaggagggtattagttgatgttgagcgaggcagaactgttccaaattggcgtcctaggagattgggtggtgggttgggatcaagcaggatgggtggtactgatactgacaaaaaggattccactagggagcaacaacaaggtggacgccctagatcagaagagcctcggagggatgatcgtcgtgccgatagggatcgtgaaaaatctcgtgaaagggtacgggaaagagaccgtgaggagaggacccgtgaacgttcgcatgaccggactcgtgatagagatctacgagatgagaagcatcaccatagagaccgtgagaggactcgggatagggagagagggaaggaccgtgaaagagaccacggccgtgaccgggagcgtgatcgtcgtgacagggacaaggatcgtggtcgggactatcggggagaaagggaccgtggtcgctctcatgatcgccatcgtgagagaggcagggaccgtggtgaaagagattatgagcgcaccagccatgaacgtgaccgtggtcacatgcatgagagggatgcagactatggcaatggtgggacaaagcatgacaaaaatctgtctagttatgggcaggattatggctatggtcagtatgagcaacacaaaggtcatgatgcatatggttacagtcaagatgtacgtggacatgaaactgaacactcaaagcggcatgagcacgaatattatcgtgttgactcgtatggtaaaatggaagctaactatcagatgccgccaaacaatgctgagccagaaggccctgaggaaggtgaggcatatgaggaaggcgactaccagtatcaccggtctggtgaacacatgaaggaagcttgattgcagcgatgagatttgcctgcagctttatactgatacacaacgatggtttcaatgttggttctttgtatgaattagtttcagctgcatagtgcctgtcagttgtgttcttccatgttggggaattctcaaaaggaagcaaaatcttgcccaactgcgtggatttttgaatttgaagcctatggctgccaatatcttgtggaataagatatttgtgtaatctggttgtggagatccatatgatctgccgttatccatctactcttctgttaagaagttttgtatgacagttccttcaaattatttgttccaacattttgcagaacttcagaattgttgttctatttggccttctaacaaaaagttgcttggtaacaactgcaacctttgtcctctacatccaagcacataggtctcatcaataaaatgtaatcatttttttttgt

SEQ ID NO: 17995 - DNA, 697 bp, Zea mays
caagcgaattggtacgggcccccctcgagtcgacgtatcgataactttttttttttttttgagtaaaattgttttctactagtttattatttctttctgtttacacgagtaaactattccactgtgataacaacatctcagtctgatgagatttattgagattaattatgttaattattacaaaaccaaacgacaaaagactaaaaacttcattagctagttagattgtggtgtcattgcagcttcttgcacatcataattattgttgacgttattgtgtttgaacgtctcggggatgttgtaatcaacagttgatagttgttttgctgcgttcttgtttacgagagattcatacagccctttgtctaaatgcaaatggagtgcatcgcatgatccagacaagcaagtcagcggtttgcagtacatggtgtctctgaaaccagtcctgtccctattaccattgtatcgaattctgccgcgaccaccacggccaaaattgactctgctgccaccggctcctctaatgcagagaccaggaagacaaaagcccccatcgtaaccaaagtgatttccaacagaccatttccgagagtctatgtcatgggatccaactgctaagctcagcaaaagagatactgagaaggaaagacacatccatttgagttctgccattttggctttctgtgttgatagtttt

SEQ ID NO: 17996 - DNA, 721 bp, Zea mays
ggccattactagacccatcctatcgaaaaaagatgaaagacccatgtctctgtcccgatcttaaccgcctcgtttctcttcctcttctgcgttccgttcaccaccgcagctgcagacggcgatttgccgacggcgtacaccctcctccaaagctacaacttccccgtcgggattctccccaaaggagtcttgtcgtacgatctggacgaacccacggggaagttccacgcgtatttcgacaagtcgtgtagcttcgccctccaaggctcttaccagttggattacaaatcgaccatctccggcgtcatatcggagaacaagctcacgaagctcaccggcgtgaaggtgaaagttctcttcttgtggctcaacatcgtggaggttatcagggacggagacgagctcgagttctccgtcgggatcacgtcggcgaacttcgcgatcgaggagttttacgagtcgccgcggtgtgggtgcgggttcgattgcaatggattgaagtcgaaaacagataatttgcaaatgatgggactttcttacaaaacctgaactctttggatgcttttttttgttcttgctccaatcattggacaagttctttgtttcaacaattggtttattgttcatctcttcttaggatcgttctatcaatcaacgtatgtattgtacttacaatcaataaaagtacatcgataaaaaaaaaaaaaaaaaagcttatcga

SEQ ID NO: 17997 - DNA, 1369 bp, Zea mays
atagctgcaggttcgtctcttccttccctttcacttaacctttcttggtctcgaagcagagtaaaaaaaaaaagcttgggctaaaaagatggcgtctttgggtgtgtcggaaatgcttggtacgccccttaacttcagggcagtgtcgagaccgtctgctccattggcgtcaattcccgccacgttcaagacagttgctctgttctccaagaagaagccagctcctcctcccaaggccaagaccgtctctgctgccaacgacgagctcgccaagtggtatggccctgacaggagaatcttcttgccggatggtcttttggacagatcagaaatcccagagtacttgaacggtgaagttgctggagactatggatatgacccatttggacttggcaagaagcctgagaacttcgctaaataccaagcctttgaactgattcacgcgagatgggctatgttgggagcagctggttgcatcatccctgaagccttaaacaaatatggcgctaactgtggccctgaagccgtctggtttaagactggtgctcttcttcttgatggaaacacattgagctactttggcaagaacatcccaatcaaccttgttctcgctgtagttgctgaggttgttctccttggtggagctgagtactaccgaatcaccaacggcttggacttcgaagacaagcttcacccaggaggcccattcgaccctttgggacttgctaaagaccctgaacaaggagctcttctcaaggttaaagagatcaagaacgggagattggccatgttttccatgttcgctttcttcatccaagcttatgttaccggagaagggcctgttgagaacctttcaaaacatctaagtgatcctttcggaaacaatttgcttaccgtcatcgctggtactgctgagagagctcccactctctaaaacatttctcattttaaggagcttcgaagatgctttgtacactttgtttgatgagagtttctgttgacattgtgaaaaaaacttccatctgcatcttcttgatatattccaatgttacttaattattgcttctaaaaaaaaaaaaaaaaaaacttatcgaaacccgcccacccctcaggggggggctcggtaccccaattccgcccctataacgcaaccaatattaaaccgtgcttccacgggcccgaccgacttaccaaccgcccttacctggaaaaaaaccctcgtcgtttacccaaacttaatcccccttcgtagcacaattccccccttttcgaaacgctgtccccaataaaaaaaataaggcccgccaccgaatcgcaccctccccaacacgacgccgcatccctgaaaggccaaaaggaaacaactgaa

SEQ ID NO: 17998 - DNA, 823 bp, Zea mays
ttttttttttttttttagctagaatccttcttctatagaaacttattacaaaaaaacaattgtacaacaatgtttttttagttgagttttgtttacagagaaaacaatcaatcagcttcttgaagtccatccaaaacaacggacccaaccaacaaaacaacagctccaagagcaaaagcaccgcccaaaacagcttgagcaaccaccagagtagttgagtcatcaggaatcagaaccacagctacaatagcagccgtgagagccgggagtgcagctgaggccaggaccgcaggagatgtaccagctaaagtttcaaggagactgagaagaccgagctcctcggctttggagaagacaccaagcttctcaagagatgacaacgtgactcccaagtcttctgcttttgagagaagaccagatttctcaacgttgcttagtacttttcgcttctctagcttcttgaaaacgtcgacgtttacttcttcgctcccttcgaagaatagtcccgctccgtaccattgtttcttccacttggcgtcatacttgttcacctttttctggggagccattgagacgacggagaaggctgctggtgatttaacggcggagtatgaccggcgaaagcgagggagaacggggttggagagaaactgtgttcgcgggtgagccgcaggagacgatatcggagcgttgacagccattggaggaagatcgaagctatgaaagaaaaggaaaaagctttggagatgtcttcgtgtgttgtttcgccgttcggacactatctgaaaatctctgaggacagaaaactgccacgtcagatgat

SEQ ID NO: 17999 - DNA, 784 bp, Zea mays
  misc_feature (747)..(747): n is a, c, g, or t
  misc_feature (756)..(756): n is a, c, g, or t
  misc_feature (759)..(759): n is a, c, g, or t
ttttttttttttttttcacaaagaaaaatatgtttaaaattgaaatattatatataaatgctattctaccctttaaattcccaatttacaaaactcgaccaacaaatttcaatctccactaaaatcaaataaatatcgaaagaaaaataaaataaaaagtcagacaagaagatcatctccgaagaggtagagaagccgctcaacggcccagctaggttcgttcttaaccggccaatccgcacacgacgacgtattagcagcaagaagcggagttctacaaagaggacacgtgcggtggttatcttcctcgccgtcgttatcatctccgccacagcactcgtagtccagccacctgtcgatacactctcggtggaacacgtggctgcagtttctgagctctctgacctcatctccgtcttccaaatctccaagacacaccgcgcaagtgtcgctgatcagttccggagaccgatccgcggcgtcgcggaacgtcgtcacggcgaggctctctttgatggtttgtgacgagatcggaggagtagatgaagaagaggaggaggtagatctggatcggtagcgtaagatccaagtaaagatccatctcaagagggtgattaagacagccatttggtagagaagttgtgtgacgatgagaccagaatcttcgatgaagaagctcattgttgttgctaggagtaggtagtgagagagaaggggaaggaagaatgaagaatctttccgattagngatgtctangtnatgggtctcgtgcgatttcctgcac

SEQ ID NO: 18000 - DNA, 768 bp, Zea mays
ttttttttttttttttcattggtctaaaggtaaatattaatgacattatttcgttttcaaaatgatataccattagatatcatatacaatacttgcatagttgtagagtacagtatagcagtaggtagcgaaaacgcatacatttttcattattgtgtaccacgacatacattaataagatgctatttgaaaactctagttccacccccacgtaataattattactaagaaaagttgggttaactagatttaatttaggaaattataataactatatatcaattatttcatatcatcatttggctatgcccacggcttcttttcatttattcagtgcgatccatggccacctggagaacaaaatttgggagtgaacacctgtgacgagcgtttgacccggaatttttagcagctccttaaccgttaatttcttgagccacgacatgatgctgagagccgtcaaaccggagccgcccgaggtggctaaacccatagctagcaaaccagtggtaataccagctggtacgagaaccggactgaatacgacgaatagcggcatagtggcgataaatgccacggctgtgccagcgagggataaaccggcgagcaataagaggaacattgcggctatggtagctaaaacggccgttaagaaacccttaaatgtcggatgtgaatgtttctcgtgttttttcttcaacaaccccattctcactatttttgaatggctagaagagagggaacctgcttttcgattaggatgttcta

SEQ ID NO: 18001 - DNA, 1612 bp, Zea mays
atactgcatcataccgcaccggcagtggcggagaaaagagatgagccagccggggccgggagccatcgccgcctcatgcctcccgactccgtgacggcccgcagccacaggccaccggataacgcacacagcggaaccatccaaaaacgcgggagctttcccccgtcaaagcccccaccctaatcccccgtctcgcgcgccaatcaaccagcaccgggagcaggagcaagagcaactcaccctcccctccggcttccgcggaactaggagctgccatgcagcccgacgccaacgctccctcgcaccgcctcgcccgcgtcgccgcgcacctaaacccccagcggccgcagatggaggaaggcgcgtccgcactgaggctcgtggtgtgccgcgccaagggcggcgcgccggggttcaaggtcgcgatcctgggcgccgcgggcgggatcggacagccgctgtcactgctcatgaagatgaatcctctcgtgtccgtgctgcacctctacgatgtcgtcaacacgcccggggtcacggccgatgtcagccacatggacaccagcgctgtggtccgcggcttccttggggcacagcagcttgatgccgcacttacaggaatggaccttgtaatcatacccgctggactccctaggaaaccaggaatgacaagagatgatttattcaacaaaaatgctgggattgttcgtacactctgtgaaggcgttgcaagatgctgtcctaacgcaattgtgaatctgatcagcaacccagtgaactcaactgtccccattgctgctgaggttttcaagaaagctggaacttatgatcccaagcggctccttggagtgacaacactcgatgttgcgagggctaacacctttgtggctgaagtgcttggagttgatccaagagatgtcagtgttcctgttgttggagggcatgctgagataactatattgcccctcctctcccaggttacacctccgagctcattcactcaggatgaaaccagatatttgacagaccgcatacagaatggtggcacagaagttgtggaggcaaaggctggatcaggctccgcgactctgtcaatggcttttgctgctgcaaaattcgctgacgcatgcttgcgagctatgcggggcgaagctggaatcgtggaatgctcatatgttgcatccgaggtgacagaactgccgttctttgcaacgaaagtgaggcttggccgtggtggagccgaggagatcctgccgcttggccctttgaatgatttcgagagagctggtctggaagcggcaaagaaggaactgggcgagagcattcagaagggcatcgctttcatgagcaagtgaagtggtacggagggagatcgtccctgagtcagatccggaccatacgtagtaacgtagatgtaagggtgttgtgatatagtgctcctacctatacttgtaaggccacggtaaaaagaaggctaattaccctttagcaactgtgaccatctacttggcataatggcatggaataaatctttcgtcttcggtggcggacacaaaaaaaaaaaaaaaaacggaaaaaaaaaaaacaaaaaaaagggcggccgtcggcgatctag

SEQ ID NO: 18002 - DNA, 941 bp, Zea mays
tcactatagtggagcggccgcccgggcaggtacactctgtgaaggcgttgcaagatgctgtcctaacgcaattgtgaatctgatcagcaacccagtgaactcaactgtccccattgctgctgaggttttcaagaaagctggaacttatgatcccaagcggctccttggagtgacaacactcgatgttgcgagggctaacacctttgtggctgaagtgcttggagttgatccaagagatgtcagtgttcctgttgttggagggcatgctgagataactatattgcccctcctctcccaggttacacctccgagctcattcactcaggatgaaaccagatatttgacagaccgcatacagaatggtggcacagaagttgtggaggcaaaggctggatcaggctccgcgactctgtcaatggcttttgctgcttctaaattcgctgacgcatgcttgcgagctatgcggggcgaagctggaatcgtggaatgctcatatgttgcatccgaggtgacagaactgccgttctttgcaacgaaagtgaggcttggccgtggtggagccgaggagatcctcccgcttggccctttgaatgatttcgagagagctggtctggaagcggcaaagaaggaactgggcgagagcattcagaagggcatcgctttcatgagcaagtgaaagcggagcggtacggagggatcgtccctgagtcagatccggaccatacgtagtaacgtagatgtagggtgttgtgatatagtgctcctacctatacttgtaaggccacggtaaaaagaaggctaattaccctttagcaactgtgaccatctacttggcataatggcatggaataaatctttcgtcttcggtggcggacaaaaaaaaaaaaaaaaaaaaaaaaaaaaaaaaaaaaaaaaaaaaaaaaaaaaaaaaaaaaaaaaaa

SEQ ID NO: 18003 - DNA, 769 bp, Zea mays
agtctttactttctcctctgcttctgatcacaaaaacctgaaccatctgtggccatggcagcctctctccaatccgccaccacattcctccagtcggcgaagatttccaccgctccttctcgtggcagtgctcacctccggtcgactcagaccgtcggcaaatcattcgggctagaaacttcctctgctcgcctcacttgttccttccagtctgacttcaaggacttcgccggcaaatgctccgacgctgtcaagatcgccggatttgcgctagcaacctctgctctcgtcgtctcgggagcaagtgcagaaggagctccgaagagattgacttacgatgagatacagagcaagacatacatggaagtgaagggaactggaaccgccaaccagtgcccaaccattgacggtggctctgagactttctccttcaaaccgggaaagtacgccggcaagaagttctgcttcgagcctacttccttcaccgtcaaggctgagagtgttagcaagaacgcacctcctgacttccagaacaccaagctcatgacccgtctcacctacactcttgacgagatcgaaggccccttcgaggtttcttctgacggaagcgtgaagttcaaggaagaagacggaatcgactacgctgcagtcaccgtccagcttcaggaggcgagcgtgtgccgttcctcttcacggtcaagcagcttgacgcctcaggcaaaccagacacttcactggcaaattcttagtcccttcgtaccgtggctcc

SEQ ID NO: 18004 - DNA, 695 bp, Zea mays
ggggaccttacctaagacatcttatcggaaaaaaaaaacaattaaaacaaaaatggcgtttgcttcaaagatcatcacatgcctcctcatccttacgatctacattgcagctccaacagagtcacacataacgtgtgggacagtgacaagcacaatgacacagtgcatcagctacttgaccaacggtggtccattgccgtcaagctgctgtgtggcagtcaaatcattgaaccaaatggctcagaccacaccagatcgccgacaagtatgtgagtgccttaaatcagccggtaaggaaattaaaggcctcaatatcgaccttgtggccgcactccctaccacttgtggtgtttcactttcataccccattggtttcaacaccaattgtgacagtatatcgattgccgtgtgaaggagactagagatgtacgaacgaataatcaaagttggcccgactttaacctaaacaatacttctgctattttctattttatgacttgagtttcttattatgtgatccatttcatatggtaataagtaataacgataaaggagctgtctctccttttcgacgctttgatgtatgtacacgtaacataccatcaggaataacactttgtctttctcttacatgtaatatatatgatcacgaggttgcatgaaaaaatgagcttttactaaaaaaaaaaaaaaaa

SEQ ID NO: 18005 - DNA, 928 bp, Zea mays
ttttttttttttttttggcagagcagcatcagttgatctttgcgtttgagaagtccatctctggatgctgagacatgaacttcttgagaatgtcttgcttctgtagctcatcactcgttggaagacccatctgcttttgcctttgatcaaacatcatcttctcaacagtggagcgagtttcagggtcaaggtcagctaatttactgttctccggttcaaccttctgagtatcgatctcaggctcacctttcacacagcatttccaccactccatctgatcttgcttagtcaacagaatcgaaatcatcttttgatcctcgatattccagtagcagtcatcaggcttcacagatcggtagagttctccatcgatgattggatcctgtcccttgagaccaagcttaagacggttctttttgatctcgtatacaacagagcgtgctttagtgccagtaggaactggaatgttaacagtaacctcctggagagtctggacccatgagtagttctcaaggtcataaccatttcctttgttaggagcaatgggggaagcttcttgtttcttctcctccacttgaattggctctgagcttgaagcagccgtggctggcttcacgctctccttctccacaggcttcttcttctcaacactctccttctcagctttcttctcggcctttccaagcttctccttcgccgccctaaccgcggcggagatctcctcctcagcggagggtttcttgagaaaatcgctctgttcggcgagaaagtcgaacactttctccaagaaacttgatgggttcgaggaatcgagcgtcgccctgaagggcaggatcctggggcgggtgctgctttcgtcttcaacctcggagatgatcgccattgtggagggggttttcgtttctagggttttgctgttgaccagctt

SEQ ID NO: 18006 - DNA, 1857 bp, Zea mays
gacccaacccagcagcagcaggcgcagccaggagcggaggagccagcacttgctttccagcggcgatccccacctaccacccccaccttcccgcttaccaagcggagcagtataacgcaggggcttggtccagcgacttctgagaaacgcgccaccagccaacgagcaagggccgcagccggagctccaatggcctccttctcctccctctctgcctcctcctccacctccaccccgtccttcaacctccccgcaaaaacctccgctggcacaggctccctgtcattccacagggcgagggagtcgcagaagtccagggccaggatggtgacggtgcgggcggaggcggttgacacgaccatcagcccgcgggtgaatgcgctcaggccgtccaagaccatggccatcaccgaccaggccacggcgctgcgacaggccggcgtgccagtcatcggactcgccgctggggagcccgacttcgacacgccagccgtgatcgccgaggctgggataaatgccatcagagatggggccacaagatacacgcctaatgctggaactctggagctgaggaaggctatctgcaaaaagcttgaggaggagaatggtctatcatactccgccgatcaggtgctagtaagcaatggagccaagcagtgcattacacaagcagtactcgctgtctgctcacctggcgatgaagttttgatacctgcaccatattgggtcagctaccctgagatggctagactggctggtgcaacgccagttattctccctacaagcatatcagacaattacctgctaaggccagagtcacttgcctcagtgatcaatgaaaattcaaggatcttgattctctgctctccatctaatccaacagggtctgtgtatcctaaggagttgcttgaggagattgctgctatagtcagaaagcaccctagactcctagttttatccgatgagatctatgagcatattatctatcaacctgctaaacacacaagctttgcttcattgcctggaatgtgggaaagaacgttaactgtgaatggattttctaaggcttttgctatgactggttggagacttggatacttagctgcccctaaacattttgtcgcggcctgtggaaagatccaaagccagtatacctctggagccagtagtatatcacagaaggcagggcttgcagctttgaacctaggttatgctggtggtgaagcagtatcaaccatggtgaaagcattccaggagcgtcgtgattaccttgtaagaagctttagggagctgccaggtgtcaagatatcggaacctcagggagccttctatttattcatcgacttcagctcgtactatgggtctgaggtggaaggttttggtaccatcaaggactctgagtccctctgtctgttcctgttggagaaggcacaggttgcgcttgtccctggggatgcatttggcgatgacaagggtgttcgcatttcatatgctgcagctatgtcgacactgcaaactgcaatgggaaagataaaagaagcgatggctctgctcaggccccctgttgccgtttaacaaaaccaacgtatcgctaatcagttgtggaccaaaggcttctgcaatgcactatcatattaaatacattcagttgacatgatctatcttcttccctttatggaaaaaaatgttgctgctgtcatttggctttggtttgtatctgaagatttatatgtacttgctataatatagatgaactgtgcaacgctttttttacctgcaagaatagaaatggtaaacatgactttattttgacaaaaaaaaaaaaaaaaaacaaagcggccaaaaaaaaaaaaaaaa

SEQ ID NO: 18007 - DNA, 597 bp, Zea mays
ggggattgggttcccggccccccctcgagtcagattcgtaggccccccccccccccccggacttcaactaagggagtgatggagctgtggaagcgatacggacattcaaaacaagctatcatacgtgatgcgaaagagttgaatgatcgctatagttcgcaaggtgttactgcgtactctgttcatccaggcatcgtcaaatcgaatctgcaaggccacgacccgacccttataggaaaggtcatccgggtggcgatgaagctcgggcctagtgacacgcctctccatggagcactcaattcactgtattgtgccacgagccccagtgcaccggtacaagggcagggaaggttctttgttccggttggcaagccggattcacgtgcggacaaatggatcagggacagagagggaaattcacgattgtgggagctgggagagagtcaattgaaacgcctactataaggtgttttgctcttatttggctgggttattacaatagttatagaaacgttcacatggtggatagtaattagttcttttcattaataaatctgttatgttaaaaaaaaaaaaaaaaaaaaagaaaaaaaaaaa

SEQ ID NO: 18008 - DNA, 1378 bp, Zea mays
ggcctccccctccactagccccaaattctccgtctcctcctgtccctctccgcgtccaagggttgcagccatccgcatccaccggaccccaccgggaatggcggtttgagtaagttcccgtaccagggttcttcgatctgggaggccgaggggacaccgggtcggagtgaggggccgccatggcgagcgacgtgcccatgaccccggagctcgagcaaatcgacggagagatccacgatatcttccgcgccctccaaaatggattccaaaagatggataagattaaagattcaaataggcaagctaaacaattggaagatcttactgtgaaaatgaaggagtgcaagcgcttgatcaaagagtttgatcgcattctcaaagatgaggagtcaaataatccacctgagatcaacaagcagctaaatgacagaaaacagttcatgatcaaagagttgaattcctatgtcaccttgaggaaaacataccaaagtagccttggtaacaacaataagagggttgagctctttgatatgggtgctggaagtagtgagcctgctgctgaggacaatattcaaatggcatcagccatgacaaatcaacaactcattgatacgggaaggaaccaaatggaccaaacagatcaagctattgaacgttcaaaaatggtcgtagcacaaactgttgagactggagctcaaactgctgcgacattaacacagcaaacagagcaaatgaagagaattggtaatgagctagatactgtccacttctcactgaagaaagctagccaactagtgaaggagattggtcgccaggttgcgactgacaaatgtatcatggcattcctcttcctgatcgttttgggtgtgattgctatcattgttgtcaagatcgtccatccgaataacaaaaacattcgagacattccagggctggccccgcctgctcaaaactatcagattcacaacaggagattgttgtgggcagaagcttccataggcatgtgatggctctgaatgtaggcttcatgtggacgcactgcctgcgaagcagcagctatccatagggcgaaagatacatagtaacaattctttgtgcctgtatatctattttgtcttgttaactccgagccctaggtctgtattcctgcgtctggtgtttgtacaccgctggccgtttggctgtgtatatggtacagagatgagatcttaaaaccaaaccagtaattatgacaaatacttgaaagagctacagtaccgaaatactccagttggtactcgctgcacttcatgggcgaatatataaagggtgccggttgggccgtgtaacacattctgaattccgaagacccatgaaaagaatgtgaacgtttaaggct

SEQ ID NO: 18009 - DNA, 1288 bp, Zea mays
tttcggccgggtaggccctactcactgtggaccccaatccccaactgctccggctcttcctcgtcgtcttcctctccgtccccgtccccgtccccctctcggcctccccctccactagccccaaatcctccgtctcctcctgtccctctccgcatccaccggaccccaccgggaatggcggtttgagtaagttcccgtaccagggttcttcggtctgggaggccgaggggacaccgggtcggagtgaggggccgccatggcgagcgacgtgcccatgaccccggagctcgagcagatcgacggagagatccacgatatcttccgcgccctccaaaatggattccaaaagatggataagattaaagattcaaataggcaagctaagcaattggaagatcttactgtgaaaatgaaggagtgcaagcgcttgatcaaagagtttgatcgcattctcaaagatgaggagtcaaataatccacctgagatcaacaagcagctaaatgacagaaaacagttcatgatcaaagagttgaattcctatgtcaccttgaggaaaacataccaaagtagccttggtaacaacaataagagggttgagctctttgatatgggtgctggaagtagtgagcctgctgctgaggacaatattcaaatggcatcagccatgacaaatcaacaactcattgatacgggaaggaaccaaatggaccaaacagatcaagctattgaacgttcaaaaatggtcgtagcacaaactgttgagactggagctcaaactgctgcgacattaacacagcaaacagagcaaatgaagagaattggtaatgagctagatactgtccacttctcactgaagaaaagctagccacctagtgaaggagattggtcgccaggttgcgactgacaaatgtatcatggcattcctctttctgatcgttttgggtgtgattgctatcattgttgttaagatcgtccatcccaataacaaaaacattcgagacattccagggctggccccgcctgctcaaaactatcagattcacaacaggagattgttgtgggcagaagcttccataggcctgtgatggctgaatgtaggcttcatgacagctatccatagtaacaattctttgtgcctgtatatctattttgtcttgttaactccgagccctaggtctgtattcctgcgtctggtgtttgtacaccgctggccgtttggctgtgtatatggtacagagatgagatgttaaaaccaaaccagtaattatgacgaatacttgaaagagcg

SEQ ID NO: 18010 - DNA, 2381 bp, Zea mays
ttttttttttttttttccttgacaagtcattaaactgtttgaacctgaaaaaagaatccaatccagagttctcaatacttgtctcgtgagtttgtccgctaacatattcaccttcttgatccttaacatatttggcatgtggcttacaagcacaattgcatatttcctttacatttggacagtactcatacagacatacacaatgtatctgcacggcaaatggtcaggtacgagggcaagctaagctaacaatcgcctcacttgtttccgagtccgaacaaggacttgatggcgttgatggcgttctcgttgatgaacgactcgtcgtagttcttcagcaagggctcgaactcctccgacttcctcaggttcgcgagatccgggtcggtgcgaactgccttgaagtcttcataccctgacttgagcgcatcctccagcgcagaaagcgcagcctctacccggcccagcttcgagtagctgcaggcgacgttgtagctggcgatggcggcctcgctgggctccggcttcgaccccagaaccgactcgaacttctccagcgcctcctcgtacttcccccccctgcatttctttcctttccccccgttagtccaaagagacttttttttttcggaactgaagcaaagcaagcaatcgcatagcgctgtcagttcaccgacttgtacagcttgagccccatgcggaggtcctcttccctctgcatcttctgctccatcttcctctggtagttttgcagctgcgggggggagttttgcagagacatggcaggcagtgagcaaaagaacaacaaccattctgcgcatttcattgctagctacacgcctacactactacttctgttctacttctactccactcacctggatctcccgcaccctgccgctgaccactccggagttcctctcgaacctgatgatctccttctcggtgaggtcgccggcgccgtcccacttacctgaactccagagtgacccagtcagcacatcagcatgcagcaagaggagaaggagaactcctcagttcccatttcttgttacaatagcggggggagggctcaggggctcagggctgggttctcttctcaccaaacctcctctccatcttcatgtacagagggccgatcctctggcggatgcagtacatggtctggccgtaccccgccgccggccagatctcctccccgaagacggagctggtggccagcaccttgtcgcccacctcgaactggccggtcaggtcggcggcggcgccgggctggatggcctccacgtacgtgccgccgtcgcggcccttggtgaacttgagcccgtacggcttctcgatcgtcacctcgtactcctcgtacggccgctcctcctccgctcccccgccgccgccgcccgcctcggcggtctccgccttcgcctcagacgacgcccgcgcgacgacgacggcgtccagggccctcctccgcgcgccgggaggccgaagcctcagggtccggccgccgaggaccgcggccgccggctggagcagcagcagagcgttgctgctggctcttgggaggcggcgggcgggggaggagagcgtcggcggcggcggctggttagcggcgacctggctagccagcgccatggctattggctaagctaggagtaggagaagcttaactgcgttgagttagctgcggcgcgatgttaaactccgcccggcaccggcagcaccgcagcagcagctgagctcttcttctcttgctcttggtcttgggctcgcgaatctgtgttctgtggtggtgcagatgaggaggaagaagaggaggaggaagagacgcttctgttctgtggctcatcctgcgctgtgtggcgccaagagggcttgcagctcaggcgtgagacggaggccacacaccagagcacggacacactgggaagaacaaagtagctaacggctgaggactgacgactgagggagtgacagggccggtgtccggcgccgggcgttagtacgtacgtgtcaccttccatgtcagtagaaagtttatctttttccccccttttgaacagaaaagaaaaaaaaaagcctttttcccccttttcatttgcataacggaaaatccatctggctttattccatcaagaggctcttgaaatcggaccccacctgtcacaaagttcactcaaacacacgactcaaaagacaaaaagttctctcccaatcccagtccatcatttttctcgtcacacagcgttcttgacgatggaagcttgatgcatagttaagatagatgatgatggggggcaacaaagaaagacaactatagaccctaccggtttgagtacccgagtgaattccacttttttaagttaccacaatctcattcgagg

SEQ ID NO: 18011 - DNA, 1475 bp, Zea mays
ttttttttttttttttccttgacaagtcattaaactgtttgaacctgaaaaaagaatccaatccagagttctcaatacttgtctcgtgagtttgtccgctaacatattcaccttcttgatccttaacatatttggcatgtggctgacaagcacaattgcatattttcctttacatttggacagtactcatacacacaatgtatctgcacggcaaatggtcaggtacgagggcaagctaagctaacaatcgcctcacttgtttccgagtccgaacaaggacttgatggcgttgatggcgttctcgttgatgaacgactcgtcgtagttcttcagcaagggctcgaactcctccgacttcctcaggttcgcgagatccgggtcggtgcgaactgccttgaagtcttcataccctgacttgagcgcatcctccagcgcagaaagcgcagcctctacccggcccagcttcgagtagctgcaggcgacgttgtagctggcgatggcggcctcgctgggctccggcttcgaccccagaaccgactcgaacttctccagcgcctcctcgtacttcccgtccttgtacagcttgagccccatgcggaggtcctcttccctctgcatcttctgctccatcttcctctggtagttttgcagctggatctcccgcaccctgccgctgaccactccggagttcctctcgaacctgatgatctccttctcggtgaggtcgccggcgccgtcccacttaccaaacctcctctccatcttcatgtacagagggccgatcctctggcggatgcagtacatggtctggccgtaccccgccgccggccagatctcctccccgaagacggagctggtggccagcaccttgtcgcccacctcgaactggccggtcaggtcggcggcggcgccgggctggatggcctccacgtacgtgccgccgtcgcggcccttggtgaacttgagcccgtacggcttctcgatcgtcacctcgtactcctcgtacggccgctcctcctccgctcccccgccgccgccgcccgcctcggcggtctccgccttcgcctcagacgacgcccgcgcgacgacgacggcgtccagggccctcctccgcgcgccgggaggccgaagcctcagggtccggccgccgaggaccgcggccgccggctggagcagcagcagagcgttgctgctggctcttgggaggcggcgggcgggggaggagagcgtcggcggcggcggctggttagcggcgacctggctagccagcgccatggctattggctaagctaggagtaggagaagcttaactgcgttgagttagctgcggcgcgatgttaaactccgcccggcaccggcagcaccgcagcagcagctgagctcttcttctcttgctcttggtcttgggctcgcgaatctgtgttctgtggtggtgcagatgaggaggaagaagaggaggaggaagagacgcttct

SEQ ID NO: 18012 - DNA, 915 bp, Zea mays
ccggccggggacaaaaaaaaaaaaaaaacgcgtcgctctactcggccgtcatacgggcgccgtcaacgtcctctccacgcgcctcgccgtctactccgtcgaccgcgtcggccgccggatgctgctgctggaggccggcgtgcagatgttcctgtcgcaggtggccatcgccatcgtgctgggcatcaaggtcaccgaccactccgacaacctgggccacggctgggccatcatggtcgtcgtcatggtctgcaccttcgtctcctccttcgcctggtcctgggggcccctgggctggctcatccccagcgagaccttcccgctggagaccaggtcggcggggcagagcgtcaccgtctgcgtcaacctgctcttcaccttcgtcatcgcgcaggccttcctctccatgctctgccacctcaagtacgccatcttcgtcttcttctccgcctgggtcctcgtcatgtcgctcttcgtcctcttcttcctgccggagaccaagaacgtgcccatcgaggagatgaccgagagggtgtggaagcagcactggttctggaagcgctacatggacgacgacaaccaccacatcgtcaacggcaagctcaccggcgcctccgtttaactactccgtctgctctgttcatgcatcagactcacttgatagtactacagcactactactgcaacaccgcaaccgcaatcccgatggcaattgctagtactgcaactgcgatggcaatgccgccttgttgttgtacaatagcccagtgtttcggccagagtccgtgctcatctttgatttgtagtatctttcaattttcaagcagagtttacacggattgtaatcacatccttgcctggtcatcgaaacctacatgtgtactatttccggcgccataacgtgtggttgattcg

SEQ ID NO: 18013 - DNA, 6135 bp, Zea mays
  misc_feature (1175)..(1175): n is a, c, g, or t
  misc_feature (2683)..(2683): n is a, c, g, or t
  misc_feature (2748)..(2748): n is a, c, g, or t
catacaacaagtaacagtgtatcatctatgagatcacagttgcgcagctgcggctgaagacttggatgacgttgtggcccactgattcgggagcccacatgtcacaggggagaagaactcgcacagctattcgaacgcctcgggcggagcgcctaggacgaactagccgttaacctccgggctccagcctccaacgttcccttttcgcatcgccctgccggctgccgctcgcccttttctctgtttcccaattcccatacgcatggaaacatctcgtcgacccaaacccatccacccacaaggcggaatacacgatccagtccgatcctcgccccgcgcgctgctccaaaccctggcgatgtcgacggcggcggccgcgaagactccgatcaaggccctgggctccgcggccgcgggtgccatgactccgaccaaatctcaggcccccgcggcggccaagacgccctgtacctctcgcgcgcggtcctcccacgcatccgagaattccaaccccaacatcccgggcacgccgcctcccccgcagtcgacgccgtccaagcccagcctcaagtccccggcgggcgcgggagccaggtccgccaccgcgaagaaaaagccctccacgcccgcgcccgccgcgccaccgctggagcgggagcgggagcggcgattcctcgtggcgaagaagggcgcgcggcggaggcgcaacgtcgggaccatgggaggcggcgggggcggccgcgggggagagatcgacttcgacaagtgccgcgaggccgctcgcgaggcgctgcgcgcgtcgcagggggagttcttccgcaaggaggtcgccgcatccacagccaccggagaggatcaattgggacaggaggaggaggggaagccgctggctgacgaggatgtgaaaggtggagcattcgaggagcggcaggaggaggagaccgacgcggagctggaggggagcagcaaggttagggcgatgaggacgaaggcgatggctaaggcgatgagcagcgttccgaatcctggctctggccgcgtcaagcatatggtgcaggccttcgagagcctgctcaacatctccggcgccacctccgatgctgaaagggccggtgagggctcatgggcgctgcccgggttgcagctatggaaggaggatgataagggtgatctgnggttcccaccagtgtcggtgttctcttctgctgatttccagaatgcagggtctaatcgactctgctcgtcactagatggaaacaccgtcaggttggttgacgtcgacaaacaagcggaaggaagtgttttatgattttctctgaaacacaattttctggtaacagtttgtcactcattttaggtcgagctgggacagcagaacatcgactggcgagtgcagcaggagaaatgtaagcctggcacagttttaatttctacttgagttgggtcatggtggatcatattctcatagccgaatgtattcttgctctctgacagtcatctgagtcactaaggagcagaacatcggctggcgggcgcagaagcaggagaaacgtaagcctgacataggtttagtttctatttggcttgggtcatgttagagcatgttctaatatctgaattcatgcttgctctctagcagtcatctgagtcactaaggagcagctggaacaaaaagctcaaggtcaccagccagcatccattcaagttgaggacagaggtaataacgcatcctcagtgttgtcgcagtcatgtcctataagttgacatacatgcttcagctagttcgtgaaaatttagtcaccatgttttctttgcgataacagcaaaggggaaagtttaaggaacagcagttcgtccaaaaggtgcaagagatgcttgcagaggaagagaagaagcgtattcatattgcgcaaggattgccatggactaccgatgaacccgaggtatgtttaactaactcatattgcgcagaattttgtgtttagggagtgtttgaatgtaatagagctaatagttagtgactaaaattagttgaggcatccaaacaccctagctaatagttcaactattaactatttttggtaaatcagttaatagttaggtagctatttattagctagctaattccactaataaattttagtcaactaactattagttctagtgcattcaaacaccccttaagatcttgacaaaattgtgattttttctcatttcagtgtttgataaagcctgcagtcaaagaaagaactgagccgatagaccttgttttgcatagcgatgtgcgtgctcttgaacgtgcagaatttgatcagcacgtgagccccttaaaaacttattttacatactttactatctgagatgtaatgccattggagttaatcgatatacctattatgtttgatcatgttctttttgagaacttaggttttggataggaacaagtttgctgagcaacaaagattagaatgggaaaggcaacaggaattagacgaagaagaaaggataaggcaactgaggagaaccgagctgattcctaaagctcagcccatgccatactttgaccgcccattcatccccaaaaggtgatgaccgagttagattttgactcatttacaggcctgataagttaccttttattctttttttactgttggtttgctacctcgatacttgagagatntattgtcatttacagaactaaccttttttcatccgttttatcggcataggtccacaaaacctccnacagttcccatggaaccgaaattctacctcaggccagaaaagttatcctggtgagcttttacttccaaaaaatataactaagttgacatatttatgcgcaaaactactttcccgaaccctgaatttatttatctgtgcaaagcatgctcaccatgcttggttacgtgttaatggtggctgacagttactatcgacagcaatgtatggaacttggaaagctgaatccacaacatcagtgccaacatccgctgtggcaatcgagaaatgcagagcatcgacacacatgatccaacaactgtttccatttcctggcatcgtcttattcattcttgattcgtcttcttccatgtgcgaagaaattgctatcaagcgtgtttttgtagctttgcttggatcgccttgcctccaagttctgttaatcgctggctctgtgcttcagatgcaatcccaccgaggtttgaaatttgtcgttcaagaaactgataaggaaattcaaggatgaattttctgtggtatattaatatgtactttaatgttggttcttgcccgctatgcatgagcccggcagtcccagtgtgcttttatatggtagtttctatttgtgcttaagtatataatataagagaaaaatatgttgtatatgagtttagaaccaacaattatggttcgaacctttatgtctgcatggttttggcatttaactatgagttagcacaatggccatagaaaccgtgaaactagagaaactggtgttttaatatagtagatagagaagataagagatggtctagtaatatgttgcagttgctgacctggttgtgtatgtgcagaagtgtagcaatctgaaacttcgaacaattcaattcaatttctgcgctctaacgtgttcatttgatgtacactcaattcttcccgcgaacaaaatcgtttcatgagcaacacaaaaatgttatatcagagttatctttattaaatttacaaaggaatttgtttgcatctacactactaaataaatatattaccaaaacatatattataatgcatttaattaaactaactcgttgttagtgtctttttcaataaaattggtcaacttatataactcgtacacacctattttgggataaagagagtatatagctgtaaaaaaacttgttgagcgggatgcattaattgacggttgatgcaaaacgaatgaatttgtaaaaatgtcaaagaaatatgtattaaaaagtgtgtcacttgagatctcgtataaaagcaaaaggtgctcacaagtcacaatagattcaatcattttctttgttagattaggcacaacctgctcaggcagtgaggcaccgtctagtaaagcctgatttggtggacagaaaattagagggatttatggggtatttctcttccatgtcccgctttttgctttttgttccgtattttgcaattcgggaagaagtcctgactgcctaatccagtgacaagctttaggcccagggcccagcgcatgagcattgagcccatccagtcttcattccccgagagcgagacgcttcaatgacctcttcggtacctcgcggccggcccgcgtaagctattctacgcgcacggcgcacccagcgcttctccttccgtccttggcaaccaggcccaggcatcgtttcaccgctattcctcctgccccatctcctcccgatccatccgagcccaaaccctagtccagccagatctccaccgccgccggcgagagcacggcatcagatccgccgcgatggcgttccgccgcatcttatccacagcggtgcgccgccgctcggccatcgccgcggcagcgtccgggaacgcgcgcgaggcctccacggccgtcgccgcggcgcccggcgtgctagcccccgacgcgaccccggtgcgcgctcccgtgatgccgtacgatcgcatcgccgaagccgttaacgccaggctccggcggcttgagcacccagacccgcgcttcctccgctatgcaagccccgttccgtcccacgccgaccacacggccatccttgcggcgccggagacccgggtcaccacgctgcccaacggcctgcgcgtggccacggagtcgtccctcgccgcgcgcacggctacggtgggtgtgtggatcgatgcgggcagcaggtacgagaacgaggaggcggccggcgtcgcgcattttgtcgagcacatgctgttcaagggcacagggaagcgtagcgccgcgcagctggagcaggagattgaggacatgggtggccacctcaacgcttacacgtcgcgggagcagacgacctactacgccaaggtgcttgacaaggacgtgccccgtgcgatggaggtcctcgcggacatcctgcagaactccaatctcgaccaggcccgcattgaacgtgagcgcgaagtgatcctacgagagatggaagaggttgagggacagtctgaagaagttatatttgatcatctccatgcaactgcattcccatatacatcccttgaccagtctgggtaataatcactaatcagtcatttgttttatctatgttcgttactctcaatggttaagtgtatcgatctgttgaacttttttgtctttttattgaggaagtttttatcttcttaaagatattgtcttatttacctcagataagatgcattatgtgttctatggtgtgtgatgaaaatctttctggtttgttgttagcatttctactagtactaaagccatatcataattcataaagagggtaatgcatttcgacatgggatagttttctggaaaatttagagtaaggaaacaaggtgagtaatctgctaggcgtttgttcctcttaaacttgctgagaagttagctgggcgaaatcatatttttttagcgggcaaggagatgaaagggttgaagacatctagccaatacctgtctcataagcaacttgttttggatcctttgttcactatagtcatcaacccttgtaattgcttttgcttgttagtaattctcaatttggttaaacatccaaggtgttgtgtatagtaaaatatatgtgttcagtgttatgaaatgctttttgcttaaatgttctgtctgtttcttccttgcataggttgagggacagtctgaagaagttatatttgatcatctccatgcaactgcattccaatatacatcccttggcagaccaatcttgggttctgcagataacgtcaagtcaatcaccaaagaggacctcgagaactacattgcaactcattatacagcttctagaatggtacataatatttaaaattttcagctgcaatgcatctgcgccattttatgttcctgttattagagtatgataggaagtatttctgcatgttttcaggttatcacagctgcag

SEQ ID NO: 18014 - DNA, 2214 bp, Zea mays
gcacgagaccattacctagaacatcctaatcaaaagtaagctattctacgcgcacggcgcacccagcgcttctccttccgtccttggcaaccaggcccaggcatcgtttcaccgctattcctcctgccccatctcctcccgatccatccgagcccaaaccctagtccagccagatctccaccgccgccggcgagagcacggcatcagatccgccgcgatggcgttccgccgcatcttatccacagcggtgcgccgccgctcggccatcgccgcggcagcgtccgggaacgcgcgcgaggcctccacggccgtcgccgcggcgcccggcgtgctagcccccgacgcggaccccggtgcgcgctcccgtgatgccgtacgatcgcatcgccgaagccgttaacgccaggctccggcggcttgagcacccagacccgcgcttcctccgctatgcaagccccgttccgtcccacgccgaccacacggccatccttgcggcgccggagacccgggtcaccacgctgcccaacggcctgcgcgtggccacggagtcgtccctcgccgcgcgcacggctacggtgggtgtgtggatcgatgcgggcagcaggtacgagaacgaggaggcggccggcgtcgcgcattttgtcgagcacatgctgttcaagggcacagggaagcgtagcgccgcgcagctggagcaggagattgaggacatgggtggccacctcaacgcttacacgtcgcgggagcagacgacctactacgccaaggtgcttgacaaggacgtgccccgtgcgatggaggtcctcgcggacatcctgcagaactccaatctcgaccaggcccgcattgaacgtgagcgcgaagtgatcctacgagagatggaggaggttgagggacagtctgaagaagttatatttgatcatctccatgcaactgcattccaatatacatcccttggcagaccaatcttgggttctgcagataacgtcaagtcaatcaccaaagaggacctcgagaactacattgcaactcattatacagcttctagaatggttatcacagctgcaggcaatgttaaacatgaagacattgttgagcaggcaaagaagttgttcagcaagctatcaactgaccctacaacaacaaacatgttggtctctaagcagccagcctctttcactggttctgaggttcgaatcattgatgatgacatgcccctcgctcaatttgctgttgctttcaatggagcatcatgggtggatcctgattctgttgcactgatggttatgcaaacaatgcttggttcatggaacaagagtgctggtggaggaaagcacatgggttcagagcttgtgcagagggcagcaatcaatgacatcgctgagagtgtaatgggattcaatacgaattacaaggacactggtctttttggtgtctatgctgttgctaaggctgattgcttggatgatttggcttttgcaattatgcatgagatgagcaaattgtcataccgggttacggaagaagatgttatccgtgcacgtaatcagctgaagtcctctatccaactccaccttgatggttcaactgctgttgttgaggacattggccgtcagctgctgacctatggacgaagaattcctacccccgagctttttgcaagaatagatgctgttgatgcaagcactgtgaagcgtgttgcaaaccgcttcatctttgatcaggatgttgctattgctgcgatggggccgatccaaggacttccagactacaactggttcagacgccggacctacatgctccgttactagattaatcagccggtgtacccatgtttaccgtctgcaaaagacaagataaaatttgcctcttttagcgtcagtatattaaggcctcagcactgcacattacgtgctgcgatggaggaattttttgagaatttgttttatttcttgtcgtgtccaaaatccacaaatctgtcaataatgataggcaggttcgactgacgtggctgacttggttggccaccggatgttttcttacaacgagtcatgaaccataccgtcccatcttttgttggaagattttactttggcaaataattttgtggcacgttatatgtaaagatggtacagttttagcttcattgtccacaaatcttgttttgaacgattaaaaaagagaaaaaagcggacggccgggcggggggggggg

SEQ ID NO: 18015 - DNA, 2448 bp, Zea mays
aaaacatagtagaatggcgtagcctttctctatgacacgtgccccttcccccctcttaagctaagggacccttgggcagcccggcatcttctccattctccaccctctgcccctctcgatttcttcttcccatctcccgatccatcgcaacccaaaccctactccaggcagatctccgtctccgccgccgctgccggcgtgagcacagcatcagatccgctgtgatggcgttccgccgcatcctatccaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccgtatgaccgcatcgccgaggccgtcaacgccaggctccggcggctcgagcacccagacccgcgcttcctccgctacgccagccccgtgccgtcccacgcggaccacatggccatccttgcggcgccagagacccgggtcaccacactgcccaacggcctgcgcatcgccacggagtcttccctcgccgcgcgcacggctacggtcggcgtgtggatcgatgcgggcagcaggtacgagaacgaggaggcggtcggcgtcgcgcattttgtcgagcacatgctgttcaagggcacggggaagcgcagcgccgcgcagctggagctggagatcgaggacatgggtggccaccttaatgcgtacacgtcgcgggagcagacgacctactacgccaaggtgcttgacaaggacgtgccccgtgcgatggaggtcctctcggacatcctccagaactctaatctcgaccaggcccgcattgaacgtgagcgcgaagtgatcctacgagagatgggggaggttgagggacagtctgaggaagttatatttgatcatctccatgcaactgcattccaatatacatctcttggcagaccaatcttgggttctgcagagaatgtcaagtcaatcaccaaagaggaccttgagaactacattgcaactcattatacagctcctagaatggttatcacagctgcaggcaatgtgaaacatgaagacattgttgagcaggcaaagaagttgttcaataagctatcaactgaccctacaacaacaaacatgttggtcgctaagcaaccagcctctttcacgggttctgaggttcgaatcattgacgatgacatgccccttgctcaatttgctgttgctttcaatggagcatcatgggtagatcctgattctgttgcactgatggttatgcaatcaatgcttggttcatggaacaagagtgctggtggaggaaagcacatgggttcggagcttgtacagaaagcagcaatcaatgacattgctgagagtgtaatgtcattcaacatgaattacaaggacactggtctttttggtgtctatgctgttgctaaggctgattgcttggatgatttggcttttgcaattatgcatgagatgagcaaattgtcataccgggttacagaggaagatgttatccgtgcacgtaatcagctgaagtcctcaatccaactccaccttgatggttcaactgctgttgtcgaggacattggccgccagctgctgacctatggacgaagaattcctaccccagagctttttgcaagaatagatgctgttgatgcaagcactgtgaagcgtgttgcaaaccgcttcatctttgatcaggatgttgctattgctgcgatgggaccgatccaaggacttccagactacaactggttcagacgccggacctacatgctccgttactaagatcaatctgccggtgtaccatgtttacggtgtgcaaggacaaagataaaatttgcctctttcggcgtctgtatatcaaggcctcagcactgcacatcgcttgctgcgacagaggtttttttcttcttcagaatttgttttatttcttttcttgctcagaatccacaaatctgccaataatgataggcaggttcgactgacgtggcttacttgggtggtcagcctatgttatttttcttacaatgagtcatgacccttaccgttccatcttttgttggaaggtttttactttggcaaataatttgatgtggctcgttatatgtaaagatggtacagttttagcttgtgcaatttttttataccttcttggaaggttattacaaagaccaggtaactgttgcgagaactaaccagtttgtactgctcccaacccttgtaaaccaagtgacgtggaggttccccacttgccccccccccccggacgtggtgtacatgcgggatccaatggcctcctcgccatgactcgactcttcacttgtatatatatatgatgggaatgcaataaagaaacagtgccctcgcgttcaaaaaaaaaaaaaaaaaaaaaaaaaaaaaaaaaaaccccaacaac

SEQ ID NO: 18016 - DNA, 3929 bp, Zea mays
tacctcgaggccggccgggatcttctcacccctctgcccctctcgatttcttcttcccatctcccgatccatcgcaacccaaaccctactccaggcagatctccgtctgtgatggcgttccgccgcatcctatccaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccgtatgaccgcatcgccgaggccgtcaacgccaggctccggcggctcgagcacccagacccgcgcttcctccgctacgccagccccgtgccgtcccacgcggaccacatggccatccttgcggcgccagagacccgggtcaccacactgcccaacggcctgcgcatcgccacggagtcttccctcgccgcgcgcacggctacggtcggcgtgtggatcgatgcgggcagcaggtacgagaacgaggaggcggtcggcgtcgcgcattttgtcgagcacatgctgttcaagggcacggggaagcgcagcgccgcgcagctggagctggagatcgaggacatgggtggccaccttaatgcgtacacgtcgcgggagcagacgacctactacgccaaggtgcttgacaaggacgtgccccgtgcgatggaggtcctctcggacatcctccagaactctaatctcgaccaggcccgcattgaacgtgagcgcgaagtgatcctacgagagatgggggaggttgagggacagtctgaggaagttatatttgatcatctccatgcaactgcattccaatatacatctcttggcagaccaatcttgggttctgcagagaatgtcaagtcaatcaccaaagaggaccttgagaactacattgcaactcattatacagctcctagaatggttatcacagctgcaggcaatgtgaaacatgaagacattgttgagcaggcaaagaagttgttcaataagctatcaactgaccctacaacaacaaacatgttggtcgctaagcaaccagcctctttcacgggttctgaggttcgaatcattgacgatgacatgccccttgctcaatttgctgttgctttcaatggagcatcatgggtagatcctgattctgttgcactgatggttatgcaatcaatgcttggttcatggaacaagagtgctggtggaggaaagcacatgggttcggagcttgtacagaaagcagcaatcaatgacattgctgagagtgtaatgtcattcaacatgaattacaaggacactggtctttttggtgtctatgctgttgctaaggctgattgcttggatgatttggcttttgcaattatgcatgagatgagcaaattgtcataccgggttacagaggaagatgttatccgtgcacgtaatcagctgaagtcctcaatccaactccaccttgatggttcaactgctgttgtcgaggacattggccgccagctgctgacctatggacgaagaattcctaccccagagctttttgcaagaatagatgctgttgatgcaagcactgtgaagcgtgttgcaaaccgcttcatctttgatcaggtactgttttggcaacctagaacctctcaccctgtagaacgttcagcatctttatgcttccttctctagtaaattctaaaggtagctctttttttcgttgggcactcattatttaagatgtactactctttttgtcgtgaagcaatatcatgctgtttttgtggtagacctctagtgataggattgtatggtttcatgttgtgcttcttatgcttacaactaatccattggatgacttgcaatcagatctcttcggtgtgcagttcaaagctaagcatctactttgccttcagtaacttagtttgggaaaattaaaaaaactggaaaaataaaagaactattctttgaattatttcctatcaaacttgggaaaacaatatattcggtttgtttgctttttgtgtcaggatgttgctattgctgcgatggggccgatccaaggacttccagactacaactggttcagacgccggacctacatgctccgttactagattaatcagccggtgtacccatgtttaccgtctgcaaaagacaagataaaatttgcctcttttagcgtcagtatattaaggcctcagcactgcacattacgtgctgcgatggaggaattttttgagaatttgttttatttcttgtcgtgtccaaaatccacaaatctgtcaataatgataggcaggttcgactgacgtggctgacttggttggccaccggatgttttcttacaacgagtcatgaaccataccgtcccatcttttgttggaagattttactttggcaaataattttgtggcacgttatatgtaaagatggtacagttttagcttcattgtccacaaatcttgttttgaacgattattgtcgtgtatttagtcaatttcctggcgtttgctttcgtgctgttctggcatattatggtcaaggcgtagcaaggcgggctcagcttgtactgtgttggcaccggaatcttcagtcatgcagcgtccagcagtcttgcaaaagctctcaacttctgcatagagtaccgaatgatcagatcagcttatcaatctctccgcttcggagaaaacatgagtggaggcaaatctggaaattttggctaactttttcactatatcattactctattttctaataccatgtgctgaactttagtgagatgctaaggtcctcattggttgccttcccctgcatgactccagctactatgctggacctgtataagataagcgtgattggttacttgttttctgcgggctaggttgaagagagtctgcgttgggtttagacgcactcatcaactgcgtagctggttgcccgtgggctccgcatctttagcctgcaccacgcgagcctagctctgcataaacgaatgaaatttctgcattcgcggagactagcgcaagggccctttttgcattcgtggaagcaggtaaggtatgctcactccaccggacatccaattatccaaacgcgacaaatctgtatggatccgacctggttgggggtatggtacaatcaactaatcgcgctctaaagtttaaaagtagctaaactgttgttgggtgctaaagtttagcgattcactttcagtaacttttagcattcatgctttgatcttcaagtgccaaagtttagctaaaaaaaacaatgctaaattctagcaccatgaatataatataaggcatatttggatctatggggctacagtttacactacactttagtacttagagatccaaacggaagtgctaaaatttgctaaatgtgaagtgctaaactttagcacctattaacagtttagctcttccaagtatactaaaatgagctaaaagtggtatatatggtgatgaaaagatgtatcctaccctcctgaccccactctctcgtgtattaatcaggggtacgaatgtatttctatatctatgagctaacacacttgcttctaaacactatttatgtactaaactttagctcttcatttgagatggctaaactttagcaccatgttaaagttcaacacatgagatctaaataggctctaaaggtttctagaatgagtactagtggaagttgcttagcttcatgcccagcaagcccaaataaacccattcctatcggttggattcaacgacgtccgagatcgatttcggcaaccaatagaaccctcagttggccacctccacaaaacctacttaggactcttttggatcaaagtaattttacaggaaaacataagattctgattttcataggaattgtcattgtagcatcctttggattgtaggattgagccttaggaaattggagga

SEQ ID NO: 18017 - DNA, 947 bp, Zea mays
  misc_feature (21)..(21): n is a, c, g, or t
  misc_feature (27)..(28): n is a, c, g, or t
  misc_feature (30)..(30): n is a, c, g, or t
  misc_feature (35)..(36): n is a, c, g, or t
  misc_feature (38)..(38): n is a, c, g, or t
  misc_feature (40)..(40): n is a, c, g, or t
  misc_feature (42)..(42): n is a, c, g, or t
  misc_feature (46)..(46): n is a, c, g, or t
  misc_feature (62)..(62): n is a, c, g, or t
  misc_feature (66)..(66): n is a, c, g, or t
  misc_feature (68)..(71): n is a, c, g, or t
agctggagctccaccgtcggnggcggnngnttccnncncnangaangggtttggggctgcanttcnannnncaaaagagggttacctaggccggccccggcggttaaatattttggactacaattgcatcaccacactcaccgcaccaccgaccactgcctccgtacgcgtccctctggcggaaaatcggtcctagtgccgagctcgttttgtttggatcttctgtatatctattaaggaggcttctccatctcctcggagcagcaaggctgtgcagcaatggagaagtataacagcaacactcaatttgcaccattgagagagactccgtttgccctccgtggtgctcttggtagttcaagctcatatcttgagcaagccaggggctacacatcttcccctgtagcagctctgcgcccaaagatgtctacacctggaaatcgactcctgcatacgagctgccccctgtcatctgctgtagcaaaccgcccgctgtcgccccatcttcctctgaagaagccacagttcagcgctactttctctatctcgcaccgtatcttcggtgtcgcgctgggagttgccatcatatccgtccccctcgccaccaagttcagcctgatgtttggcgtttgagagcgatttgctgcatcttatgaggaactgcatttccccgttcctgtgactgtttcatcgttcgtctgggttaccttgcaacacaactttaggtgcagttggaataacatctttgtcatgctgacagacttctgtaatacagtaataagtaaaactataaaatatcagtgcaaggaggtttgccccattatggatgtacatggtcatgaggtctgcagcctgcaggtttggctgggaaatagttgattatcatccccccaaaaaaaaaaaaaaaaaaaaaagaaaaaaaaactcaagggggggcccggtaccca

SEQ ID NO: 18018 - DNA, 757 bp, Zea mays
tcgcccttaagcagtggtaacaacgcagcgtacgcggcgggccaatcgaaagcccgaaaaggaggacgaaccgaagaagaggacgcggcaccatggcgacggcacaggcagcgtcggcgtccccaacccaccaccgcgcgtctccagggacgtcgccgccgcagccgccgtaccccagcgccgccaggatcgccgactccgcctgcttcccccagtacaccgcctcgctcaagtgtttggaggccaaccaggacaagaccaagtgccagcagcagttcgacgattacaaggaatgcaagaagaaagagagggaggctcggctggaacggaataaaaccagatcactctttgggtgaacaatggcgtcccacctgagcaatatgctggcggtgcaataagtctcctgctgatgtgagcgaaatcacggcttttttctttggtttcatgatgatcctctgcaacttgtgcaaggtagggaatagaaataccgatctcgagattgagggagatgtaagggcgtctgggaacagctcattaacacaatggctacggtgaatgaatcgaatgagcgaggatgtattttgagaacaaccaggcgtcatgaaacgacagtttgttcaataaaattgtattccacccctgtaacgattgtacttcaaaatatttccatgtgttctctaaaaaaaaaaaaaaaaaaaaaaaaaaaaagtactctgcgttgttaccactgcttaagggcagatccagcacactggcg

SEQ ID NO: 18019 - DNA, 702 bp, Zea mays
aatcacttcgccccatccagaaagacgacggccaatcgaaagcccgaaaaggaggaagaaccgaagtaccgaagaagaggacgcggcaccatggcgacggcacaggcagcgtcggcgtccccaacccaccaccgcgcgtctccagggatgtcgccgccgcagccgccgtaccccagcgccgccaggatcgccgactccgcctgcttcccccagtacaccgcctcgctcaagtgtatggaggccaaccaagacaagaccaagtgccagcagcagttcgacgattacaaggaatgcaagaagaaagagagggaggctcggctggaacggaataaaaccagatcactctttgggtgaacaatggcgtcccacctgagcaatatgctggcggtgcaataagtctcctgctgatgtgagcgaaatcacggcttttttctttggtttcatgatgatcctctgcaacttgtgcaaggtagggaatagaaatactgatctctagattgagggagatgtaagggcgtctgagaacagctcattaacacaatggctacggtgaatgaatcgaatgagcgaggatgtattttgagaacaaccaggcgtcatgaaacgacagtttgttcaataaaattgtattccacccctgtaacgattgtacttcaaaatatttccatgtgttctcttaaaaaaaaaaaaaaaaaagcggcc

SEQ ID NO: 18020 - DNA, 1294 bp, Zea mays
  misc_feature (196)..(196): n is a, c, g, or t
ggccgcttttttttttttttttttaaacaacacagggtattctttttatttatgttattgtttataagttacatcacattttccttggtggcggatggctaggtcctcgtggtagcaaatccccaacaacatcaggtgacatcgccacccttggtggcggatggctaggccctcgtggtagcaaatccccaacaancatcaggtgacatcactacccttggtggcggatggctaggtcctcgtggtagcaaatccccaaacaacatcaggtgacatcgccacccttggtggaggatggctaggtcctcgtggtagcaaatccccaacaacgtcaggtgacatcgctacccttggtggcggatggctaggtcctcgtggtagcaaatccccaacaacatcaggtgacatcgccaccaagggtggtggatggctaggcccggagggtggtactcttcctcgtggtagcaaatccccgacaacatcaggtgacatcgccacccttggtggcggatggctaggtcctcgtggtagcaaatccccaacaacatcaggtgacatcgccaccaagggtggtggatggctaggcccggagggtggtactcttcctcgtggtagcaaatccccaacaacatcaggtgacattgccgccatggaaggaggcttcgtaggtccagcggctggcattctccatgatggtggcatcgccgccatgggtggaggatggctaggcccggacggaggtactctcgtccgtggcaataaatctccgatcatgctaggtggcattgttgagtatggttgtgcatctactgtcgatgccaaaagtgtgatcaatagtgtcagtgccaccacaaccacaattggagatgtgatggctccgacaatactaatcttgctgctaaccatggctagcttgtggtttttcccttcttttgtttttgtggatgtttgtgcataggagatcgttgtcgccgccgggccctgggggccccctatatatatagtcaagcctagcttgtaaataaggcatgcatatggtaatcaatacgatcggtggaatgcttttatggccctaaaagaggtgtggcatgtatttatagtttttgtatttatcaatttctatatatgcacaaatggaaaagttttattgcgcggttgaatatgtttagcctgcttttatatcttaacttttcaaaagtacgttcaaatagaagaccaatttttagaatgtttttacccttattaagtttttactatcttaaagacataacttcaactaatcatttactacccc

SEQ ID NO: 18021 - DNA, 1623 bp, Zea mays
tacctcgaggccggccgggccggttttttttcgcctccgaattccgatcaccaaaaaaaggcctttcttttcttttcgtcgccctctcggtgctctgcttcgctgcgtcgcccgcccgtctctaaaagccttgtgtggatcgtggacgccgacgcggccgcagcagcagccacgggacgggagtagaggcgcagagagagagagagaaagagcgagagaaaggttgtgctcgctgcctgccgccgagagacggatgaagaagtgcccatcggagctggagctggaggccttcctccgcggccgggaggacgccacggcggcggcggcggcggcggcggtggccgagcagaagcctgcgcacgacgtcgctgcgctggcgccgttcggcgccggtggcgtgttcccctccagcgatctgtccgccttcagcttcgctgactcgaacaccctcaatggaactggaaacatccataatcacctttggtcccataaccacaacgtcaggcatcccgcagtctccacgacgatcgagtcgcagtcgtcgatctgtgcagctgcagcagcaagtccaacatcggctaccaacctgtacctgaaagagagccaggctctgggcggcacgagtggttccgactccgacagcgattcgctgctggacatcgagggtggcccgtgcgagcagagcacgaacccacaggacgtgaagaggatgcgacggatggtgtcgaaccgtgagtctgctcgacggtccaggaagaggaagcaagcccacctagctgaccttgagacacaggtcgaccagctgcgaggcgagaacgcgtcgctcttcaagcagctgacggacgccaaccagcagttcacgaccgcggtcacggacaacaggatcctcaagtcggacgtggaggccctcagagtcaaggtgaagctggcggaggacatggtggcgcgcggcgcgctgtcgtgcgggctgggcagcctggggctgtcgccggcgctgaacccgcggcaggcgtgccgcggccccgacgtgctgtccgtgtccggcctggacttccccggcgccgacgacgcctgcttcacggggctgtccccggcggagcagctgcagctccagagctcccccctgcagagcatcgccgccagcctcgagagcctggacaaccggatggccagcgaggtcaccagctgcggggggcccggcgtcgacgtctggccgtgggaccaccactccaacggcggcctgtccaagtgaagccggagacgccgggtgggagtggggtgagactcgcgccgctcgccgacggcacctatcctgtcctagtgtatgcgtatatcgatatgcatggcgggcgctagctatgaccatgagccgccgttatttctgtgttcgctggagtggtgaaagtgaacggacttgagtttttcagagtccctcgtctccgtcggtacatttactagttctgtaatagaactgactagcttaagctcgtgctactacatatatatatgtatgctgagagactgaactcgaagcataatcatgctaccatattatgtcatcattacattccgatctctaaaaaaaaaaaaaaaaaaaactcgagactagttctctcctcgtgc

SEQ ID NO: 18022 - DNA, 1232 bp, Zea mays
aaatgtttgctaaattctcaccaaggcgaagccacggaaaccgccaccgtcatggtgcccccgacggccactgcgatgcccgtcttcctctccgcggcgccccctcctttttccacccgccgtcggcgcagccgccttcctgccatttccgcatccctttcgccgtccccttcctcttcggaggagccgctgctggtgcgcgcggcgcggggcgaggacggcctcccacgcccacccgcgtggatgatgcgacaggcagggcggtacatggcggagtaccaggcgctggccaaacgccactcctcgttccgggagcgctccgagaacacggacctcatcgtcgagatcacgctgcagccgtggcgtgccttcgcgcctgacggcgtcatcctgttctcagacatactcacgcccctaccggccatcggggtaccgttcgatatctcggactccaaggggcccgtgatccaatcgccagtgcggtccgaagggcaggtgagggagctcgtccccatcgaccttgatatgctccagttcgtcggagagtcactaaagattctgcgaaatgagattgatggaaaagctgctttgctaggatttgtgggggccccatggacaattgcaacttacattgttgaaggggggatgaccaacacatacacaaatataaagaacatgtgccatacagctcccgatgtcttgaggtgtcttctatctcatcttgcagaagcgatatctgactatatcatttaccaagttaactccggggcccagtgtatacagatatttgattcatggggtggacaacttccacctcatgtgtgggagcagtggtcaaaaccatatatcaaaaagattgtgaataggattaagaaagagtgccctcatgtaccccttgtgttgtatataaatggaaatggaggtttacttgagcgcatgaaggacacaagagttgatgttattgggcttgactggacagtggacatggctgatggaaggaagcgccttggtaatggaattagtgtacaagggaatgtggatccagcatttctgttctcaccattaccagtactgactgatgaaattcgtaggttagttaagactaaaaaattcatttaatttatgttattttgagtttttggttaatgctcatgtgcaattcattaatgagataacataaaacgctgcctgagtagtatacatcttcatgttgggcaaaaaaaaaaaaaaaa

SEQ ID NO: 18023 - DNA, 1653 bp, Zea mays
acggaagaagcgttttgccagtccatccacccaagcgaggcgaccgaggctgggctcctccccgaggcccggcgggaagattagattagagatagcaaaaggcgaagccacggtaaccgccaccaccaaatcgctaccgccaatccgccatgatgctcccgacggccaccgcgacggccgtcttcctcaccgcggcgccttcctctttctccacccgccgtcggcgcagtcgcgccatcttcgcatccctttcgccgtccttctcctcctcggaggagccgctgctggtgcgcgcggcgcggggcgaggacggcctcccacgcccgcccgcgtggatgatgcggcaggcagggcggtacatggcggagtaccaggcgctggccaagcgccacccctcgttccgggagcgctccgagaacacggacctcatcgtcgagatcacgctgcagccgtggcgtgccttcgcgcccgacggcgtcatcctgttctcggacatactcacgcccctgccggccatcggggtgccgttcgatatctcggactccaaggggcccgtgatccaatcgccagtacggtccaaagagcaggtgagggagctcgtccccatcgaccttgatatgctccagttcgtcggggagtcactaaagattctgcgaaatgagattgatggaaaagctgctttgctaggatttgtgggggccccatggacaattgcaacttacattgttgaaggggggatgaccaacacgtacacaaatataaagagcatgtgccatacagctccagatgtcttgaagggtcttctctctcaccttgcacaagccatatctgactatatcatttaccaagttaactcgggggcccagtgtatacagatatttgattcatggggtggacagcttccacctcatgtgtgggagcagtggtcaaaaccatatatcaaacagattgtgagtaggattaagaaagagtgccctaatgtaccccttgtgttgtatataaatggaaatggaggtttacttgagcgcatgaagaacacaggagctgatgttattgggcttgactggacagtggacatgactgatggaaggaggcgccttggtaatggcattagtgtacaagggaatgtggatccagcatttttgttctcaccattaccagtactgactgatgaaattcatagggttgtgaaagcagctggtccaaaaggtcatatacttaatctgggccatggtgtacttcagaaaacacccgaagaagctgtagcacatttctttgatgtcacaaggcgcttgagatatgacacccttttccaaggttctgttgctgaagaattgcatcacgttgcttgacaacggcaatgacattcccatttttcatcaagtggtgtatttgatctgtcatatcatcttagagtcgtagtagattcctagtgttgcctgcattctacctttcaagagagactcattttcttaagcctgtatatgtattgcagagataccggcggcaaatctagtgcaattttattcattgtttgttcgttccattattcatctggctgaagaagggatgcatgatgaccctggtttggtttcaatgattaatgacaatataaattattatagttaatgtaaaaaaaagaaaaaaaaaaaa

SEQ ID NO: 18024 - DNA, 1317 bp, Zea mays
gcacgagaccattacctagaacatcctaatcaaagcaggccgcagttgtaggtacagggacaaatccccggttctttctccaccctccgaccggccggcggccgctgcaagtttcaccgcagttggcaactggcaaccccgctctgacctaggaggatgtcgggtttcggcgatgggtacgtggggacggcgcaggacgcggtgaagatccggcggctggagaagcagcgcgaggcggagcgccgcaagatcgaggagctcaagaacaagtccgcggacgggcagcccggcctcctccagttcggctccagcacctccgagattcttgagactgcatttaagaaggaaacagttggtctcgtcaccagggagcagtatgtcgagaagagggttaacattcgaaccaagattgaggaggaagagaaagagaaacttcaaaagctgcaacaagaagaagaagaattgcaaatgcagaaaaggaaaaagaggagagtgaagagtgatccacgcttatctttctgtgatgacattgagaatggaagtgacgaagatgattttgagaatcaagaaaccaagaaaaatggccctgccaaacttgggaaggatccaactgtggagacaagttttctacctgatagagaaagggaggcagaggaacaagcagaacgagaacgactgaagaagcagtggtcgcatgagcaggaattgattaaaaatgaacctctttcaattacttacagttactgggatgggactgggcacagaagagcaatccaggtccgtaaaggtgacaccattggagaatttctaagggctgttcaacagcagcttgcccctgaattccgtgaagtacggacaacttcagttgagaatctactttatgtgaaggaagatcttatcatccctcatcaacacagcttttatgaattaattatcaacaaagcaaggggcaagagtggaccacttttccattttgacgttcatgaggatgttcgtaccattgccgacgcaacaaaagaaaaggatgagtcccacgcggggaaagttgtagagaggcattggtatgagaaaaataagcatatattcccagcctcaagatgggagatctatgacccaacgaagaagtgggaacgctacacaatccatggggattagcatggaacatcatacatagagagttaaattattttgtactttggatgtccgaaattaccagcactcaagaatatgagaatggcacaagtgacgatttgaatagcataaattattactgttgtttgcaaaaaaaaaaaaaaaagagtgaaaaaaaactcgagg

SEQ ID NO: 18025 - DNA, 961 bp, Zea mays
ataaagcggtcaaaattccttttcccccccagggggccaaattttgggaaaagggatatggggtggggccttttcttttttttccccaccggggaaaaaggggatttttttccaaggcgttaaattgggtaacccccgggtttttccactcccggcgtttttaaaaggcggccaggggaggggggtaatttcgcccccctttaggggggaatgggttccggggccccccttgaggtggacgggatcgattaacttttttttttttttttttgaaaaaaaatggaaaatttattaattagacagtatgtgggcatcctgttccacatgggaatgagaagatgctataggttctctaagtattgcacagtctgaaaaaataacaaaaaaagggaaggggaggaaaaaaaaaatcacatgatattgggaaccatctcacattatgaataatctaccaagaaacatttaaaaaagaaaaccctttgtttctacagtagctttaagtttatagttcttggaatgactgtattccattgaagacatctcagtaacaggaagctgttttagcaatcccatgtgcaaatattaataaaaaatatataaaataatgcaattcatctcttgccttcaccccggcaatcatgacatttctgagaactgttttgcttgaaaatgggttaagctgtaagttttgcctgaagcctccatctctgcagcccgttgggggggcaacatcactaaaagctggatcccctgaatccctgtttagtcccggggaaaaggggaagaaggttaaaaaaaccctgggggattccaattggcccagtttttcataaaaatgtccaagaaaggtctccgggaaatcccggacccgggggacccatatttaaaagggcccccccgggggggacccccctttgtgtccccttaagaggggaaattgggccttggaaaaaataggaaa

SEQ ID NO: 18026 - DNA, 681 bp, Zea mays
aactcctttccccccccccgccccatccttcgggtgcgttaagcttttttttttttttttttgaaaaaaaatggaaaatttattaattagacagtatgtgggcatcctgttccacatgggaatgagaagatgctataggttctctaagtattgcacagtctgaaaaaataacaaaaaaagggaaggggaggaaaaaaaaaatcacatgatattgggaaccatctcacattatgaataatctaccaagaaacatttaaaaaagaaaaccctttgtttctacagtagctttaagtttatagttcttggaatgactgtattccattgaagacatctcagtaacaggaagctgttttagcaatcccatgtgcaaatattaataaaaaatatataaaataatgcaattcatctcttgccttcaccccggcaatcatgacatttctgagaactgttttgcttgaaaatgggttaagctgtaagttttgcctgaagctccatctctgcagcccgtttgagtgcaacatccactagaagctgaaatccactgaagtcctggttgaggtccggtggagtagggggaggagtgttgaaaagaccactctgtgtattcgtacttggtccagtttttcgattaggatgttgtttaaacacaataaagttggaactggaggggggaaaggagtt

SEQ ID NO: 18027 - DNA, 998 bp, Zea mays
gccggccgggctgccccaaatctccactccccggcaaccacttgctgcaaagaggaatacgattcagcttagctcagctccaccaccaccaagaacaagatctcgacgaagcagccagacgacaggcaggtagcaccggggtcaacgcggcagacaaacaggctctcccgctcgtcagctagcagccatgagtaccatgaagttttgccgtgaatgcaacaacatcctgtaccccaaggaggaccgggagcagaaggtgctcctctacgcctgccggaactgcgaccaccaggaggtcgcggacaacaactgcgtgtaccggaacgtggtgcaccacagcgccggggagttcacccaggtgctccaggacgtggccggcgaccccacgctgccccgcaccaagtccgtgcgctgctcctcctgcggccacggcgaggccgtcttcttccaggccactgcgagaggggaggaagggatgacgctcttcttcgtctgctgcaacccgagctgcggcaaccgttggagagaataatggacggttcctctggcgcaacagccaggacgacatgattttttttgcaagattttcatccgacagacctgctgctcccccccatatgagcatgtcaactgattggattggattggattggattgtactactatgttcccagtgcgttcagacatttcaataacttgccggcagggtaaacttccctgtggcctgtgcttcattcatttgcatcaaagaaaggatgagatgaggagaactttttccacgttcggccccctccctctgcacctaaaggtttcatccactcaaacaaattcaccatcaggtgaggtggagaaactgtcctcacttcacatgacacacggttatgcaagttctctctctatatttctgttttttttttttttttaccaatttctgcagctcatggttatgcaagtacaaattcttgaacagccacgtgcttaattgattttcagttgtc

SEQ ID NO: 18028 - DNA, 829 bp, Zea mays
tctttgattgcttcgccacatcttttatttttatccttctaagtcatttctctatctatccatatagataaaaaccttctaatagatctctgtgtcattttattcgtaagaatgagatctagtgtagaagataacaaaggatggataggaccagcgacaccggagatatcgaacggttttgagtttcagaaaggttcgaaccggacaccaaaccatcaccggtctactatggggaagccagcgccgtcaaaatgggacgatgctcagaaatggctttctggtgtagggtttgctcgtggaggtggtggaggtggtgacaagagtagtcatcactcaagaagtaataagccgagaaactcgaacgcggatgatcttagacttatagcttcagcttcacagagagaacgtgaagggagaagatcagtacgttgagtatgatgatgaagagatggcggcgggaagaccggaggttgagacgaagaatgttgattgtggtgaatctgtttggaggaaagaaagtagtattaatccaacggctgtgattagatccgtttgtgtgagagatatggggactgagatgactcctattggtagtcaagagccttctagaacagctacaccggtgcgagctactacaccggttgggaggagtcctgtgacttcaccggtgagggcttcacaacgtggtgaggcggtgggggttgtgatggagacggtgacggaggttaggagggtagagagtaataatagtgagaaggttaatggttttgtggagagtaagaaggctatgagtgctaggaagctcgagggggggcccggtacccaatcg

SEQ ID NO: 18029 - DNA, 2062 bp, Zea mays
cgaatttggtgataccgtaatctaagatcaatcttaggaaatccagttaatactaggagatttaaaatcttgtttccatcccaacccactgagggctcgttcggttaggatggattgagaaaagggtttaatcctgtccagtattttcctaaccaaacaagccctacaagattgttcgattagaagtggattgagatagattagaggagattaaatctcttgctattcaaaattgaatagaagagaatttaatccccccttaatctacttcaatctttatacaaccgaacgaagtccaagggggcatttgattctacctaagggcttggattaaatctctaactagtaaaaaatgaatagaaagagatttaatctctctcagtgccctccaatccgtatgcaatcgaatatggcctaactaaacgtagaatacatgtattaaatatagtctaattatcaaacatattatataggtaaagactacgagacgagacaaatttatttaaacttaattaaacctataattagtacatataaatgatatttaaatatttgttgtgacacataactaaattttagtcagtgtaactaaacagcccctaaaaggaacatataaaaatggtaattaccaatgcagttcaatacttcgcgtgacaaagatagatgccacaaccaccattccctccacaccacacaatactttcttcttcggtagacaacaccatttaccaaccaatccttccctgccaactgcagtagtttgttgaataactcgatcgagatagacatatcgctatcggtgtagcattcaagtagggaggtggccatgaacaacattgaatcgtcggagctgaggaaggtgttccaaatgttcgacaagaatggcgatggccaaatcacgaagaaagagctaggggagtcgctcaagaacctgggcatccacatctctgatgacgagcttgatgccacgatggacaagatcgacgccaatggtgacgggtgcgtagacgtcgaggagttcggaaagctctaccgctccatcgtcggcgagggccaagtggacaagcacgacgaggaagaggacatgcgggaggcattcaacgtcttcgaccagaacggtgacggcttcatcaccgtggaggagctgcggtctgtgctgtccagcctcggcctcaagcaagggcgcacggccgaggattgccgtaagatgattagcaaggtcgatgccgacggcgacgggcgcgtcgacttcacagagttcaaagcagatgatgcgcggcggcgggtttgatgcacttggtacatgatcgggactttggaggattgaagatgccttaatataattgcgtggatggtaagggcgttgtagatacttcgttcattaaaatggttcgcatggtacggatgtggcaatctaatgacatttcttcattagttaattatttggtttggtgaattcatagatacttttccttctttttttaaatttgaggagttttggttttttaatactaatttgtgttaactattagttggatttaattgggctgagtctgccaattgggtatagcgagcatttggagttagggcggttcattgttcaatttttcaaccattataaatataaataaatatattaattatgtaacgtaattaagaaagagtgtacataaactccataaaataaacaattatagattttttaacgtagatttaaaatgttatatagacatgataactaaatagctattttccatacatgccatattattttttcctgtcagggctactacgccttgcttctctgatgcatatttttgaaaacaagggacaacatcaccattcatcttaacgttgagcctgtataatttttgtgctcatacaaatttgtcttgaatcccatagtcatatcttgaccatcaaaactccaaatagcacatataaagacgttgaaaagtttatgaggcaaacatgggcctaacggaacatatggattgtaaaatagaaaccaaaaagtccgaaacaaaccaaaactaagttgctaactcagactgtttcagca

SEQ ID NO: 18030 - DNA, 1068 bp, Zea mays
ccggccgggagtggcagaccggcagtacaggctaccagcccacatgcttttctttccctcccgttccccgtctgtctccctctcgtcgcatcgcgcaccgcttccccagttcccccagctccccccaccttccgttgccttctcgaactcaacccccgcccccgtcgcggatcgtcatggccgccggcctcgccttccccgtcgcctcctttccactcgcctgcgtctcctcacctccccaccccgggcaccgcatctgctgcgcgatcccgtcgtcgtcctcgcgccgcaccgtcaaatcctcgccgctccgcgcgactaccgtcctctccagggaacgacggggcacgggccgtggcgcgtccgtagtgtgcgctgtccaaggccaggacacgaccatccaagtcccagatgtgacaaagtcaacatggcaatcactcgtgatcgagagcgagcttcctgtcctggttgagttctcggcggcatggtgcgggccatgcaagatgatagaaccagttgttggcaagctctcgaaggactacgaggggaagctgaaatgctacaagctaaacacagatgagagcccggacatcgcaagccagtacggggtccggagcatccccaccacgatgatcttcaaggatggcgagaagaaggattcggttatcggggccgtgccagagagcacactggtcacatgcatcgagaaatttgtcgagaggtagaatgcgtagtggatctcttgagcggtttcctttaaatcaaaaggtcatttcgagaccacttgggccatacagaacaattctataactgcctctagatgatgggattatatgtatattatatactctgttattattgtttgaagaaagcggcatgaaatttgtgtccaccccagccttggttttgttttcttattctttagaggctctgaactgtgtaacgtggacgaccgagaacctcgttctattcttctcataatatataagaatgcacacatgaaacatcaaaaaaaaaaaaaaaaaaaaaaaaaaaaaaaaaaaaaaaaaaaaaaaaaaaaaaaaaaaa

SEQ ID NO: 18031 - DNA, 861 bp, Zea mays
cctcgaggccggccgggccgggactgcaccagcccacatgcttttctttccctcccgttccccgtctgcctccctctcgtcgcatcgcgcaccgcttccccagctcccccaccttccgttgcctcctcgaactcaacccccgcccccgtcgcggatcgtcatggccgccggcctcgccttccccgtcgcctcctttcaactcgcctgcgtctcctcacatccccaccccgggcaccgcatctgctgcgcgatcccgtcgtcgtcctcgcgccgcatcgtcaaatcctcgccgctccgcgcgactaccgtcctctccagggaacgacggggcacgggccgtggcgcgtccgtagtgtgcgccgtccaaggccaggacacgaccatccaagtcccagatgtgacaaagtcaacatggcaatcactcgtgatcgagagcgagcttcctgtcctggttgagttctcggcggcatggtgcgggccatgcaagatgatagaaccagttgttggcaagctctcgaaggactacgaggggaagctgaaatgctacaagctgaacacagatgagagcccggacatcgcaagccagtacggggtccggagcatccccaccacgatgatcttcaaggatggcgagaagaaggattcggttatcggggccgtgccagagagcacactggtcacatgcatcgagaaatttgtcgagagttagaatgcgtagtggatctcttgagcggtttcctttaaatcaaaaggtcatttcgagaccacttgggccatacagaacaattctataactgtctctagatgatgggattatatgattatatgtatattatatattctgttattattgtttgaaaa

SEQ ID NO: 18032 - DNA, 859 bp, Zea mays
gcacaaatcgaagctggtatgcaagattacaggggatacaattaacaagttggaggatcacatatggaagcacatcaacgggaagagatttcttaacaagctagaaagggtagaagaccggatggcttctggtgagatgcctgatggagaacctgtgatgtcaaatgaagtggcaaagaagagcaagtcaagcaagaaggacaagaagaaagctaatgttgccagcacttctttgccaagagaacctaaaccagagatggctgattcagatgatccagatttctgggtgcctcctgttggaagtcgctgggatgacgatgacgggaaagacagatgggagtcattaccaggaaaggccaacttagcaaagaacgaaggtggtactgatgatggtgatggtgatgacaatgatacggctgacaaggatgatgctgaatcaatggaacttgcttcaaggacaaagcgaatgtcaatagaagcagctgggccaaggaagaaaaaacccaagaaggagcagtaaggcattcgcaatttgtcaagactcaaatgaagaatttggtctcgttcggaagaagaagcgttatctatttgattattgggtcgtgtttcctcagatttgggtaatcaatgactggatttgtgttagcatgtttatggttaacgcctgtcaactgtgatacatctacatttgcacgtaccttgcatttttttttttggaaaactttgagggccaactatcagttgtcttttgctagggtttaggacgtgctatgattggacaacatagacggagctagagctccaaattccaagataactcattcgaaataccaaaaaaaaaaaaaaaaaatttgcggcc

SEQ ID NO: 18033 - DNA, 1087 bp, Zea mays
  misc_feature (961)..(961): n is a, c, g, or t
  misc_feature (1002)..(1002): n is a, c, g, or t
  misc_feature (1087)..(1087): n is a, c, g, or t
ttttttttttttttttggtaaaatgttaaatattataccattttcaattttgacagaagttacaagagatgactagtagcagagaaataataacaagacgacaccgaaacaaactacggacaacatcaacgaccaaacctaagagcaacacagcaaaacaaataaacggattgatagcgagacagcctcggaccaaactacttcaaaactacctgagagaaacatgtcggttgccgcgagctaccgagagaagggcaccctcaaaccctgaatgctacggctcctacagcttccaactagtaccctagagcgaaccaaagcatagaatccaagctcgagctccaaagcctgacacgaatgaagaaaccaccggcggtacgaggagaagccgagatccgacgatgccgtcgttcagtggcttacgctggagattaccgcctccattgcattccaccgggaccgtgtacacccatttaaccgcaacccatatagagtagacatatcgaaaaacggacaaccctccggaggagactcaaccaaagccgaacctagagcttgtagcctaactatctcaccacaaattcacaagagccgtaagcggctctcaagacatgacacaatgaagctgcgattatttgagacgagccaggagacggagcaggccacaacaccattaccacttagatttgcgggatgaaaagagcaaacagagagcaagagccaaagctatcacaaaccagatgcgccatagaacatcaacgccaagccaccaggagacgcggaaagcagaccaacgggaccaccaccgacgaaaccctaagcaccaccaccaccagagaactcgaaggcggaccccaaagtaagcagagagaagaagactttaccgggaaccagtgaagtcagaaccccaacaccacacgcagccccactcacccacagacgccgcccggagagagataangccgacgaggcattaaaagcgcagcacgcggcaccaggctncgagatgcgaacctttctcccgggaaaattgccgtaactccacgccagataaagaatgatccgagccggaaagaagccgccctcn

SEQ ID NO: 18034 - DNA, 2144 bp, Zea mays
gggatagcatattagcatatggtattggagatgggcccccggacccgaaatccccgccgcacttaagtactacaatcccaggggccaggccaccggcatgttcgcttccatctgccggcggcggctcttccgcctctgtcaaatccccttcggcaccggcgcaatccctagcgacgccctcccccactgccactccttagcaaccatcgcggacgctcccgtctccgagccctgtgctgcccttgtctcttgcgggctctcccccgccgccgcggtcgcccacaggctcccaatccgctccaccgccaaggccgacgccgtccgcgcgctcctccgcagctacggcttcaccgacgcggaggtcgccgacctagtccgccgattatcgcagatcctcagcgtcgaccccgaccggatccgccccaagcttgacctcttcgcctccctcggcgtcaagccgcggcggctcgccagatatcctgccctcctcacgcgcagcctcgacaagcacctcgtcccctgcatccagttcctccgcaacattctcagcaccgatgaggacgtctgcctcgccatctcgcgcaccccgcgcgccctctcggctggcctggagaagatcatgcggcccgccgtggacaccctccgccgtcttgggctccccgatgagtctatctcgaagttagtagtcatcgagatgggcgtgctcatgatgtcgcccgaccgcatatgccagatcttcgaggccctcaaggagctcggcttgggcgtaacggagaagcgctttccttacggcatccgcgccttgtgctgcattagtagggagaagtggctgcatagggtggccctttaccggagcttcggggtgtccgagggtgagctgcagagagcgttcaagaaacagccgaatatagttaacttctctgatgagatcataaagaagaagatccggttcttcctggatgtgctgaagcttgaactaagcgaagtaatggagcaacctgcgattatagggtatagcttggagaggaacatcataccaaggtgtgccgtgctaagcttgttgatgagggagggaaagattgggcccaacgtcaagttgatttcggcattgcttggtagtgccaacatgttctccacaaggtatgtattgaggtatgccaatgagttgccagatgttgttaaggcatatgagggtaagatcacatttgatgtcttcagggaacaggatcttttagttccactgaagctgtgagacaagtttagcaagattatgtcacaagtttaggcgccatgctttccaatgccattgagatcatagcatgctatgattctaacactgttttattgttatgttaattctggacatttttcacataaccatctttgtagcatttccctttttttatcctcgctaacaaatgtaaaaatacggatcttgtgatgctgtcttagttatttgatctggtgagctgaactggttcaaaaaaaaaaaaaaaattttgaaatatgttgcatgaattaccttagtaactcatttactatcttgattaagactctgttcctttctagtaattgatacataaattcgtcattcaaacttcgaagatcctgattttgttggtcctcttaatatgcaatgtgtacatctactgagttttatgtgaagttgtcgagcatgtaaaagtgaaatacaaaatggctcttgagggtttgatgcatatatacatcattgggaaatacagcaacaaacagctatcgtcgacataaggactgcttttacataaccttcaccatatgactggagagtttctaaaattctgtgttaagatgttactaggataccgataaatattatgtcgatatcttggtgaacaccaaggttattaaggcgttaaggcgagacatggcgaccgacccccttccaaacgcctaggcgacgccatacgagcatcgcctaggcgaggatatgcaaaaaaatcctaacaatctaacacttgcaaattgcaatagcaaaattggtaaggttagataatacaatacaagcctttttgttgtccatgctttgttgttcttgtagcatccatgatccatctctcttatcgaagatccaacccctcttcttttctttcaagctgcaagctaca

SEQ ID NO: 18035 - DNA, 4921 bp, Zea mays
cctgtaattaaaagttccttggattttgattggcatgttgtgccgcgatcttcactcagtttttttggtttgctttttgcaccatgaactgcatgctttagagataacctactgaaatttaaatatcagaccgtgttcggtccttatggttaatgaatatttggatcagcatggtagatactttgtgtgcagaatgtaccatagttgaaaacactgtgtttcacatagtttatggtagtgtagtaactcctgtcgctcgagtgttccccctgaagataaatcttgtgaaatgatgccaaatgcggtcactaactctactaaagatgtcttggaggccgatgacacaactttcaataatgaatttccgatcaagttagatcagctcggtgatgatcctgttatttcccttggaaacatgcttgttgaacttatccagcacgaggattcttgttctggggattcaaatggcccgaccagtacatataagctgctcctactgaaggaaagcatttccaaggagattgaaaagactgaactcgagattgattcattggaaggcgaacttaaatctgtgaatactgaggctgcaactactcttgaaggttctcccacaggggtgacgcatacagaaaatctttcaccctctagtgggacatccaaggttcctggaagtgtggagatctgtgatacatctgatatgataaaagaaccaggggagctcattggttctcctaaggtacctgtggtgcagtatgatgatgtcaaaagtgctgatatgatggaaattgaaacagctccagttcataatgcaaaaacagttccttcagaagctggtgctatatctcctgtagtcgctgagggtaaggcctgtgcagctgctgatcttagctcattgaaagcttctgaagaagctgggtctcaaaatgatattgacaatggcaggctggaaacttcttcacgccaagctaatgctgattccatgaaattagaaattagtgatgacctaccagtgaagaaatggacataccatgatcataagtctgatttgctcagttctgtcacatctgcaaatagtgctatagccaaagaaattaatgaagtgctatttaaatcattgcctgctgatacacctcgccttgatttgtttgcatcaagtcatcttctgagccaaaggaagagtgatttgattgtcaaagaaaggcttggagtatgtaaaaccaggctgaggttgaaagagcagatgcttacaatgaagttcaaggcatattgtcacttgtggaaagacgtccaactattttctgcaaataaacagcgttcaaagtctaataagcgcactgatcagagcaaccgaacatcacaaattggatctcagaggcaacgctcctctaaccgctcgcgattaaccatgcctgctggtaatttaagtacattctcaactccagaaatgtcagatgttgcaatgaggttgttttcagagttcaaaattaagcggtgcagaaattacttgaaaatgcctgcactgattattgatgagaaagagaaggagtggttgaagcttatgaacaagaatggtctagttgaggatcctgttttagttgagaaggaacgggtgatgataaatccgtggactcaagaagaaaagaaaatttttatggagttgcttgctaaatttggcaaggatttctccaaaatcgccagtttcattacacataaatctactgcagactgtgtggagttctactataagcatcataaatcagatagcttccgagaagtgaagaaactattggaccttcgtcaacagcaacccaccagcaattttcttggagcgaaatctggacataaatggaatcctgagtcaaatgctgcttctcttgatatgcttggggtagcatcagtagtagcagcccatggccttgaatatgcaaaacaagtggagaaaatttctgcgaaatccctcatccggactgcatatgggcccaatgtgacttccgtggctaataaatcttctgataaggagtgcattgaccatgtgcctttgcacgagagagaatctgtagcagctgatgtactagcaggcatatgtggcactctctctcctgatggaatgggctcatgcattactagttctgctgatcctggacagaagattagcatgaaaagagtggagcatgtcttgtcccaagaaaatgacaaaaccgttgaggaggaagacacactctctgatcaagagtgtgaagttgacccagttgattggaatgacgacgagaagtcaattttcattgaggctatgaataactacggaaaggattttgctcggatctcgtcatgtgtgaagagcaagtcatatgaacaatgcaaagtgttctttagtaaggctcggaaatcactcggtttggatttgatccatcaaggggcagccgatgttagtatgccagctagtgataccaatggagggaagagcgatactgatgaggcctgcgctgtggaaatggattcagctatctgtagcacacagtcatgttcaaagattgcgatggatgtttgtcctactgaaggagccattggagggcctaactctgttataatctctaagcaggcagaagcatatatatcaaatgggtgcaatgctgatgttaaaattgaggaagatgagaaggtagctgataaaaattgcagcattgttgatgctaagaggtccagtgatgctactcacgaagctggtcctattgacatcaattgcccaggaagcacagataagctgcaaggaactgatgatgtcgttgacctagtaaacatgcatagtaatagtggcatcagctcttcagctaagcatgcagtggccattcactcggaaatgagatccactttacattctgtagaggtccttcaaacagacaaaggtgaaggtactggtactgatttgtcctgggtggaagaatgttcacaccatgctctggataacacaccaatgaaaaatggaaattctggtgccccggctttcttggcttcagatagtggtatcaaggacaatgttcgcatctcaaacataactgctgcttccaccgttagtcctgcattcacttcaagttatcagcattctgtacctggagatatgcccctgccaaaaccaaagccacttgttaccccgcttaccccaaaggatttaatgcctgtgcagttcagttcagtgcttcctgaccccactgcaattcgtttcgagggcatagcctcaataactacgcccaacttcgaggacactggcaacagagtcagtggtgctctaggggctaaagagatgagcaagtacccagcttttagagacccatctggtaatcagcaaagcaccttgttttgtaatattgatggttatatgaatcatcgtctgacaactgaattaccatttttttctgaaagaactgcgagtggcactgtgaatacttcacaggcggatcggttgacccaaacaaaattgcagaatggcaggtccagcagcttgtgccttcaaaacaattccgatggcattcaatggcccagagaccacgaaggaggactggaaggctctttgaggccttgctctcgcaatacaagctccgagggtgatgagcaacaaaagcggcctggtgatgtcaagttgtttggacagattctcagccatcagtcaaccctgcagagttctggcttgtcttgcaatggtaacaagagcaagcctccctcaccaaagatcgacacatctgtgagatccatgaacaatccaatggaccgtgtggtttgttcttccaggcctggcaccactccacatctgggtctggaggaaagattggcaaggtgctatggtcatctggatggtagcacggcacagcccgagccactgctcgtgatggcaaagcgccagcggtccttggccggcgtacagttttactcggctaagaacggcacgcttggtgtgttaccagattaccaacaaccttcgacgcagccacagcaatcagatcccaagcgtgtggaaaggttgtctgatccgcagaagaggaacgtgctggaactcatctcgggtttccagcagcccggcagagtcgcccgtttcgggggtgctggcatcctcgtaagcggcaacgtctcggaccctgtggctgctgctctcaaggctcagtatggtcccggttctaagattatgggcagcgacgtggatccttggacggacataggaagcaggtagcgccgtagcagctctactgcttctgttgctccttgtaccatatatttagttttggtgtaacttgaatgaaatcatcagaatatgagatgtggggggtggggagtgaatggctttcctgcccatactatctgtaggcttttggccagtagcagtcgggtttcgctgtttactggcattaacatttttactctttcttctgcagctccatacccttttggtatagcttgacatgccagcagtggcacagtgccgtaggttccctagaggtgaactagatgtttgtcagcatggtttgattttgccagcctatgcagaaaacctcacttggtctttgtaatgtggtaatgccatgtatcagtatcctagtctgatggagttttggttgagacagttctcaaaaaaagctggttcatcttctgtttctgcttataacattgcaacgtggtgcgtttgctgagatggcatcggcacgtcgttctggacttgtcgcttttgagttttgacttcgttgcacgtgagtttctggctggaggtggatttccttgggcggcgcctgcggaccgggatcgcttttcggtttcacgagcttcttttggcgtcggctcggctctttccgtagcgtgtagggctgtggtggtccttctccagcagcagcagctacgccagccatgacctagatgccttgctcgctttgatctcatc

SEQ ID NO: 18036 - DNA, 909 bp, Zea mays
tacatctatcgaaaaaaatatattaaactttaatcaagaatcctctctctttctctagagagagaaatctttctcccatgttcccgatcaaaatctttcacaggggaggagattctgttttgtttttgttttcgatctttggatcgattgtagtttcgctatggcgattatctctttcgcataggcaattttttgtttcgttttgacgattttgttgtgagtttcaaatcaaatcgaatttgttcttcatgttcttcttttgattctgatttggttttattcaataaaatctggttcttttccagatcagttttgctccctttctctgtgctcactattattccgctaaatccaggaaaccttttatttgtatctgctggctaagctttgtttcttcatcataacaggaatcaatctttgctctctattgttggtgaagtctcctgtaaggtaaagaaaggagatgattgatgaagcagtgaggagttggcgcggatttagattagtcagagtcttattgaaggcgttccggaaagatcttgttgctgtctattttgaagctttcatgggattcacatctggcgatatgaagaagagtttcgttggatttgcggcgatttagagatgcttggaacaagcaagcgaatcaaactaagcggcgaagaggaacggtggttctcggaccgacatgtagccgacggtggcaccagattactcttctcgaatccagaaaattcgaagtgtaattagccaacacgtgtgcaacatgcatgatgcttgacccgtcggggtgggttcgggagggagggttggactttgtttgggcttcacgattttgttgtggattaagtttgatttgcttgtaaatcggcccatggcctgttaagctttataaaagcaatcattgac

SEQ ID NO: 18037 - DNA, 1502 bp, Zea mays
ctgacgtgcgcacggcccatctcagtcttactgaatgtgtcccgaacacagaaacgagcccaaaaaaaaaatccagaagagtgaagagacgagcgggcttgccgtacctggtccacaatcatagagatttccggacccaaaccgtgcgctccggtcccggtcgtctttctttcgggcctctccgagtggtcaataaaccccgcctcccttctgtcatcccgtacgtctcgacctcgcagccgcaaacgcgaaaccctagcctcgagctctatctccggccacagctggtcaggttagcgacgaaggatgagcaggcgctggagccgcacgatctacgtcgggaacctccccggcgacatccgggagagggaggtggaggatctgttctacaagtatggtaaaattgttgacattgacctgaaggtccccccaagaccacctggttatgcttttgttgagtttgaagatcctcgtgatgctgaggaggcaattgctggacgggatggatacaactttgatggacaccgtctaagagtggaggctgctcatggtggtagaggtaatgcttcctcgcatgatcgttcaagtggctttggtggcggtggtggagcacgtcgtggtgtgtcgagacactcagagtatcgtgttcttgtcactggactgccttcttctgcatcatggcaggatttaaaggatcatatgcggaaggctggtgatgtttgtttctctgaagtgtatcgcgaaggcggtggcaccgtaggaattgtggactacacaaattatgatgatatgaaatatgctataaagaagctggatgatactgaattcaggaacgcctttgggcgagcctatataagggtgaaggaatataacggcaaacgtggtcgctcctactcacgtagccgaagcccaagtcgtagttacagcaaaagcaggagtccgagtaaatcacccaggactcgccgttcatcatctagatcccggtcaagatctgtttcttctcgttcaaggtccccatcaaaaggacgttctccatcaagatcaccagcaagatcgaaatctcctaatgtttctccagcaaatggtgaagcagcaagccccaagaagcagagcccaaacaggagcccatctggctcacgctctcctgatgcgaagcctgaataaaattgctatgctgttaaaggattgcagatggagtcaggagctcttcttttcttaacatttgtcctctgttctagtaccatcagtgtcttatcgcagtacgagattggatgatattaactatctgtatcagcttgtatcgatggactccaagtgttgtcactcttgttgtctagtgtgctgaaggacccatttacttttgctaaacttttccattggtgattgttggatgcatggtgtggatttgtgctgtgttggctaaatcatgttgttctagaccttatgcattttttccatttcactaaattacctgacggttgctgcatattatgcagttttgc

SEQ ID NO: 18038 - DNA, 5224 bp, Zea mays
  misc_feature (4778)..(4778): n is a, c, g, or t
tcaatccctgtagcctgttcctttgactaggtagagagctaaggccgagttcaagagcatgggcatgtgtctgagcctgacctgtataggggtgtggatgagacgtttccaagtgtgtcgagtcggagtggttgaaacagtgctcagcatggcagaaatttgtgtggtaatctgttccggacatcatcctgaacggtggaatagccttcctgtcttcaacggggttcgcggaagagtaggtggcatttaatgcgcatgcttccctgttgaggcagttgaccaaggtcaagcttgggcatggcgaaaatttcttccaaggtcgaggccgagattagacgttgcatgtagtcacactctcagtggttgaaacagtggtcgaagtgggggaatagtaccctgtattcacgctctgaccattgtttttgtggtaaaagtagattagatcgttgtcatgtcgtcctttgttgactttggcacctttagtggggtaggttgtcgtacgtactacattatatgtgcacgttccgggaacagagtggttggctgaggtgggtacaccctggagcgttgctcgagacaccctcgggcgagtcgaaaatgcgtttcccgcccgaggttggcctcgagcgagtcgtgatttaggttccgtgtggccttggtaatattgggagcgtgtttgcttgtgaccccttcttacccaagcgtcttggcactttagagttgtgatctggtacccctaattatggtacccgacaaccttaaaaggtatagctccaatccacatcatgtctactcatgacaacccacatggttctgatagtttcgataaggctttcgtccatcttcttaaatatgatggctgatattgtagtcaatgaggtgtactatatagcatggataatgtgcaccaggtgtaccctgaggcactatgtgatgcgagccactgctcctgtagccactcctgaacgtattagcatatttgtaagcattgtaagggacaatcaactgcatcatttacaaactacatcatacccgacaacttggactctggtatctaccactatgatacgatatatctggcactacagcaagacacgctaacactatggcatgaccaaggcttgcccccatgtacaactttatgtctgcgataatataggagtagttgggcctctgctaaacagggcccactacctaatagatatgtatcactctctcctcacttcggctataaaagagagggatagagaaacatagaatgggtttcgaaaaaaactctttgactctctaaatagaaacaagaggaaagggaagttagttggtcattatctttgttgatgcctcaacatgtaattttcttcgccattgtatttctcaatccactatatacaaagaggttatagggtatatattacacatcttacggtccgaacctatatttaaattacccatgtattgatgcctaggcggtatccagcaacagagtgtctctagcacgcatctcttactctatttatcaactctcccccgaatacatgtggttccttattgtcactggcggatctacagggtgtcaccctgtagtccggtaccggcataacatattagctttgtctatttcatgacttcaaacatgttgcaacaacctacagatgcgttcagtctatctatatacaagaggaagaatacaagtgacaaatctaatttgtgaatataagaattattatgctggtttacatagaataccaaattatagcacacatttatcattccttattgaatttctaaatgtatttcactgaattattcatgcatttttaatttggcataccttatagtaaaattctataaccgctactgcttattgtcattatgcgacttggaagacattttctacctactgaaagcggtctgttttttgtgttgtcgagagtgtgatgggtaaccatagttaataatgcactggatctatcactactcatacaggtcccatatgcctaataatgttgtgaagaccaactcatctgaccacatctgtccctaccatgcttgtacaccacactacatacatcactcatcactggtccttcgtttcggtaccctcctcccacaatgttcaatgtatatactaatagttctcaaataaattcctgtggatgttacaaaaacccacggtctttggtttcctgaagaagtatttcatggaggcgcgcacgtccatcgtactgcgtcctgcagctatggccgcccccatctggccaataaatgtactaggtcacttgtagccaatagcgtttcaacatgcacacagcttttcccccaatagtgcaggtccttgtattctcctccctctccctcacctcaaatctcatccacacgaacaggcggcacggcagtattcctccacagccctcctctctataagatggcacagccctctcaggtaggggcgagtgtctcactctcacatagtaaaaaaaaaaaacgccccaaggttcttaagcacaattctctagctatcttggtctcctacacagcctatgcacatgagcccatgcctctcctctccttgcgcctgcatagagaggtggtatgatcacctggaaagtttttaactctctctctctctctctctctctctctctctcttacaagcctagaccttatgcatggtcggacggacacatctgatcataggacatatgagtaggccacactcctcctgcccctctctcgtagagatcaacacacactgctcttagtgccaggacctagagaggggagcgtggagagggcatcagggggccttggagtcccatcagtaaagcacatgtttcctttctgtgattcctcaagccccatggacttaccgctttaccaacaactgcagctaagcccgtcttccccaaagacggaccaatccagcagcttctactgctacccatgctcccctcccttcgccgccgccgacgccagctttcccctcagctaccagatcggtagtgccgcggccgccgacgccacccctccacaagccgtgatcaactcgccggacctgccggtgcagcgctgatggaccacgcgccggcgccggctacagagctgggcgcctgcgcagtggtgcagaaggatccggcgccagcctcgacagggcggctgccgcggcgaggaaagaccggcacagcaagatatgcaccgccggcgggatgagggaccgccggatgcgctctcccttgacgtcgcgcgcaaattcttcgcgctgcaggacatgcttggcttcgacaaggcaagcaagacggtacagtggctcctcaacacgtccaagtccgccatccaggagatcatggccgacgacgcgtcttcggagtgcgtggaggacggctccagcagcctctccgtcgacggcaagcacaacccggcagagcagctgggaggaggaggagatcagaagcccaagggtaattgccgcggcgaggggaagaagccggccaaggcaagtaaagcggcggccaccccgaagccgccaagaaaatcggccaataacgcacaccaggtccccgacaaggagacgagggcgaaagcgagggagagggcgagggagcggaccaaggagaagcaccggatgcgctgggtaaagcttgcgtccgcaattgacgtggaggcggcggctgcctcggtgccgagcgacaggccgagctcgaacaatttgagccaccactcatcgttgtccatgaatatgccttgtgctgccgctgaattggaggagagggagaggtgttcatcagctctcagcaatagatcagcaggtaggatgcaagaaatcacaggggcgagcgacgtggtcctgggctttggcaacggaggatacggcgacggcggcggcaactactactgccaagagcaatgggaactcggtggagtcgtctttcagcagaactcacgcttctactgaacactacgggcgcactaggtactagaactactctttcgacttacatctatctcctttccctcaacgtgagtttctcaataatttgatgtcttaatctatgcgtgtgtttctctttctagacttcgtaattggctgtgtgacgatgaactaagtttggtcatcgcatgatgatgtattatagctggctagcatgcactgtggcgttgattcaataatggaattaatcggtgtcgtcgatttggtgatttccgaactgaatctctgtgatgaacgagatcaaacagtatccgccggtgacggacgttcattactattggcaagcaaagcaagtactaatgtaattcagctgtttgatgacagaatgaaaaaaatgttgaaggctgaagctataacatgctgaaagagaggcttttgctaggtaaaagtctagctcacaaggtcaattccatgatgccgtttgtatgcatgttaaaatctgcacctaatggcgcggctttatatagtcttataattcatggatcaaacatgccgatcatttagttgggttaaaagttcctgttactaatgggttatctaattgcttctattaacactaatttcttgatgagctgcaaatctgattcgttccttttcagactactgtatatctcgaattatctatccctaggttgacatcatttctcgtctgctggatgatgcctcatatatatatttctatgtgataataatcctggctaaaaaaactatattctgattgttttctgatttcatttttcgtcggtagaaaagatatttttagattctatcggcacatatccacagattncaaaggtctgcatgattattttatttcgtatagactatgaattgctacttgctatttgattggccatcgtgattcatgcacaacttactatctgactctctttaattaattaaacctttagagtgtatgttgaaagctaattttatttacgaccacctccatctcaaaataaatcaatttatagagctgtacaaagtaaagctattttaagtttgaccaaatttataaaaataacacaaatatttatggccctaaactattatcatcatttaggtattaactctatgcataatgtacttagtgtgatcgttgatgatttttaatataaataaaattggtaaaacttaagatagttttggggatgtagggccggggtgctagggtttctcataggcacatcaaatgtcgtccatgagttcaaatatggacgattgaataattcatgt

SEQ ID NO: 18039 - DNA, 2708 bp, Zea mays
  misc_feature (846)..(846): n is a, c, g, or t
  misc_feature (848)..(848): n is a, c, g, or t
cattgggtacctcgaggccggccgggaccttcggctccgcgggcccggcccccaactcccaactccctgccgtgcaacgggggtgagatcttgtgttctcgtaggctatgccttccccgatggctcgcgtcctgcaccgccgtctcctcctcctcgccgccgtctccttcgccgtggtcgcttctctccttcgcccagctgctgcagtgcgcccgtttgttttggttctctccggtgaggacttcctcaaggattcggccgcgcacccgtccctcccctctgccgactccaccgacgacgacgggtgggacgacttcgccgacgattcaccagccgccgacccgctcctctccccgtcctcctgggtccctcttcttgacccagcaagccctcccctttctggcgatgagacggactcgtcggccgacgcgctcttcgtcgcgggcgcccgcgcgatgctctccgcagcgtccgatggggacgacgcggcgttcgccacggctgccgcgcagatcgaggccgcggcagaggcggggcacccgggcgcgcagtccgcgctcgcgttcctcaccggcgccgggatgacgcgcccggcatcccgatcgctcgcattcctgttgcacaagttcgccgccgacgcgggagatcttcagtcaaagatggccctcgcgtactcctacttccgccaggagatgtatgaagaagctgttatactatacgctgaacttgcagaagctgccctaactagctccttgatatcaaaggagccaccagtgattgaaccaatccgtcttcacagtgggactgaagaaaataaagaggccttgaggaagtcccgaggcgagngnacgatgaagattttcaaatcacggagtaccaggcacagcgaggcaatgctgctaacatgtacaaattagggcttctgtattactatggcccacgcggccgccgccgtgattatggaaaagcttttcattggttttctaaggctgttgagaaaggcgagacacgagcattggaacttctgggtgagatctatgctagaggtgctggagtggaaaggaactatactgaagcatacaagtggttggcacttgctgcaaagcagcaacattactcagcttacaatggattgggttatctatatgttaaaggctatggggtggagaagaaaaacctgacaaaagcaaaggaactttttgaacttgcagccgagaataaggaagctgggggacattataaccttggtgtgttgtatcttaagggtattggtgtgaagagggatgtaattagagcatgcaatctcttgcttcatgcagttaatgctgggcaaccaaaagctatttatcaggtggcgaaactgttccagaaaggcattggtcttaagaggaacctccatatggcaacaatgttgtacaagtctgttgctgagaggggaccctggagttcattgtccagatgggctttggaatcttatttgaaaggcgatgtagggaaagcattgctcttgtattccagaatggccgatcttggatatgaggttgcacagagcaatgctgcctggattcttgataggtatggtgatcaaagtatttgcatgggagaatctagtttttgtacagatatggaaagacatcttcgtgcgcatgctttgtggtggcaagcatccgagcagggtaatgagcatgctgcattgttgattggcgatgcctactactatggtcggggcgtagcaagggactatgaacgtgcagcagaggcatatatgcatgctcggtcacagtctaatgctcaggctatttttaaccttgggtacatgcatgagcatggtcatggacttccccttgatttgcacttagcaaaaagatattatgatcaagccgttgaggtggattcagcagctaagctccctgtcatgcttgcactaacaagtttgtggctaaggaagaactacgcagacagttttttggttcgctttatcgattcacttccagaaatatatcctgttgttaacaaatgggtggaagatgttctcctggatgaagggaatgccacaattttgactctctttgcttgccttgtaactgtcctctacttgcgagagcgtcaaaggcgtcaagtggcagcagccaacccccaacaacctgatgatgtggtcatgtaaatgtctgttttcatgacatgtgcagccctgttgcttgagggaattggagatgtaaaacggtagctccttcacatgactcatgtacactaaattgagtaggggacatgaaaacctgtggaaactcagacaatgtttcctgcctggtgaatattcacctttccaagacttgggagctatgcttgtaaaggacaacatttcttggaaactggctgcttagaaatattgtttagaaatatcacagatgtttaaaagtagacttttccccccttgtgcatttgcacggccatcgaatttcgacaagcacacactgatagcatatctggaagaggcaactttgcaattggtagtttaggggtcagattaactttccatcagcatttaaacacactgcatagttttcgctggatgttttaattgaaaatgggcggtgcaaaactgcatattgggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaac

SEQ ID NO: 18040 - DNA, 1362 bp, Zea mays
gatataggtggagaaatttagagggaatcgctgagagttgtcttaggcatgccttccccgatggctcgcatcttccaccgccatctcctcctcgccgtcgtcaccttagccgtggccgcttctctccttcgcccagctgccgcagtgcgcccatttgttttggttctctccggtgaggacttcctcaaggatccggccgcgcacccgtcccttccctctgccgactccgacgacgacgatgggtgggacgacttcgccgacgattcaccggccgccgacccgctactctctccgtcctcctgggcccccctcctcgacccaaccatctctctcccctctggcgatgagacggactcgccggccgacgcgctcttcgtcgcgggcgcccgcgcgatgctatccgcagcgtctgatggagacgacgcggcgttcaccacggctgccgcgcagatcgaggcctcggcagaggcggggcacccgggcgcgcagtctgcgctcgcgttccttaccggcgcagggatgacgcgtccggcatcccggtcgctcgcgttcctgctgcacaagttcgccgccgacgcaggagatctccagtcaaagatggccctcgcgtactcctacttccgccaggaggtgtggtggtcaataccgtttactctaaggtctagtttgggtactctagtatttaagtggtttggagggattgaagagtgtataaattccaacagatcaaaaactcacacaatacatcttaatccacttcaatccctctcactactagagtacccaaactaggcctaattgggggttgaatgcttgagttcgttggcgcgcttgcaaattgaggaggttttcggttcaggtgttagctttcgttcttggggtagattaaattgcgaaaggttagttccctggggtgagcaggcatcagaattgcaagttgtttcagttaatcaattggtagtccacttgctgaaaaaaaaaaaaaaaattgatattatttgctggtagaaattgcaaggcctgtgtcttgtaatttatagtatggttcttatttttaccacaacattttttaaaaaaaattatgcacaaacattacacaatatagaatcaaattctctcttcatcattgtagggttatatgtaatgttaggtctacaaatttttcactagaactgatgctttccatgacacaaagccatcttacaagttggagctaatttaagatgcagcaatcgaattgacaaaatttatcagtactaaccatgatgatttttttcttgaataccagtgagcatcctgctttaaccatgtttacttttttttatcttgcatccagagttccagacatggattcggatgcac

SEQ ID NO: 18041 - DNA, 766 bp, Zea mays
atggtgtcgcttgcgtagagttcattgctggaaaggaaggccatgttgactatgacacagttcctggtgtggtttatacgcatccagaagttgcatctgttggcaagactgaggagcaggtgacggctctaggaattccctatcgtgtgggcaagtttccacttttggctaacagtcgtgcgaaggccattgatgatgctgaaggggtagttaaggtgatcgcggagaaggaaaccgataagattctaggtgtgcacataatggcacccaatgctggtgaaatcatccatgaagctgtcatcgccttgcagtatggagcatccagtgaggatgttgctcgaacatgccacgcacaccctaccgtgagcgaggccctcaaggaggcttgcttgcaaaccttcaataaagcaatccacatataatttctcattttctatttccttgccatccaaacttttggctcaacaagatccaaagtttatggtaattttgggcctgttggaacagaaggcctccagttgtccttttgttttgttggcaataatgtgaattctttgagttgcccacatcttatagtcgtttatgcttcattggcatggcatatccatccaaattccaaaataatgttctgatactatgttttactgtgtatgcccatgaaccattgatggatacatttcggacgttccagtatggccgtgttcgtgccttgatttctttttcaaaaaaaaaaaaaaaaaaaaaaaaaaaaaaaaaaaaaaaaaaa

SEQ ID NO: 18042 - DNA, 2107 bp, Zea mays
cggacgcgtgggttttgcttcctcgcacgagaccattacctagaacatcctcatcaaccaatctcaactctctcccttcctctctctccagcgcacaaggatcttttcttcgggcagggacggccaaggaagcgcccgcggagagagatgatgctggcgatcctagcgaggcggcgtgccgcggaggccgtgctgcggcggccgcaggcggcggcgggggcggccgtgtccgcctggagggcgtacgcggcggcgggcgaggagagcgatgtggtggtggtgggtggcgggcccggagggtacgtggcggcgatcaaggccgcgcagctggggctcaagaccacctgcatcgagaagaggggcaccctcggcgggacctgtctcaacgtcggatgcattccatccaaggctcttctgcattcatcacatatgtaccatgaagcaaagagttcttttgcacatcatggagttaagttttcaaatctggaagtggacctcccagccatgatggctcagaaagacaaagctgtggcaggactaacaaaaggaattgaagggctctttaaaaagaacaaggtgacttatgttaaaggctttggaaaattgtcatccccctcagaagtgtcagttgacttgattgatggtggtagcactgttgtcaaaggcaaaaacataataattgcaactgggtctgatgtaaaatcacttccaggaataacaattgatgagaagaaagttgtttcatctactggtgcactgtgcttgtcagagatcccgaagaaactggtggtaattggagcaggttatattggccttgagatgggttcagtctggaaccgccttggttcagaggtcactgttgttgaatttgcgccagatatagtaccatcaatggatggcgaagtcaggaagcagttccaacgcatgctagaaaaacaaaagttcaagttcatgctcaagacaaaggttgttgggtgtgataccagtggagatggcgtaaagctgacacttgagcctgcagctggtggtgagcagaacatccttgaagcagatgttgtccttgtctctgctggcagaaccccatttacttctgggattgggcttgaaactcttggcgttgagacagataaagctggcaggatccttgttgataagcgcttcatgaccaatgtgaagggagtctatgcaattggggatgcgatccctggtcccatgcttgcccataaagctgaagaggatggtgtcgcttgcgtagagttcattgctggaaaggaaggccatgttgactatgacacagttcctggtgtggtttatacgcatccagaagttgcatctgttggcaagactgaggagcaggtgacggctctaggaattccctatcgtgtgggcaagtttccacttttggctaacagtcgtgcgaaggccattgatgatgctgaaggggtagttaaggtgatcgcggagaaggaaaccgataagattctaggtgtgcacataatggcacccaatgctggtgaaatcatccatgaagctgtcatcgccttgcagtatggagcatccagtgaggatgttgctcgaacatgccacgcacaccctaccgtgagcgaggccctcaaggaggcttgcttgcaaaccttcaataaagcaatccacatataatttctcattttctatttccttgccatccaaacttttggctcaacaagatccaaagtttatggtaattttgggcctgttggaacagaaggcctccagttgtccttttgttttgttggcaataatgtgaattcgatgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgagcccatc

SEQ ID NO: 18043 - DNA, 1088 bp, Zea mays
caatatatataaatgaaaagagtaagcaagaacagggtttgtggtttttttttttatcatgcaacttttatttaaccaccacgatataccatcacatcacatccatgatccagcagactcggacaataacagtcgatccttacagctagtagcagcacacacgacacgagctaagcaaggaactggtacctgaacctcacaagtcacaacacggaggatcgagcagttcagtccatacgcgcctcgtcattacgtcttcactgactggctccgactccgagtacatacaactagtgcagttccagattatttatgcaataacagttttcgaattctaggatcttttgtaataaggttataaacttataatggagggtagatggatcttgctgtctctagtctcagatggcgaggacgaggcccggcagcgacttgtgcgcgctgtcggcgcggcggctctgccacaggcacctggaccctgcagctgcagacgacgacgcagccgaggggggtgaggaggaggaggtagaagaagaggcagcgtcctgctgctgcttaggcggagcagctttcttggcggaggcagcgccggcgaggagggtgacagtgaggtcggtgttgaagtactccctgagctgtgtgatgaccccgtcgggccccacggtccaggcgtgcacccagtagagctggcgcgcgtcgtcagcgccgccctccgcgacgacggtggacccgaaggcgtcgacggagcgcggggagaaggcgaacccgccgccgctcatgtggcgctggtggtccgcgccggtgaggaggcgcatcatgtgctggcgcgtggggggcccgtggaaccaccactcgaggtcgggcgccagcagcttccgcgcccggcgcgcgtcgcgggagccgagcgcctcgtacagccgcagcaccaggaagcggttgcgctgctccgccgactccccggcgagcgccgcctccgccagctcctgccgcgtaggctctcccatcctctcccccgatggatcgaggctgtggttctgagaaactgtcagtggaaacggctgctgtgtctgtgtggcagcccggccggc

SEQ ID NO: 18044 - DNA, 1690 bp, Zea mays
tttatattggatttatacatcctcttgaagttcttgtatcaccgcacctagagaattgtttacttcagttatatggcattatggaccattttcatttaggagacttctgattttatccatgctttacataattacattacatatttcaggctcttttgcattcatcacattgggttcctcgagcccggcgggcttttgcacaccatggagttaagttttcaagtctggaagtggacctcccagccatgatggctcagaaagacaaagctgtggcaggactaacaaagggaattgaagggctctttaaaaagaacaaggtgacttatgttaaaggctttggaaaactgtcatccccctcagaagtgtcagttgatttgattgatggtggtagcaccattgtcaaaggaaaaaacataataattgcaactgggtctgatgtaaaatcacttccaggaataacaattgatgagaagaaagttgtttcatctactggtgcactgtgcttgtcagagatcccgaaaaaactggtggtaatcggagcaggttatattggccttgagatgggttcagtctggaaccgccttggttcagaggtcactgttgttgaatttgccccggatatagtaccatcaatggatggcgaggtcaggaagcagttccaacgcatgctagaaaaacagaaattcaagttcatgctcaagacaaaggttgttgggtgtgataccagtggagatggcgtaaagctgacactggagcctgcagctggtggtgagcagaccatccttgaagcagatgttgttcttgtctctgctggcagaagcccatttacttctgggattgggcttgaaactcttggtgttgagacagacaaggctggcaggatccttgttgataagcgcttcatgaccaatgtgaagggagtctatgcaatcggggatgccatccctggtcccatgcttgcccataaagctgaagaggatggtgtcgcatgcgtagaattcattgctggaaaagaaggccatgttgactatggcacagttcctggtgtggtctatacacatccagaagttgcatctgttggcaagactgaggagcaggtgaaggctctaggaattgcctataatgtggggaagtttccacttttggctaacagtcgtgcgaaggccattgatgacgctgaaggggtagttaaggtgatcgcagagaaggaaacagataagattctgggcgtgcacattatggcacccaatgctggtgagatcatccacgaagctgtcgtcgccttgcagtatggagcatccagtgaggacgttgctcgaacatgccacgcacaccctaccgtgagtgaagccctcaaggaggcttgcttgcaaaccttcgataaagcaatccacatataatttctcattttttgtgtccaaactccaaagtttgtggtaattttgggtctgttggaaaaaaggcccctgattgtccttttgtttttgtcggcaatactgtgaattgaccctttgagttgtccatcttagcggggttttgtgcttccttggcttggtttatccatccaaataataacctgatactatgttttacattttatgcccatgaaccattgatggatatacatttctaaggttccagtaaccgcagtgttttgcgatgtttacatgtgactgttgctgtgagggcc

SEQ ID NO: 18045 - DNA, 1454 bp, Zea mays
  misc_feature (1249)..(1249): n is a, c, g, or t
  misc_feature (1317)..(1317): n is a, c, g, or t
  misc_feature (1333)..(1333): n is a, c, g, or t
  misc_feature (1397)..(1397): n is a, c, g, or t
tgggacctcgagccggcgggcgggctttccttgtctttcctccccggttggccggttccccacgcccaccttttcttcttcccatctcgtctctctcttcagcgcgcaaggatctcttcgtcggggagagaggaccaaggaagcgcccgcggagagagatggcgctggcgatcctagcgaggcggcgggctgcagcggccgtgttgcggcggccgcagacggcggcgggggcggccgtgtccgcctggagggcgtacgcggcggcgggcgaggagagcgacgtggtggtggtgggcggcgggcccggagggtacgtggcggcgatcaaggccgcgcagctggggctcaagaccacctgcatcgagaagaggggcactctcggcgggacctgcctcaacgtcggatgcatcccatccaaggctcttttgcattcatcacatatgtatcatgaagcaaagagttcttttgcacaccatggagttaagttttcaaatctggaagtggacctcccagccatgatggctcagaaagacaaagctgtggcaggactaacaaagggaattgaagggctctttaaaaagaacaaggtgacttatgttaaaggctttggaaaactgtcatccccctcagaagtgtcagttgatttgattgatggtggtagcaccattgtcaaaggcaaaaacataataattgcaactgggtctgatgtaaaatcacttccaggaataacaattgatgagaagaaagttgtttcatctactggtgcactgtgcttgtcagagatcccgaaaaaactggtggtaatcggagcagggtatattggccttgagatgggttcagtctggaaccgccttggttcagaggtcactgttgttgaatttgccccggatatagtaccatcaatggatggcgaggtcaggaagcagttccaacgcatgctagaaaaacagaaattcaagttcatgctcaagacaaaggttgttgggtgtgataccagtggagatggcgtaaagctgacactggagcctgcagctggtggtgagcagaccatccttgaagcagatgttgttcttgtctctgctggcagaagcccatttacttctgggattgggcttgaaactcttggtgttgagacagacaaggctggcaggatccttgttgataagcgcttcatgaccaatgtgaagggagtctatgcaatcggggatgccatccctggtcccatgcttgcccataaagctgaagaggnatggtgtcgcatgcgtagaattcattgctggaaaagaaggccatgttgactatggcacagtcctgggnggtggtctatacactnccagaagttgcatctgttggcaagactgaggagcagggtgaaggctctaggaattgccatatgngggggggaaaagtttccaccttttgcctaacagtcgtgcgaaggccattgatgacgc

SEQ ID NO: 18046 - DNA, 1962 bp, Zea mays
ccggccgggaacaaagcaaagcagcttctctctctctgtctctctctctcgcctccctctcgacgacgatctcaggcgctcgcggggagtcgagtcgagaccagcctcgttccttcataaaaagctcacttagttgttgtccccgcatctttttttagctgttcttgtttgattacatcatcttattttgtgcttgaatctaacctgccattaagtttttatcgcttcgttatttctctgttgtgcttgtcttgttcttttgttgctctaaccatggacgcaggctcccgctcgatctcctcggcgaagaaccgcgccgccgccgcgccccggccgccgctgcaggaggcgggctcccgcccctacatgccatcgctgagctcgggaccccgcaacccgtcggccaagtgctacggcgacaggttcatcccggacaggtcggcgatggacatggacttggcgcactacttgcttactgagcccaggagggacaaggagaacgcgtcgggcatggcggcgtccccgtccaaggaggcgtaccggaggctgctcgcggagaagctgctcaacaaccggacacggatcctcgctttcaggagcaagccgccggagcccgagaacgtttcttttgcggacacgacttcctccaacctgcaggccaagccggccaaacagcgtcgccacattccccagtctgccgagaggaccctagacgcaccagagctagttgacgactactacctcaacttgcttgactggggaagcaacaacgtgctatccattgctttgggagacacggtgtacctgtgggatgcatcgagcggatccacatccgagcttgtgaccgtcggcgaggacagtggtcctgttacaagcgttagctgggctcctgatggtcggcacatggccgtcgggctcaactcgtctgacgtccagctctgggacaccagctccaaccgactgttgagaacactcaggtgcgcatgaggcaagggtaggctcgctggcatggaacaacagcgtcttgaccaccggttgcatggacggcaagatcgtgaacaatgacgtaaggattagagaccacgtcgtgcagaggtacgaggggcacagccaggaggtctgcgggctcaagtggtctggatcagggcagcagctggccagcggaggcaacgacaaccttctgcacatttgggatgtgtcgatggcatcatccatgccatctgctggccgcaaccagtggctgcataggctcgaggaccacatggccgccgtgaaggcactcgcgtggtgcccgttccagagcaacttgctggccaccggcggcggtggcagcgaccgctgcatcaagttctggaacacgcacaccggtgtgtgcctgaactcggttgataccggatcgcaggtgtgcgctctgctgtggaacaagaacgagagggagctgctgagctcacatggattcacacagaaccaactcaccttgtggaagtacccatcgatggtgaagatggctgaacttaatggccatacctctcgcgtcctcttcatggctcagagtcctgatggatgcacagtagcgtcggctgctgctgacgagaccctccggttctggaacgtttttggaacccctgaaacgcccaagcctgcagccaaagcttcccacaccggggatgttcaacagcttcaaacatatccgataggatgagtgagtcaagactattattggatattgtctatacttgacttgatgatggcctgtcgttttcggaaggtcagaaatcaatgacacagggtttgcttcagaaatcagatgtaatgttttttcctcatttttggttggaacatcaagggcgcttgtttgatgtaccaattattgtaaatcaagacagcaatatatataaattgatattttgtcggttggatttggcaaaaaaaaaaaaaaaaaaaaaaaactcgagagggggg

SEQ ID NO: 18047 - DNA, 1918 bp, Zea mays
gaaggaaactaaatgattattcaagcaaaataaatacatcaagaagcacaagataagcattcaacccctacagagggttgataattatttaaattctggagtgtgcgtactgaaggaatacaaaaattacaatcctgtttgtcaggcaacgcagtccaaacccaggcacccgatccacatgctccaaaccacccttctcatctgaaagcagcatgacgataaattttgtgagagaagagatgagttttaccaataatatgttgaagttgaacaagtggatatgactcacagtacgtgtgtaagtaatgaactcaaatgagctgcagaaggagatggaacaaaactacaaatatagaaccttttgtttaaaaaaaaccttatgttcaagagtggtttttttttgtagcatgagcacattattgctttattcacctgtctagtacatggacacctttatttaagctcatgagagaaatcatctgaaattaaacaatgcaagaaagagctatgcaaacaattaattatatgcccaccaaaggaattaattcttgcgttgggccgggcaaatatatatatagcttttccgatccgtggtgtttctttgtacgtagtatatatatatacctttctaggtttttcgtacatcggtggtcgttggggcactttgtacagatcctcatccacagcttgactaacgataaccttacgcttcatcactgggtatgcaacagcggcttcagcagctcgcacgccgccgccgtcctgcaactcgttggcgccgtcacagtgcttctccacttccctccttatcacctgacacacactcatccagttactaatacgcgacgccgagcgaatttaatgaatggactcggatcagggaaaacataccttgatctgggctgcaggcttgcgttggaaagaaggggtccgaaacaagacaagctgttccccgccggcgacgccgcctttctcgccaaccacgacggcggcggcggcggcgctgccacggcagttccagcgcttcatcagcctggcctgcatggctgagtcgaagtactgcgtgatggagagatcactacagtagttccacattccaaacgccgggatctgacaccccatcatcttctgatatagatagtacaacagtaaaaatatatactcacggttagacagacagagaactaagagaagtgaagaataacatctcattccagcagaaagaaacgatgctagctagtaatagcttcaaatatacgagtctttgcatgcagaatcctgtttaatttggatctgactcacctccatctccatgcaatgtcgtcgacgacaggagactctcctacatcccaagagggccagatgaggtggtcaggccatatatagcttttaggcgcgcggtctggtggtgcagcccagagatgcggtgatgcagcgtgcacatttatatggacgagtgttttgtcgcggtcatggggttcatgcattggcggtggcagtgcagactgcaggctgcctgcacgcaggccggccagaggagcgtctgccattgatggcggcacgtaaacggaaggggccaaaaggctgggcagcatgcagatggccggaaaaccaaattataataatggttcgcgctgcacgcagatctgctgaatgatttggatacgcatcaagctgcgcaggagtagtaatgccatgcatgtggcagtagtagtaacgctatgtgcatgtaattatttaaggacatgcatgcctgttgctaactcttatatgcaagctaatattgaatccattttaacaacaggaaaaacaatttgacatctagcatggatcatgtacaaataaaactaatacctgcattagcataatcatatttaaatagattatcatatgcagtatagaaagacatagattaagg

SEQ ID NO: 18048 - DNA, 1140 bp, Zea mays
ccccgcgggggccggggcggggtttccggggggcgccaccacgcgcgctgttctgcgtgcgagcgacagctgggctcctggtggtcggcacatggacgtcgggctcaactcggctgacgtccaggtgtgggacaccagctccaaccgactgctgagaacactcagaggtgcgcatgaggcacgggtaggctcgctggcatggaacaacagcgtcttgaccaccggttgcatggacggcaagattgtgaacagtgactgcaggattagagaccacgtcgtgcagaggtacgaggggcacagccaggaggtctgcgggctcaagtggtccggatcagggcagcagctggccagcggaggcaacgacaaccttctgcacatttgggatgtgtcgatggcatcatccatgccatctgctggccgcaaccagtggctgcataggctcgaggaccacatggcccccgtgcaggcactcgcgtggtgcccgttccagagcaacttgctggcctccggcggcggtggcagcgaccgctgcatcaagttctggaacacgcacaccggtgtgtgcctcaactcggttgataccggatcacaggtgtgcgctctgctgtggaacaagaacgagagggagctgctgagctcacatggattcacacagaaccaactcaccttgtggaagtacccatcgatggtgaagatggctgaacttaatggccatacctctcgcgtcctcttcatggctcagagtcctgatggatgcacagtagcgtcagctgctgctgacgagaccctccggttctggaacgtttttggaacccctgaaacgcccaagcctgcagccaaagcttcccacgctgggatgttcaacagcttcaaacatatccggtaggatgagtgagtcaagactatacttgacttgatggcctgtcgttttcggaaggtcagaaatcaatgacacagggtttgcttcagaaatcagatgtaatgttttttcctcatttttggttggaacatcaagggcgcttgtttgatgtaccaattattgtaaatcaagacagcaatatattttgtcggttggatttggaaattgttgtaaatcaaggcaaccgtttgtttcacaaaataaaaaaagatatttcgcgt

SEQ ID NO: 18049 - DNA, 2335 bp, Zea mays
accttccctctccctgcttccctcctgctacaaataaaaattcgtggggcggccgcacccgaaaacgccccacagccccacagcgcaagcgagcagatcctcctccctctctgcatcctggcctcctctctgcctccccacgccgatctcgagcacctggggagaccgcgagacgtgcgcctgatttttctcatcgcagcagccctcaagttccccacctcttttttcttgcagctttcaattaatctggttatttagctacatctttattttactttcattttgcctttaatctgtttagttccattgcatcttctgcggttgcagttagtattgctgtttgttgctccgtgtttcttgttcttttgcttctaaccatggacgcaggaacctactccatctcatcagagaagagccacacggcggcagcggcgcggccccctcttcaggaggccggcactcggccctacatgccgtcgctgagcacaggatcgcgcaacccgtcggccaagtgctacggcgataggttcattccggacaggtcggcgatggatatggacatggcgcactacctgctcacgaagcccaggagggacaaggagaacgctgtggcagcgtccccatccaaggaggcgtaccggaggctgctcgccgagaagttgctcaacaaccggacacgcatccttgccttcaggaacaagccgcctgtgtctgagaacgtctcggcagccatcgcagcttcctcccaccatgccaagctggtcaagcagtgtcgacatattccccagtctgcagagaggattctggacgcaccagagcttgttgacgactactacctcaacctgcttgactgggggagcaacaacgtgctatccattgctctgggcgacacggtatacctgtgggatgcctccagtggatccacgtctgagcttgtgaccattcacgaggacagtggtcccatcaccagcgtcaactgggctccagatggccaccatatcgctattgggctcaactcatccgatatccagctctgggacaccagctccaaccgactgttgagaactttcagaggtgtgcatgaggaaagagttggctcactggcatggaacaacaacatcctcaccactggcagtatggatggcaagatcgtgaacaacgacgtgagaattaggaaccatgttgtacagacatacgaggggcacagccaggaggtgtgtgggctcaagtggtctggatcagggcagcagctggctagtgggggtaatgacaaccttctgcacatctgggatgtgtcgatggcatcccccatgtcaaccgctggccgcaaccagtggctgcacaggctcgaggaccacatgtccgctgtgaaggcactcgcgtggtgtcctttccagagcaacttgctggcaactggtggtggcggcagtgatagatgcatcaagttctggaacacacacactggagcatgtctgaactctgttaacactggatcacaggtctgtgcccttctatggaacaaaaatgagagagagctgctgagctcacacggattcacacagaaccaactaaccttgtggaagtacccatcaatggtaaagatggctgaactcagtggccatacctctcgtgtccttttcatggctcagagccctgatggttgcacagtagcatcagccgctgcggatgagacccttcgcttctggaacgtatttggagaccctgaagtggccaagcctgcagccaaggcttcccacactgggatgttcaacagcttcaaccatattcgataggaacaagtcatgagaacgatcccttctgttggaaatggccgtgcatcatatgtgaggtctattcctattgatgagatctatccacattgagtaagcacacaacatcagcgagcattgccatcatatgcatcattcagaaatccaggatcagggccgtaaaagggttggactatgtatctgcaacatcgcaagcaacagggaggctgtctcttcagaaattttcaagaggacgtgtcagtaacatactcaggaggccgtctcttcattcaaagagtatcttttacacgacttcttgagtataaaaaactcatttgtacaatcctacctgtctattgaattgtctttagaaaaaaaaagtctttattgtatgtacttttttttttatcttttatgcctgaagaactgttttccccttttcttttagaagtaggagccggtaaagctactctttcaatttgtcacaagcattatttatttttataatttgtcctctgtttcattgatttcaaaaaaaaaaaaaaaaaaaaaaaaaaaaaaaaaaa

SEQ ID NO: 18050 - DNA, 2320 bp, Zea mays
attgggtacctcgaggccggccgggggctacaaataaaaattcgtggggcggccaaaccctaaaacgccccacagcgcaagcgaccagatcctcctccctctgcttcctggcctcctctctgcctccccacgccgatctcgagcacctggggagactgcgagacgtgcgcctgatttttctcatcgcagcagccctcaagttccccacctcttttttcttgcagctttcaattaatctggttatttagctacatctttattttactttcattttgcctttaatctgtttagttccattgcatcttctgcggttgcggttagtatttctgtttcttgctccttgtttcttgttctttttcttctaaccatggacgcaggaacctactccatctcatcagagaagagccacacggcggcagctgcgcggccccctcttcaggaggccggcactcggccctacatgccgtcgctgagcacaggatcgcgcaacccgtcggccaagtgctacggcgataggttcatcccggacaggtcggcgatggatatggacatggcgcactacctgctcacggagcccaggagggacaaggagaacgcggtggcagcgtccccatccaaggaggcgtaccggaggctgctcgccaagaagttgctcaacaaccggacacgcatccttgccttcaggaacaagccgcctgtgtctgagaacgtctcggcagccatagcagcttcctcccaccatgccaagctggtcaagcagcgtcgacatattccccagtctgcagagaggactctggacgcaccagagcttgttgacgactactacctcaacctgctcgactgggggagcaacaacgtgctatccattgctctgggcgacacggtatacctgtgggatgcctccagtggatccacgtctgagcttgtgaccattcacgaggacagtggtcccatcaccagcgtcaactgggctccagatggccaccatatcgctattgggctcaactcatccgatatccagctctgggacaccagctccaaccgactgttgagaactctcagaggtgtgcatgaggaaagagttggctcactggcatggaacaacaacatcctcaccactggcagtatggatggcaagatcgtgaacaacgacgtgagaattaggaaccatgttgtacagacatacgaggggcacagccaggaggtgtgtgggctcaagtggtctggatcagggcagcagctggctagtgggggtaatgacaaccttctgcacatttgggatgtgtcgatggcatcccccatgtcaaccgctggccgcaaccagtggctgcacaggctcgaggaccacatgtccgctgtgaaggcactcgcgtggtgtcctttccagagcaacttgctggcaactggtggtggcggcagtgatagatgcatcaagttctggaacacacacactggagcatgtctgaactctgttaacactggatcacaggtctgtgcccttctatggaacaaaaatgagagagagctgctgagctcacacggattcacacagaaccaactaaccttgtggaagtacccatcaatggtaaagatggctgaactcagtggccatacctctcgtgtccttttcatggctcagagccctgatggttgcacagtagcatcagccgctgcggatgagacccttcggttctggaacgtatttggagaccctgaagtggccaagcctgcagccaaggcttcccacactgggatgttcaacagcttcaaccatattcgataggaacaagtcatgagaacgatcccttctgttggaaatggccgtgcatcatatgtgaggtcgattcctattgatgagatctatccacattgagtaagcacacaacatcagcgagcattgccatcatatgcatcattcagcgatgctaatcagaaatccaggatcagggccgtaaaagggttggactatatgtatctgcaacatcgcaagcaacagggaggctgtctcttcagaaattttcaagaggacgtgtcagaaacatactcaggaggccgtctcttcattcaaagagtatcttttacacgacttcttgagtataaaaaactcatttgtacaatcctacctgtctattgaattgtctttagaaaaaaaaaagagactttattgtatgtactttttttatcttttatgtctgaagaactgttttccccttttcttttagaagtaggagccggtaaagctactctttcaatttgtcacaagcattatttatttttataatttgtcctctgtttccttattggaaaaaaaaaaaaaaaa

SEQ ID NO: 18051 - DNA, 2008 bp, Zea mays
caaataaccattcacggccgatccctaaaccgccaacaaatcgccccacacagtctctctctgtctctctctctcgcctctctctcgcctccctctcgacgacgatctcaggcgctcgcggggagtcgagtcgagaccagcctcgttccttcataaaaagctcacttagttgttgtccccgcatctttttttagctgttcttgtttgattacatcatcttattttgtgcttgaatctaacctgccattaagtttttatcgcttcgttatttctctgttgtgcttgtcttgttcttttgttgctctaaccatggacgcaggctcccgctcgatctcctcggcgaagaaccgcgccgccgccgtcgccgccgcgccccggccaccgctgcaggaggcgggctcccgcccctacatgccatcgctgagctcgggaccccgcaacccgtcggccaagtgctacggcgacaggttcatcccggacaggtcggcgatggacatggacttggcgcactacttgcttactgagcccaggagggacaaggagaacgcgtcgggcatggcggcgtccccgtccaaggaggcgtaccggaggctgctcgcggagaagctgctcaacaaccggacacggatcctcgctttcaggagcaagccgccggagcccgagaacgtttcttttgcggacacgacttcctccaacctgcaggccaagccggccaaacagcggcgccacattccccagtctgccgagaggaccctagacgcaccagagctagttgacgactactacctcaacttgcttgactggggaagcaacaacgtgctatccattgctttgggagacacggtgtacctgtgggatgcatcgagcggatccacatccgagcttgtgaccgtcggcgaggacagtggtcctgttacaagcgttagctgggctcctgatggtcggcacatggccgtcgggctcaactcgtctgacgtccagctctgggacaccagctccaaccgactgttgagaacactcagaggtgcgcatgaggcaagggtaggctcgctggcatggaacaacagcgtcttgaccaccggttgcatggacggcaagatcgtgaacaatgacgtaaggattagagaccacgtcgtgcagaggtacgaggggcacagccaggaggtctgcgggctcaagtggtccggatcagggcagcagctggccagcggaggcaacgacaaccttctgcacatttgggatgtgtcgatggcatcatccatgccatctgctggccgcaaccagtggctgcataggctcgaggaccacatggccgccgtgaaggcactcgcgtggtgcccgttccagagcaacttgctggccaccggcggcggtggcagcgaccgctgcatcaagttctggaacacgcacaccggtgtgtgcctgaactcggttgataccggatcacaggtgtgcgctctgctgtggaacaagaacgagagggagctgctgagctcacatggattcacacagaaccaactcaccttgtggaagtacccatcgatggtgaagatggctgaacttaatggccatacctctcgcgtcctcttcatggctcagagtcctgatggatgcacagtagcgtcggctgctgctgacgagaccctccggttctggaacgtttttggaacccctgaaacgcccaagcctgcagccaaagcttcccacactgggatgttcaacagcttcaaacatatccgataggatgagtcaagactattattggatattgtctatacttgacttgatgatggcctgtcgttttcggaaggtcagaaatcaatgacacagggtttgcttcagaaatcagatgtaatgttttttcctcatttttggttggaacatcaagggcgcttgtttgatgtaccaattattgtaaatcaagacagcaatatatataaattgatattttgtcggttggatttggaaaaaaaaaaaaaaaaaaaaaaaacccgggggggggcccggt

SEQ ID NO: 18052 - DNA, 2555 bp, Zea mays
attccaccaccaccgacaccaactgcgccgaggccggaggcggagtagagccagaccagaatggtattggggggaggccctctaggcgccttcattggccgctacccctcctcctccgccgccgccggtgacgatgaacaaggggacccgggacccggaggaggcgtcattcgccatgaccgcaagtgccgggactggcccttcctcgtcctcttcgccgccttctgggttgccatgattgtcaactccagcttcggattcaaccagggcaacccactcaggctgacatacggactggactacaaagggaacatatgtggcagcaggcatgccgatcctgatttgtatcagttagatgttcgctattgggtgaaccccaaccaggtctaccaaagtggcctcaaaaccagtcacatcgagctacctgatgctaaaaccatctgcctgatggaatgcccacttcctgccgaagatggcttgaattttgtttgcgattatccagaaggtgacatacgcctctctgtcgacgactggattgacgcggtcgccccgcgccccccccgcctcccgccaggcctgaggaatagttctcttcagctgcagggtccatgttaccctgtcatatttccaagtgtaaatgtctactggagctgccagtttattgcacgggcatccaatgcctctttaaagcattggaaggacatgggtggtgtcaccatcgacgagaacatgctaatagacagaacaattcatgatgcaattaatagcaaatctgccgtcatgaagagatatgttgcagatattgggaagtcctggcctgtggtaatcctttgtgggggattactccctttgttcctatctatgatctggttactcatggttcgcttttttgttgctgggatgtcttggataacagtggtggtcttcaatgctcttgtggtatctgttacaatgttcttctatataaaagctggttggattggccatgatcctttgactgttgtaattggtgaaagtgatccttacgttagcataggtggacgagagataaatcaccttcatgctgcttccgtcttgatgacagtgataatgatacttgctttcctgacttcaatagctatcgctcggcgcattatgaaagcaacatcagtcctaaaggttgctgcaaaggtcgttggcgaagtgcaggcacttattatttttccagtcgtgccatacttgatcctcgctatcttttacactttctggttttcagcagcacttcatcttttcagcgccggtcaagttatacaaaatgattgcaatacagattgctgttcctacgatctgaaacttggcaaagtaaattgtgacagatgttgtggctacactatccattacaccccacatattggcatcgccattcttttccatctttttggctgttactgggcaacacagtttttcatcgggtgttcttcgactataattgccggatcggttgcttcatactactgggcacgcggtgaaatatcgcacgatatccctttccataccgtggtatcttccctgaagcgcttgttgcgctatagcctgggatctgtggctctgggctcactgatagtgtccatcgtagagtgggtgcgattcatactagaatcactacgccgcaggctgaaatttgttgactctgcccgcggaagccggttcgggaagacggtatcatcctcatcccagtgctgcttaggctgcatcgattggaccctgaaatcggtgaatcgaaatgcctatgtcatgattgccatcacagggaaaggattctgcaaggcttccgtgctagcgactgggctgatcatgaacaacgtattgcgcgtcgggaaggtgaatgtcattggggatgtgatcctcctgttgggcaaactttgtgttagcctgttgtgtgcgctgtttgccttccttatgctggacgagcacaagtacagatctgggcataacaagatctcatcgccgctggtccccgtgctgctgtcgtgggcgctgggctatatagttgcgaagcttttcttcgcagtggtggaggtgtcgatcgacacaatggtcctgtcattctgccaggactcggaagagcatcaggggaacgcgcggtatgctcccccgctgctgatcgagacattggacgaggagagcgagttgcgaaggctgacacaggggccatgatcgatcttccaaataggaggcactgaactgaatggctgtggtgttggttgcatgtcttttttatatgaatcatcactggggttgatggatggagctataggtgcaagcatgtcttttttactttttatatgtatcagctaaatacgaggaatagaatagaatagggcttagtgctggaattgaaacccacggtctgtaatgtatgttcagctttatttgaccatgtctttttggtttaaatattgttagactgtgtgtatggcccggcaccactgttgggctgccgacccattagggttagtgttatgagtctatatattgtaccctatctcctatcaatacatcaaccactttacatt

SEQ ID NO: 18053 - DNA, 2039 bp, Zea mays
  misc_feature (393)..(393): n is a, c, g, or t
aatcagacgagtaaaccctttgcaaactaaatacatgttttttacactttttcatcttacatgaaaaaacttcaacacaagtttctccttttaccactctatccttaacacctttgaacccatggaaaatgaaaagtgggagactttaattgtattgtcctgttttagttctccatgcaagagcttcggcaggtcccaacaatatatataactctacgagcatgtactacctagatactaggttttagttctcaaagcactacatacatctaagaaaccacttcatacaacccaatgtatctaagtcttgtatcttatttactataacctatcaaaatacgactcatttatgtgggttgtattagtagaatcgtatctagacttagaaaaccntgttaaagatgttccttcaccaagataccgtctcttatgtttttttacatttattctcttgatatcgcttaagctagatacaatatatttacgtgagttgtacatgccctaattaatgtagcggtcattgaactttaataaccatccatatcaaagcatgaatggcttggatgattgattcgataaccgcctatataaatagccaatatttagagacggctgggatatccgcctcatgtgtcgcagccacctttaatatgtagttgttaagatatatatggaacattattttacatttaagcaataacaactttcctattatttttttgttcagtaatataattgaaatgttctagctgtaaaaattgattgccccatgcatatcattatggtttgggtcgtttcagcaacgaaaaccattgttctattgtactaagtatgttttatgtagtattccgtagacgatgaatcttgtttgctagccgctatcttaaataaatttcattctaattattgttatcgaagatttgataatttcctacgcgcgattaggaacggtacggtgtggcctctccaccactcacatacatcaggctctcgtcaactcacctccacccgttctcgtcttctgcctaaaccgcccggtttcgccgcacgctcgcgttctccgatcacgcatgccattgccatgcaacctaccacagaaatatgctcgtacgtacctgcgtccatgcctctcttcaccgacctgcaacaatcctcgcccaaattgtataatttcactcacccccaagagcgagcgaatcaacctctgccggaacatacagagcaatcctcttgcactgccacgtacggtgcacgcacgatggctgtgtcccgcgccgtcctgctcctcgtcatcctcacgggggctgccgcgtcctcgcccacggattccactcctgaggatgccgataccaagccgagcatcctgacccccatcgcgcacagcccgctgggatctttcgaaggcgccgatgggcccgtcgccgacaacgccatcgacgacgatgacgcggcgcccgtgggctcacccatcggcaccaccatgacggagccggagccgcagctcgcgccccccgggctccccgatagcagcgccaccgctgcttccgtaggccacccagtcgctgctgctgctgttgccgcagctatggccaccgccagcgccatctttgccttgtgagaggagggtgcatgtgactgtgtgtgcagctgtgcgcacgctagctgttaagttagagcggtattgattcacgcattatgtgttggtgttatgcttccaagttgtgcttgcacgtcttatccttcttttgtaatctttttttactgttttcattcaaaaaatatgttgttactgacgaactcaccagaaattagtaggggccgcctggaaattttcttctttttaatcctaggagataggcgcacaattcatgtgaatggttgtcccgccaaatgcacctaggcccatcacgtctcgttgatcgtgctcggcacgtgaatggttgcctgcacgcgtggaggccaatgcaacttgcacgcgcagatacaaccaaggcgaaaaagcatgtccgcttgaaccacactgttgtggacttgttttc

SEQ ID NO: 18054 - DNA, 2686 bp, Zea mays
  misc_feature (2629)..(2629): n is a, c, g, or t
taaactaacaataccttaaagagttattaggcagcaaatggtcagggaatacacagttacggtctaccgcaacgcgttaataaacacaaaggacaattatgaccagctgcgccagctcaccgatttatggcgatggcgcgttcgcgtctacggtctatccatctccaaaacgatgggcacgagaccattacctagaacatcctaatcaaaaaaaaccaagagctgaacagcaaattcctgtcccgcacatctgctcgccgcccagcgaacctgatggcgctcgtcgacacgaaggccgccggcgcgtccacctccaccgtggccgctgcgcccacggtggagcacctgttgttcctcgtcgtcctcgacggcgtcgagacgcccatccacgaggggacgctgtacggaagcgccgggggcacagtcaccgtcaccggccctggccagctctccgccgacggcctcgagagcgtcctggtgcgcggcggcgggaccgggaccggcgccgtgcggttcacgctctgcgccgacgcggccgccgagggcgtcggcgctgcgtgcttcgagcggtgcggcgcggcccgcgtggagggcgcgcgcgaggtgtccgtgtcctcgtgccgcgccgtggaggtggagcgcgcgggcagggtcaccctcgaccgctgccgcgacgcgcggctccgcggcggaggcgcgctccgcgccacgcggtgccggcgcgctgacgtcgagagcttcggcggggtgcgcctggcccggtgcaaggccgcgcgcgccgactggtgcggcaccgtacgaggtcgacgctgtgcagggccgtcgacgtccgccgctgcggagccgtcaccggagagcggtgccgcgtcgctgaacgctgcaggatgcggcagcgtcgaggtggcgcgggccgtgatcaacatggtggaggaagagcagccgtagccagcttgtactgtgatcgcggagcggctgaagacaattcattcccgattgtaaactgaacaagaatgctcctctttataaatggttcttcagtaggctttgtggttctcgttttaactgctttgatagttcattctcgatgtgacttccatatttccatatccactagaacgacactttttacaaatctctaaatataaaaaaaccatcaatttgatttttgaaggccacaccaagtggtgaacgttatcttcaaagctgttttttcactaataactgcaatacaattgggcttatcagcccagcagcccatccccagcagcactgcctcgtcgtctcgcatattggcgttggcatcaccgtcggcattgtgcccattaccatgccgccgctgcccgcggccgacgatttactcattctcgagttcatcgcgagcaaccgccgtatcccccacgccgtgttcaactccttcatcgcctcccaatccccaccctccgccttctcccgcacctcacagcgcctccgaaaagccctagtgctccgcgccctcgacgccgccctctacaccgtgggcgcctcctgctcctccagcctcctcctccacaaggcgcgaaaggtcctcgccgaccccgacgcagccgcctgcttcccccaccagattccttttacagaaaatgaagaaaacgatgaggctagggctgcggtggccgatctcaagcgcctcctcgaccttgagtgggccaacctcccgccctccacgctcgagctcgtcgccggggacgggtcccaccagactggtgccgctgccgaccacaccatgcgtacaaagcttcgcctgttcggtacctctattcacaaagctagcctagtccatatcctatttggttttgtttttgcttttgaaacaattgtcctgtttaccttttccaatgttgttgcttactgaaattaatgaatggatgaatgatgagattgtggttactccatttgccgtaggggagtcagcgaagcgtgaaattttagctaagcctgtgcaggttggatccgcttctcatcaatcaattcggacgcaagttgctgataacgcgagcaatgccaataaagctgatggcgcccggcgagatgaggcacatccttctaattctaatgtaaactatgaggctgatagtgatcgtgaaagtatggttgggcaccaaaatgcatcggttaaaggagcagagggtcaactttcagagaagtctgtctttacttctaaaaagcgcgttcttgtggagagaattccgaaggcaagcacttatcaggcactccttccattccaaattataagacattttaacttttctagatttattactacgtttctaaatatagtgtatatctaagtgtatagcaaagactatgcatctagtaaattcaaaacttttataattagggatagagagattaattaatttgtcgtgcttttattcgcattctgcccatgtattagatgataaagctaatcaatcccatatggaagtacccatcttctatcaactttgagtgcatcttagcttgccatttttggttaccaatatttccaaataaagtttcctttccggtttctgtattttctgctggctcgcttggttaaaatgcatatatctacttatgaatgaggaagttgttctctctctctgtgtgngtgtgcgcgcgcacgcgtgtgtgtgtgtgtgtgtatatatatatatatatatatata

SEQ ID NO: 18055 - DNA, 1000 bp, Zea mays
  misc_feature (892)..(893): n is a, c, g, or t
  misc_feature (993)..(993): n is a, c, g, or t
ctcgaggccggccgggccgggactgcctcgtcgtctcgcatattggcgttggcatcaccgtcggcattgtgcccattaccatgccgccgctgcccgcggccgacgatttactcattctcgagttcatcgcgagcaaccgccgtatcccccacgccgtgttcaactccttcatcgcctcccaatccccaccctccgccttctcccgcacctcacagcgcctccgaaaagccctagtgctccgcgccctcgacgccgccctctacaccgtgggcgcctcctgctcctccagcctcctcctccacaaggcgcgaaaggtcctcgccgaccccgacgcagccgcctgcttcccccaccagattccttttacagaaaatgaagaaaacgatgaggctagggctgcggtggccgatctcaagcgcctcctcgaccttgagtgggccaacctcccgccctccacgctcgagctcgtcgccggggacgggtcccaccagactggtgccgctgccgaccacaccatgcgtacaaagcttcgcctgttcggggagtcagcgaagcgtgaaattttagctaagcctgtgcaggttggatccgcttctcatcaatcaattcggacgcaagttgctgataacgcgagcaatgccaataaagctgatggcgcccggcgagatgaggcacatccttctaattctaatgtaaactatgaggctgatagtgatcgtgaaagtatggttgggcaccaaaatgcatcggttaaaggagcagagggtcaactttcagagaagtctgtctttacttctaaaaagcgcgttcttgtggagagaattccgaagtgggatagctctgatgatgatcagccagtgcggaagcgcaagttagatccatttgagagaannccatatccttctcctacatgtgcatataagatcagaaagaaatggagtaagatagagatagaaaccttgctggaaggggtggacaagtatggcataggcnactggaa

SEQ ID NO: 18056 - DNA, 2579 bp, Zea mays
tgcatgcctgcagcgacagggagtacatcataggccgcaggatatgggcatctgggaagacgttttactgtgtgaccaaggtatgagacaaaaatagcttatatgaactaatttctgctgcctgtgattgcgccgactccatgtttagctatccttgtactcagtaatgactttgatctggaactggatagggagtaaccatttagtgtaatgatgctttgtagagttgagtgcgagtgtaatgcggtaaggcatcaattctatgctgacagtgctttgtacctaagctgcaaaatgatttgctgtaggtggaataaaacttctgtgagccttggtatatagggttatcctatgttcccaaaccattccacaccagtggttgagatgctcgtcccactaggaaaatcgtcaaactacactttttcaatcattatgttctgaataaaaaaaaagaatcactttcttttcagtgttttgtttttgcccacagattacagtactatagtcgcacataaaaatgccatggcttcatctttttttgtgaatttatttattgttgagtgtaagctaccttgtttctgtcttccaccaactgcttcctggaagaaactgtttttggcatttcttttgttgtatctagaattttgtgtgggcatgctttttgtcatttcaaattatagatagcagcagctatgttaaacaatgagattaaacctcactcgccaattttttcaagggcgtgcctcgtccctctgttccaagacaaaacaaacctcgtcgtgtggacttgtactactcgagctggtgcatccgtccaggtactaatatcacagtcatttccaacctttgtactaggataccaaataactcaaggccatgcactcaactaatcctgtttttatctatcagttgaatcaagaaaaggcgacggtgcaatgactgcatgtgaggtgctcttattccaccatgaagatatggggatcccatgggagattgcgaagctcggtgtccggcaggggatgtggggctgcgtcaagaggatagagcctggccttcgggcataccaggttgcgaggactgctggagagcctatctcaaaacatgccgccatggcgcatgttaccaccaggttcgatgccgacgagctcgtcacggaagacagcgcggaggccagttcatccagtgacaacaacaagaccgccgaggttgagaagccaaagcactggacaaacaacatacccaaggttctcatgatcggcggcgccgtcgccctggcttgcaccttcgacggtggattgatgaccaaggccgccatattcggcacggcgaggaggtttgcagggccaggaaggcggtaggtggatggagctggtcaccctagagcaatgccatgctaatcatgtgtagcaaagcgttggttggatggatgcctggaagtgccctaagcagtcctttttgtagcaatgcactgcagaggacagaatgccttgtctagttgctcagtctagacatcatcctcatgttgcagataaggtggtgtgctcttattacagatcagtatcagttgagaaaaatagatccctgcacatcccgagaaaggaaatggacgacaaagatccagcgacacagagaagtgtacgtaagcagaccgggcatgcttgtgctgctgctgcagccgcgccgccgggttagagccagctggataggttagaaatgtagcattattatgaggacaaagtgtacgatgaacaaggttcattctggcagctgtacgacgaacaaggttcattgtcgttagatgaaacgacaagaattcactgctgtttagtaacaagaattcttggtcttgtagctctggcatctatttgttctcccctatggaaactagatgttgacctttttggcagttggtgcaggatttttgcacgtacaagtttttacccaaaaaaaaaaaaaaaaaaagcgacgcggggccttggaataagaaattaaaaaaaaaaaaaaaaaaaaaaaaaaaaaaaaaaaaaaaaaaaaaaaaaaaaaaaaaaaccccggggaaaactggggcagggggggggaaaaaagggacccaaacaaaacccccccctttttttttcttggaaattaaaaggggggggcccctgaaacccccccccgaaggatcccccccttctgggggaaaaccttggccccggccggaaaattggcccctttggggggggggccaggggggtggaaccccccttttttcggaagggggtccccaaaaaggttttagggtccccccccggggaaggggaaaatttttggggggggaattggaaaacttttggtaaagggaaagggaaaacccaccccccgaagggggaaaaattcctcaaaagtggggggggtccgggaaaaaaaaaaaagcccttcgggggagggttttttaaagggccaaaggaggggcttcccaacccccttaaaggccccaaaggggaccccctggttggaaaattttttggaaaaggtggcgaaatggtgggccaacccggaggcttaaaattttttggaaaaattaaccaagggggtttccc

SEQ ID NO: 18057 - DNA, 1464 bp, Zea mays
gtggattggggcgagtatcatgcaaatacaaacgatcgagaggttgaaactgcaaaatgacgcgtcgcatcgctgtcatcgtggtggcatcggtcttgtcggcaatggcggtcatgggcatagcgttcatctggacaaggatgaggtccagatcaagggacgatctcctccgtgcagacatgggcgacgacgggtcgtccggcgagatgatccgcgccatcgcggcgtcgcagctgagcttcaagtaccaggagctgcgcgcggcgacggacgagttcagccagacgaacaagctcgggcagggaggctacggctccgtgtacaggggcgtgctggcggacgggcgggaggtggcggtgaagcggctcttcttcaacacgcggcagtgggcggagcagttcttcaacgaggtgaagctggtgagccaggtgcagcacaagaacctggtcaagctgctgggctgcagcgtggaggggcccgagagcctgctcgtctacgagtacctctgcaacaccagcctcgaccactacctcttcgacgcgttcaagaagaacgcgctggactgggagcggaggttcgagatcgtgctgggcacggcggagggcctctcctacctgcacagcgcctcggaggtccggatcatacaccgcgacatcaaggccagcaacgtcctgctggacgacaggttcaggccgaagatcgccgacttcggcctcgccaggaacttcatggacgaccagagccacctcagcaccggcctcgccggaacttttgggtacatggctccggagtacatcgtccacgggcagctcaccgagaaggccgacatctacagctacggcgtgctggtcctcgagatcgtcaccggccggaagagccacaactcggtggcgtcatctgcagaaggcctctcactcatggcactgatatggagacactacaccgcgggcaccctgacggagctgctggacccgaacctccgcgagcagtgctcggaggaggacgccctccgggtgttccacgtcggcctgctgtgcgcccaggcgtcgccgaaccttcggccgcccatgtggaaggtggtggagatgctgagcggcagggatcacaaggcggtggcgcttccccggcccacccagcctcccttcatcaacgtcaaggggtccagcggcaagagcgacagctccggcgggtcggcgtccaactccgacaagtcgcccttctcgctgaaccagctgtcagtcagtggggtgcaggccaggtaaaagctagctagctagctgcggatatcatgtgtttgggctagcggcattttttttcaagttttgtaagtcgtggcgtggatatatcataggtttgacttcgattttctggcttcgttgatctggtaacatactctgattattgctagtatgtgcaagtctttggaagaaagattcatgtttgcaaacaaaaaaaaaaaaaaaa

SEQ ID NO: 18058 - DNA, 1511 bp, Zea mays
cagcccaccacacccagctccctccccgccccgcccggccctgccaggccttgtcttcttcttcctcccgattcgtgtttttttcctttctttttcgctgctgcaaaatatcgccgtttcctatctcttatcccccacgcatctcccgcctcgcctccgccacacgttccgcgcctccacacctctctcgatctcgcgcgtctggatttttccgacccgatcttttccccccgcatcagctgtcttctccttgcgccgggccaggccgcctctccctcctcccttcgcttgcgtctcaccacttatcattcatcactgctacttcgttcgagagggatacggataccccattgccggcccactggcgagagagattttggtgcgactacagagtcccaatcctataccccggccccaaaactcttctctgctaccagtaaccgttccttccgccggaatcgattttgtgagggggcgagttccgccaccgtgggcgtatcaatatcggcgaacgctcgagttctcgcggcgaaaaacaacgcgttctgcgaggattccgtggtgaaagaccgggtccttttttctgcggattccagctgccaaacagagatgtcggctctcctcgacctactgatggggatcttccgccagcagaccctcggcggcgccgccctggagctggccgcgctggcggcgcccctctggctcgccgcgctcgttggcctcctcatcgggtgggcgtggcgcccgaggtgggcgggggtcgtcgtcggcgaccacaacgcccagcaggcggcgcagctccctccgccgcccgccgctgccgcggtggtccctcgcaacgaggcgcccgccgtcgtaccgagaactgtggtggctcctgcggcgcccgaggacgagcagctggcggtgaccacccgtgacttgatgcacctctggcggctcgtccaggagaaggacggtggcccgtcgtggatccacatgatggaccgcaccttgccgaccatgaggtaccaagcctggcggagagacccaccgaatggtccacacagtaccgcagtagcactatctttgaggatgcatccccagacgtccggagagatttcttctgggacgacgagttccgggtgaagaacagctgggacgacatgcttcttcagtacgagacactggaacagtgcgccaagactggaaccatggttgtccggtgggtcaggaagttcccgttcttctgcagcgacagggagtacatcataggccgcaggatatgggcatctgggaagacgttttactgtgtgaccaagggcgtgcctcgtccctctgttccaagacaaaacaaacctcgtcgtgtggacttgtactactcgagctggtgcatccgtccagttgaatcaagaaaaggcgacggtgcaatgactgcatgtgaggtgctcttattccaccatgaagatatggggatcccatgggagattgcgaagctcggtgtccggcaggggatgttgggctgcgtc

SEQ ID NO: 18059 - DNA, 2569 bp, Zea mays
  misc_feature (808)..(808): n is a, c, g, or t
  misc_feature (884)..(884): n is a, c, g, or t
cggggcctcgcgatcgccaccacaccagcagatcccctcccttctactccgggccgggcttgtcttcttcctcccgattcgttttcttttttcttttcttccgctgctgcaaaatctcgcgctggcgcggcccgaggccagaggactcctccgatccttatccctcacgcatctcccgcctcgcctccgccacacgttccgcgcctccacagctctcgagcgggggtggatttttttctcttgacccgattttcgcatcagctccttctgcccaccgggctcgtctcctcccctggtcccgccggcatcactcgccgtcaccgcgcctgccctttagagaaggtgtacccccattattccattaccggcccactgacgagagagagagagagagagagagagagagagagagagagagagagagagagagagagagagagattttggcgtgactatccagagtccccaatcttacacccaaaaactcttctcagctaccggtgcggcatatcgcccctatcggcggcgaacatttgagttctcgcgacgtgtcctcgaggattctgtggtgaaagatcggatttttagctgcggattccagttgccaaccagagatgtcggctctcctcgatctactgatggggatctttcgccagcagaccctcggcggcgccgccctggagctcgccgcgctagcggcgccgctctcgctcgccgcgctcgtcggccttctcatcgggtgggcgtggcgcccgaggtgggcgggggtcgttacggtcgacaacgcccaacagatggcgcatctccncccgcgggcggcggcgcctccggaccgcgccaccgccaccgctgtggcctctcgcaacgaggcgcccgccgtcgtnaccgagaactgtggtggctcatgcggcggccgaggacgagcagcagcagctggcggtcaacaccggtgacttgctgcacctctggcggctcgtcgacgaggagggacggtggcccgtcgtggattcacatgatggaccgcaccttaccaaccatgaggtaccaagcctggcggagagacccaccgagtggtccaccagcaaagtacttttcgtcagccgcactgttaacttaaatggctagagagacctcgtcgaattgatttgtttgtgtgtgtgtgtgtttgtttcattccagagtggtccaccacagtaccgcagcagcacaatcttggaagatgcgtcaccagaggttgtgagagatttcttctgggacgacgagttccggatgaacaacagctgggacgacatgcttcttcagcacgagacgctggaggagtgcaccgagactggaaccatggttgtccggtgggtcaggaaggtgagccgttctgcatccacacatctctgctggtgattattgagctcaaaccatggggcaggctgcttatattaaccgacgatgcgtgattctcgcgtgcagttcccgttcttctgcagcgacagggagtacatcataggccgcaggatatgggcgtctgggaagacattttactgtgtgaccaaggtatggaacgaaatagctagcttattattgatatatatatgaacgaacggacggacggaatttctgctgcctgtgcttgcgttgcgttgatgcccattttttcttctctctccagggtgttcctcgtccctccgttccaagacaaaacaaacctcgccgtgtggacttgtactactctagctggtgcatccgtccaggtaactatacgttagtttcacagcagtgatctctgcagccttggtagcaggatgactcaagtgcatgaactgaacctatcctattgtatctaatctaccagttgagtcgagaaaaggcgacggtgcaatgagtgcatgcgaggtgctcttgttccaccacgaagacatggggattccatgggagatcgcgaagcttggcgtccggcaggggatgtggggctgcgtcaagaggatagagcctggccttcgggcgtaccaggtcgggaggaccgccggagaggctgtttccaagtgtgctgccatggcacaggtcaccaccaggttcagtgccgacgagctcgtcatcgcagggccgggcaacacggaggccagttcttcttcgtccggcgacggcgcagaggttggcaaggtgacgaagcactgggcgaacagcatacccaaggttctcatggtcggtggcgctgtggccctggcctgctgcaccttcgacggtgggttgttgaccaaggccgtcatcttcggcactgccaggaggtttgcaggagggccaggaaggcggtaggtacggtgtaacggtggacggaaagatccagcggcacaacacaaaacaagtgttgctgcactgcagcccgctgcgggttaataggttagaaatatagcatttgttacgaggacacatatagaagtattatggaagaaaaccgctgttagataagaaatacactgctgtgtattagtagttaataacaagaattcttggtttttgtatgtaaccatattgtggatcggatccattgttccgccccatggacactactactacc

SEQ ID NO: 18060 - DNA, 2208 bp, Zea mays
gcctcgcgatcgccaccacaccagcaatcccctcccttctaccccgggccgggcttgtcttcttcctcccgattcgttttcttttttcttttcttccgctgctgcaaaatctcgtgctggcgcggcccgaggcagaggagagaggactcctcggatccttatccctcacgcatctcccgcctcgcctccgccacacgttccgcgcctccacagctctcgacctcgtctggatgcacgagaccattacctagaacatcctaatcgaaaactgcccaccgggctcgtctcctcccctggtttctttttcatcactcgtcaccggctcaccgctagttcctttagagaaggtgtacccccaatattccattaccggcccactgacgagagagagagagagagattttggcgtgactatccagagtccccaatcttacacctaaaaactcttctcagctaccggtgcggcatatcgcccctatcggcggcgaacatttgagttctcgcgacgtgtcctcgaggattctgtggtggaagatcggatcttttgctgcgggttccagttgccaaccagagatgtcggctctcctcgatctactgatggggatctttcgccagcagaccctcggcggcgccgccctggagctcgccgcgctggcggcgccgctctcgctcgccgccctcgtcggccttctcatcgggtgggcatggcgcccgaggtgggcgggggtcgtcgtcgtcgacaacgcccaacagatggcgcagctccccgcggcggcggcgcctccggaccgcgccaccgccaccaccaccgcggtggtatctcgcaacgaggcggccgccgtcgtaccgagaactgtggtggctcatgcggcggccgaggacgagcagcagcagctggcggtcaacaccggtgacttgatgcacctctggcggctcgtcgacgagaaggacggtggcccgtcgtggattcacatgatggaccgcaccttaccaaccatgaggtaccaagcctggcggagagacccaccgagtggtccaccacagtaccgcagcagcacaatcttggaagatgcgtcaccagaggttgtgagagatttcttctgggacgacgagttccggatgaacaacagctgggacgacatgcttcttcagcacgagacgctggaggagtgcaccgagactggaaccatggttgtccggtgggtcaggaagttcccgttcttctgcagcgacagggagtacatcataggccgcaggatatgggcgtctgggaagacattttactgtgtgaccaagggtgttcctcgtccctccgttccaagacaaaacaaacctcgccgtgtggacttgtactactctagctggtgcatccgtccagttgagtcgagaaaaggcgacggtgcaatgagtgcatgcgaggtgctcttgttccaccacgaggacatggggattccatgggagatcgcgaagcttggcgtccggcaggggatgtggggctgcgtcaagaggatagagcctggccttcgggcgtaccaggttgggaggaccgccggagaggctgtttccaagtgtgctgccatggcacaggtcaccaccaggttcagtgccgacgagctcgtcatcgcagggccgggcaacacggaggccagttcttcttcgtccggcgacggcgcagaggttgacaaggcgacgaagcactgggcgaacagcatacccaaggttctcatggtcggtggcgctgtggccctggcctgctgcaccttcgacggtgggttgttgaccaaggccgtcatcttcggcactgccaggaggtttgcaggagggccaggaaggcggtaggtacggtgtaacggtggacggaaagatccagcggcacaacacaaaacaagtgttgctgcactgcagcccgctgcgggttaataggttagaaatatagcatttgttacgaggaaacatagaagtattatgcaagaaaaccgctgttagataagaaatacactgctgtgtattagtagttaataacaagagttcttggtttttgtatgtaaccatattgtggatcggatccattgttcttccccatggacactactactaccagtctaccagatcgatgttgaccttgtggcagttgctgcagtttttttttcaaaaaaaaaaaaaaaataccttatgctgtgtgtgtttagaataaaaaaatttttctcc

SEQ ID NO: 18061 - DNA, 1952 bp, Zea mays
  misc_feature (1916)..(1916): n is a, c, g, or t
  misc_feature (1935)..(1935): n is a, c, g, or t
  misc_feature (1943)..(1947): n is a, c, g, or t
aaaatcacacccgtgtctgtacgccacccagttgcttctctgtgtactctccaactcatcaccggctccatccttgtcctacactgacctcgtccccatcccgcaaccgcaagcaaccaccgatccagcccgttcggcctttcggcgaatggtgacgaaccaggacgcggaggcggcatcggcggcagccccggggccaggggcgacggtggacccgatgcgcctagcgtcgcggtggcggtcccagacggagtgggaccgcgcggtgccggagctggaggctgagccggagccgtccgagctcaacaccgtcaacagttcgggactcttctccgtcgtctctacggacaagttgtccgtgaaatacctcggcagccatcaccacggccacgacgtcggtgtcgtgcaggccgaccgccccgctcccacgcgccgggccgtgtactacttcgagatggccgtcaggaacgcgggatacaaggggcagacatccatagggttcacgagcgagagcttcaagatgaggcgacaaccgggttgggagtcaaacagttgtggataccatggtgacgacggccacctttaccggggtctagggaaaggcgaaccgtttgggccaaaattcacatctggtgacataattggcgctggcatcaactacttgtcacaggagttcttcttcacgaaaaatggagctccggttggagccattccaaaagaaattaaaggcccactatatcctacaattgcagttcatagtcagggtgaagagttgactgtaaactttggaaaggaaccattctgttttgacattgagggttatattcttgaagagaaaatgaagcagcaatcggtgtctgataaattgaacttggagacggacatcagtcattggattgtccgctcatatctcctacattatggataccaagatacattaaatgcttttgatatggcaaatgcaactgacccccccaccaatcgccaaaatggtcatgcagaacctcccgaaacgtatggtcttagccacagaaaacttttgcgtcagcttatcatgagtggagatattgactctacattcaaaagacttggggagtggtatccacaagtgataaaggatgagaaatcggttatttgcttactactccattctcaaagattcatagaatatatcagggctgaacaactggaagatgctgtgcactatggtcgtgctaacctggcaagcttcttgacacacgaagcttttgagtggctgctgaaggatagtgtggccctgctggcgtacgagaagcctgcagaatcatgcttgggatacctgatgggctctccccagcgtgaattcgtggcagacgcagtgaacgcggctgtcctgtcgacgaaccccaccatgaaggaccctgagagctgcctctactcgtgtctcgagaggctactaaggcagctcacagtttgtagccttgagcgacgtgcattcaacaacgaccaaggagatgcattcttactccacaaagaaatgcaaaactatgaaaggtctaggcgctcatagcctcataggcatcaggattgttgcgcttctgaagtaaactcggttcgggtgttagacctcctcatctgccgtttgaagggacgaagattcaatgacaagcacgtatccttccctttgcaggtctgcagcgcccctcagctttcgcaagggtgagcaccgaattgcatggacacagctcaggcgcttcgggaggtgttctaacctctctgtaatcagaaaactcacagtgagataaagccaacgtttcagatttcccctattttgttggttggctaatatgctgtttgacactatgaatgctaaaaagtaaagacgcttcgacaaaaaaaaaaaaaaaaaaaaaaaaacgaaaaaaaaaaaaaaaaanaaaaaaaaaaaaaaaaaanaaaaaaannnnnaaaaa

SEQ ID NO: 18062 - DNA, 2638 bp, Zea mays
gccggccggtccgggactccagttgcttgcctggtctctccactcaccctttttcaccttcgcctcgccggcctcgtccgcctcctgcactgaccttttcctccacgtttccggcaactgcaagcaaccactgatccagcccgttctgtgtcccggcgaatggtgacgaaccaggacgcggatgcggcagcgccaggggcaggggcaacggtagatccgatgcggctagcatcgcggtggcgatcccggccagagtggaactgcgcgtcggcggagctggaggctgagccgtccgagctcaacaccgtcaacagctcgggactcttctccgtcgtctctaccgacaagttatcggtaaaatacctcggcagccatcaccacggccacgacgtcggtgtcgtgcaggccgaccgtcccgcgccgacgcgccgagccgtgtactacttcgagatgggcgtcaggaatgctggatacaaggggcagacatccattgggttcacgagcgagagcttcaagatgaggcgacaaccgggctgggagacaaacagttgtggataccatggtgacgacggccatctttatcggggtcaagggaaaggtgaatcatttgggccaaaattcacatctggtgacataattggtgctggcatcaactacttgtcacaagaatttttcttcacgaaaaatggtactctggttggagccattccaaaagaaattaaaggcccactatatcctaccattgcagttcatagttacggtgaagagttgactgtaaactttggaaaagaaccattctgttttgacgttgagggttatattcttgaggacaaaatgaggcagcaatcagtgtctgataaattgaacttggagccagacatcagccattggattgtccgttcatatctcctacattatggataccaagatacattaaatgcttttgatatggcaaatgccaccgatcgccccaccagtcgccaaaatggtaatgcagaacctcccgaaatgtatggtcttagccatagaaaacttttgcgtcaggtgagcttggaaactcaattcaactgattgttgaattcatttctctggtatcttagttagcatctatgtgaactcagttggtacttcgtaaaagttacacagaatttttttcttcgaacagaaaatattgcatagaattacacttcatttttagtacagtttgacaattaggcaccagttcctaatgattattgcatgggaaacttcgtgtgaagtatctttattgttgttactgtttgttatgagggtaacctgacttttgttttttttactaccaaccaattaggtttgaagttctatatctttttaacttgattagaattttaaatttgcatgtgtttgagctcattagctgccgtttccattctcacaggaaagtgatagttgatctttgcgctgagctgccttgaagtttgagctcttttacctttggttgtgctgcgcgaatatgttgtagtattacatttgtccacatcattccactttattttgcagacaactggatattgatttgctattgccctgtttttttttggcctctggtatggcttctgctttctgaaaacagtttattttatttgataaagcttatcatgagtggagatattgactctacattcaaaagacttcgggagtggtatccgcaagtgataaaggatgagcaatcggttatttgcttcctactccgttctcaaagattcatagaatacatcagggctgaacaactggaggttgctgtgaaatatggtcgtgctaacctggcaagcttcttcacccacaaagcttttgaggggctgctgaaggatagtgtggccctacttgcgtatgagaagcctacagaatcatgcttgggatacctgatggactcttcccagcgtgaatttgtggcggacgcggtgaacgcggctgtcctgtcgacgaaccccactgtgaaggaccctgagagctgcctttactcgtgtctcgagaagctactaaagcagctcacagtatgtagctttgagcgacgtgcattcaacaactaccaaggagatgcattcttactccacaaagaagtgcagaattatgaaaggtctaggcgctcataggcatcgggtttgatgcgcatctcagaagtaaactcagatgctagactcccaagtctcaactgctctttgaagggacgaaggttcagaaccaagtggtcgaccatgctaagcacaaatccttccccttgatgcagcacccctactttcggaagtgtggatacaagatttcacagacagaggtcaggctttcggaaggtgtcttatcctccctgtaatcagaaaactcagtcagatacgccaacgtttcagtctccctagttttttttgttggttggctaatatgatgtttgacattgacattgtggatgctaaaaggtaaagatgcttcaatgtatgtccaccttttagaacatctgcatcatagttgataatcatctaagtcctaggctcctagttgaaaaccatctaggtctaggtctctagttgacttttagtggttaatgacaatataaaattatgatgatgattgagtttacgtgctattcgtgtccctactaatggtaatc

SEQ ID NO: 18063 - DNA, 1886 bp, Zea mays
aaatcgtcgttcccgcaattttcttaacgaacgggtttggtcgggaccggagtttgctttcacccaattcggtgatttttctgcttcgttttaatatactgttttcccttctcgggagtggataggcgaatggtgacgaaccaggacgcggaggcggcagcgccaggggcaggggcggcggtagatccgatgcggctagcatcgcggtggcggcgatcccggccagagtggaactgcgcgtcggcggagctggaggctgagccgtccgagctcaacaccgtcaacagctcgggactcttctccgtcgtctctaccgacaagttatcggtaaaatacctcggcagccatcaccacggccacgacgtcggtgtcgtgcaggccgaccgtcccgcgccgacgcgccgagccgtgtactacttcgagatgggcgtcaggaatgctggatacaaggggcagacatccattgggttcacgagcgagagcttcaagatgaggcgacaaccgggctgggagacaaacagttgtggataccatggtgacgacggccatctttatcggggtcaagggaaaggtgaatcatttgggccaaaattcacatctggtgacataattggtgctggcatcaactacttgtcacaagaatttttcttcacgaaaaatggtactctggttggagccattccaaaagaaattaaaggcccactatatcctaccattgcagttcatagttacggtgaagagttgactgtaaactttggaaaagaaccattctgttttgacgttgagggttatattcttgaggacaaaatgaggcagcaatcagtgtctgataaattgaacttggagccagacatcagccattggattgtccgttcatatctcctacattatggataccaagatacattaaatgcttttgatatggcaaatgcaaccgatcgccccaccagtcgccaaaatggtaatgcagaacctcccgaaatgtatggtcttagccatagaaaacttttgcgtcagcttatcatgagtggagatattgactctacattcaaaagacttcgggagtggtatccgcaagtgataaaggatgagcaatcggttatttgcttcctactccgttctcaaagattcatagaatatatcagggctgaacaactggaggttgctgtgaaatatggtcgtgctaacctggcaagcttcttcacccacaaagcttttgaggggctgctgaaggatagtgtggccctacttgcgtatgagaagcctacagaatcatgcttgggatacctgatggactcttcccagcgtgaatttgtggcggacgcggtgaacgcggctgtcctgtcgacgaaccccactgtgaaggaccctgagagctgcctttactcgtgtctcgagaagctactaaagcagctcacagtatgtagctttgagcgacgtgcattcaacaactaccaaggagatgcattcttactccacaaagaagtgcagaattatgaaaggtctaggcgctcataggcatcgggtttgatgcgcatctcagaagtaaactcagatgctagactcccaagtctcaactgctctttgaagggacgaaggttcagaaccaagtggtcgaccatgctaagcacaaatccttccccttgatgcagcacccctactttcggaagggtggatacaagatttcacagacagaggtcaggctttcggaaggtgtcttatcctccctgtaatcagaaaactcagtcagatacgccaacgtttcagtctccctagtttttttttgttggttggctaatatgctgtttgacattgacattgtggatgctaaaaagtaaagatgcttcaatgtatgcccacctttgagaacaaaaaaaaaaaaaaaa

SEQ ID NO: 18064 - DNA, 2432 bp, Zea mays
atacattaaatgcttttgatatggcaaatgcaaccgatcgccccaccagtcgccaaaatggtaatgcagaacctcccgaaatgtatggtcttagccatagaaaacttttgcgtcaggtgagcttggaaactcaattcaactgattgttgaattcatttctctggtatcttagttagcatctatgtgaactcagttggtactccgtaaaagttacacagattttttttcttggaacagaatattgcatagaattacacttcatttttagtacagtttgacaattaggcaccagttcctaatgattattgcatgggaaacttcgtgtgaagtatctttattattgttactgtttgtgtgtgttatgagggtaacctgacttttgtttttttactaccaaccaattaggtttgaagttctatatctttttaacttgattagaattttaaaattgcatgtgtttgagctcattagctgccgtttccattctcacaggaaagtgatagttgatctttgcgctgagctgccttgaagtttcagctcttttacctttgcttgtgctgcgtgaatatgttgtagtattacatttgtccacatcattccactttattttgcagacaactggatattgatttgctattgccctgttttttttttggcctctggtatggcttctgctttctgaaaacagtttattttatttgataaagcttatcatgagtggagatattgactctacattcaaaagacttcgggagtggtatccgcaagtgataaaggtatacagtcttgtggttgatttgatttaccatcaccctgtcatttccaggaaaaatatatgacagattttatctctcaaataatcttctgaacttgtgttacagttaatgtcttcctcatacattcagtcctgttttcctgaagaactttgttataatctctatgtgttctaagaaataatttctttccttggcaggatgagcaatcggttatttgcttcctacttcgttctcaaagattcatagaatatatcagggtaattattaaatttcaatccatgcacttcataggtcacgccgcttcgctataggctgaatagattgcacacaacttcatggcagcatcacatatcaactcatactttaactaatgcattaggctgaacaactggaggttgccgtgaaatatggtcgtgctaacctggcaagcttcttcacccacaaagcttttgaggggctgctgaaagtaatgccatttgttctttttttgttggctttcttttgttctgttgcatgcattgtgcttttacattagtaatgttcatctgtttgttgaaatgaaatcttcttaacttggtgcgtctacaatttcaatgagcttaagcacttttgtattgatccccccggggctcctttagccgcctcctgcaggatagtgtggccctacttgcgtatgagaagcctacagaatcatgcttgggatacctgatggactcttcccagcgtgaatttgtggcggacgcggtgaacgcggctgtcctgtcgacgaaccccactgtgaaggaccctgagagctgcctttactcgtgtctcgagaggctactaaagcagctcacagtatgtagctttgagcgacgtgcattcaacaactaccaaggagatgcattcttactccacaaagaagtgcagaattatgaaaggtctaggcgctcataggcatcgggtttgatgcgcatctcagaagtaaactcagatgctagactcccaagtctcaactgctctttgaagggacgaaggttcagaaccaagtggtcgaccatgctaagcacaaatccttccccttgatgcagcacccctactttcggaagggtggatacaagatttcacagacagaggtcaggctttcggaaggtgtcttatcctccctgtaatcagaaaactacgtttcagtctccctagttttttttgttggttggctaatatgctgtttgacattgacattgtggatgctaaaaagtaaagatgctttaatgtatgcccacctttgagaacatctgcatcatagttgaaaaacatctaagtcctaggctcctagttgaaaagcatctaggtctaggtctctagttgagttttagtggttaatgacaatataaaattatgatgatagttgagtttacgtggtattcgtgtcctggaaatcaattattggtttttaaataatgggtgagaaggttaaagctgagatagttttctaagagtcaatggagttgttgaaaattaaggctaaaatagggttgttgaaaagtaaggctagtttggaaagtcaatcctcattaaaaatggaggggatcgagggggaataaattaatttctccatcaatactcttttcaaaggggatttaagtttttaaaaaaaaccctaagaataataatagg

SEQ ID NO: 18065 - DNA, 2055 bp, Zea mays
cccgagcgccaccgtctccgaggccaagcgccgccgtccccgtccccgagcccgagcgccgccgagcccatctccgagtgcgccaccgtccccttccccgtccctgagcccgagcgtcgccgagcccatctccgagtgcgccaccgtccccttccccgtccccgagcccgagcgcgccgccgtgcccatctccgagtgcgccaccgtccccttccccgtccccgagcccaagcgccaccgtcttcgaggccaagcgccgccgtccccgtcctcgagcccgagcgccgccgagcccgagcgccgagtgcgccgccgtgcccatctccgagccctcggtgcactccttgatcatgccttaattacttgttaaaaattcatgccttgattacttgtttttgctagtcctgccttaattattgttaatcttagattgttaatgttggtcattatgcttatattgttggtgttttcacttacatattttgttaaggtcaccatttttgctttagtagcttgtatcccttgtgattaaatgttggtaattatgcttatgaagaattttgtcatggatagttgatgcaactactaggacccctgccttaattattgttaatcttatattgttaatgttggtcattatgcttatattgttggtgttttcacttacatattttgttaagggccccatttttgctttagtagcttgtatcccttgtgattaaatgttggtaattatgcttatgaagaattttgtcatggatagttgatgcaactactaggaccccttcttggtagaaaatctccatagtgattggggaaacaagtctatttttagtgcttatggccacatacatcatggaagtacatagccatggcaatgttattatctccctatgttataagacttgttcttatctcccttcttagttttttgactacctatctttgcttcccaaccctatgttataagacttgttcttatctcccatctttgacttgttcatagccatgacaatgttatttggacccctctttttgccctataagccacatccttgttttccctctgatccctgcctttgttgcgatctcaatgttgattgtgaggcttggccattttcagttttagagatggaaaaagagccacttgacatggttgagagctcagttcgagtcatcgagacacatgttgacatcattcgcagtctagtgactgatggggttgtggatactagtgaaccggaatcagtgtacacacttaagaccactttgtttcaaattggagatgtatgcgacatgcttgagaagtgtgctctgtccatcaaaaagtatgctgactccaagagggctaaaattattcaagatgaagccctgcaatatgctgaagatgatgaagctgcagatgatttggaggaactcccaagcccagatctccttactcaagccgacatattggaaaaatattttggaattgagtatgatagcgaccagtcaaggggttgttgatgtttagtcctaaacaacacgatatgagtatcgtaggtttcactcttagagataatgtattttgtatgaacctcttagagagtgtcaagtcaatgaactatcttcgagtactattgggaagtgtatctctttgatgtatttttttttctagtgatatcgatggtgccgagtagcaccaaatttggacttgtgtccatatctatagatgctagtagttgagcactagctcctacaatcttaagtgtgtagaccccaagaagagattaagtcctgtagtctaccacctcccgttatttgtgggcttcaccgatggctggaaacatttggtgatagcaaacgaccttcgggctgaagacgtctgcgagcttgttaagaggccagacgatgttgagccggtgtactatgtccggatgtgtggtcacaaaattaaaagctgccccggctgcatgtgtgtgcttctcttctcttaggtggggtgctaagtgatcttagtagccgacataagagaagagaagcgcacagatgaagccggggcggctttaaattttg

SEQ ID NO: 18066 - DNA, 4047 bp, Zea mays
gtgctctttaactttctagtatcacttcaactgtttttcttttcaaagatctcttggttgtttattgtggatataattgttgtttatagcatattatcgaatctatgtttggtaggaactactgctcaatttgaaaccaaaatggatcaagcggagccagcgaggagcggtgtacgcagcaaaatttgcaacagtgttgtacctgccaacgagtcaggtgagcttattttaacttgttttgtttgattgtaaaattaaagggtggataacatgttttctttgaatataaaactaaagagtggtttctgatcggatagtgtgtttctaattagtctgttggattgtgactcatgcagaacaccgttccaccaaacaggaaggcagaatgtctagtaaccgtgaggtcccagagtctttgttgcctacaaaggacgaaattccggagccggatcatcattctccaccagagatcaacttccaactgtgcattcctgatactactcagaaatggcttgtgagttgtgcagattccataactggtcttctttgactaattttacatcgataccggacatcacatcactgtacatgttcatagttgtaaagttctttttaagtttctgaccacatcgctaaaaaggtgtttctgatcactgtcacccccaggacctatccaagtcgctttccaatgcagttagacgacagagaaggcatgactatgatgtcataatgctgaaggaccccaagaagagactatggcctgtcgtttaccacgacagcctgttatttgtgggattcaccgcgggctggaaacatttcgtggcatcaaacgaccttcgggctggggatgtttgcgaacttgttaaggagccagacgatggtgagccggtgtactctgtccggatgtctgatcacaaaatttaaagccgccccggctttatctgtgcgcttctcttctgttaggtgggctgctaaactctgtggtttgtctttttttttacctgtcagtcgagtggtttgtcttctttccctaataacccgtttgcaacttgcgagtgtgcagacctccaagaagcatggtgcagccgacttgcggaccttgtgaaaagcatgtgggtctgcccccccttttttttgctggaagtcatggagaaaccatgtgggtcaggcgtttctgcgtggatttttgacgatccacagcctataaaaacatagagcgacacagctgtagtagtactgtagaagtcgggcagtgtgggactgcaacatgaattgtgatgtgttgtgtggttgggacttggaagtggtggtgtaaccatgtgctgtgatgttgcagccatgtgcgcgcggtggtcatggtcgattttgctctctgccgtttgaacattccgaccatgcctgaactggataaagatttcagtatataatagtgtactgttactacttactattgtccttaccgtttatgggtttacactaaaaaaaaatcttcgatgctctcctagaggaaaatgcaaaccgttccgattgtggaagcgacgtcgtcgtcgcagatggattcgcggcgtcgtgacaagacttccatccgcgcaaggcggtgtttgcccaacgcccatgctgctactgctactggtagccggcagccgcattgatccatcgatcgattcccattcccccctctcccacctgcctggattgaagccggcacccactcgcgtccattgcgcggcacggctcgccactcgcgtcccacctggcagtggctcagcagccagcacgacgcctcgacggtcgtgcagtgcacaagggttgggatttccgcccgccaccggcgaccacatccccaacggcccccgtcattatttcggctcatcaaacccgacctgccaagtgccaaccccgctgtccccttcgtcaaggcacagccaagatgcgcatcaaatccacagttattacagcagagctggagatgcgcccggtgcaccgtgagcgggttgcctctgatctgcatctgctccggcctctggtctggatgccatgccagtcaacctccgcagctcgccggttcatctgccacgcgaataggctgatgacttggcaggtgagcctaccaaacacgtcaacggttacgtcggtgaatttgacgtgcccaaagagtgtggcgcgtgctatgttataatctgtgtgtctccgtctgtttgttgtaacttacccttacccctggccctgagagtaaaaactgttcctgcgcagctgccttggctgatgaagagggcagccgaacgcttgtatctcacgtaaagactgctactttgactcgcattcctttgtaacctgcacgaggaagtgagaaagaaaggttgtccgctaggatgtggtctttctccgcaatgaatttatccagttttatactactactttcattcttaaatatttattatccgtcattttatttttatactaaaacgacgacaagtaaaaaataaatgaggaagaatttctctataagagcaccactacaagaacttgaaaatccactttgaaatttgtccgtccatacgaactctacgactacgagcctactactctactactgcctacggaggagagagagagatttcatgagttcgtgttcagttagtcttggtgcaccagttccacccaccaccggatataggtcatgccccttataagctcgacacaggggcaggcacaccgcacagcaccgcaccgcactgcatcggtcgccagccgagccgagccgagccctgctctctcctccagctccccaaatcacactccgccatggccggcacgtgcgctcacgtcgagttcctccgcgcgcagccggcgtgggcgctggcgctggccgcggtgggcctgctcgtggccgtgcgcgccgccgcccgcttcgcgctctgggtctacgccgcgttcctccgcccgggcaagcccctgcgccgccgctacggcgcctgggccgtcgtgacgggcgccaccgacggcatcggccgcgccgtcgccttccgcctcgccgcgtccgggctcgggctcgtcctcgtcggccgcaaccaggagaagctggccgccgtcgccgccgagatcaaggccaggcaccccaaggtccccgaggtgcggactttcgtgctcgacttcgccggcgaggggctggccgccgccgtcgaggcgctcaaggactccatccggggcctcgacgtcggcgtgctcgtcaacaacgccggcgtgtcctacccgtacgcgcgctacttccacgaggtggacgaggagctgatgcgcaccctcatccgggtcaacgtcgagggcgtcacgcgtgtcacgcacgccgtgctgccggccatgcccgacaggaaccccggccccattgtcaacatcggctccggcgccgcctccgtcgtgccttctgatccgctctactccgtctacgccgctaccaaagcgtgagctccccgttttcctagtcactgcttccatgctgtccgttgcgcatgctatagcttagattggctcgattctaggatagatggcttctagtacaagtaagattgcgactgatcgagaacaaaaggagcacgtctttcttgcctacatggtttgggaactattgtagcaacactgggatcaggaatcagaggaaacgccttcagtgtgaatccctaccttgcgtgttggtcatgccagattctgatgcaatcatagggggagttagttagatatgcattcagatgctagaattagttgggtactgaaattccatcagtctaggattactcgaaatgtctagatctgacgtatgatccttctccttaggggaaagaaaaagataggtaactgcataagcaaaaaaacttttactgtaaggcgtactggtttttgtttgcataagaaattaagaactaaaaaaaacttttgtgatgctcctgttgagttggtctaacatccatcctgcttgcaactattagagctcactgaatagtggggctatattatcctgtgatctaatattagatgaatagttgaaaaacctat

SEQ ID NO: 18067 - DNA, 1584 bp, Zea mays
actttgaaatttgtccgtccatacgaactctacgactacgagcctactactctactactgcctacggaggagagagagagatttcatgagttcgtgttcagttagtcttggtgcaccagttccacccaccaccggatataggtcatgccccttataagctcgacacaggggcaggcacaccgcacagcaccgcaccgcactgcatcggtcgccagccgagccgagccgagccctgctctctcctccagctccccaaatcacactccgccatggccggcacgtgcgctcacgtcgagttcctccgcgcgcagccggcgtgggcgctggcgctggccgcggtgggcctgctcgtggccgtgcgcgccgccgcccgcttcgcgctctgggtctacgccgcgttcctccgcccgggcaagcccctgcgccgccgctacggcgcctgggccgtcgtgacgggcgccaccgacggcatcggccgcgccgtcgccttccgcctcgccgcgtccgggctcgggctcgtcctcgtcggccgcaaccaggagaagctggccgccgtcgccgccgagatcaaggccaggcaccccaaggtccccgaggtgcggactttcgtgctcgacttcgccggcgaggggctggccgccgccgtcgaggcgctcaaggactccatccggggcctcgacgtcggcgtgctcgtcaacaacgccggcgtgtcctacccgtacgcgcgctacttccacgaggtggacgaggagctgatgcgcaccctcatccgggtcaacgtcgagggcgtcacgcgtgtcacgcacgccgtgctgccggccatggtcgagaggaagcgcggcgccattgtcaacatcggctccggcgccgcctccgtcgtgccttctgatccgctctactccgtctacgccgctaccaaagcgtatgttgaccaattctcaagatgcctctatgttgagtacaagagcaagggtattgatgtgcaatgccaggtgcccttatacgtggcgacaaagatggcatccatcaggaagtcttccttcatggtcccatctgctgacacctatgctcgtgctgccgttcgtcacattggatacgagcctaggtgcacaccatactggccacactctgtcgtgtggttcttgatctccattcttcccgagtcccttatcgacagcgtgcgcctgggcatgtgcattaagatccgcaagaaggggctggccaaggacgccaagaagaaggcgctgtgattgatgtttcagaatgcatgttcagattcgcacatttcctcatcacctgtagtagacacgtgccttgctgtagtcactttattagctaccattgcctcctgagtctgttaagaatcgagaatgtcattgttccatccgcggttatgatgatgaaaaatacgattcttcaattcaaaatgtaacactaatacgagtaatgatgcatgaaattaacttgaagaagttgtgcaactcagttgtttttctgaaccatttcacatttttgtgggtctctttgcctgcacacggcttcaaatggaatttcctttgccacaagaaaaaaaaaaaaaaaaaa

SEQ ID NO: 18068 - DNA, 1887 bp, Zea mays
gtattagaactagaaaacttatgtgatgttcctgttgagttggtctaaaatgtccattctgcttgcaactattaaaactcagggaatagttgggctgtattatcctgtgatctagtacatattggatgaagaatggaaacccctataaacaatgaattattgccatgtgccatgcaggcatacaacagctgtaaatgagcaattgacctccttttttgtatctttgtgttatgcactacatacttagctgaaaagcgcgaacatgatggatctttcatagggttagtgtgtgtgttatgagcctttgagtctgcacggtgtaattcctttttaaaaaaataactgtaattaggcagattcacccattcccttcaacttaataatggcacactaaaaattaattaatgttatctgtattttccaggtatgttgaccaattctcaagatgcctctatgttgagtacaagagcaagggtattgatgtgcaatgccaggtaacaaatctctctatgcatcgaaggttgtctcgaattatcaaccatttttgcagttattttgacttagttttgtgctattgcaatgactctcaacaaattccaattttccatttcaactatagtttctagatctcttttctctttctaaagaactaaaagaaaattttgatgaaccagtctagttgtcgcctaggcatctaggcgaggctctaatactcgcctagacgcctagtcgccttaaacacatgtcctcgcaaatttctgcagttctgaaatttccaaacaaattaaccatcttaaatcatcatttcacgtgttctactcaactggttaagcttgtttatctgttgaactgatttgtgtctaccttttgataatgcttcttgatcaattggagatttagtgcttttgcaagtaattgcatcggtcttatcaagtaaatatgttgtgttccctatggacttttgcactcatagcttcttcaatctattcaggtgcccctatacgtggcgacaaagatggcatctatcaggaagtcttccttcatggttccatctactgacacctatgctcgtgctgccgttcgtcacattggatacgagcctaggtgcacaccgtactggccacactctgtcgtgtggttcttgatctcgattcttcctgagtcccttatagacagcgtgcgcctgggcatgtgcattaagatccgcaagaaggggctggccaaggacgccaagaagaaggcactgtgattgatgtttcagaatgcaggtccagattcgaagatttcctcatcacctgtagtagacatgtgccttgctgtagtcactttattagctccggagtctgttaagaatcgagaatgccattgctccatccacggttatgatgttaaaaattattattcttcaattcaaaatgtaacactaatacgagtaatgatgaatgcaattaacttgaagaaaaaaaaaaaaacaaaaactccgcccggcggggtcacgtttttgtgaagtttctttgcccgcgcatgactttaaatggaattttctgtaaacagagtttgctgtttatggagaatttaatactctcccttccacatttgtcttgaactatcgttttcagcagtgttcatggtttaaaaggcgtcgcctaggcgtccagacggcgatctgtcctagatgtcggtgccgtctagataaaaatgtgtatgacgtctgtcttggcgtagtacgtctgggcgatgctttatcccctctaagcgacgccttatcctctagggtttgcagaccaaattggcgcgtttgggctttagggtttaggcgcgcgttttgggcttcttccccctgtgcgcgcgcggcaaatttatctgtgtgtacgtggctgctccctg

SEQ ID NO: 18069 - DNA, 1420 bp, Zea mays
ttcttaaaaatccaatttgaaatctgtccgtcgatacgaactctaccaacgagagagatttgtgttcgtgttcggtcagtcttggtacaccagttccacccaccaccagagaaagcccatccccgttactaataagtcccgtccagtccaaagctcggcaccgcaccgcatcgaccagctacacgaatcagacggcgccatggccggcacgtgcgcccacgtcgagttcctccgcgcgcagccggcttgggcgctggtgctggccgccgtgggcctgctcgtggccgtccgcgccgctgcccgcttcgcgctctgggtctacgccgcgttcctccgcccggggaagcccctgcgccgccgctacggcgcctgggccgtcgtgacgggcgccaccgacggcatcggccgcgccgtcgcgttccgcctcgccgcggccgggctcgggctcgtcctcgtcggccgcaacccggagaagctggccgccgtggccgccgagatcagggccaagcaccccaaggtccccgaggtgcgcaccttcgtgctcgacttcgccagcgaggggctcgcggccggcgtcgaggcgctcaaggactccatccgtggcctcgacgtcggcgtgctcgtcaacaacgccgggctgtcctacccgtacgcgcgctacttccacgaggtggacgaggagctgatgcgcagcctcatccgggtcaacgtcgagggcgtcacgcgggtcacgcacgccgtgctgccaggcatggtcgagcggaagcgcggcgccattgtcaacatcggctccggcgccgcctccgtcgtgccttctgatccgctctactccgtctacgccgccaccaaagcgtatgttgaccaattctcaagatgcctctatgttgagtacaagagcaagggtattgatgtgcaatgccaggtgcccctatacgtggcgacaaagatggcatctatcaggaagtcttccttcatggttccatctactgacacctatgctcgtgctgccgttcgtcacattggatacgagcctaggtgcacaccgtactggccacactctgtcgtgtggttcttgatctcgattcttcctgagtcccttatagacagcgtgcgcctgggcatgtgcattaagatccgcaagaaggggctggccaaggacgccaagaagaaggcactgtgattgatgtttcagaatgcaggtccagattcgaagatttcctcatcacctgtagtagacatgtgccttgctgtagtcactttattagctccggagtctgttaagaatcgagaatgccattgctccatccacggttatgatgttaaaaattattattcttcaattcaaaatgtaacactaatacgagtaatgatgaatgcaattaacttgaagaagttgtgtaaaacacttcttccccccgcc

SEQ ID NO: 18070 - DNA, 2803 bp, Zea mays
tcccacggccaacgaggttcggtttttgtctaggcccgcgagacggcggtcatacgcggccagcgctgcgcgccacgccgccgcgtcgccgctcgcgaagcccaccgtctcggccatcgttagcgcggtgcgttgcacgaggaaccggcgagggcggagggctaccgtcgacaaatgtggggagcaaagcaaccagcaactgcgactgcgactgcgactgcaagtgaactgtgaacccggcggctatttctcatcgactcggcagagcggaacaccagaaacaggtcgggttccccataaaccctcaatccaagtatattcgtatcgctgtttccgccattggatgcaggggcaaaatcggaaagctgcaaaactcggcccacttgaggtggagggtttcttctcctcgggcgccctcgcggccccccttcaaccgccgccgcaaagaacggcccacttgactacttgaggttgagggtttcttctcctcgtgcgcactcgcgtttcctcttcatccgccgccacaatctttgcggcgccctcacacaccaccgccgccggctagagcctagggccgtaatcgtaacagccacccctgagactgagatggatacagcggaggaggctgggcaggaagtagtcagcgctgttggggaggatagtatcccggaagctgccgcctgcagcagggaggagaggaaggaggaagaggaggaagaagtggaggtgagcttcgatgaacttggcctggacgagcagctgaagagggcgttgaggaagaagggcatcctcaaggccaccccgatacagcgggaagccatcccgctcatcctggaagggaaggatgtggttgcaaaggccaagactggctctgggaagacctttgcctatcttctcccacttctgcacgagctactgaagttgtcctcagaaggacgtatacgaaaacctgcaccaaatgctttcatcctggttcctactcgagatttatgccaccaggtgtataatgaggcattatctctccttgagctctgtacatgcaaattgagggttgtgcaagttaccgcgagcatgtcggataaggatattactgttgcattgtctggcccccctaacattctcgtatcaactccagcttgtgttgcaacatgcatatcaaagggaattattcgtggacctgcagttaaagagtcactttcaatgatgattcttgatgaggctgacctacttctatcctaccgctgcgaagttgacttgaaagctctcatcccacatatcccgagaagctgtcagtctattctgatgtctgcaacttcaagctctgatgttgacaagttgacaaaactacttctgcataacccatttgttctaactctttcggaggttggtcaagcaaaggatgatgtgatccccaaaaatgttcagcagttttggatctcctgtgatgccaaggataaaatacttcatatccttgcacttctaaagtttgagctcattcagaagaaagttcttatatttgtaaactcaattgatatggctttcagattacgactgatcttggaaaagtttgggataagatctgcagttttgaatgctgagttgccacaaaattcccgactacatattatagaggcattcaacgcaaggctatttgattatctaatagcaacggatgacactaaaacaaaggagaagcaaaccaatgaggaaaataaaaaagaggcaacattgtcccgcaaacggaagaagcaaaccaataaggaaaaccagaaagagcaaaaggtgtcccgcaaacatttgcaacagactttagatgctgaatttggagttgtcagaggaattgacttcaaaaatgtatttacagtagtcaattttgacatgcctctggatgctactgggtatgttcacagaattgggcgaacaggtagagcaaataagactggtgcatccatatcgcttgtttcaccaaaggaggatagtacttttaaagagattgagcatatgttgcaagatgtcgaaaagaaagatatggactgcatttcacctttcccattacttacgaaagatgctgttgaatctctacggtatagggctcaggatgttgcaaggagtgtgacaacacgtgatgtacaggaagcgcgtcgacaagacataaagaatgaaatcctcaattctgagaaattgaagtctcattttgaagagaatccaacggaccttgatttgctcaaacacgataagttgctatgcaacaaggaaattcctgcatacctgcgtgatgtccctgactacctaattgatccgaaaacaaaagaagccagcaatgctgtcaagctttccagggctgctatgcatatcgacaagccccaaaggcggaaaaggcaggggtttaagggaggatcagggaaaagcagagaccctctcaagacattctctgctgagggcaaacgagggagacggaggaaagaaagggagggagaaccagatagaagaaagaagagtaagaaggcgtgaagttgatttttcaagcagtttgctatcaagctcgcccaattttgtaggctttgtttgaagcaacttgacaaagtgctgtatcggtgacactcgtaggtcgtagctaaggagtatgtttttattgcctgatggcaactcttaatttttaaagtgtactcgcttccccccttctcctgtactgttaggaagcactaatgacgtgaaatttcattcaccaaatcaggggtatttaaagctaataatgttaagtccccccaggtggaacattcacacaaaaaaaaaaaaaaaaaaa

SEQ ID NO: 18071 - DNA, 2053 bp, Zea mays
ttgggtccctcgaggccggccgggaccaacaaccgcgtccgcgtcgagtctctactctctcggctgtccggtccggcgcggctctcgcgtctccaacctacccatgctgcagctcctccaactccaaggctcacaccaccccgcgacgggcgacgctaattaagtagagctgcaacacctgggttggaggctagagcttgcaaacaccaccagcgaaaacgtcgtggccagccatcccggtgtcgtcccgcgttctacagccaccgctgtcgtcgccgtcctagactcctagatccgtcagcttaacgagctccattccttcgaggccagccatcccggtgtctcagcagcggcggcggcggcgtcgagctcttgctttctgtgggaggacgcatggcgatgtctgcggggcgtgggctcttggtcctcttcttctctgccgccgtagtggctgagctcgcctctgccgcgaacggtcctttcctgtccgatagcgtcttccagtcgagcgccggatctacagggaggagcttgctgcaggccaagaatagttgccctgtgaactttgagttccaaaactacacaatcatcacaagcaagtgcaaaggaccgaagtttccagccagccaatgctgtgccgcactcaaggaattcgcgtgcccttttaacaattacctcaatgacgagagcaatgaatgtgcatcgacaatgttcagctacatcaacctctatggcaagtatccaccaggtctgttttccagcgagtgcaaagaaggcaagatggggctttcttgcgcagatgtcccccggaaggacagttccactgcaaacagtggttatcgcgcccaaagcagcttgcttgcgttgattactgtcttgagcgtggtagcagcgttgttctactgaactacagctccattcatttcccacaaagatggtgtgttacaactgttgaggcttgagttgcaccttttggtgcttatgggttggcttcctgattctttcttttgagagcaactccaatagttatataaattttagccctctaaaccacagatttaagaagttgctaaataactttgagagtaaaaaaatatgagttctcacatagttctctaaatatatgttgtagttttattttgtatttattcacataaaaaaaataagtcacaaatgtcatcaattaccttcattatctacataatgcagccaacattttttatttaacaagttgcaaatggttgtcaaatgtagaaaggaaatgaggttagatgagaagttgctaaatttaggaagttcatttagagaactgttggtgagtagtttttatgttaactgcctaaattattgatttagaaagtcttttagataactactggtttgacaaccccattttttccaatgtaattcattgcttgctgcatatttcctgagttcgatttgatctgtcagtgtcaatgttagcttgtgtctcagttaacggtgtcattctattgtgagtcccgttgtgataaatttggacaagtatatatatgtcggttataattcgtatgaatggttagcttgtttatgttgggtccgaggaatgtaatcgatggttcaccgttcctctggaaaatgttgtgtttgcaatttagagagtattgttgcaatgactattatgtttgacaacaaaatactcagaaagtattgttgcaactccagttacgtccaccagcagtcacgacagcttaatctttcggtgttctcccactcagtgaaaagcgcatattgtttttgatgccacaaatcgtatctgctactgctttaccattattttacgatatttcttcatagacgattcgctacgggatgctttcgtgctaatgctttatttaaatgcatgtcttcatggccttacgcagctaataaagaacgacgcgacataagtttagtgaggatctcttcggtttctgtccaactagattctctacttaaaaatctcaaatcccaaacaaagagatatctccacatagcaaattaatgaatcaacatatagtacatgtaattgaat

SEQ ID NO: 18072 - DNA, 1058 bp, Zea mays
cattgggacctcgaggcggcgggaaaccatcaaccgcgtccgcgtcgagtctctactctctcggctgtccggtccggcgcggctctcgcgtctccaacctacccgggcccctcgggcccccccgccaaggctcacaccaccccgcgacgggcgacgctaattaagtagagctgcaacacctgggttggaggctagagcttgcaaacaccaccagcgaaaacgtcgtggccagccatcccggtgtcgtcccgcgttctacagcctctgcatcccgcgttctacagccaccgctgtcgtcgccgtcctagactcctagatccgtcagcttaacgagctccattccttcgaggccagccatcccggtgtctcagcagcggcggcggcggcgtcgagctcttgctttctgtgggaggacgcatggcgatgtctgcggggcgtgggctcttggtcctcttcttctctgccgccgtagtggctgagctcgcctctgccgcgaacggtcctttcctgtccgatagcgtcttccagtcgagcgccggatctacagggaggagcttgctgcaggccaagaatagttgccctgtgaactttgagttccaaaactacacaatcatcacaagcaagtgcaaaggaccgaagtttccagccagccaatgctgtgccgcactcaaggaattcgcgtgcccttttaacaattacctcaatgacgagagcaatgaatgtgcatcgacaatgttcagctacatcaacctctatggcaagtatccaccaggtctgttttccagcgagtgcaaagaaggcaagatggggctttcttgcgcagatgtcccccggaaggacagttccactgcaaacagtggttatcgcgcccaaagcagcttgcttgcgttgattaatgtcttgagtgtgatagcagcgttgttctactgaactacagctccattcatttcccacaaagatggtgtgttacaactgttgaggcttgagttgcaccttttggtgcttatggctatgggttggcttcctgattctttcttttgataaaaaaaaaaaaaaaa

SEQ ID NO: 18073 - DNA, 1146 bp, Zea mays
agtatttgctaggtctcgcctctgccagtagtcggccgtggcctcgcccacaagctaatcctacggcccacggaaccagtcagtcctctctccttccggcttccgctgctcttctttctttcctggcatcttggagacggcggcgagacgaggagaggactggaccatggctgcctcttcggctctcaggctaatcctgggctcctcgtcggcgtcgcgtcgccagattctgtccgagatgggatacaaattcacgcttcttagtgcggatatcgatgagaaagcgatcagaaaggagaacccagaggaactggtggtcgccttggctcatgcgaaagcagacgctattctggagaagatgcagaacaatgggatgatgaaagagattcttgattctcaagatactactctgatgataactgctgaccaggttgtgttgcatgatggagtgattagagaaaaacctagcacaccagaagaggcacggaaattcatcaaagggtactctgaaagccatgctgcgacgattggatctgtgcttgttacaaatgtgaagactggagctagaagggaaggatgggataaagcagaagtttatttccacaaaattcctgacgaagttgtggagagtttgatcgaggagggcgatgtgttctatgtcgctggtggtctccttgtggagcaccccttaacttcacctctcgtggaagccattgttggtacaattgatagtgtaatggggctccctaaggcgctcacggagaagctcatcaaggaatccctttcagagacatagctacaatcctatggactgaactgacctgtaatgcagaaatcatattggtggcggactggcggtggctaaatcagtttggcagcaatgtagtgtgagaatcatgtaaccattcctattttccaacaaaaaaggccgtcatgtgatcagcccactatgaacggaattcatccttggcttccatgaccataggtctgctgaatcattcgttttgttttctgtaatgtgttcggccgcaaggatttttaacgcctggcagattgcttgatttgatctatgaattcgtgctaggtgctctgtggcaaaaaaaaaaaaaaaagctttgttatatagagaggtgttaatggatcacg

SEQ ID NO: 18074 - DNA, 770 bp, Zea mays
agcagtatttgctaggtctcgcctctgccagtagtctgccgtggcctcgcccacaagctaatcctacggcccacggaaccagtcagtcctctctccttccggcttccgctgctcttctttctttcctggcatcttggagacggcggcgagacgaggagaggactggaccatggctgcctcttcggctctcaggctaatcctgggctcctcgtcggcgtcgcgtcgccagattctgtccgagatgggatacaaattcacgcttcttgttgtttttttttgcgccctatcgtttgagatgtttgctttagtaatttcttctcccgcacctttcagttcattcattttcttttttctccgggggctttagagtgcggatatcgatgagaaagcgatcagaaaggagaacccagaggaactggtggtcgccttggctcatgcgaaagcagacgctattctggagaagatgcagaacaatgggatgatgaaagagattcttgattctcaagatactactctgatgataactgctgaccaggttgtgttgcatgatggagtgattagagaaaaacctagcacaccagaagaggcacggaaattcatcaaagggtactctgaaagccatgctgcgacgattggatctgtgcttgttacaaatgtgaagactggagctagaagggaaggatgggataaagcagaaggttatttccacaaaattcctgacgaagttgtggagagtttgatcgaggagggcgatgtgttctatgtcgctg

SEQ ID NO: 18075 - DNA, 2488 bp, Zea mays
ggaccctcgaggccggccgggccgggctaccgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcggcccgcagtgtgagagctcgattcgttgccgtccacttgtctcacggcctgtcgccatctccttcctggttttttcatccgaccatccccggctcctccgcgccgtcggcgacgactccatcgagtcactcggccgcagcaaccggcgaccatgtaccgagtcgcctccgggctcggcgccctcaagaggcatggggcaaatgctcaaatgatgaatgctgcaattaggtgtgccagcacaagtgttgcacagaggtcttccggtggcttctggacctggttgactggtgcgcgttcaaatgaaatacctcctccagatttcacacttccgggagtgactattcctcctccgctgcctgaccatgtggaggctggcaaaacaagagtcacaacacttcccaatggtgttaaaatagcctctgagacatctgcgggatcatcttgttctgttggagtttatgttgattgtggttctgtatatgaagcacctgaaacaacaggcgccagtcaactgttgaagacaatggccttcacaaccactgccaacaggagtgagttgcgggttgtgcgtgaaattgaggcaataggtggcagtgccaaagcatctgctagccgtgagatgatgagctacacttacggagccctgaagacttacatgcctgaaatggttgaggtgcttattgattgtgtacgcaaccctgcttttcttgattgggaggtaaaggaacagattttgaggctacaggcagagcttgcaaaatcatcaagttatcctgaaaattttcttttggaggctcttcattctactggctattctggtgctttagcaaacccactaattgtgccagaatattcagttagcagattgaatgcagatgtcctggagcaatttataactgagaactacactgcttcccgaattgttctagctgcatcaggtgttgatcatgatgaattggtatctattgccgaaccccttctgtctgacattcccagtgtatctggaacaacaaggccaaaatcaacctacattggtggagaatacagaagaagtgcagattcatcgaacacagacgttgcattggcattcgaggtcccaagtggttggctcaaagaaaaagattgcgtcactgtatcagttcttcaggcacttctgggtggtggtggcaagttttcttggggaaggcaaggaaaggggttacattcacgtctaaaccgcctcgtaaatgaatttgatcagatcaagtcaatctctgctttcaaggatgttcacagtaatactggcatctttggaatccatacatctactgatgcatcatttgttcctaaagctattgacctagcagccagagagctcacttcccttgcaactcctggacaagttgaccaaagccaactggaccgtgctaaagcctcagctaaatctgcgatactggcaaatttggaatcacaggcatcgctaacagaggacatggggcgccaagttttggcatttggtgaaaggaaacctgctgagcaccttctcaaggctatagatggtgttactatgaaagatataacgtctgttgctgaaaagatcatttcatccccattgacaatggcatctcatggaaacgttctgaatatgcctacttatgagtcggtcagtggcaagttccgctcaaaatgaggagtacatgacccttcccttcattttatcaccttgtttgctggacaagttttaccagtcccttgtcattcacgtctaggccatggttcttggtcagtttcagaagaaataaggaacctcatgcagttttgttcgtgaaacctgtgatcacttcacaattattcccttttctcattcttttgcggaacattcgtgtggttaatgctggtgatagaccagtaacgtgcttgtaaatttaactgaaccctggcccctcattcggtaccaaggccccccagagaatgtacaaaattgtcgtaaaactcttgacaaaaatgttgtcgcacatgaataatgattctacagaactgaagtttgcatgaaaaaactccacgtcggggacccggttccccctggtgtatcttttggggtggtgtaaatgggtaacctaccattggtttttttttctggtcagctactttggtttatttctctaaattagttacatggtgtgccattctagttcgttttaacaagtttttgtatgctattcctggaatttgcatccctatgtgtgttaaattttatagcggtaactttttgtcaggtttgttagggcaaaagtgttgagcttacggacaatctgcaggcatgca

SEQ ID NO: 18076 - DNA, 973 bp, Zea mays
gttttgaacttttgagcataaaccgcttgtattttcgtgttgctgcaccaggtatttcaggtctggaactgatgaaaatcaagtgtgctctaaatgaaacactttttttttgttgccgcgtccgttttttttttttccatgctaattggccaacctttatagtcaacatcgttatatgaatattttttattgttggctctaaatgacatgggaaagatttagagcccaatgtaagcactattattaaagacccattattaaacttgctctaaagagataaattcagaaaccacgagttagaagtgctccatgacgagcgcgcacgcgtgtaagagctgccaaccgtaccacaagtagtctacgcctggttccttgtcacggagccgttgaacacgacgatctcgtcgccggcggccacaccgtgccactcgaaggatctcgactcgtccatcacgctctgttcatgtatgaagaagtaggcgccgtcgcgcgggagcgggaaccgtgcccccgccccgcgcgcgcgctccagctccgcccgcagcatcgacaccgcggcgcgcgcgcccacggccatctccacgcgtccctcggcgcaccccgacacgacgatcacccgcagcggcggcgccggtccctcgccacgcctcttctccgtcctcttgtcctgcggctgctgcaggtgctggccatcgaggagggcgacgtggatgacggagccctccacgacgccgtgccgctcgatgccgccgccgccgccgtcgacgtcctcgagcacggcaccgttgtggaggagcgtcgtggcggccgcgggccagcctcggcggctctggagcttctccttgacgtcctgcacggtgtcgaagtagcccacctccatcttgaaggcctcctcgcctgagcacacgaaggtcacgtccatgcccagaggtgccgatcaaggtcctacttagtaccaggctaccagcaagtt

SEQ ID NO: 18077 - DNA, 4446 bp, Zea mays
cctcgaggccggccgggccgggaaaccgcctttctctcccctactcttctccctccctccccgccggccgggccgggatacaagtagcgcccggagaaccgagaggccggagaaagaaaggcggaaagagggagcaaaatctcactttgctgggagttctttcctctgtttccgactcctttgttctcttagtgttcttggttggtggaatggaagctcagcagctccatttgtgttccagagatcttcgtcgttctcgttcccctcgtgtgtagcctttggtaggttggtggaagggcgaggcacacaagaaaattgatagaggggggatccccattttcagctcttcgtgtttttttgtaggaggaattcccgttcacatgatccgtgcctggacgtgacggttttgccgcgctctgctgcttccctttcggggagaagaggactcgactcaaatcatttggtatcgcagacgtcgcccttcccagttcagttgagagagatttctggcatgtccggcgcaagtaactatggatccctcatcgatgaatggttgccgccccctacacctagcccaagaactctcatgtctagctttctgaatgaagaattcagctctgcgccattctctggtccccatgatcaatctgaaaagagcagagaagttttgaattcgagcgatgaggttccttcacatgctgtcaaaggcctatttcaaaatggtttctcaaatttgttcagtgctaaatcaaactccaatggtggtttggcggagcgcagggctgcgagagcaggtttcagtgtcccgaaaattgatacttctcgagttggttcatccacagttattccatctcctgtgtcaattccacctggtctaagtccaactacacttcttgagtctcctgtttttctttacaataaaatggcacaaccgtctccaaccactggcacattgccatttttgatggctacgaatgataagtcaacaatatcaccagctgccaagataactgaagattctacatttgataatgatgtgttttctttccaaccccacttacgttctgaacaaacagggttctctactgcagaaaaggactatggtgcctatgagaaaaagcagtccttgtcgaatattcatcagcaggaatccagtcttcgaagctccaagcccgttgctgtcgaaggataacactagtgcaacaattgttaaagcgaagccatcttctagttccatgttcagtgatagtcactattcagctgaccaacagcaagctgacgagacaaacataaaggtgcaaggcaaaggtgtggaggctagatcagctgcttttgctcctgtatcagcgcacagtgatgcatctctcctggagtctcaagaagcacttgatgtctcctcaacactgtctaatgaagaggacgagagggcaacacatggcactgtttctatagagtgtgatggtgatgaagctgagactgtatctaaaagaaggaagctggaactagatgctttagaagctactcttactgctactacctccaccaccagtaccatcgacatggggcctgcagcctcaagagctgtccgggagcctagggttgttgttcagaccacaagtgaggtagacattcttgacgacggttatcggtggcgcaagtatgggcagaaggttgttaagggcaatccaaatccaaggagctactacaaatgtacaaacccgggctgttcagtgcgcaagcatgtggaaagagcatcgcacgatctgaaatcagtcatcacaacgtatgagggaaagcacaaccatgaagttccagcagccagaaatagtgggcaaggcagttccagcgctccatctgcatcacaagctggtggttctcaccgtaggcaagaacctgcacaggccagctttgctcacttcggtacggcttctttcagctcgttcggtctcccaccgagtggtcagttgggaccaacaactggcaatttcggcttcgggatggttcccccaggcatgacgatcccagtgccctctctaggatcgcttgcccctgtaaagatggttggaaattcatcagctatgcaggggtacccagggcttatggtgccgggagaaccaaaggtagagcctgtctcgcaaccactcatccaaatggcaaatgcatctccaccagcttaccaacagatattgagcaggcctcctttcggtcaccagatgtaaataataggaaagagaaaggggataatagatttgcttcagcttgtatacatgatagctacgctgcaacatggctttagtgttcatggatcgtccaattttttatttctattttatttttctgcccacgcatgtctttgaagcaaagaatgctgaggatgataccctgtcgtgcctgttgtaatcacgtaaaggatacctttcgtctttttgagactcgaaattggaaaacgatcaatcaaaatttctggttgcgaatgcaaatctgatgaattgtgctgccggacttgcagtatacaactgttctttttagataatggaagagttgtagcttcaaaccttttcaaagtaaaaacatcagtccacaattgttacaactatcatggagactgaaggtcagcggttaagccggtagctttgaacttttgggcataaaccgcttgcattttcgtgttgctgcaccaggtatttcaggtctggaactgatgaaaatcaagtgtgctctaaatgaaacacctcttttttgttgccggttcatttttatattgtttcatgctaaatggccaaccttatagtcaacatcgttatatgaatatttttattattggctctaaatgacatggcaaggatttagagcccaatgtaagcactgttattaaacttgttctaaagagatgagattcacaaaccacgagttagaagtgctccatgacgagcgcgcacgcgtgtaagagccgccaacctagtctacgccgggttcctcaccacggagccgttgaacacgacgatctcgtcgccggcggccacaccgtgccactcgaaggatctcgactcgtccatcacgctctgttcatgtatgaagaagtaggcgccgtcgcgcgggagcgggaaccgtgcccccgccccgcgcgcgcgctccagctccgcccgcagcatcgacaccgcggcgcgcgcgcccacggccatctccacgcgtccctcggcgcaccccgacacgacgatcacccgcagcggcggcgccggtccctcgccacgcctcttctccgtcctcttgtcctgcggctgctgcaggtgctggccatcgaggagggcgacgtggatgacggagccctccacgacgccgtgccgctcgatgccgccgccgccgccgtcgacgtcctcgagcacggcaccgttgtggaggagcgtcgtggcggccgcgggccagcctcggcggctctggagcttctccttgacgtcctgcacggtgtcgaagtagcccacctccatcttgaaggcctcctcgcctgagcacacgaaggtcacgtccatgcccagaggtgccgatcaaggtcctacttagtaccaggctaccagcaagttagaggcagccatggacatggcccggcatatataccatggacggaatgcatcatgtgtgactctccgccatctccccgatctgttggttagccgcaaccgcaaggatttccagtgagcaatcaccatgcaatgagacgccatttttttaagaggaggttttattccaatctctacacgagttatgcatgtaatgaggcgccattgcccattggccttgagaagttcagactgtacacatgacagacgcttgtactgttgttcttgcagatgccatgcaaattgcagtgatgcaaacgaggctattgtgatactgtccttgccttccataaacctcacagaatgggcatggctcctaggttgagattgctcattgctcggcgtgctgttttgagctgcagttaactcaggagggagcagctcatattgtcatgagcaagttgtgatagaacacgtttattctgcctggtgcgctgtctctctgcgtgtgtgttcttggttttggccagccaagacgacagacgattactttgtgctctctgctggatcctcattgtaatttgtatatttttttttgagaaacactcattgtaatttgtataaacgcaatctatactccaaaagcccattgatgtcaaggggccagttggacatacatagttcatgtgacataaactcaatcacacacatctaagtgataaaataggtgaatagacagtgagagtttaaacacacacatagtgaatgtgacataaatagttcaaacagacatagttgatcaacaactggatggtgataacaaacggattggtgaaaacaattatcttcagctcctgaatttaggtcctttttcttcttttttggagctgca

SEQ ID NO: 18078 - DNA, 3138 bp, Zea mays
  misc_feature (3043)..(3043): n is a, c, g, or t
  misc_feature (3049)..(3049): n is a, c, g, or t
  misc_feature (3071)..(3071): n is a, c, g, or t
  misc_feature (3073)..(3075): n is a, c, g, or t
  misc_feature (3088)..(3090): n is a, c, g, or t
  misc_feature (3097)..(3097): n is a, c, g, or t
  misc_feature (3102)..(3103): n is a, c, g, or t
  misc_feature (3113)..(3113): n is a, c, g, or t
  misc_feature (3115)..(3115): n is a, c, g, or t
  misc_feature (3121)..(3121): n is a, c, g, or t
  misc_feature (3123)..(3125): n is a, c, g, or t
ctttcttccatcccttcctctcctcggtcaaaccgcctttctctcccctactcttctccctccctccccgtctctctctctctaaaaaaagtagcgcccggagaacccggccgcccggcgaaagaatggcggaaagagggagcaaaatctcactttgctgggagttctttcctctgtttccgactcctttgttctcttagtgttcttggttggtggaatggaagctcagcagctccatttgtgttccagagatcttcgtcgttctcgttcccctcgtgtgtagcctttggaggaattcccgttcacatgatccgtgcctggacgtgacggttttgccgcgctctgctgcttccctttcggggagaagaggactcgactcaaatcatttggtatcgcagacgtcgcccttcccagttcagttgagagagatttctggcatgtccggcgcaagtaactatggatccctcatcgatgaatggttgccgccccctacacctagcccaagaactctcatgtctagcttcctgaatgaagaattcagctctgcgccattctctggtccccatgatcaatctgaaaagagcagagaagttttgaattcgagcgatgaggttccttcacatgctgtcaaaggcctatttcaaaatggtttcccaaatttgttcagtgctaaatcaaactccaatggtggtttggcggagcgcagggctgcgagagcaggtttcagtgtcccgaaaattgatacttctcgaggtggttcatccacagttattcgatctcctgtgtcaattccacctggtctaagtccaactacacttcttgagtctcctgtttttctttacaataaaatggtatgtgatatttccttaattggtttcttctgctctcaatatttatctgttacactgttatccaattttgaaataactcataattggaggaagcaccgaagactttcatattgcaaagtttggtacagtatagaaggaattgattgctgcttactgtatagaacatggttttctgcagtatacttatgtatgacaacaacaccgattgttgtctactgtgcaaaatattgtatactagaaatatagttatctgattggtgtcttagaagcttggcttatgttttgattctatagctgctagtttggaccaacacttacaaatccatctctgtgcctgccctttaatattttccttgcggacttagctgaattggttatgatatattgcaggcacaaccgtctccaaccactggcacattgccatttttgatggctacgaatgataagtcaacaatatcaccagctgccaagataactgaagattctacatttgataatgatgtgttttctttccaaccccacttaggttctgaacaaacagggttctctactgcagaaaaggtgatttccttgattgttagtatctacctgtattttccctcctttttgcagtgcagtgttataatactatttggcttccctctattgccaacctcactacaaaatttcctctttttgtttttttggtacaaagcaccttttaattgattcatgtgccagaaaaatgttttttatctacaggactatggtgcctatgagaaaaagcagtccttgtcgaatattcatcagcaggaatccagtcttcagtcaagctttaccgcagtcaaggataacactagtgcaacaattgttaaagcgaagccatcttctagttccatgttcagtgatagtcactattcagctgatcaacagcaagctgacgagacaaacataaaggtgcaaggcaaaggtgtggaggctagatcagctgcttttgctcctgtatcagcgcacagtgatgcatctctcctggagtctcaagaagcacttgatgtctcctcaacactgtctaatgaagaggacgagagggcaacgcatggcactgtttctatagagtgtgatggtgatgaagctgatgctgtatctaaaagaaggttagtatcgtccatcaggtaaaacttgatgcaggtattgcactgaatccactgatactctttttcaggaagctggaactagatgctttagaagctactgctactgctactacctccaccaccaataccatcgacatggggcctgcagcctcaagagctgtccgggagcctagggttgttgttcagaccacaagtgaggttgacattcttgacgacggttatcggtggcgcaagtatgggcagaaggttgttaagggcaatccaaatccaaggtctcactttcactaacatttcttacactactaaactgtactccatcccctgaaattagcaggcattgattcacttgtctgcaggagctactacaaatgtacaaacccgggctgttcagtgcgcaagcatgtggaaagagcatcacacgatctgaaatcagtcatcacaacgtatgagggaaagcacaaccatgaagttccagcagccagaaatagtgggcaaggcagttccagcgctccatctgcatcacaagctgttggttctcatcgtaggcaagaacctgcacaggccagctttgctcactttggtacggcctctttcagctcgttcggtctcccaccgagtggtcagttgggaccaacaactggcaatttccgcttcgggatggttcccccaggcatgacgatcccagtgccctctctaggatcgcttgcccctgtaaagatggttggaaattcatcagctatgcagggctacccagggcttatggtgccgggagaaccaaaggcagagcctgtctcgcaaccactcatccaaatggcaaatgcatctccaccagcttaccaacagatattgagcaggcctcctttcggtcaccagatgtaaataataggaaagagaaaggggataatagatttgcttcagcttgtatacatgatagctacgctgcaacatggctttagtgttcatggatcgtccaattttttatttctattttatttttctgcccacgcatgtctttgaagcaaagaatgctgaggatgataccctgtcgtgcctgttgtnatcacntaaaggatacctttcgtcccanannnaaacgtaaccctnnncatgcanggtgnngacaggtacntncatggngnnnaaaaaaaaaaaaa

SEQ ID NO: 18079 - DNA, 1772 bp, Zea mays
taaaaaggccccccactttttttttatttttttatatgatttaacaaaattcattcttttctctatattaaagccccctgttttttttttttttttttagcccaaaaaacttaactcatcattagctttataacagtggtgatgacaaaagtgcaacagctcttacggagtacattatattctacatatggcataatacatgcatgtcgttatagcactaataattaaacagcctaacttgacctctccccaccaaatcccacaagcccaagtaaacacttcaccagttgttccacgttaacctccccctcgcggctacctgccggcaaggtgccggccgcgacgaccaccacaagacatcagcatgcctacgccgacgacttgcgcacgaagtacctgtaggcggcaaccttgcgcttccgggaaccagaattgtctatggacagcaccatcttgccggcttccctagccgtgaaggcattgtgcacgggctcctcggcggtggccgagaccatcctcgtcttctccacgcagagcgtgtagctgtcctcggccgccggcacgtactcggctccgtactcgaggtcccagcccccgacgaccagatcccacgttatcgttgcaccggcctcgataccgtcgatctccaggaagaccttctcgccacccttgatggtgaactcggacgccggcttcggtggtccgttctcgaggtcaccggtgcggctcagcccgccgtactgcacaggcaccagctccggccggatgaacttgtagagtgtctcggcgacgttgccctcgcgcgcgatgacgaacttgctcttggtgcgctccgtgaggaagggcgagatcatggagaagagcacggagaagtaccacggcacgttaatgaacaccttccgcgctaccatctccgggtagttgtcctggaagagggagaggatctggttgctggcggctctgagctcccgctttggcatgtccttgaggtcggtgacctgtatgatggcgttgacgcccccgggcctcagggtgagcgcgcgcacgccacgctccatgacctggacgcgccagcggaggaagcgcgcgaggcggtcgccgtcgccgaagacgcgctcgtacatgtccctgtctttgaagacgccgtaggcgttgtagcagacggggtggccgtcgcggtcccagccgtgcatgtaggcgacgatgccctccaggtccttgaagcccagctcctcgtccagcacggcgtcggcgccgaactcggcgcgccaggcggcgcagcggagcaccatggcgtgggcgtcgcggacgcggaagtcccgcgcgcggaggaacttgaggagcaccacgtcggcgcgctcgtcgaccggggcggcgtcgtccgccgcggcgggaggggagcgagggttcagcgggacgccccagatggagatggggtccgggtgggtggcgagcagcgccttgaggtcggcgagcgcgcggagctcggacgccgggagcgcggccgcgacgtacgagtcctccttgaaagaggaggagcggagcagcgcagtggcgtccatgagcgaggacatgaggctgcgcttggcgcccttggaggtcggggctgccacgggcgcgggcggcggggtggtggtcggagacatgacggtggcgtggggcttgcggacgtgcggcggggtggggaggggaagctgggaaggggacaaggcgtctgcgggaatggtgggagctgcggcgaggagaggaggaagaggttttgaaatgggagc

SEQ ID NO: 18080 - DNA, 2179 bp, Zea mays
caacggcccgattgtgtaagaaaggaatgcgttaaggggttccacaactaaggaaaattgccttagggcggcttgcccggggaaaaaacaaggttatcactcggcggctttaaaaggataagggccacggccaaaccttgttgttccattaaggaagaacaaaagggccccaacaggcgaataggaggcccacggccggttcaacgggaccggggaggttcgaacaaaaccccatggcggcaatttttggcccgattggaaagttcaacgtcggggaaaacggcgaacaaaggcaactggcccaactaagaaaaggcggaagcaaggatggcccgcggtggcgtacttgaaaaaaaggatggccggttatggaaaaacttaaaagccccaaggttttttttttttttttttttttttttttttttttttttttttttttttttttttgaaaaagaaaactttagctcatcatcagctttataacggcggtgacaaaaaaacagaagttcgacatctcttacattatactctacacatggcataatacatgcatgtcgttatatatagcactaataataaaatagcctagcttaacctctcctctccaagtccgacaaatataagcccaagcaaagcatgcatgcaggcacttcaccggtggttccacgtttgcctcccccctggcgcggccggccggcaagacgccggccgccgccacgagcacagcaaggcctacgctacgccgacggcttgcgcacgaagtagcggtaggcggcgaccttccgcttccgggaaccggagttgtctatggacagcaccatcctgccggcctcccgagccgtgaaggcgttgtgcagcggcccggcgtcggcgtcggcggttgtggccgggaccgtcctcgccttctccacgcagagggtgtagctgccgtcggccgccggcacgtactcggcgccgtactccaggtcccagcccccgacgacgaggtcccacgttatcgttgcgccggcctcgataccgtcgatctccaggaacaccttctcgccacccttgatggtgaactcggacgccggcttcggcggtccgttctcgagctcgccggcgcggctcagcccgccgtactgcaccggcaccagctccggccggatgaacttgtacagcgtctcggcgacgttgccctcgcgagcgatgacgaacttgctcttggtgcgctccgtgaggaagggcgagaccatggagaagagcacggagaagtaccacggcacgttgatgaacaccttgcgcgccaccatctccgggtagttgtcctggaagagggagaggatctggttgctggcggctctgagctcccgcttcggcatgtccctcaggtcggtcacctgtatgatggcgttgacgccgcggggcctgagcgtgagcgcgcgcacgccgcgctccatcacctggacgcgccagcggaggaagcgcgccaggcggtcgccgtcgccgaaggcgcgctcgtacatggccctgtccttgaacacgccgtacgcgttgtagcacacggggtgcccgtcccggtcccacccgtgcatgtacgccaccacgccctccaggtccttgaagcccagctcctcgtccaccaccgcgtccgcgccgaactcggcgcgccacgcggcgcagcggagcagcatcgcgtgcgcgtcgcgcgcgcggaagtcccgcgcgcggaggaacttgaggagcaccacgtcggcgcgctcgtcgtcggcgacggcggcggcgtccgccgcgccgggaggaggggagtggggattcagcgggacgccccagatggagatggggtccgggtgggtggccaccagcgccttcaggtcggcgagcgcgcggagctcggacgccgggagcgacgccgccacgtacgagtcctccttgaaggaggaggagcggagcagcgcggtggcgtccatgagtgacgacatgaggctgcgcttcccgcccttggacgctggggcgggcgacggggtggtggcgggggacatgccgctggcgtcggggcttgcgggcctgcggcggagtggtcaggggaagctgggaaggggacaagcgtccgtctgcggaaatggtgggagctgcggcgaggagaggagaaaagaagaggttttcaaatgggaggaggatttggagtcccggccaagcc

SEQ ID NO: 18081 - DNA, 1206 bp, Zea mays
gggtacctcgacccggccggccgggtaaatataaaagacccgtctccgtctcgggggagcaggagaggggggagaggccaagaacccagccgcgaagccaagccaagcccatctgatccggcacctgctgccctgccccaggccccagctcgtctctcaggtcgccttgccgttgccggttccgcgcccggctcagagtcgcgagctcgtctcgcagatccggcttcgcttgcttgaattctgttctttgggagcaaagaggtgctggccggtggcgtggcttggtgctctggggccggcgagtttttttgcgtccgctcgctctgcctgtagtcttcttgctgcggcggcggggtggagatgggggtggcgggggagaagttccagctggggacggtgggggcgctcagcctctcggtggtgtcctccgtctccatcgtcatctgcaacaaggctctcatgagctcccttggcttcaacttcgccactactttgacaagctggcatctcctggttacattctgttctctccatgtggcattatgtatgaagctgtttgagcacaaacctttcgatgcaaggaccgtcatgggattcggagtgctcaatggcatatctattggacttcttaacttgagtctgggtttcaattctgttggtttctatcagatgacaaagctggccataattccctgtactgttatactggagacccttttcttccggaagaaatttagccggaatatcaagctttcccttagtgtgctccttcttggtgttggtgttgcaactgtaactgatctgcaactcaacgttatgggatctgtactgtccctactggcaatcatcacaacctgcatcgctcagatcgtatccttttgattgtacattactcactattttttttatgtggcatatctgtcacagtatccagaacgatttgcacacaacaaactttgcatttgccactaaagcatcctttaatttgagtattagtgttctgtggcgtgtaacttgagtccttaacaagccatcagatgacaaatacaatacagaagaagttcaaggtatcttcaacacagctcctgtaccagtcatgcccataccaggcattgacgttgttccttgtcggtccattcctcgatggatttttgaccaaccaaaatgtctttgctttcgactacacaactcaagttctgtttttca

SEQ ID NO: 18082 - DNA, 1736 bp, Zea mays
ggggagaggccaagaacccagccgcgaagccaagccaagcccatccctccccccccccgccccccgccccccggcccctgctcgtctctcaggtcgccttgccgttgccggttccgcgcccggctcacagagtcgcgagctcgtctcgcagatccgttttcgcttgcttgaattctgttctttgggagcaaagaggtgctggccggtggcgtggcttggtgctctggggccggcgagttttttttgcgtccgctcgctctgcctgtagtcttcttgctgcggcggcggggtggagatgggggtggcgggggagaagttccagctggggacggtgggggcgctcagcctctcggtggtgtcctccgtctccatcgtcatctgcaacaaggctctcatgagctcccttggtttcaacttcgccactactttgacaagctggcatctcctggttacgttctgttctctccatgtggcattatgtatgaagctggccggccgcgccccgttcgatgcaaggaccgtcatgggattcggagtgctcaatggcatatctattggacttcttaacttgagtctgggtttcaattctgttggtttctatcagatgacaaagctggccataattccctgtactgttatactggagacccttttcttccggaagaaatttagccggaatatcaagctttcccttagtgtgctccttcttggtgttggtgttgcaactgtaactgatctgcaactcaacgttatgggatctgtactgtccctactggcaatcatcacaacctgcatcgctcagatcatgacaaatacaatacagaagaagttcaaggtatcttcaacacagctcctgtaccagtcatgcccataccaggcattgacgttgttccttgtcggtccattcctcgatggatttttgaccaaccaaaatgtctttgctttcgactacacaactcaagttctgtttttcatcgtgctgtcgtgcctgatttcagtctcggtgaacttcagcacttttctcgtgatcgggaagacgtctcctgtaacctaccaagtccttggccatctgaaaacatgcttggtcctcacctttggctatgtcctgcttcacgacccgtttagctggagaaacatacttgggatcctaatcgcggtaatcgggatggttctgtactcgtacttctgcactagagagactcagcaaaaaccagcagaagcctccccgcaagccgttcaggcaaaggagggtgaatcgaacccgctgatctcggactccctgagcgctgccgaaaatggaggcagtgccaccgacgatgaacctctgaaggtaccaatgtggagctcgaagtactcgaaggcgtgaagtggctgttctggtattagtgcacacggtgctatacagaattcagcgtggtaggcagatactagggttggaaggcaaccctgttcctgttccatttttggccttctattttttcttcttcctggcacaaatactataaatatgtgctgtcagtaaatggatctcactcttgagaggaatacctcagctcgagaccgagtgttctgttctgcctgaaagctagtatttgtttgtgctccactccacgtgtaaagtggtagatggacatgatctcaacagtagtagtttgcattcttttgtactagtgatatacaatatttatgtattcctcgtgttccctaagcggccaaaaaaaaaaaccacgcgtccg

SEQ ID NO: 18083 - DNA, 1789 bp, Zea mays
gggtacctcgaggccggccgggccggggggagacccgtgcctttctgttggataaaaaacacccgcctccgtctccatctccggtgagcaggaagagggggagggaggaggccaagagcgcagcggcgaagccatagccaagctcacccgatccagtccctgccgcccccagcgtgccacagccagtcccgcgctcagctcagctcagattcacgagctcgtctcccagatccagcttcgtttggttgaattctcttctttggaagtgctggtgggcggcgtggtttggtgctcttggggccggcgtgtttctgcgttctccgggctatctgcctgtcttgctgcggcctgcggcggcggggtggagatgggggtggccggggagaagttccagctggggacggtgggggcgctcagcctctcggtggtgtcctccgtctccatcgtcatctgcaacaaggctctcatgagctccctccgcttcaactttgccaccactttgacaagctggcatcttctggtcaccttctgttctctccatgtagcattatgtatgaaactctttgagcacaaacctttcgatgcaaggaccgtcatgggattcggagtgctcaatggcatatcgattggacttcttaacttgagtttgggtttcaattctgttggtttctatcagatgacaaagctggctattattccctgtactgttatactggagacccttttcttcaggaagaaatttagtcggaacatcaagctttcccttagtgtgctccttcttggtgttggtgttgcaactataactgatctgcaactcaaccttgtgggatctgtattgtccctactggcaatcatcacaacctgcattgctcagatcatgacaaatacaatacagaagaagttcaaggtatcttcgacacagctcctgtaccaatcgtgcccataccaagcattgactttgttcctcgtcggcccattccttgatgggtttttgactaaccaaaacgtctttgctttcgactacacaactcaagtcctgttcttcatcgtgctgtcgtgcctgatctcggtctcggtaaacttcagcactttccttgtgatcgggaagacgtcgcctgtaacctaccaagttctcggccacctgaaaacgtgcttggtcctcgccttcggctacgtcctgctccacgacccgtttagctggagaaacatacttggaatcctgatcgcggtgatcgggatggtcctgtactcgtacttctgcactagagagactcagcagaagccggcagaggcctccccgcaagccatcctgcaggcaaaggagggtgaatcgaaccctctgatcttggattccctgagcgccgccgaaaacgggggcagtgccaccgacgacgagcctctgaaggtgccaatgtggagctcgaagtactccaaggcgtgaaaggctgttctgttactggtgtactacggtgttatacagaattcagcttggtaggcagatactactactagggttggaaggcaatcctgttcctgttcctgttccatttttggccttctattttttttcttgttttcatcctttctggcatatactacaaatatatgtgttgctgttagtaaatggatctcactctttggaggatgatacctcagctcgagacgagtgatctgtctgaaagctatttcctcgtgttccatccactccacagtataaactggtagatggacatgatatcaacagtagtggtttgcattcttttgtactagtaaaaaaaaaaaaaaaaaa

SEQ ID NO: 18084 - DNA, 1979 bp, Zea mays
gccggccgttccggggagggggagaggccaagaacccagccgcgaagccaagcccatctgatccggcccctgctgccctgccccagctcgtcgctcgggtcccccggccccgttgcccgtgccgcgcccgggcccggctcagagtcgcgagctcgtctcgcagatccggcttcgcttgcttgaattctgttctttgggagcaaagaggtgctggccggtggcgtggcttggtgctctggggccggcgagttttttttttttgcgtccgctcgctctgcctgtagtcttcttgctgcggcggcggggtggagatgggggtggccgggggagaagttccagctggggacggtgggggcactcagcctctcggtggtgtcctccgtctccatcgtcatctgcaacaaggctctcatgagctcccttggcttcaacttcgccactactttgacaagctggcatctcctggttacattctgttctctccatgtggcattatgtatgaagctgtttgagcacaaacctttcgatgcaaggactgtcatgggattcggagtgctcaatggcatatctattggacttcttaacttgagtctgggtttcaattctgttggtttctatcagatgacaaagctggccgtaattccctgtactgttatactggagacccttttcttccggaagaaatttagccggaatatcaagctttcccttagtgtgctccttcttggtgttggtgttgcaactgtaactgatctgcaactcaacgttatgggatctgtactgtccctactggcaatcatcacacgggccaattatatcccgttgaaatacaatacagaagaagtttaaggtatcttcaacacagctcctgtactagtcatgcccataccgggcattgacgttgttccttgtcggtccattcctcgatggatttttgactaaccaaaatgtctttgctttcgactacacaactcaagttctgtttttcatcatgctgtcgtgcctgatttcagtctcggtgaacttcagcacttttctcgtgatcgggaagacgtctcctgtaacctacaaagtacttggccatctgaaaacatgcttggtcctcacctttggctatgtcctgcttcacgacctatttagctggagaaacatacttgggatcctaatcgtggtaattgggatggttctgtacttgtacttctgcactagagagactcagcaaataccagcagaagcctccccgcaagtcgttcaggtatctgtctgctggaactctcggtctgaatggtgcttttagcaaggttgccaaggtcggtcatgttgctggctcaagaaccagagaaaagttacaattggctgtatcagatctagcagccaaagtgaatcgtcaagcgattttgtttcaagtaaaaaggcaaacttgttttgcgtgcagctggaactcgtgatgttggtgcatcctgctgattgcaaaagcatgttagatgctttcatagctggctgtgatttccattccaggacaaccatgagcatgtatcagcatattcgtgagactgttgaagaagagaaagtaattcttgagtggcatcctcaacccgatcaagagaaatctcccatgctgttgttgaaggatgcttttggcgctgagaggaggaaagctataagatgctaaatctctccattgcatacgggaaaacgtaggaagggcactgcagctgatgttgctgtgtgcaatgcttgagatagacagaaatactcgtcttaaggagcttggttgggcgctactcatgtgggtagtttatgcataaagttatgcctgttcgctgcttaaatgttgccatattttgtttttctctttgaaactgtgaagggcgcaactttttaatgacttctgtaacttgtgtatctagcatctgtattcggtattctgagttaaaataggcaacattttattatattttacataatttcttttaagg

SEQ ID NO: 18085 - DNA, 747 bp, Zea mays
taaataaaatgccctcgcggcctcaccgcccgattgccatccatcacatcctctcccaccttactcaagctagtgcgagcatagcaatggggttcgcccggaagagtggagttgcagcagtaggggtttggtggctcctcctgctcgccggcgtgctgttgcctttggcggcggcatttggccggcacgccgatgccggcaacgacatgtgcgacatcaagtgccagcatcacagcgacccggccaggaggcagcagtgcgtggatgagtgccatagccgggagcaccatcacccggcctagcagagagttttgcgagatgaagtgtcagcaccaccaggaccctgcaaggaaagagatctgcgtacagcagtgcatgagctatggtctcagccaccgtgcgagtgccagtgttgatgatgagggtgaaaagcgcttccatggctgggaaacgacggtggccggaggaatcttcgaggtggtgtgacgacgtacgacgttatataacagtagtacgtcttaattaataaaataagctacacccgcgtttcccttatatatatgtcttgctatgcatagagatatcatggcaaaggcataggaataaagtgcgtgcgatatgcatgtacgtgcatgttcgtagtaatcttacagagattacgcagaaattttattaaaagcagtttgatttcacataaggaaggaatttaggaacacgaaaaatctctctcaaaaagacccaaaaaaa

SEQ ID NO: 18086 - DNA, 784 bp, Zea mays
  misc_feature (715)..(715): n is a, c, g, or t
  misc_feature (718)..(719): n is a, c, g, or t
  misc_feature (742)..(742): n is a, c, g, or t
  misc_feature (751)..(751): n is a, c, g, or t
tcgggagtcccgccggggcaccggtacccgcgctcgcgccctctcgcccgggattgccatccatcacatcctctcccaccttactcaagctagtgcgagcatagcaatggggttcgcccggaagagtggagttgcagtaggggtttggtggctcctcctgctcgccggcgtgctgttgccagccaccgcatttggccggcacgccgatgccggcaaagacatgtgcgacatcaagtgccagcatcacagcgacccggccaggaggcagcagtgcgtggatgagtgccatagccgggagcaccatcaccctagcagagagttttgcgagatgaagtgtcagcaccaccaggaccctgcaaggaaagagatctgcgtacagcagtgcatgagctatggtctcagccaccgtgcgagtgccagtgttgatgatgagggtgaaaagcgcttccatggctgggaaacgacggtggccggaggaatcctcgaggtggtgtgacgacgtacgtcttaactaataaataagctacacccgcgtttatatatatgtcttgctatgcatagagatatcatggcaaaggcataggaataaagtgcgtgcgatatgcatgtacgtgcatgttcgtagtaatcttacagagattacgcagaaattttattaaaagcagtttgatttcacataaggaaggaatttaggaacacaaaaaagccggcacancannccctataaacattgtcctgcggntacattcgntgtcttgtctaaacagcttatatatacactagc

SEQ ID NO: 18087 - DNA, 1056 bp, Zea mays
ttgggcccccccggccccccccgaccacacctccagtcctccactgacaagccgccgccgctcttccacctacctctccccggcctcgcacccatggccacggctttgatggttgcagccaccacctcctgctccccgggccgcgccgcgccgcgcctgaagccggtggcctcctcctcctccagcagcagcagcagcagctcggcgcggccgcggcggcccttggcgcagcagctcccgcggctgctggcgacggcggcggcggcggcggtagcagccgcgccgctcccggcgctggcggagcagatggagaaggccgcactgtttgacttcaacctgacgctcccggcgatcgcgaccgagttcctgctgctcatggtggcgctggacaagctctacttcacgccgctaggcaagttcatggatgagcgggacgccaagatccgcggtgagctcggcgatgtcaagggcgcctccgaggaggtgaagcagctggaggaccaggcggcggccatcatgaaggcggcgcgcgccgagatcgcggcggcgcttaacaagatgaagaaggagaccaccgcggagctggaggccaagctggacgaggggcgcagccgtgtggaggccgagctcgtagaggcgctcgccaacctcgaggcgcagaaggaggaggctgttaaggcgctcgacgcccagatcgcctcgctcagtgatgagatcgtcaagaaggtgctcccatccgcgtgatgaaaccaaaccggccctgccttatcctacgactatagttacatgaacatcataaattaatgataattttgaagaaattggccgatgactccgacactgtactcatgaaagattattggatgggttgtgtccaccgcctgtgttgggtgtggattgttgtagactcgcagtgatctttctcgataagcttgtacagttcagtacatacagacacacattgaaaccatatagatacaggatacattttgccctaaaaaaaaaaaaaaaaaaaaaaaaaaaaaaaaggaaaaaaaaaaaaaaaaaaggccccta

SEQ ID NO: 18088 - DNA, 1464 bp, Zea mays
cccacgcgtccgattgatgtctgcctgggtgcgcgtataaaagctagctagtgccataaagaaagagagagcgagaacgagtggcgatggcagtactgcacttgcaggtggcggcggtggcggtgctgctgatggcgacggggctgcgcgcgcagctgcgggtgggcttctacgacagctcgtgcccagcggcggagatcatcgtgcagcaggaggtgagcagggcggtggcggccaacccgggcctcgccgccggcctgctccgcctccacttccacgactgtttcgttgggggctgcgacgcgtccgtgctcatcgactccaccaagggcaacaccgcggagaaggacgccgggcccaacctcagcctgcggggcttcgaggtcgtcgatcgcatcaaggcgcgcgtcgagcaggcctgcttcggcgtcgtctcctgcgcggacatactcgcgttcgcggccagggacagcgtcgcactcgccggtgggaacgcgtaccaggtgccggcggggcggcgggacgggtccgtgtcgcgcgcgtcggacaccaacggcaacctgccgccgccgacggccaacgtcgcgcagctcacgcagatcttcggcaccaagggcctgacgcagaaggagatggtcatcctgtcgggcgcgcacaccatcggctcctcgcactgcagctccttcagcggccggctgtcggggtcggccacgacggcgggcgggcaggacccgaccatggacccggcgtacgtggcgcagctggcgcggcagtgcccgcagggcggcgacccgctcgtgcccatggactacgtctcccccaacgccttcgacgagggcttctacaagggcgtcatggccaaccggggcctgctgtcctcggaccaggcgctgctcagcgacaagaacaccgccgtgcaggtcgtcacctacgccaacgacccggccaccttccaggccgacttcgccgccgccatggtcaagatgggctccgtcggcgtgctcaccggcaccagcggcaaggtcagggccaactgcagagtcgcctgatccatcgtcatcactcgtgtggagttgtagattcgttatattgatttggaccggacgacgtcgacaggatggcgtagcatagcatagcctgcttgcgcaattgtatgtatgcctgtacttgcgcgtgtatgggtttcgctgtgcaaattttcgttggctcccccgattgattgaggcgtgtgtgcgtgtgtgtctcttctgaatctgaatggaaaatctgtaacctgagctaaaactgctcgtgtactacccaatagttgcttcaaactacgatggatttttatccaaaaaaaaaaaaaaaaacacgcacaaatatgtactgtatttctcaatcaactaaggatcggagaaactggtttgtaaaggggattttgtaaacaccagtcaatcagacatgtaactcgacatgggccta

SEQ ID NO: 18089 - DNA, 2492 bp, Zea mays
ggcggtattcgatcattattaaaaatctaattaccggttagtgaagctttacctagggtaacgaatatgctcatgagtatcaatgtattaggctcatattttacttgtagcatgtttttatcaaatatttcatagataaaataaatcagtatttggtatgacgctgtgttctaaattaggtaaggatccaaaatgtgaatccaaattcaaactatttggtttgtattgataatattcatattagtattcgaatttaaatatggcaaatagcgtacccatacgagtggagcctgcttgagccttccccctgcggatctctccgcattccatcgcccccaaggccccaatcatggctggaaaagctagcccgcccccaattggcaggcactctaccaacctatgtgtcccctgtgcacatgcctggcatatggcacactcactgctggtctggccctaaacccacatttgttatatagagatagggattagactcccgagtgcctttgccttccttaaccaagaagcatatagctactgattgatgtctgcctgggtgcgcgtataaaagctagctagtgccgtaaagaaagagagagcgagaacgagtggcgatggcagtactgcacttgcaggcggcggcggtggcggtgctgctgatggcgacggggctgcgcgcgcagctgcgtgtgggcttctacgacagctcgtgcccagcggcggagatcatcgtgcagcaggaggtgagcagggcggtggcggccaacccgggcctcgccgccggcctgctccgcctccacttccacgactgcttcgttggggtcagtccctcggtcgcaagctcgcagctgctgctcacacttcaaagggctggtcgcaaaccaagaacgactgaccgcttgtttctgcactacctgcagggctgcgacgcgtccgtgctcatcgactccaccaagggcaacacagcggagaaggacgccgggcccaacctcagcctgcggggcttcgaggtcgtcgatcgcatcaaggcgcgcgtcgagcaggcctgcttcggcgtcgtctcctgcgcggacatactcgcgttcgcggccagggacagcgtcgcactcgtaagtcacactgctttagtgtcagtggacgcctgccttttgattttaacccgacatgattagtttacatggatttggaatccaatgctggactggactagactgaaaagcatatgtgtctgttcgaccttttttgacgcacatgatgccgcgtgcagctgcctgaaagaactcgatgcattgccgggcccgggcatgggtccaactcccaactttatttacagtatttgcttactctccaatccatccatccatccatccgtacgtataggccggcgggaacgcgtaccaggtgccggcggggcggcgggacgggtccgtgtcgcgcgcgtcggacaccagcaacctgccgccgccgacggccaacgtcgcgcagctcacgcagatcttcggcaccaagggcctgacgcagaaggagatggtcatcctgtcgggcgcgcacaccatcggctcctcgcactgcagctccttcagcggccggctgtcggggtcggccacgacggcgggcgggcaggacccgaccatggaccccgcgtacgtggcgcagctggcgcggcagtgcccgcagggcggcgacccgctcgtgcccatggactacgtctcccccaacgccttcgacgagggcttctacaagggcgtcatggccaaccggggcctgctgtcctcggaccaggcgctgctcagcgacaagaacaccgccgtgcaggtcgtcacctacgccaacgacccggccaccttccaggccgacttcgccgccgccatggtcaagatgggctccgtcggcgtgctcaccggcaccagcggcaaggtcagggccaactgcagagtcgcctgattcatcgtcatcactcgtgtggagttgtagattcattatattgattgatttggaccggacgacgtcgacgggatgctacatggcctgcttgcgcaattgtatgtatgcctgtacttgcgcgtgtatgggtttcgctgtgcaaattttcgttgtctcccccgattgattgaggcgtgtgtgcgtgtgtgtctcttctgaatctgaatggaaaatctgtaacctgagctaaaactgctcgtgtactacccaatagttgcttcaaactacgatggatttttattcaaactatcacttccaaacacgcacaaatatgtactcaatcaactagggatcggagaaactggtttgtaaagggaattttataaacacaagctattcagacatgtaacaaaaaaaaaaaaaaaatcgacatgggcctaagttctcgtcgacctgattgctccgaacctctattcgatatttatcaagtgttcctgattgttaacatggtttgaacaagagtggatcggtaatagaggtaggttaatctaggagtgtgtgctccagatcct

SEQ ID NO: 18090 - DNA, 4369 bp, Zea mays
  misc_feature (335)..(335): n is a, c, g, or t
  misc_feature (566)..(566): n is a, c, g, or t
  misc_feature (3862)..(3862): n is a, c, g, or t
  misc_feature (3942)..(3942): n is a, c, g, or t
gatgcaaggaatcattgacttacatcacgatatctttttcttcctcattctgattttggttttcgtatcacggatgttggttcgcgctttatggcatttcaacgagcaaactaatccaatcccgcaaaggattgttcatggaactactatcgaaattattcggaccatttttcctagtgtcattccattgttcattgctataccatcgtttgctctgttatactcaatggacggggtattagtagatccagccattactatcaaagctattggacatcaatggtatcggagtgcgcctcttaacgagggtgatttaagtgcaacgaaatgtaccngtggttcgcgaagcatctggcttaccggtcatctcccattcccgtcgtcgagagactaaaagaactatagcatgccagaaacggggagttgaggtggttagacctataccccgaaatgctcccagcataggagcctatggttccattcttgttattgctggaggtacacatacctcttctcggtgtggtggagcgatatacgaaaaatagatgctaagcccgcaatgtccnataacggggcttcagtagtgaatctatcggcaccacagcagtggcatacaactttggacctaagggccggccccgttacctttcggaatgggggatccccgttggcaacaaccacggtagtagttgcggaactactgggccaagagaggacaacctgttgttcctgctcctccttcttcgcttcggggacggaggtcctacggtaggtaagagcacgcacaagcacttggccgaaggggaccagcgcttctactcctccaccgaggagccgttcttgcgagaagcaagggatgtcgtgaacggtgggaggtcaaagaaagagaattgacctctgaatacagtgatcctatgatctagatagactccgtcctttttttttagataagggtgactcaagaggggggagaactacctaactaaagaagaatagcgctctttaaaaataagagtaggcgtggagagctttttgcggggaaacttgcaagtcaagtttggggggaggcgggcgtcgacccaaccttatgagtattcggactataacagttccgatgaacagtcactcacttttgacagttatacgattccagaagatgatccagaattgggtcaatcacgtttattagaagttgacaatagagtggttgtaccagccaaaactcatctacgtatgattgtaacacccgctgatgtacctcatagttgggctgtaccttcctcaggtgtcaaatgtgatgctgtacctggtcgttcaaatcttacctccatctcggtacaacgagaaggagttgcccgtggtcagtgcagtgagatttgtggaactaatcatgcctttacgcctatcgtcgtagaagcagtgactttgaaagattatgcggattgggtatccaatcaattaatcctccaaaccaactaaaccggggaagctgaagcggaaatgcaattctcgggtgagggaaggcttcgctcgctcgctcaaaaagctctaacgctcgtttacgagtggagtgcataagcccttattgaagtagggcgaggccttactacacgagctcgtaagtaaagcacggaacgagccttgtctacgaagcttcgcttcatcatcttgcttgcttctgccgaagcttaacgcactataacataggcatgcatgatggtatggtaggaagactccttttaaggccgaccactacataggagcgataggaagccaagccgtcaaaaggaaaggcgagcagcccttattgcaatagcaaacggcctacttatagccctatttataccctttatcggggacgggccttacaagctcaataaattgcaattcttcaccttttcctcagacagtgggaatgaattttcttacttgattgacattgacagatatgtgtaccacaccgaacaagcaatatgtcatatgcttgatgtaccagccaagccagctctttttttctccgttcccttatccttagcgctaaagtcaaaataaaatgcaagagagtttgtatttgcaaatgaaaatgaatatggatctaaaaaaaattatataatcaatcaataaataataattggaataatataaaaaatatccttcgcgtattcgtttagaatcttgttgaccctactcgcttactcctattttcctgctttctttttcgacagaattcattctattctaactttcttgaaagaatggggttctgggctcaccctctcttcctttttgagaaagatgggctgccctgggagtctcgccttggtgattctttctctcttgggggtcttcttcggtagcgaatccgctctcataaattggatgaattcttctgggtcggcttcgggatccgcctctgagagttggcaaaagtacctcaacttatcggagtcggaggaaaatgccgcgtccgaaccatccacaagccacaccccgccgaaccctgaacctgaagcaccatccatttcgttcttgcgagaacgaatcaaaaatgttattcgctcatgccagcgtatacgaaaataaaaaatcctaaaaaggattaacgaagatcttcaccttgaaacggcgagcgccgagaagcgggtaaaaatcgcccaggtcctcgataacatgaactggaaaagggttttcttttatacctatacgggggaacctaagataaagcccatatcgacttaacggtccacgattgggatcgcgcacgaaaaggctaaacacagcctttttcttgtcctcgggacagcgggctagtcccgtgcctgtttttttgagttggggtacacaatcttccttgtgactgccaaaccagatttccgtttttagggagaaggtgtagtctttttgaacggtggtatcgtcaagaagaacgaggcccgccccatttctggggcggggggaaggagaagtgggactgtgggtctcctttcattaaaaaaaaaaaaaaaaaaaaaacacaaaagtactctgcgttgttaccactgcttgactattgctgttaatagatacctgcttgcttcttgcttactggcaacctttataagatctccaccttcaagcttgagtacaagcagctctttaaaaaaggggaattccggtccctccctatccttcatgtgctctttcaagatcaccctcgacagcgcagttaggtcttagagaaggaactgatttacctaagtctaagtaagtagccaacttccgataatcattcctagctttgcgctagattcagtatggtgatacgcattttagaaatagcaagggataatagctcttcttaagagaatggctgctttgggggagttctctttccctctaacctctaactcgaaattgaataagagaagacaaagctacgcattcactcgtagcactcgttaggccccccatgaatatgcatggagccatgcgcatgattccaagagcgaggcgaaactaaataagaataaccagtaatgtcacgaatgaatgaagcaagctcttttagatggtatcgatcagagccaatccaccctgttctttcctgattatcgtcacttaaatgaaatcccactagctgaaatagaatccgtcaagtaagagataagccagagatccagatcattagaatacgttaccggtccaagatgggcctcatcgcgaaaaagagtatgttattcctatctctaggagtagtagcgctagcggcgcagaaggagaaagtagctaagcgctaagaagctatctagagagtttccagctgaggtttcctattggtatcggcggagaacggatctgagaacagcttctgattttgttttgnaatcaagtgcaggatgaaatggaagataatcaatggaatccaagtatctttgccttccttcttcgcttattatctttggncaatgtcccaagaataggttgagagagaatatcccctagcttgacttccaactcttcacagagcagtcgattcggtcatcacatgttactggttggatgacgatcggaaaactcttagtaggttgggatcaagaagaaggattggtgctggacaagagataagaatagagagagtgtgtaatcaaagcaagggataacggtcaagtgcacatttcattcatgtcaaggctatctgaaaagcaagggaaatcatgattcattggattggcaaatcagacagatttaatagctatacttggctaaatcagacagattttattgttgtagtgaggaaaataaaaaatgttaatgaattattgaccctagtctaaaggtaccagtatctttcccaagcaccaacttgctttcgattttttatgtgagcttc

SEQ ID NO: 18091 - DNA, 1358 bp, Zea mays
ccacgcgtccgttccaattttgtcttctcggcacccgcgggagctgcggcagcggcatgaaggcgcggccccgtgcgtgctagtacgccgggcaagtgacaaggcgtggccgcaagtcgcgcacgagtcgtggcgacggcatccaagcaaggaaaagaaataaagcggaaaactttaaacgggtacgcaggagatccagcgaaatggcggcgccgccgccgtcatatccagcggccttgaagccggagatcggccctgacggcctcgctcgagattctcccgtaatcgcctacaccgagaaggtcattttggaggagcagctgcagctgaagaaatacattcaggagaactattccaaaattcgtgatgtagaaaaggagttagagagtcttactttagaaatgaaactgacagctggaccaaagaaagcagcactagagcatctgaggaagaagattgaaatatcaacagagaaaatacgtttagctaaggtgaaagaggaacatgcaaaaaagacttgggaagttgctgcacaagttgttaaagacgaagaggatgctaagcagaaattatgtgatgacctaaaccatctagtccaggagagtgctgcttcccaatatgcaagattggaggagctgaagaaacgtttagaatctctaaatcccataagggattctgttaatgtgtcaggtgtttatactgcacagcatgctactctgaattcagtacctcagcaaccaactgcacaaaatcctgcagatgtaactggccgtcagaatattgccacaaagcctgcttctatgcaacagcagcctatacctgcggaggcagaaaagaagagaagaccctcgaattcggcaagagggaggggtggtgtcatgatccttccgaagggaagagagggttctgggtcaggatggacaggtgctgggtttgatgtagatagccgtacatgacgcccggtatttcaagttattcgtaccattgaaaccatgctctccaaaattcacaagaattagattggtcaccaaaaaaaaaaattcagagccattccagaattctaatgtgaggaaggtgtacgtttgatcatttgttcatccattggatatgaatcatgcacctttttaatccggggttttacatatatattcaaaggctagaaatcagaacctatttatgagcattttatagggcatgttgtcttatggtgagtttgactatggtacatctggatgaacggatgtatgctaagttgaattgtattttaataaaaggtgtttgatgcggatgtatgagtggatgtaaaaaaaacagagattatttggttgtatgagccaatgcaatttgttgggcttggg

SEQ ID NO: 18092 - DNA, 794 bp, Zea mays
gtgcggcgctcgagccggccggtcggcacctcgaggcccgcctcgattgccgttgttgtttgttatcacagcagccagtagcagctcaattagcaccaccgaccccggcggcaatcctggccggcatggcttccacgtcgaacttcctggccgtggcgctggtcatgggcgccgtgcttctcggcggcgccggcacgtgccacgcggcccgccggctcgacgaattgccgccgctgcctcaagtcccagcaggtattccgagtctgccggcgccccaagtgcccgagctgccgatgcctcaagtgccgacggtgcctcaactgccgggcgtgccgctgccgcccgccgcggtgccgtaggtgcgctgatttggtcgcgggtggatcggagggaattgatggagaaattagttcatttctctctcaatttccttcaatgcttccgtgattctcttgtcatcaaattaactctgatggtgtatcgttcccccgtgccgccctctctttgtaccgccgccgccgcgtcttcaccgaccaccgacgagcctagagacgtgcaaatgctgcctggcacacgggtgctgccgccaacgccctgtcatgtacctgtgtttatgtacgggtatttttgtctgttgtaccattgtattttctcctgcgacgaaattaattaaatatgctcattactacagcttacgcaaaaaaaaaaaaaaaagtggcccctacgtacaatcaggttcaccagactaaacccagtttggttctcggctgaaaaaaaaaaaaaaaaagccccta

SEQ ID NO: 18093 - DNA, 1142 bp, Zea mays
tcgagaaaatcaactgttctggggccaaaaggaacttcaggttcaattaagtggatccttctgaaaaaagaaaagtaatactctgtatttctagcatccttggtgtgctaatttatctgtttttttttcctttcagatattgttgttacttctggctttgatcgctgttccatggatgctcttcccaaaaccttttatcttgaagaaacttcataaggagagatttcaaggtcacacttatcgtttcctagggacatctgaaatggatccagattctgaacctgattccgcccgagcacgtcatgatgatttccatttcagcgaagtttttgtgcatcaaatgatacattccattgagtttgtacttggtgcagtttcaaatactgcatcttatcttcgactttgggctctgagcttggcgcattcagagctgtcaacagttttctatgagaagttgctgttacttgcctgggggtatgacagtcttatcgtgaagtttgtggggcttatagttttttcttttgctactgccttcatattgctcatgatggaaacactgagtgccttcctgcatgcactgcgtctgcactgggttgagttcatgaacaagttctatcatggggatggttacaagttcaagccattttcatttgctctgctagcagatgacgaagattgatgcatgtgtagttcagcacgtaaacagattggttcatttcttacaaagttttggagcacaggtgtcaaatttcgtgggcaagatgggcttttcctgatacacagcattttgtcagaccgctagactttttcctagcgcatgagtgcagttgtcgttgagattgccagccttgtggaaggagattttgtaagtttacagcaatattgtagagggcaagttcatcgtacagttcctccaacggagatgcagattatagttgctaacaaaaaaaaggatagaaatgtagacttgtccgcgtacttttgacttcaaatttatcagcatgactgccccttaccacttatgaatgaaaaatatgtatttggccattcattcaaccgtcgctggaagaaagacatgcacgctattgtactgttttgttttacaaatcaaataaatagctctaatcgtgctaattcttttc

SEQ ID NO: 18094 - DNA, 646 bp, Zea mays
aaaatcgtcgaaggaacacatgaggacctccgtgatggcaaatttctccccagagccagatctgaggcgtcacccgccaccgcacccgtgtcgtccacctcctcgcgttagcgacgccttctggaagcttcgggaggccgcgctgcgctccggcgggcgggcgggatgggggtgttcgatcgactgcccccgatggaccacatgcgttccgagaagatgtgcttcgtgcagctcatcatgcccgccgacagctcgcgcctcgccgtcacttacctcggcgagctcggcctactccagttcaaggacagatttcaaggtcacacctatcgcttcctagggacatctgaaatggatccagattctgaacctgattccaaccgaacacgtcatgatgatttcaatttcagcgaagtttttgtgtatcaaatgatacattccattgaatttgtacttggtgtggtttcaaatactgcatcttatcttcgcctttgggctctgaggtttgcctcttgtgtattgtgatgttatgctggttgttgcatgtttttaactttccccgtttcaactcctcacttctgtgtattaattgttggtttgagtttggcgcattcagagctgtcaacagttttcaaaaaaaaaaaaaaaa

SEQ ID NO: 18095 - DNA, 2005 bp, Zea mays
catgcggctgccaagcgctgctggaaagtaaaaaaacgcacggggagcttggcagacgtgacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgcttctccgtgcggatgtccgtcgcgaccaccgaggccaccaccaccatcgccgtgggcgcctcggaggaccaggcgctggaggctaggaactccaagacggtggtggcggtcatcctcggcggtggcgccgggaccaggctcttcccgcttaccagacgcagggccaagcccgcggtgccaattggcggcgcgtacaggctcatcgacgtgccgatgagcaactgcataaacagcgggatcaacaaggtctacatcctcacgcagttcaactcgcaatccctcaatcgccacctctccagagcctacgatttcagcaatggcgtggccatcggagacggattcgtcgaggttctagcagcaacccagaggcctggaacggaggggaaaaggtggtttcagggtactgctgatgcagttcggcagttcgactggcttttcgatgatgcaaaatctaaagacattgaagatgtgctgattctttctggtgaccatctctaccgtatggactacatggactttgttcagagtcatcggcaaagaggtgcaggcatcagcatctgttgtttgccaattgatggcagccgggcatctgattttggcctaatgaagatagacgacactggaagggtaatttcattcagtgagaaaccaaaaggagacgaattaaaggcaatgcaagttgacaccacagtgcttggcttatcaaaggaggaagcagaaaacaaaccttatatagcttcaatggggatctatatttttaagaaagacatactcctaaaccttctaagatggcgttttcccactgcaaatgattttggttctgaaataattcctgcttcagcaaaagaaatcgatgtaaaggcttatcttttcaatgattactgggaagatattggaactattaagtccttctttgaggcaaaccttgctcttgctgaacagcctccaaggttcagtttctacgatgctgacaaaccaatgtatacatcacggagaaacctaccaccatctatggtcaacaatagtaagatcactgattcaatcatttcccacggatgtttcttggataactgcaggatagaacatagtgttgttggagttcgttctcggataggctccaatgtgcacctcaaggatactgtaatgcttggcgctgattattatgaaactgccgtggaaagaggagagctgcttgcagaaggaaaagttcctattgggattggagagaatacaacgattcaaaagtgtatcatagacaagaatgcgaggatagggaagaaagtggtaatctccaactctgaaggtgtagatgaagctgatagaacttccgaaggcttctacattcgatctggcatcactgtcgtactgaagaacgcgataattgctgatggattggtcatatgagctgaaaaggtctcacaggacgggtatttgccgcacaaaatatcaataggagttctttgttagttttacaataagatgctgtatagcagtcaacaggttattcttgtctatacaagatacctttgtctacaaatcttgtctcaccatgttgtattcgactcaaacaatgttgcagtcatggacattgtccgtttcaaattttcttccttgcacatttacacaaaccttttcaatttttatttcttgctaaacaataaaagctgttgttctaatcagtatgcaaccaaaaaaaaaaaaaaaaaaaaag

SEQ ID NO: 18096 - DNA, 1968 bp, Zea mays
ccggcgcgcgaggcccccgcgtctccgtcgcccccctcgccgtcgccgacatgggcaactgctgcccggggtcgtcgtcgtccgcggagcccgcgccgccgcagccgccggacccctccggctcgtcgcgccccgtggcttcgcctgcctcggtgtcgccgaccgcggcgcccgcgcccgccaggcccccggcccccatcggccccgtgctgggccggcccatggaggacgtgagggccacctacgccgtgggcaaggagctcgggcgcgggcagttcggcgtcacgtcgctgtgcacgcacaaggccacggggcacaggttcgcgtgcaagaccatcagcaagaggaagctgtccaccaaggaggacgtggaggacgtgcggcgcgaggtgcagatcatgtaccacctgtccggccagccgggcgtggtggagctcaagggcgcgtacgaggacaagggctccgtgcacctcgtcatggagctctgcgccggcggcgagctcttcgaccgcatcatcgccaggggccactacaccgagcgcgccgccgcctcgctgctccgcaccatcgtcgagatcgtgcacacctgccactccatgggcgtcatccaccgcgacctcaagcccgagaacttcctcctcctcagcaaggacgaggacgcgccgctcaaggccaccgactttgggctctccgtcttcttcaaggaaggttgatttgcttgctctcactctcctccatggttgcattgcatcatcacattcatatctgttgctctgcatatgcattgcaatgcgatgcaggggaggtgttcagggacatcgtcggcagcgcctactacatcgctccggaggtgctgaagcggagctacgggcccgaggccgacatatggagcgtcggcgtcatagtctacatcctgctctccggcgttccgcccttctgggcagagtcggagcacggcatcttcaacgccatcctgaggcgccaggtcgacttcaccagcgacccatggccgcgcatctcgcagggcgccaaggacctcgtcaggaagatgctcaaccctgaccccaagcaggcacgagctgcatacgacgtcctcaaccatccgtggatcaaggaggacggcgaggcgccggacacgccgctggacaacgcggtcctcggccggctgaagcagttcagggccatgaaccagttcaagaaggcggcgctgcgggtcatcgcggggtgcctgtcggaggaggagatccgtgggctcaaggagatgttcaagagcatggactccgacagcagcggcaccatcaccgtggacgagctgcggagagggctggccaacaagggcaccaagctgagcgaggccgaagtccagcagctcatggaagctgccgacgccgacgggaacgggacgatcgactacgaggagttcatcacggcgacgatgcacatgaaccggatggatcgcgacgagcacctctacaccgcgttccagtacttcgacaaggacaacagcgggtacatcacgatggaagagctggagcaagccctgagggagaagggcctgctggacggccgagacatcaaggagatcgtggcggaagtggacgccgacaacgacgggcggatcaactacaccgagttcgcggcgatgatgaggaaaggagacccggagccgtccaaccccaagaagcggcgcgacatcgtcctgtagaggaggggcgtggagctcgggagcacgtcacgtacgtacggctgctggcaggaatcttcgtcttcgtggtggcggagaaattaagcagacgcgtgcgcgttctatctctggacatgtataatattgcacgcgacaggagcggaggagctgagggggggagtgaccgcgcattattaatatgaaaaaatggcaaccgggtgtcggttattcttgtctgcatgtcgttactcggatgttatagtagaacgaactgttcgtactgc

SEQ ID NO: 18097 - DNA, 1139 bp, Zea mays
ggacctatagaagtccggccgggccgcagctagctagcttacacagaagggcgattcgatcgaggccgccgccccgccgccgccgccgccggagacgatcccctgcagtcagttagttaagctacaaaatggcctcgctggacaccgtcagaggagatcttggcctggttgttttgtacctaagcaaggctgaggcaagagataagatctgtagagctatacaatatggatccaagttcctgagcaacggacaaccaggacctgcacagaatgtcgacaaatcaactagtctagctcggaaagttttccgactgtttaagtttgttaatgatctccaagctctgattagcccccctgccaaaggaactccacttccgctgatcttacttggaaagtcgaagaacgcgatgctgtcaactttcctctttctggaccaaattgtttgggctgggagaacaggagtatacaagaacaaggagcgagcagagtttcttggcaggatagcattttattgctttctcggatccaatacctgtactactatcatcgagctagccgagcttcagcggctttccaaatcgatgaagaagttagagaaggacctcaagcaccaagagctgtacaagaacgagcagtatcggatgaagctgaagaagtccaacgagaggctgctcgccctcatcaaatcgagcctcgacatagtcgtcgccgtggggctgctgcaactggcaccaaaaaaggtcactcctcgcgtcacgggtgcgtttgggttcgctagctcgctcatcgcctgttaccagttgcttccagccccagccaaatccaagtgatctgcctgcccacctcgggccaggcagctggtgcattgattggtgaaacggcggttgctgtcgccccttgttgtcgctgatactgataagaaataaatctggaccgaactgtccgtccccgtaggatataaccaaggattattgctgtgcatgctggcattgccgagggccatctcatagcctggttgatctgccttgccttagacttgatcatgtagcacgcttgtatttgtatggtccggtgtgccactatcatactacaactgttgcgaaataattagaaatttcataccaaaaaaaaaaaaaaaa

SEQ ID NO: 18098 - DNA, 999 bp, Zea mays
cttatcccagttatcaaagactgattttactccacatgatagatgtttcgccattacaaaccgctcagcaattcaactatttaaaggtagcaggcattcaagaccagggcatcactcaaaaacaaaaccagtagcatttctgtaagaggggtaactaaatgggacgacataatgttttccagatcaaccaatcccagtaccaagaatccagcagcaacaggtgggcgaacaaagattctagatcttgttgaaggcaacgatgtcacacgactggacatactcgttgatgggcgcctcacagagcacttcctcaataagggtgtcgacagacacaaggtcgtcgatgatcgtcagcatgatctggagcttcttgatgccataacccacaggcataagcttagatgcaccccaggtgagaccctccatttgaacactgcggacagcctcctccaacttcttcatgtcagtctcatcgtcccatggcttgatgtccatgaggacggaggatttgccactttctttcttctttgcaggcttggcagcctcacgctcagctgctgctttcttgtcctcctcggtctcatcgccgaacagatccatgtcatcgtcatcatcttcatccttggaagcagcaggagcagctgcagcaggagccgaggatgcactcaccccagaggcctggccagggaaccttgaagaaacggccgcggcgacggcgtcgtaccagcgggcagcgttcaggaactcggcgctgggcttcacgggcaccgccgcgaacaccttgacgtcgtccttggtgatcccatcgccggagatgtaggtcttgccggcgaggtgcgcctcgagggccttgagcccgtcggcggtgtggaggtcggagaacgtgacggccatcggatccggcgagctcgggggcttgtcgaattcgctgggcggcggcggcggcgctggaggctaaaatcccaaaaccctagcgagaccgagagcccggcccggccg

SEQ ID NO: 18099 - DNA, 5153 bp, Zea mays
  misc_feature (1583)..(1583): n is a, c, g, or t
  misc_feature (1756)..(1756): n is a, c, g, or t
gatcccctgaagggcaaaggcatgcatggtccatacttgataattgctcctctttccactctctcaaattgggtgaatgagatctcgaggtaattatctcaaggcattctttcaacacccttatcatcaatggtttctaatgctgatacacttgattccaggtttgttccatctgtttctagtatcatttatcatggagataaagtggcccgagctgagataagaagaaaatttatgcctaaaactgctggtcctgattttcctataatagtgacttcatatgagattgctatgttagatgcaaggtttcttgctcactataggtggacatatgttgttgtggatgaggtgacaaaaaaaacagatgctgtatattattgctcttttatggccttttcccttctttgtattcatgtgtcagttctatgatttctacagggacatcggttgaaaaattctaagtgtaaactattgagggagatgaagcgcataccaatggctaacaagctccttttgactgggacacccctccagaacaatctggcagagctgtggtcgctattgaacttcattttgcctgatatattctcatccaatgaggaatttgaatcatggtatgattcacaggatcacttcagcgggtgtcggattcctatttgtacttcttttttatgtcattccatttgtagtcagttttaagcactgggacacaaattccaatgactgggtgcacttttgcactcatcagtgacttatgcataaattctggtgtatatctagaaaagctagaacggcttacaatttggaacaggaggtagaattttggcttagctttcattgtattctggcgtgcttttgcacagctttgcaaattatttcagattcatacttcatagaggattggtttctggtccttaaaaaccatatttgttcggtaaaccgacatactacgttctgttaaaagagtacccaagtgcatacacaatttcatcatcatgctctgatgtacatggttagagacattgaataataaagcctgtaattgtttattgggacgtctaacccataagaaggttgctccagttaaaatgcaattttctggagtatcatacttgttgatgatatattgtgtactcacatcatatttgttgccatgtcaatcatcaggggcgacggcaggggggcacatgggggcaatgtcccccctaatgctcccctaattctataggatatgttaggtttttagctaattcttatgtaaatagtgcaaaaaatgcttctaacagcccccctaatctaatttggtccccctaattttggatcctggcttcgcccctgtcaatcatgcaccaacacattcatagatggatgacaattatatttggttctgagttcttacatactagctaaaatgcactgatggttcttagtaatgttaacacattttttgaggaataacaatatatagatgtataacatcacaacttggccattatttctaagtataagtattccatgcattatatttgatttgttctgcctttgttgtgatggcacctgtcttcctgaaggtttgatttttntgcgaaaggaagtgaagaaccagaagaaagtgaagaaaaaagaagggttcatgttgtttcaaagcttcatgccattttgcgcccatttcttctgagacggatgaaggaggatgtagaacaaatgcttccacggaagaaagagataatcatttatgctaacatgactgaggttnagaagcgaatccaggatcacttagttgagaaaacctttgatgtctacttgaatgatgaatcagatattggtatcacatttgcatttattcatgtttagacttacattctattacatctctaatgtaagaaccttgtaatttgacattattttggtttaccagtgttgcgtagacctggcatcaagacaaagctaaatagtctctttattcaattgaggaagaactgcgcccatcctgatcttttggaagctgcatttggaacaacaagtatgcctgttttttttttgttattctgcgtgcttgttttcttcagatatctatttacattgtattctatttgtgtttttgcaggcctttatccacctgttaataagcttttagagcaatgtggcaaatttcagcttctggacaggctactaacttccctacttgcacgcaagcataaggtatggttttaatgaacatgttacccaagtttgtgtttttttagtatttcttaactaactttagatcaactgatatatgtttgtaggttctaatattctcacaatggacaaaagttttggacattcttgagtattacctagattcaaaaggccttggggtttgcagaattgatggtagtgttaatttggaagagaggcggcggcaggtaacatgctagcctgtgccaatatattactcctttcattccaaattataaaatattgacttttctagatacattacttttgctatgtatctagatatacactcatgtgggagcctccaacactggatctgccctagatacacactaagtctatatgcataacaaaaagtgatgtatctagaaaagccaaaacgtcttgtaatttgggacgtgtactatttttctaaagaacatctaaactctgaggatttgcactgtgttagatatcttggtacatgtataaatttatttcccttgtctgaattagaatttgcattgttgcatgctcttggtattaatgactttttacttgcaccattctgatggcacttgtatgtgctcacatattctttattttgttgatactgtttgtgttcagttcgattgttattgacacttcccaatttctcatttaacatcggcacatccaagtggcaaattctttagttggtcagcacgtaacattttctctccaacaatccaaccacaatttatgaaaacccatcgtttacagtagcaaagaagcaagcagtacctgtcgttgggtaaacacaaagaataacaaaagttgccttttgagcttttctgttgctccttttttttgctgctcgataatcgtctatctgtcgctacttttacttcacaaaaaatcttttgttactgttttttgttgcagatagcagagtttaatgatttgaatagcagtctgaatgtctttattctgagcacacgggctggcggacttggtatcaaccttacttctgctgatacatgtatcctttatgacagtgactgggtaattttctgtcaagactactatactcatcagaaaaaaaatgtttacaagaaagcctttttttgctggctactttctttggctgctgattgacttattatgctagttgtaatatggtgctcgtttactcgatcctccagaatcctcagatggatcagcaggccatggatcgatgccaccggattggtcaaacacgcccagtgcatgtatataggctggctacctcatattctgttgaggtatgcttcagtgatccgtgttttcagacttgtcactttggctactgtctcagggttactcagcttttcacctttgcaggagcggatcatcaagaaagcttttgggaagttaaagctagagcatgtggtgataggcaagggacagtttgaacaagaaagagcaaagcctaacgctttagaggtaaccattttgtccaaactcctaagtatatacaagtggttgccactgcgtagacccgccgcaaatgcacactggaaaattgtcgttggtacctttttcccatgggatgcaggagggggagctgctggcgctgcttagggacgagcaggacgaggaagatcggatgatccagaccgacatcagcgacgaagacctcttgaagctgatggaccggagcgacctgtccggaccacctggtgctgccgatgccgctccactgatcccgctgaaaggccctggctgggaggtcgtggtcccaaccaagagcggtggcggtatgctctcgtcgctcaccagctgagcgatgccggcaccatgtttggggtgcccattttgctagtcactcatcatgtggacgatggggcgcttgttggccggtcgccgatcaggcggatattttgcatgtatgcccccctacaaactgttgatctgggtgttgagcctgcaacagtagggttaggttatttcctcccgtgtccgtgccagtgacacgcaagtcggattgagttatgctgtgaacttctgatgagtcgctgcaagctgcctttctgacttgagctttttgctgcttctgttgctgcgttctatgatgtagtaacagtagctgatggtttacaccaaagcggagatggatgccctctatgatgtagtccttgctatataacttgaacactgatgtgattttctgtagtgtcaactgccatgctttatcggttttagtgtccttgtcggcagaagcgttgcaccatttttgtgatttgtgtccgcgtgtatggtgccaccttgtggacgtctcttctgatgaaatagaaactgttgtgcgagaatgaatccaggacactgcattctttattgcttctgatatttatatatgtagagtaaaagaagtgtgcgctggtacaggatacgaccagacgcctcaatggagaagtggatatgtgctatcaagggtcacatctcttgaacctgtgctatcaagggtcacatctcttgaacctcccttgaacgttggctgagagcagtagtaattgtttagatcccgtaacactctcccttaagcagttgtccatcatgtacatcctcttttaaaacctgtaggtaaaaggtggtttgcaataatatactgtgtaacgttctagagaaatccagtgggaaaattttggagaaaatcaacagtatatgatgtctttgatgtctatcgaaaaccctgatggggaaaaaaaatcaagagactgacatatgcttgtgttgacattgatcattaaaaacctaccatgagaaaacatgatagtaaaactcataggaaaagagtacaatgtgatgttagtattaggttggtcaaagagatactccccttgatgcaatcaaatctctaagtcgacgcataccaatacccttaaggcctagtttgggtactctagtaatgagtgggatttgagtggattgagatg

SEQ ID NO: 18100 - DNA, 1579 bp, Zea mays
cggaatttgaatcatggtttgatttttctgcgaaaggaagtgaagaaccagaagaaagtgaagaaaaaagaagggttcatgttgtttcaaagcttcatgccattttgcgcccatttcttctgagacggatgaaggaggatgtagaacaaatgcttccacggaagaaagagatgagcatttatgctaacatgactgaggttcagaagcgaatccaggatcacttagttgagaaaacctttgatgtctacttgaatgatgaatcagatattgtgttgcgtagacctggcatcaagacaaagctaaatagtctctttattcaattgaggaagaactgcgcccatcctgatcttttggaagctgcatttggaacaacaagcctttatccacctgttaataagcttttagagcaatgtggcaaatttcagcttctggacaggctactaacttccctacttgcacgcaagcataaggttctaatattctcacaatggacaaaagttttggacattcttgagtattacctagattcaaaaggccttggggtttgcagaattgatggtagtgttaatttggaagagaggcggcggcagatagcagagtttaatgatttgaatagcagtctgaatgtctttattctgagcacacgggctggcggacttggtatcaaccttacttctgctgatacatgtatcctttatgacagtgactggaatcctcagatggatcagcaggccatggatcgatgccaccggattggtcaaacacgcccagtgcatgtatataggctggctacctcatattctgttgaggagcggatcatcaagaaagcttttgggaagttaaagctagagcatgtggtgataggcaagggacagtttgaacaagaaagagcaaagcctaacgctttagaggagggggagctgctggcgctgcttagggacgagcaggacgaggaagatcggatgatccagaccgacatcagcgacgaagacctcttgaagctgatggaccggagcgacctgtccggaccacctggtgctgccgatgccgctccactgatcccgctgaaaggccctggctgggaggtcgtggtcccaaccaagagcggtggcggtatgctctcgtcgctcaccagctgagcgatgccggcaccatgtttggggtgcccattttgctagtcactcatcatctggtggacgatggggcgcttgttggccggtcgccgatcaggcggatattttgcatgtatgcccccctacaaactgttgatctgggtgttgagcctgcaacagtagggttaggttatttcctcccgtgtccgtgccagtgacacgcaagtcggattgagttatgctgtgaacttctgatgagtcgctgcaagctgcctttctgacttgagctttttgctgcttctgttgctgcgttctatgatgtagtaacagtagctgatggtttacaccaaagcggagatggatgccctctatgatgtagtccttgctatataacttgaacactgatgtgattttctgtagtgtcaactgccaaaaaaaaaaaaaaaaaaaaaaaaaaaaaaaaaaaa

SEQ ID NO: 18101 - DNA, 790 bp, Zea mays
tccataaaacttaacgcatagctaaaacagttctagatatctgtaaaacacatcactttcaaatctccagccaaaagcgagaccctcagatgcacatccatcttaacggttagccttggcaacacgctcaatctcgtccttcttcttgatggcatagctgttggatgagcccttggcagcattgatcagctcatcagcgaggcactcagcaatggtcttgacgttcctgaaggcgctctccctggcaccagtggtcagaaggtagatggcctggttcaccctcctcaggggggagatatccacagcctgcctcctcacaacaccagcagacccaatacgggtagcatcctcacgtggaccactgttgatgatggcatcaacgatgatctggatggggttggcgtcggtgaggaggtggatgatctccatggtgtgcttgatgatgcggacggccatgatcttctttccgttgttgcgcccgtgcatcatgagggagttggtgaggcgctcgatgatggggcactgcgccttgcggaagcgcttggccgagtagcggccggccgagtgcggcaggaaagtgtagtgcttcatcgacgtcaccgcgaggtagtcgttcagcgagatgtcggtcacctgaacatcctcgaaggtccagcggttgaagagcttcacgtcgcccccgggcaccggctccgcgaccgccatggctgagggtgtggtggggggaggggaggtggcggcggcgggtgcagggagagttggaaaacctagtggaatcggcgcgcggggc

SEQ ID NO: 18102 - DNA, 2442 bp, Zea mays
  misc_feature (2409)..(2411): n is a, c, g, or t
  misc_feature (2432)..(2433): n is a, c, g, or t
aatagcctctacgctctaccgcatccttccacaaaaccctttcttccctttcttccttccgccgccgccgcgaccggctaaacccttcatttcgccgcagcgacgaccacccgccgcgggccaactatggcgcccgttgcggctcccatacgcgacctgcttacctctttcagccccggcgcggacttcctcgcgctctcttctggggacggccgcatcaaggtatgggacgccgtgcggggccggctgcagaccgagtttgctgacatccctgcagtggaggcggtcgcggtcgctgagtcgaagcgcggccacctcgccctcgattacacctgcatgaagtgggtacaactttccagtaagaagaagaggaaggctgggagctcattgattgtgcttggtacaggcagtggagatgtgcttgcacttgatgttgccgcgggacattggaagtggaaggtcagcgattgccaccctgggggtgtgacagctgtagaatactcgaaacatgggcggaatgtgtacacggcaggtgctgatggcatggtctgtaggattgatgcctctaatggggctgttgttggaaaatttaaatcttcttcaaaggcaatatctgcattagctgtgtcatcagatggaaatatgttggcaacagcagctggccagttgaggacctttgacacttccagcaacaaaaaaattaaaaaattctctggacatccagttgctgtgaggagcatggtctttagcaatgatagccaatatgttttgtcatctggagttggtgaacgctatattgccatttggaagctgggcagtggtaaaacccagagctcaaactgtattctgtcgatggagcacccagcaatgtctgtggactgtaaatgttcggacaaaggagaaatatacattctggctatttctgagattggtgtctgctatttctggtctgcaaatgttgtggatgacctgcgtaataagaagcccaccaagatcatattatctgagtcatctgtgtcaacagctcatcaagcattatcgatatttgctgcaaaacttcaaggagtggatgggcctaattctgcccatgtcctactggcttatgggtctgtagtgaaaccatcttttgataaacttttggtttgttatggtacagatattagtttgggcatttctcaagatggagttctcttgccaaatactcaaaccaccatggcaaagaaaggccaatctgtgaaaaagcatgaaactgtctttgctctagaccgagccaatgctgaagatgccatccttcctcttccaaaactccatacacaggaaaagaaaaggaaacatggtgtaacaaaacccagtggcgatgttgagcctgagattcatagtgacctcaccactacaagatctattcataaaagagttcctgtgcaaagaattgaagatgacagcacatgcatcgaggatatgatgagggagtgtggcatcattgaaactagagtagatgagagcatgaagggccatgctggtataccctttaacattttgtctggtctttttggtgatggcagcataaaattcgatgccaatttacccagtaagaagattcgaggtcatctaagatcattaaaacctggagatgcttgcaaacttcttgataaattagtatctgcatggaaaacgagatctggtagcacggaacttgtattgcgttggatatactgcctgttagtcattcatggccgttttatctgctccgaggaatcgattaacaacctggagaagatgtgtgcagaaagatacacagttactgaagatttgctgaagctttctgggcggcttcggttaataacagcacaggtcgacaaggctgctagtaacatgtctgagccgacatcaggggagatgcaggatgctgctttccagtctgacgaagaggaggaagatgaagatgttgatgaaacagtattcggtcaagattcagattcgtcacagaatagcggcaccggcgacgatgcaaagtagactcactgctggtattcatcattatggtgattgtattgtttttaattaaattgccaagcttgatttttgtcaaggcgacgctggaaggttgcacagaattttgacagtgtctctggtttcattttgaaagcactcgaagttgtctcctcctttacccctttttttccttatatacgacggcaattggttaaagttacatacccgaaggttgtccttgcacataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttttttnnnccccccccccccggggggggnnccccccccc

SEQ ID NO: 18103 - DNA, 1532 bp, Zea mays
gacctgcaggctgctggccagtggccaccacgtagtgccttgcgtggagccgaggcggatgtgctcatgtgcatcagtggatcgatctatcatttgaagtttagaatcatcaattatttgatttattttattatttattccttaatacgtttcgttctttatctttgtttaatcaaagaatgttcgaagaaactttataaaatgatccaaaatgacaagtaagtttttatcattctagttaatagtattttcaaaccattcaacatttgtatttattattattatatatgtaaatatagatattatatatatgggttaaaagggcctctatataaataattttcgtccaggtcccctgaaatctcaggaacggccctgcacgcagccacacctcgcggttggggctcgcggctcccgcgcaccgcctgtgctactcctgcgccccctcgcggctggcccgcaacggtccaacggtcacttctagctctcgtgcagtcgtgcgtcctccatcgtcgcctctcctcccgcggtcagggtaacgccgcgtgtctcccgtcgcatactcgctcacacccatggccgcaccgccggccgcctcgctagtggcacgcgccgccctcccgccgcgccttcgcccaaccaccgcttctccccttggccccgccgtcctcggtcccagcagccgccgccggtacctccgtctccgccgctcgccatcgctggcggggactgccgcggcggcggcgagctccccatccgtgccttcctcgtttccggggcccgggccaggtatcggcgatgccctcggcgacgtcgaaatctactccgcggccaccggcgagcccgtcctgttcagagacctgtgggaccaggacgagggagtgtctgttgttgcgctgctaaggcatttcgggtgcccatgctgctgggagttggcctctgttctgagggacacaaaggagagattcgattctgctggagtaaaactgattgctgttggtgttggcactccagctaaagcccgtattcttgccgagcgcttgccctttccgttggaatacctctatgctgatcctgatcggaaggcgtataatctcttgggtctatattttggtgttggtcgcacgttcttcaatccggccagtgcgaaagtgttttcacggtttgactcccttaaggaggcggtgaagaattatacaatcgaagccaccccagatgacagggcaggtgtcctacaacaggggggaatgtttgtgttcaaaggtaaagaactgttgtacgcaaggaaagacgagggcacaggcgaccatgcacctttggacgatgtgctcaatatctgctgcaaagttcctgtaacctaacccgacggcttgtcccacagctcagtaggtccgtaacacagatcactttgagctatctttactagtgatttcttatttcatccttgttacaaaaaggagagtaagaatatactcgtaacaggcacattgtctttcatccattctcttttggcaattggcgttagcagatcc

SEQ ID NO: 18104 - DNA, 2001 bp, Zea mays
gcacgagaccattacctagaacatcctaatcgaaaaacttccgtccgttcccccgaactctctctcctcctcggccacctcccatccccgttccttccctccatctcatcatcaccgccgccagcgccaaaaccctacccacccacccaccgatggcctccccggcgccggcctcccccgcggccgcggcggcgcactgccccccgccgcgcatcggtctcgcgggcctcgccaccatgggccagaacctggccctgaacatcgccgagaaagggttcccgatctccgtctacaaccgcaccgccgccaaggtggactccacgctgtcccgcgcgcgggacgagggctcgctgccggtgctgggccaccgcgacccgcgcgggttcgtgctgtccctcgcgcgcccgcgcgccgtcgtgctgctcgtccaggccggccccgccgtcgacgccaccatccaggccctctccccctacctcgagcccggggacgccatcgtcgacggcggcaacgagtggtaccagaacacggagcgccgcatcgaggaggcggcggcgcgcggcctcctgtacctcgggatgggcgtctccggcggcgaggagggcgcgcggaacgggccctcgctcatgcccggcggcagcgccgacgcctacgccaacatcagggacatcctccagaaggccgccgcgcagacggaggacggcgcctgcgtcaccttcgtcgggcccggcggcgccggcaacttcgtcaagatggtgcacaacgggatcgagtacggcgacatgcagctcatcgccgaggcgtacgacgtgctccgcaggctcgggggcctgtccaactccgagatcgccgacgtcttcgcggagtggaacaggggggagctcgagagcttcctggtccagatcaccgccgacattttcaccgtggctgacccgttggacgggagcgggagcggcggcggggcgctggttgacaggattctggacaagactgggatgaaggggaccgggaaatggaccgtgcagcaggcggcggagcttgcggtggcagcgcccacgattgccgcgtcgctggacgggaggtacctctcagggttgaaggacgaacgggtcgcagccgctggggtgctggaggaagaggggatgccggcaggcctgttggagacggttaatgtcgacaagaaggtgctggtggatagggtcaggcaagcgctctacgcctccaagatttgcagctatgcgcagggaatgaatctgctgcgagccaagagcgtggagaagggatggaaccttaacctcgcagagcttgccaggatctggaagggcggctgcattatccgtgcgaggttccttgataggatcaagagcgcgtacgacaggaatcctgagctcgccaatttgattgttgacagagagtttgcaagggagatggtgcagcggcagaacgcgtggaggtgggttgtggcacgcgcggtggaggctggcattagcacgccaggaatgactgctagcctttcgtacttcgatacctacagatcaagtcgattgcctgcaaatctgatccaagcgcagagggatctgtttggtgcacacacctatgagcgcattgactgtccgggttcattccacaccgaatggaccaagctggcgaggaggagcaatggcgcagccatttgaggaattggttggtatgagaagggatgttttctgctttgtgtgatttctctctgtgggttatcttttgttttactattgttatctttatgcttctagatccaagtcgagtacttcaaataatgctgtactgtatggttggcaagtgaagaacattgtgtagcttcagttttactgtgatgtaggtacacacagtttgattctcttaattttggtatgcaattgctatgatgcctctcaaaccacaatgttgtgtgtttaaagagttatctgaaatgtgttgaaattgctactaagaatactgagttttgcctcaaaaaccaacccc

SEQ ID NO: 18105 - DNA, 1625 bp, Zea mays
taggttttttctatgataacccgtaccaaacacgcacatacttcgacagaagatgccgcgcaattggtgttgcgttttgtttgcgatgagcgatcgcttcgtaaaggcagaacaaacgcgtacgcgtcgttgcagtcccgccgcgccttttctacatctcaccggtccggtagtccagtttccacgtaacccctcgctcttcttcagacttccatactaccccgttctcctctcctcttcccccaaatctgcgtgcgccgcggcaaccctagcccccgcgatccgctcgccggagggaaggagggagccccgccggcgtccatggaggtgaagctgtggaacgacaagcgcgagcgggagctcctggagagctacgcggacctgtacgcgatcatcaaggtcacggagaagctggaacgggcctacgtccgcgacctcgtctcagccgccgactacgaggcggagtgcctcaagctcatctcccagttcaactccctctcctcctcgctcgccggcaccgtcgccgtcccgcgcttcgtccaggcgtaccgtctcgattgccccgccgcgctcaaccgcctcctccagtcgggcgtcccggccaccgtcgagctccgcgccgcgtccgcctcatccgcgcccgccgccacctccgcctccgccgcagccatcgcgcactgcgtgcagaccttcatcaccgccatggacgcggtcaagctcaacatgcttgccaacgaccaggtccgccccctgctgcaggacgtcgctacatccatggccaggctcggctccctactgccgcccgactttgaggggaaggtcaaggttaacgagtggcttggcaagctgcataagatgggggccgcggatgagctcaccgagcagcaggccaggcagctcaacttcgacctcgattcggcctacagtgccttcttggctgcgctgcccgctgctggtctgtaacggggtaaggatctaccagcttgatttttatttggttggttcggtctattatgcttttgacactggagcactactctccactactgtagtactatagatatctgtaatttcggtactgctatttgttgtcaataagaaagttttgttttcctttgtatacagtaaatatgtttattgcatggcatacattcacattacaatgcttgcaaatgacctgtttatttggatacatttattctattctctgtggaacatatggacttatgaagtgataactgtataatatattgttctctcccattatatgtcattatctttctacttgatggagtcatgaatgatctattttcttctttgggttacaaacaatataaatgaagaagaatgacatagttgacaacttggggtgttctttgagtggttgaagctcatttgatttgggaattagctgttcataaaccagtgggcaccattatgctcactaccttgtacttcacttgctaataatcatgtgcaacagctaccaccttatctattattcaattgtattgatcttgttgataataaacagaaaatataatttaaattactattatttcagttcctgacacaacttcataatagcaaaatcttgtgtttgagtttttgactgcaggcatgca

SEQ ID NO: 18106 - DNA, 2774 bp, Zea mays
tattgtttagcagtacatgtgtgttatgtgaacgtaataaatacactgccctctacaaaattcctcactgggttacattacgtgttggatgtgttgataggcaaatgccactttttacctctcgcataacctggttggggtcagtctgagaatcagtgaacgcagaacaatcgcgtcgttgtcgtccagtttacacgtaacccctcgcccgtattcagaattctgaaattccaagcccgatctcctctcctcttccccgaatctcgggcgccgccgtaaccctagcccccgcgatccgctcgccggagggaaggagggatctccgcaggcgcccatggaggtgaagttgtggaacgacaagcgcgagcgggagctcctggagagctacgcggacctgtacgcgatcatcaaggccgtggagaagctggaacgggcctacgtccgggacctcgtctcagccgccgactacgaggcggagtgcctcaagcttatctcccagttcaactccctctcctcctcgctcgccggcgccgtcaccgtccctcgcttcgtccaggcgtaccgcctcgattgccccgccgcgctcaaccgcctcctccagtcgggcgtcccggccaccgtcgagctccgcgccgcgtccgcctcatccgcgccggccgccaccgccgcctccgcgtcagccatcgcgcactgcgtgcagaccttcatcaccgccatggacgccgtcaagctcaacatgcttgccaacgatcaggtccgccccctgctgcaggacgtcgccacatccatggccaggctcggttccttgctgccgcccgactttgaggggaaggtcaaggttaacgagtggcttgccaagctgcataaaatgggcgccgcggatgaactcaccgagcagcaggccaggcagctcaacttcgacctcgactcggcctacagtgcctttttggctgcgctgcccgccgctggtctgtaaccgggcgtggacctggttcgttctttacttctattacagtactatagatatctgtaatttcggtactgctattttattgttaataagaaagttctgttttctttatatactgtaaaaataaatatcgcatgatatacattcacatgacaacgcttgcaaatggcctgtagcctgtttacttgggtacatttattccactattctctatggaacatatgaagcaataataactgtataatgtattgctctctcccatttaggggtgttaatagatcacggtccaaatgtttcttcacaataagttagggtccttaaataattctagttcaaaaatgaatagaaatagagcccaattctaatccgatccttaagtgttatagtataaaatctagaaaccattaccacccctactcccattacatttgattatctttctacttgcatggagctataaatgatctattttcttctttgggttatagacaatctaaatgaagaatgacttagttgacaacttggggtgtcctttgagtagtcgaggttcgttaacttggggtgttctttgagtagttgaggtccaggtccatttgatttgggaatcagtagttcataaacagcgggtacgttatgttcagtaccttgtacttcacttgctgtgccaccttatttgggaatcatgtgtagcataccaccttatctgttaccccattatattgatcttgttgggaataaacaaattttgattccatttactattatttcagtttctgacacataacttcataacagcaaaatgttgtgatgcttttgttactgcagatcagtactctagacatgaactttttgtggtattttgtctgctgacgagaaagtgctgagcttatactgacctgatctcttgtcaatgagttctgcaatatttgtatgttacatgcattaccacataatttatgcatgatgccgtatacggtagaatgcttgcatatggcctgttcatttggatatatttcttaccattgggttatacgaagcagtaagtggaacttatatagtttcctgtagacctcatgatctttctatttataagaatgcgcagttggaattgttgatatgtgctattggttttgtcgattccttttttgttctcaagatcaattgtaatgcaagcagagggcatatacctgcagtgcactcaattttagtatggtttgtcatcttggaattttctttgcaatagctgacctgcatgcttttgtcagaaaaatcatattcattgtcttctagggttgttaacccctgcagtttgcaaaaccagtatgttttgttccaacattgatacagcgctaacagatgctcccttttactcattatatgttgtgacatactggcagttagtcaacttgttttattgtaggatgttatcgaaccacttggaactgttccacgaaattttgttagacttgcatggaagaatatgaagtaggcactgttgccaatcagtttactttgaatctttatgattaatataatttgctactgtcctctggtgttccttttggtacagttgaaaacttgagaaaaacaattggtttaaggttttctttgggcatcagaatggctcgagtttattttttgtgttattacttcgaggtttcttcaagcaccgttgtgtttttggaaccgtatcgtcaaaatctgatattatccatgtactcttgttcaacttatgctgtccttgaaataccggttttagatgggctttcttatcttgccttgctagaaaggctttagttctgca

SEQ ID NO: 18107 - DNA, 1317 bp, Zea mays
agttaaacctaactgcctctcctctctcccagtctctcgccgctcgcctctcagccgccgcgtgcctcccagtctcccgccctcgcctctctcttcctctcctctctccctgcgcgccgccgccgtgcctcgccttgcccagagactaaggcgccaggacagtataaatttagttcacgtggttgtggacttctcgctttttggattcaacattttctgcttctctgctctggaatacagaagtgccattgtgggctcaagaggataatgtacgggaggcgtgcatcgcaactgctgaaggagatcgactcctctgaggctggccagctcgtgccattcaacagtgacgtgtttgatcaagtgattagagagtgcaatgagcacaactcacaatttcaatcgttgatcaggaaaatggtggagcaaaacttagatatcgagacaactagaaatgaagatcactatggtgcagctatccaccatctttccctgctccgtaacaaaagatgccttatggcttacatgtacaaccgagcagaagttatccagagttttagatggaaaattggccctgtgcttcctcatgacatacaagaaaagctccatttctcagaaaaggagtacttcaagaaccactctgcagccattaaatcatacatatcagagatggatatagatttgacagtggacatggttcctcccaaggatccttacattcaggttcgggtgctggaggacattggtgaagtatcgctcggtgaccattctgtgtcattgaccaagaactcactccatttcctaaggcgcacagacgctgaacagtttatatcacagggtcttatggaagaatttctggagtagggatcacatgtatgaatgtatgatggtacaataggatggtgcactgccctcgttctccccagcgatgctgcctgatgccctatttgcaacaatgaaaagacgcgttctgtaccaaggagcttcttaactagtcgctggacgatgatttcgaaagttgtgcaggcagtcctatactagattcattgcctctatttacatgtggatgacttttagttagtgtgccatccaagaaagcagatgttgcaaacattgtaacttgtgtattaacattggttttgctggtagatttcatatttgtgtttccaagattccatgtaatcaagaaaaaaaatgaaatcttggttgaaacagtctttcacagtgaggagttagtttcattttatagctaacatgcaagagacaatatgtctagttaacatttaaaaaaaaaaaaaaaaactcgagcccggcatcata

SEQ ID NO: 18108 - DNA, 1641 bp, Zea mays
  misc_feature (47)..(48): n is a, c, g, or t
  misc_feature (1614)..(1614): n is a, c, g, or t
tagattcattctggtggatatttgggagaatggaagatggttgttannacggcacatttgagcttatacaggatgagagcaaggctggtgcttgcctttggataacaaaacgacgagggatggagtactggccaactccaggccggccgggaaagtatatggtgaatcctaacaaatcaaaaaggatgctgacaaacaatatatatcctagcatccgaatgcctgaattctttgagaagatagttgttcacacactcagccataattttcgcaatgctacaagacttgagcgtgtgcaactgagatttcctatcaaagcgcatagtgctctggttaaaataatatatgctggcgtaaatgctagtgatgtcaacttcagttcaggacgttattttagtggtaatcctaaagaaactgcttcacgccttccatttgatgctggttttgaaggtgtgggaattgttgccgctgttggagattcagtcagtcatatcaaagttggcactcctgtggcacttatgacttttgggagctatgctgaattcacggaggttccagccaaacatcttcttccagtgccaagaccagaccctgaggttgttgcaatgttgacatcaggactgactgcatcaattagtcttgaaaaggcaggacaaatgacatctgggcaagttgttttagttacagcagctgctggtggaacaggacagttcgcagttcagctggcgagattagcaggcaacaaggttgttgccacatgtggaggtgaaagtaaagctgaacttctggcttccttaggagttgatcgtgttatcaattacagaaatgaacgagtcaaagatgttctgaagaaagagtttccaagaggtgtagatatcatatatgaatctgtaggtggggaaatgtttgacttgtgcttgaatgcacttgcagtccatgggcatctcattgtaattggtatgatctcccagtatcaaggagaggatggctggaagccaaagaactacactggactatgtgagaagattctagctaaaagtcaaactgtggctggatttttccttgttcagtatgctcacttgtggcaagatcatcttaacaaactttttgacctgtatgcctctggaaagctaaaggtttccctagaccccaagcaattcttgggtgttgcttcagtcgtagatgcggtcgaatatcttcattctggcaagagtgttggcaaggtcgttgtgtgtattgatccatcatacggtcagatcgttgcaaaattataatccatggacatgatgcgcattgtcttccatggtcacgtaggttattgtcttatagttacacatatacatcaagaccgtattttcccagcgggtgacaaatgaataagggaacatgttggtgtatagtttagtttcatttttccaaagtgtaagatgcacaactatactgaaggacaagcatgggcatggaaatcgattaagtttctaatcccgtgcagtaggatatgcattcgtgtggcctcgttccacgttgtatgtatacagtatatattatataacttgtctcagtgccacatgcttcaaaaaaaaaaaaaaaaaaggcccctacgcaaaaaaaaanctcgcgactagttctctctcctcgtgc

SEQ ID NO: 18109 - DNA, 941 bp, Zea mays
tgggacctcgagccggccgggaatagtctaataaactttgtatttctttcatttcgagttcaacaagtatttgcgcgcagtatcgccctctatagggccattgggtacctcgaggccggccggggccggcttcatccctctttcttcttcttcttcttcttcacacaagcgtgctccttctgctcttgtgctaagtagctagctcacaacagaagaggacgagaggaagcaaggcggcggcggcggcggcagcaacaacatacaccgctggccgtggcgccatgggcatcctggaccacatgtcgcatgtgtgcagcatcacggagacgaaggaggcgctcaagctcaggaagaagcgaccgctgcagacggtgaacatcaaggtgaagatggactgcgaaggttgcgagcgtcgcgtgaagagcgcggtgaagtcgatgcgcggcgtgacgagcgtgacggtgaacgcgaagcagagcaagtgcacggtgaccgggtacgtggagcccgccaaggtgctggagcgcgtcaaggccaccggcaagaacgccgagatgtggccctacgtgccctacacgctcaccacctacccctacgtcggcggcgcctacgacaagaaggctcccgcgggcttcgtccgcagcgcgccgcaggccatggcagaccccagcgctccggaggtcaagtacatgtccatgttcagcgacgagaacgtcaacgcctgcaccatcatgtgatgcatgcatatgtatagtctctcgatcgtatcatgtgtagtagtacgagctagctagtgcatatcgatcttcgtactgtatcatatcgatcgaaagaaccttaatagccaatacaagaggaatgtgaattaagcaatcaaaaaaaaaaaaaaaaaaccaaaactctcgggggggggcccggcccccaattccccctataggagg

SEQ ID NO: 18110 - DNA, 893 bp, Zea mays
gggagctcgccttgtgtcggtgcgggtacctcgaggccggccgggctcccccgccgcgccggcttcatcactctttcttcctcttcttcttcttcttcacacaagcgtgctccttctgctcttgtgctaagtagctagctcacaacagaagaggacgagagaaagcaaggcggcggcggcggcggctgcggcagcaacaacatacaccgccggccgcgtggcgccatgggcatcctggaccacatgtcgcatgtgtgcagcatcacggagacgaaggaggcgctcaagctcaggaagaagcgaccgctgcagacggtgaacatcaaggtgaagatggactgcgaaggttgcgagcgtcgcgtgaagagcgcggtgaagtcgatgcgcggcgtgacgagcgtgacggtgaacgcgaagcagagcaagtgcacggtgaccgggtacgtggagcccgccaaggtgctggagcgcgtcaaggccaccggcaagaacgccgagatgtggccctacgtgccctacacgctcaccacctacccctacgtcggcggcgcctacgacaagaaggctcccgcgggcttcgtccgcagcgcgccgcaggccatggcagaccccagcgctccggaggtcaagtacatgtccatgttcagcgacgagaacgtcaacgcctgcacagtcatgtgatgcatgcatatgtatagtctctcgatcgtcgtatcatgtgtagtagtacgagctagctagtgcatatcgatcttcgtactgtatcatatcgatcgaaagaaccttaatagccaatacaagaggaatgtgaattaagcaatctatatagtatattacggcctcgaacctctgctaatatcagtctaattaaatacatataataagcaaactat

SEQ ID NO: 18111 - DNA, 733 bp, Zea mays
  misc_feature (706)..(706): n is a, c, g, or t
gggtacctcgaggccggccgggccgggcatgcttcttcttcttcttattcagacattatcaagaagttggcagcagcagcggcagtagccatgggcatcctggaccacctgtcgcatctgtgcagcatcacggagacgaaggaggcgctcaagctcaggaagaagcggccgctgcagactgtgaacatcaaggtgaagatggactgcgaagggtgcgagcgccgcgtgaagagcgcggtgaagtcgatgcgcggcgtgacgagcgtggcggtgaacgccaagcagagcaagtgcacggtgaccggcaacgtggagcccgccaaggtgctggagcgcgtcaaggccaccggcaagaacgccgagatgtggccctacgtgccctacgcgctcaccacctacccctacgtcggcggcgcctacgacaagaaggcgcccgcgggattcgtccgcagcgcgccgcaggccatggcggaccccggcgcgccggagctcaagtacatgaacatgttcaacgacgacaacgtagacgcgtgcacagtcatgtagtttcttctcttcttctctttccgtggatcgatcggatatccctgtcactgtcatcaccggccggccggccggccttattattattcctactgaaaccaacgtcaattatatccgttcatgcaaaaaaaaaaaaaaaacacgcccccgcggacgcgtgggngaaaaaaaaaaaaaaaaaaggccccta

SEQ ID NO: 18112 - DNA, 1953 bp, Zea mays
taatattattaatagtagtagtaataataataatatgtaggcattctttcataactactcctaaatgaacaatttgtaaataaagttgtctggtacaagtcgtggtgtttggtttcaaggggctaattttaaggttgactatttgactgtccactgttggccttgtgagctgcttacttgcaattttagttgtgtcaaaggtttagataaagctttagaaagtaaattaagattgactagctagggtaaaacaaagttatttgtactgggtgccaaattaaagggagccaggtgtgcatgataaggaggtgggtaggtgaaacgtgcatggacacgtttcaggcagcggttggaccggccagcccagcccagaagagccgtggtgctatcaaatcggacatgcagcttcaggcacctcgcccgccccgaaagctcagcggttttactgtgcgtatactagctatacaacccaagcaagcatgatggggattaattaatgggacgattgattgaaaaccaccaaaaacctgggcggcatggcacccatcctcaccacacaagcaccagtagtggcagctgtactatatatatgcgtcgttaccttcattcatcgattcttcttcttcttattcagacattatcaagaagttggcagcagcagcggcagtagccatgggcatcctggaccacctgtcgcatctgtgcagcatcacggagacgaaggaggcgctcaagctcaggaagaagcggccgctgcaggtacggtatggtatgagagctagctgcttgctgctgcctcctgctgctgctagctgctgctttgtctcttgattcgcgcgctgcatgccatggttgcttggcagactgtgaacatcaaggtgaagatggacgaagggtgcgagcgccgcgtgaagagcgcggtgaagtcgatgcgcggcgtgacgagcgtggcggtgaacgccaagcagagcaagtgcacggtgaccggcaacgtggagcccgccaaggtgctggagcgcgtcaaggccaccggcaagaacgccgagatgtggccctacgtgccctacgcgctcaccacctacccctacgtcggcggcgcctacgacaagaaggcgcccgcgggattcgtccgcagcgcgccgcaggccatggcggaccccggcgcgccggagctcaagtacatgaacatgttcaacgacgacaacgtagacgcgtgcacagtcatgtagtttcttctcttcttctctttccgtggatcgatcggatatccctgtcactgtcatcaccggccggccggccggccttattatctattcctactgaaaccaacgtcaattatatccgttcatgcatcttctcctccaaaagtttctgcttttaagaaaacactactccctcctcgattgtcgttttatcccttaatttttatatctatatttaaataaatgataataaatctagacacatatataaaataaatacattaattattgtatgaattatttaaaaagtaaaactaattttattttaagacggagggagagtatttattatagcaaccgtgacatctaacataatcgaaactcgcgcaaagtcttagttactcttggtggttgtcatcacatcacaagtaaggcagtcgtgaacatatttgtactaacgtctttcagaaccactgatactagggactagtagaacaaaatatttgtatagacgggtaactgagaaccgtcggtggaaatcgatttttattggtggtcgggctaagaaaaccgtcagagaaatcgattttccgctagcggtcgagataataaaaccgccagtaaaaatcttttccaggaaacataaaatttgttttaaaaatagcaaaaaaatattgatcgaaattgcaagggtctcgcacaaaattcatttctacgtgattgttgggaatcaaacccacatcctcacccc

SEQ ID NO: 18113 - DNA, 2173 bp, Zea mays
cattgggtacctcgaggccggccgggcattgggtacctcgaggccggccgggagtcatcgtcagaatttcctcttttttttccttccccaacttctccctgcgtcggccgatgctgcggcgactgaccacagctttcgaccctctccagtggagggaacggggttagcgagcggcctccgctgcgacggcaacggcgtgggagggccatggcggcccccgcgctcgccttccccatgttgctggctgcctcactgctctccgtcgccgctcctgcgctggctcgaagcccatcttgccctgatggttggcaaggcggccctgttcagaacagatgcttcatgtacatatcagcctccctttcttgggatagatccgaggctgtctgccataactacagcgggcatctcgctgcagtatcatcaatccaggagctaaacttcgtgaagtctctctgtggatcatcatccacaggatgctgggttggagggcatcactacagcactagtaccggtaacggttggaaatggtctgatgattcctctgtttggaatgagactgtcttccttggtgagccattgcctgccaactgcagtgatcctgcatgtaaagtagccaccagcaacgatttgtgtactttggtcaccaatggtcagccttcaactattactgaaaaaaggtgcggtgagtcccatggtctcatctgcaggatgaaccacgtggacagatgctaccatgatcattgtcacaaggagtatttcatatccattattgctgtgagtggtttcatcctggcaaccactctagccgttgtggtttggctgcttgtctacaggcgaagcaagaaacgaagaagatcgcgagaagtgttaagtgcctcagctgctgcactggtagcaccgcaatggaaagtattcaccagtgaagaacttagatcgatcacaaagaacttcagcgagggtaaccggcttcccggcaacgcaaagacaggcggaacctatagtggaatcttaccggatggatccaaagtagcaatcaagaggcttaagagatccagcctgcaaaggaaaaaggacttctactctgagatccggagagttgcaaagctatatcaccctaatttggttgctgtaaaaggatgttgctatgatcatggtgaccggtttattgtctatgagtttgtcgcgaatggtcctttggatgtgtggctgcatcatattcccagaggagggcggagccttgattgggcaatgagaatgagagctgccacaactcttgctcagggaattgcgttcttgcacgacaaggtaaagccgcaggtggtgcaccgtgacatccgtgcaagcaacgtcctactcgacgaggaattcgggtcgcatctgatgggggtggggctttcgaagttcgtgccgtgggaggtgatgcacgagagaaccgtcaaggccgcgtcctacggctacctcgcccccgagttcatatacaggaacgagctgacgacgaagagcgacgtgtacagcttcggcgtgctcctcctggaaatcatcagcgggcgccgccccgcgcagtcggtcgagtccgtcgggtggcagaccatcttcgaatgggccactccgctggtgcagtcccaccgctacctggatctgctggacccgctcatccaggagtcgccggacgcgggggtcgtccagaaggtcgtcgaccttgtctactcctgcacccagcacgtcccttcggtgcgcccgaggatgtcgcacgtcgtgcatcagctgcagcagcttgagctcaagtctgcagcgtccgagcagcagctaaggagcgggacgagcaccagcgcgacgtctccaatgctgccgttggaggtccggactcctcgctgaaatgtgctgccagaaattgatagcctttttaagtactctctagctctgtaggtggtaccacattccttgtgggccaccgttatcttgatcagttgtagacttgtcatctgtaacctctaatctgctacatatgtcgtgggttttcaatgtgtgacctaaagaagctttaggcttatgctctcaagtctgaagaaacaactcatctgtatttcatagagtaataacagtagcttgtaatactatttcctatcaacacaactagcagttcgatttctatcatatttacatttggcggccc

SEQ ID NO: 18114 - DNA, 696 bp, Zea mays
  misc_feature (5)..(5): n is a, c, g, or t
  misc_feature (22)..(22): n is a, c, g, or t
ggtcnccggatcgtccaatcanagcgcgcgctgcacgtcatccgcgtcgaagcggatacagtgtcggggcatacgcaacccggaagcgggcgtatatgaacagcgtgggtcagacgcggagggtgcactttggattcgctcgatcggtcatcatcggactgtgcaagcacgagaggggtatacaggcatacagcggattcataaaccgtcagagtgttaggacaagatggtggccaatggtgatgcacctgctagagggagcgcggcggcagccgcaagcctgcgtaggcgtaggaccacaagcggtgctgctgctggtggaggcggtgccagctcaatgctccaattctacactgatgaggctgccggccgcaaaatgtcaccaaacactgttctgatcatgagtattgggttcgtagccgtcgttgctgtgctccatgtattcgggaagctgtaccgcacctccaactaggttggcattgccatatccaagaaagctgagtccaccaagagaggattcctgtagaacaatttaaatggatagcaagtgactatcagactctgttgtagaagtttatttatacaacttgcaatgctgcgaggctattcataaatgcctgcgagttttgtttaagtaaaaaaaaaaaaaaaaaaccctcgcgcgcataaagcatatgccgtgagagtttcatggct

SEQ ID NO: 18115 - DNA, 721 bp, Zea mays
gcgctgcacgtcatccgcgtcgaagcggatacagtgtcggggcatacgcaacccggacgcgggcgtatatgaacagcgtgggtcagacgcggagggggcagttaggattcactcgatcggccatcatcggactgtgcaagcacgagagggggatacagcggattcataaaccgtcagagtgttaggacaagatggtggccaatggtgatgtacctgctagagggagcgcggcggcagccgcaagcctgcgtaggcgtaggaccacaagtggtgctgctgctggtggaggcggtaccagctcaatgctccaattctacactgatgaggctgccggccgcaaaatgtcaccaaacactgttctgatcatgagtattgggttcgtagccgtcgttgctgtgctccatgtattcgggaagctgtaccgcacctccaactaggttggcattgccatatccaagaaagctgagtccaccaagagaggattcctgtagaacaatttaaatggatagcaagtgactatcagactctgttgtagaagtttatttatacaacttgcaatgctgcgaggctattcataaatgcctgcgagttttggtttaagtcattgcttcgtattttgaaatttgctggcataaagcatatgctgtgagtttcatggcatttattctcattaaatggcatgccacgtgttggagacttgttcacaaaaaaaaaaaaaaaa

SEQ ID NO: 18116 - DNA, 599 bp, Zea mays
gatacagcggattcatagaccgtcagggacgcgcgcatacagcatacctccatgcacggcccttcccgcttcccctcggccggtggttccaagttttgatttgagtgttaggacaagatggtggccaatggtgatgcacctgctagagggagcgcggcggcagccgcaagcctgcgtaggcgtaggaccacaagtggtgctgctgctggtggaggcggtgccagctcaatgctccaattctacactgatgaggctgccggccgcaaaatgtcaccaaacactgttctgatcatgagtattgggttcgtagccgtcgttgctgtgctccatgtattcgggaagctgtaccgcacctccaactaggttggcattgccatatccaagaaagctgagtccaccaagagaggattcctgtagaacaatttaaatggatagcaagtgactatcagactctgttgtagaagtttatttatacaacttgcaatgctgcgaggctattcataaatgcctgcgagttttgtttaagtcattgcttcgtattttgaaatttgctggcataaagcatatgccgtgagagtttcatggcatttattctcatt

SEQ ID NO: 18117 - DNA, 1067 bp, Zea mays
  misc_feature (974)..(974): n is a, c, g, or t
ccggtaccgactggttagttgtagagggtatgcggtgcgcacgtgcacgtgcgcgcaagtcgtctggaataaaaatgctctgaaagcccagatgtccagcatatcgacgcagagtcgcagtcgcagcacacactgaattctctttagctagctaagagagggtagccacaccaagacaggatgcagacagcgaaggtgaaggcgaaggacatggtgagctcggcgaaggagaaggtgaaggaggggtcggcaaagatgcagggcaagacgggcgaggcgacggcggccacgcacggcgagaaggagatggccaaggaggcggcccgcgccaagaaggaccaggccaacgccgacaagcaccaggagaaggccgaccaccgagcggacgccgccactggccaccacggcacgcgcgtgcccctcaccggcccgcacggccaccacggcgctggcgcggccgtcgaccccgcgtacccgtcctccggcaacacgtacccggcgtcgggcaagtacatctaggtgactgcgtcggatgagcgaggccagggtcgtggtcgcacttgcgtttttgtgtacgtagcgaccgagaagatcgatcctggctgtacgcctgcagtaccggtaccgactggttagttgtagagggtatgcggtgcgcacgtgcacgtgcgcgcaagtcgtctggaataaaaatgctctagttgctgttaggttgcttaatttcagtgtagtcgttcgttcacgggcactgttgccctctatgtagtatgttttttttttgtttttaatcgttttagtgtttgaccaagtacgcgtaatagatttgtaagttcgacaacgttttaagagttcaattcacgcaattcacgctgatcatattatcaccacacccccccaaaaaaaaaaaaaaaaaaaaaaaaaaaaaaaaaaaaaaaaaaaaaaaaaaaaaaaaaaaaaatttttggtgacttgcntcggatgaacgaggccagggtcgggggcccacttgcgtttttgtgtccctagcgaccgaaaagaacaatcctgggtgtacccctgcagtaccg

SEQ ID NO: 18118 - DNA, 1428 bp, Zea mays
cattgggtacctcgaggccggccgggattcaggtgcccggacttatccgagtatcggagagtatccgacagttcgccttcccgtctttccctctccccccacacccggtcgtcgtcgtcgcggcgtgagcgtctgagcgagcgtgcgagagcgagaggggggaacacaaaaccctagcaccgtcgccgacggacgccagagtagagagatggcggtggacgaggtgaattcggtctacgtcggcagccttccctacgaggccaacgaggagatgcttcgcgacgccttcgggtactacggcaccatcgtctccgtcaaggtgattaatgatcatactatcaaaggcaagtgttatggttttgttactttcactcaccccagagctgctgagcaagcaattgcaggcatggacggcaagaaattaggcaatcgtattattcgagtaaatgaagtgcgtacaagaggtccccgagattttggtcgagatggttttagacgagatccaagaaggtatggtagagatccatactgggacagaagggatagggaacagagctatgatcgtgaaagagatccctaccatgacagggatagtgatagatcccgcgagcatgatagagaaagagattatgagcatggtggctttaatagagaagttgactatcccatggatcgagatcatgaagtagacgacatacatcctagagaacatgatcgtgcagcagaaacacataatatggattcagataatgacaaatataaggaacatggatcaagaaaaagccacccaaaaggtcgtgatagcaaagatttatcgagttccagtgatcttcaaaatgatgggaaacaccagttggataaaactattcagatgcgtgaggaccttgaaaatgaggttagccagattaaggataaaatctctgcgaaaggacaacacattgcagatttgcagaagaaagctcagaaattagaggatgaactggctgctgcacggaaagtctcttcagaacgacaattagctgttacagacctgtacaaacattttcttcaactccaagactacaacgatagggtcaaaacagctgaacataggctgcagtctcttgttgacgctgccatggccgagcttgacatggccgaagatgctactaccagagatggctcgatgtatgagaacggcgtggtttgaacaccgaaagggggctgccagctgtcatgtctagggatgaaaacggtcgaaaacgatcgaaaaaacagttaaattgtttttgttttcatattttttggtcgaaacgaaaacgaatacgaaaaccaacggtcgaaatacgggatcggaattgtcggttattcgaaaacgataaactatagtcggaaagataactattttgtagttttatcaaaaacataataaactccatgtacttccct

SEQ ID NO: 18119 - DNA, 3951 bp, Zea mays
gtttctttcgtttctcgagttccgtggtcttgtaacaaccgttagttttttgtcgcgaacaattattctgtcgttttggattgcttgtgtgctaccgatagggtcaaaacagctgaacagaggctgcagtctcttgttgatgctgccttggtcgagctcgacatggccgaagatgctactaccagagatggctcgatgtacgagaacggcgtgctttgaacacccaactgccatgggtttgtgtggttgctgatttgttagatttgtagtttgcgtctgccatgtaatagaaccgcactgtaactagaaacaggaaaaatgttgtgtaagggtcggagaatctgctgtcgtggtccctgagcccggatttctctttcgtagttggattcattaaccggcctgagtattcctgttaccgtatgttttgagcgtgatgaaaaaaaaaaaaaaaaacgagcgcgagcagcccttcccccacctctagatgtgaagtagtgctgctctgctaactgatcagggaggagattaggagaggagaccagacgagactccaaaagtctcttgaaacggcagagcagagcaggccatctctgatttgtatctgccgcctgccacaattgttttctacgggcaccgtccacgtcaacggcgcaggctcatcttgaccgcttctcatcagcacctcctgacgcagattaagtccatgacagaataacataagaaaaaaaaagaagctagtaactatggtcttgattggatgactgcatgtctgtaatcaggctcgcggctcgtcccatcctggctgtccggatacggttgtttcgagggtacgagtggatacaatcaaaatgatttaaaatgacatattttgtatccgtttatccagtctacgtctctcatgtgcagccaaccaaataaaagcttagctaaattcaatgcacgtggtggttcaagacgagatagtgcagataaccaatgtaacgaagaagggccaggccgttgtctccgaggtggaactgagggagaagcatgtgaaccatactggcgaaaacgtcgagctgctgccggttcttggaacagcagcttcccagaatccgcctccagatggtcagtcagtcagtcatgactcacatggcatgagcagatctccatgcaacatgcatgcatcagataatgcatgcatgccatcgttgcgtcattgtaacaagtccgtagaaatgcaggaaggggaggagtcgctggagctgagaccaggaagagagggatggtgctcccgtttacgccactgtccatcactttcgacgacatcaaatactcggtggacatatgcctcaggtaagcatacattagaaaagacctgccttatcagcaagatacaaaccgataatactaaacaacaaattgtatggctctttgacaggaaatgaaagacaaagatatcactgaagatcgtctgctgctgctgaagggagtcagtggagcgggcaataccacactgatggacgtgctggcgggaaggaaaactggcgggcacatcgaaggagacatttcaatctctggatacccgaagaaacaggagacgttcgctcggatcgctggctactgtgagcagaacgatatccattctccgcacgtcactgtttacgaatccctcttgtactgtactccgcgtggctctggttgcccccatgaagtggattcagaagcaagaaaggtaggccaaagattgtctccatcctgctaatcggatcactggtaattaattatagtgcttggtaattaatcttcttcacgacaggaaccatcttcttgaacctggggaacaagatgtaagcatgcacccttgctgacagcgcacctattgagacctggtggtatatgctgtgctgggcatactttgacaaagaaacttacttgtgcttcgtctttcctcgtgtagtgtggcacaagacaggaccttttcaattccttgggattcatgtacgccgcagttcttttcattggaatccagaatggccaaactgtgcagccgattgtggacgtcgagcgaacggttttctaccgagaaaaggcggccggaatgtactctgctgtctcctctaccctacgcttttgcgcaggtaactggttgttctagccgaacatttggattacaggaaagaagaacggctctttcccttccttcatcctagagctgatgagttctaacagttctaccttggaacaggttctcatcgagatcccacacatcttcctccagacagccgtgtacgactacggcctcattgtctacagcctgattgactttgactggacagtcgagaagttcttctggtacatgttcttcaccttcatgtacttcacgttctacgggattcgggatgatggcggtcgccatgacgccgaacagcgacatcgccgctatagtctcgaccgcgttctacctacgcgatatggaacatatctttgccgggatgatggcttcctcttgcactacgtacgctacaccccagttttctctgtgctgctggatgctgaagcgtacatggctggctggctggctttgtagaggataccgatatggtggagatggtactcgtgggcttgcccggtggcttggacgctgtatgggctcgtcgcctcacagtttggagacatcacacacgtcaggctggaagacgatggggaagcggtgaaagacttcgtcaacagattcttcggattcgagcatgagaacctgggttatgtagctactgctgttgttgggttcactgttctcttcgctttcgtcttcgccttctccatcaaagtcttcaacttccagagaagataagggagggcgctatggtgctgcttcagctcgcttcagtttatatgcgtttcagcaatgtaacatgatgagagagtatacatttagcctttgtttatttgtaggaagtttgacttcattttttgttttctggccagtttggcctgttttgaactgaaaggagccccccagtgtaaattgtatgtagacggtgcacagctgagttcaatacttgaatgtaagatttttctctgacttgcgtcctgaattaaggcttcttggattatataattcaacttatggattatataagcatctattgatctgcttatgaattatcataatctagatatctagattatataatccacctaataatctgtgttgtttatttatctctcaacttatttaagctggattatataatctaggggtaaacaaacatgataacttaagaaaaagaagaagctagtaactatgtaacgaagaagggtattcaggttcagacagataattgaggacgtccataaacattagacgcaaataaactgaccatacagaagcagcatccctctcactgctgaagtgctgagtgacgaacaaaatcataaaatcacttgtcgaaatttctatgcagaacccagaacggtgcaccgatcgatcagcaaaagatcatcaaatcacttctctcgttaaaatgaatatcccaaaaaaaaaactcatgtgatgacatgcttcagaggctatcctaaacgcttttagatcgtccatgcttactgtgaatttgtgataaatagatcctctgctaaaagatacaagtatgaaggtaaaatgcagaaagataagaaagtggattatgggaatctggaggatggaaacactaaacaacatgatgagtgtaacagaaaatctcagagttacatttatcaaatgcaagggcttgacaagaatataagcaaaggaaagaatgtaggagctgatgaaggtaaaactggcaaatcttattccagctgttctggtgaagaaaagaacaaggtgcatataactgatagcgatgaggatgatgatagtgatcttcttggagaggagcttatggcaatgaaaaattgtggatctggatacaaatagccagaatcttggaa

SEQ ID NO: 18120 - DNA, 1134 bp, Zea mays
agaaaaaagggatctactgaatagatattgatacaaatattttgagatggattggggtaaatatttattaaaaatctacttagtctttagtctagagtaagtagataaatctctagagtaagtagataaatctctaaacacttctttttcttttaaaaaaagggtttaaatctctggttctttatggtatagaaagaggtgagattaggtgcccttttcttcattttgcatttcttattaattttgtataccgctattccgaagaatatatttttttttattcttgcttatcctactttcccagttgttctaagtaatatgcgcggtacaaagttcgtggtaggaacttctttgagtcattgtatttttctgttcatacgaaggaaacaaatatgtgattttccaaattggaaaatagaaatgaagccctttttgttcagtctatctggacctttttgtataataggaattaattagaatattatattctaagtatttcgtttcgtctaggaacagaacgtcaaaatattccttgacttgaataaaatctggaattgtgttgtataagtgaacatgaatttattatcactcaatgagcatcttgtatttcatagaaattgggggttatatagtccttacgtaagggccagcctatccaactttcaggcattaagatacgtttaagacgtggatgattatcataagaaattcccaccatatcataagattcgcgttcttgaaaatcggcacttctccaaacccagaaaacagacgggattctaggattatccttttgggcaaagacttttatgcatacctcttctgggttatctataccatactgtattctcgtaagatgatacacgctagctaaagatccaccgggtgctacgtcataagcacattggggaacgtaaataattgtaaccatatacatataaaatgacagcaatggaatcccaatcccccgcttttatttgtaaagtctctactcctcgatgatcgaagcccaaagacctatgaaccacgtcatgtttaactagccaattagataaccaaccctgctgcattgccttgatctctccccctttgtataaatatttcacatttcaaatgcaagtttgaaagattgcg

SEQ ID NO: 18121 - DNA, 1423 bp, Zea mays
cattgggtacctcgaggccggccccgagatcagatccgacaactcgccctcccgtctttccctctctctcctcccaccacacccggtcgtcgttgtcgcggcgtgagcgagcgagaggggaaaacccaaaaccctagcacccccgccccgtcgccgacggccgccggagtagagagatggcggtggacgaggtgaactcggtctacgtcggcggccttccctacgaggccaacgaggagatgcttcgcgacgccttcgggtactacggcaccatcgtctccgtcaaggtgattaatgatcatgctgtcaaaggcaagtgttatggttttgttactttcactcaccccagagctgctgagcaagcaattgcgggcatggacggcaagaaattaggcaaccgtattgttcgagtaaatgaagtgcgtacaagaggcccccgcgattttggccgagatggtttcagacgagatccaagaaggtatggtagagatccatactgggacagaagggacagggaacggagctatgatcgtgaaagagatccctaccatgacagggatagtgatagatcccgtgagcatgatagagaaagagattatgaacatggtggatttaatagagaaattgactatcccatggaccgagatcgtgaaggagatgagagacgtcctagagaacatgatcgtacagcagaaatgcataatgtggattcagataatgacaaagataaggaacatgtatcaagaaaaaggttcagccgcccaaaaggtcgtgatagcagagatttatcaagttccagtgatggtcttcaaaatgatggaaaacatcagttggataaaactattcagatgcgcgaggaccttgaaaatgaggttaaccagattaaggataaaatatctgggaaagaacagcacattgcagatttgcagaagaaagctcagaaactagaggatgaactggttgccgcacggaaagtatcttcagaacgacagttggcggttacagacctgtacaaacatttcctccaacttcaggactacaatgatagggtcaaaacagctgaacagaggctgcagtctctcgttgatgctgccttggtcgagctcgacatggccgaagatgctactaccagagatggctcgatgtacgagaacggcgtgctttgaacacccaactgccatgggtttgtgtggttgctgatttgttagatttgtagtttgcgtctgccatgtaatagaactgcattgtaactagaaacaggaaaaatgttgtgtaagggtcggagaatctgctgtcgtggtccctgagcccggatttctctttcgaagttggattcattaaccggcctgattattcctgataccgtaaatattgagcgtgatgaaaaaaaaaaaaaaaacgagcgcgagcagcccttcccgca

SEQ ID NO: 18122 - DNA, 1069 bp, Zea mays
ccggccggccggccgggatcgagctgagctgagcatatggggtagtgtgtgaggcgatagagaagctggtgctcataaccaaccaccactcagtcctcctcctctaccctttcccttccgccgcgttcctacttggtcctagagggagagagatctcgaactccaagggcgcatgctccggttgctagctacgataccgtgtgcgtagctgcggcagcccttgatcgatcgatcgatcgcttgtgcggaaggagccggatcgagtggagtcagctagatactccgtggtcgtcgttggacgtacgccagaagagggagctagagaagaataccgtgtacagctgcttccaacatggcagctgcctcgtctgcccacggcctgttcggactcggcgacgggcagatgcagatgcagatacagcagcagcagcaggcgccgcctcctcctcttgtgaacaacccggccgcgccgccgcccaagaagaagcggaaccaacccgcaaccctgacgcggaggtgatcgcgctttcccccaagacgctgatggcgacgaaccggttcgtgtgcgaggtgtgcaacaaggggttccagcgggagcagaacctgcagctgcaccggcgcgggcacaacctgccgtggaagctgaagcagaagaaccccaaggagacgcggcggcgggtgtacctgtgcccggagccgacgtgcgtgcaccacgacccgtcccgcgcgctgggcgacctcacgggcatcaagaagcactactgccgcaagcacggcgagaagaagtggaagtgcgacaagtgcaacaagcgctacgccgtgcagtccgactggaaggcgcactccaagacgtgcggaacccgcgagtaccgctgcgactgcggcaccctcttctccaggagggacagcttcatcacccaccgtgcgttctgcgatgcactagcgcaggagagcgcacgggtgccgcccatgggcgccggcatgtatggcactggcggcatggccctcggcctctccgggatggccacatcacagttgcagtcattccaagaccagacccactcctcgg

SEQ ID NO: 18123 - DNA, 2160 bp, Zea mays
cattgggtacctcgaggccggccggggccttttatcgagctgagctgagcatcatggggtagtgtgtgtgtgaggcgatagagaagctagtgctcataaccaaccaccactcagtcctcctcctctaccctttcccttccgccgcgttcctacttggtcctagagggagagagatctcgaactccaagggcgcatgctccggttgctagctacgatgccgtgtgcgtagctgcggcagcccttgatcgatcaatcgatcgcttgtgcggaaggagccggatcgagtggagtcagctagctagatactccgtggtcgtcgtcgtcgttggacgtacgccagaagagggagctagagaagaataccgtacagctgcttccaacatggcagctgcctcgtctgcccacctgttcggactcggcgacgggcagatgcagatgcagccgcagcagcagcaggcgccgcctcctcctcttgtgaacaacccggccgcgccgccgcccaagaagaagcggaaccaacccgcagaccctgacgcggaggtgatcgcgctttcccccaagacgctgatggcgacgaaccggttcgtgtgcgaggtgtgcaacaaggggttccagcgggagcagaacctgcagctgcaccggcgcgggcacaacctgccgtggaagctgaagcagaagaaccccaaggagacgcggcggcgggtgtacctgtgcccggagccgacgtgcgtgcaccacgacccgtcccgcgcgctgggcgacctcacgggcatcaagaagcactactgccgcaagcacggcgagaaagaagtggaagtgcgacaagtgcaacaagcgctacgccgtgcagtccgactgggaggcgcactccaagacgtgcggaacccgcgagtaccgctgcgactgcggcaccctcttctccaggagggacagcttcatcacccaccgtgcgttctgtgatgcactagcgccggagagcgcacgggtgccgcccatgggcgccggcatgtatggcaccggcggcatggccctcggcctctccgggatggccacatcacagctgcagtcattccaagaccagacccactcctcggccactaccgccatcagcagcaacccggcggcgcagttcgagcacctcatgcagtcgtccaccggctcccccgttttccgcggcgcgcaaccgacatcatcgtcttcctcgccgttctacctcggcggcgccgaggacggccatcaaagcctatccggccacacctctctgctccacggcaacaagcaggcctaccacggcctgatgctgttgccggagcagcagcaccaggcggggagtaacggcctcctcaacctggggttcttctctggcgggagcagcggtcaggacgcgcgcctcgtgttcccggaccagttcaacggcgccgttggcgggaacgtccgcggcgacggcagcgagcacggccacagcggcgctaacacggaatcagcggccatcttctccgggaacctaatgggaaaccaccaaatggcaagcagcgcgggcttttcttcctccttgtacaactcgtccgagaccgttgcgccggcgcagatgtcggcgactgcgctgctgcagaaggccgctcagatgggcgcgacgacgagcagcggcaacgtgaactctctgctcagggggcttggtagcagcgccggcggcaccttgaacgggaggcctgccggagcagcagctgggttcatggccggcgagggatcctcgtcgaggagcacttcccaggccgagaacgagagccagttccgggacctgatgaacacgctcgcagcttccgggagcggagctgctggcacagcgttcagcgggggtttcccgggcatggacgacagcaagctgagcacgagagacttcctcggcgtcggcggcggcgtcgtgcggagcatgggtggcgcggcagggctgccgctgcggcacggtgccgcgggcattggcatgggctcattggacacagaaatgaagtaggcgaatcgaaatccgaaacgagcattattatgctccactcttgggctcttgcattgcatgcaaggtaagtagtagcagcctaagcaaacgacctatggaaagatgagaccatttgcgcccaaaataacaaatgaggccgtcaaccatcc

SEQ ID NO: 18124 - DNA, 3167 bp, Zea mays
ttgcatgcctgcaggttgcttgcacagagtgatagaacgcaagtttgtttcgttccccgttttgcgccgctagaaaacgagtgccgtcccgtatcgctatccaagtgtcgagtgacgccgcactccagcggctcaattctaatccagcagcctggcagcaggccgccatcgcccactcgccgtcgcaccaaccgccccagtgaagggcccatgccgccgtctccgtccgactccagccccgacatggacccgcgcagcggctactgcgcgtcgacgaggacgttctacagcctgcgcgcggcgccgccttcgccgccgccgccggacgccccgctctccttcccggctttcgccctgtccttcctccccaccccgctgccctcgcccttggccgcgagccgcccggcgctcgtagacgcgggcacgggcgagtccgtcccgctcccggccttcctctccaggctgcgcgcgctcgccgccgcgctccgcgcccggctccgcctcggcccgggcgacgtcgcgttcgtgctcgcgcccgcgggcgtccacgtccccgtgctctactacgcgctcatgtccgtgggcgccgtcgcgtccccggccgacccgtccctacccgccgccgaggtctcccgcctgctcgcgctctccgacccgcgcgtcgccttcgccgtcgcgggcaccaggggcaagctccctcccgggctccccaccgtgctgctcgactcgccgacgttcctctcgttcctgcacgagcccgaggacgcggcggtggtccgggtccggcagtcggacccggtggtggtccggcagtcggacccggcggcggtgctgtactcgtccgggaccacggggcgcgccaaggcggtcgtgctgacccacggcaacctcatggccagcaacgcgacgcgggcgcccgcggccggggagaccctcatgctcgccgtgcccctcttccacgtgtacggcttcaccttctgcctgagggcggcgtcggcggcgcacacgctggtgctgcccgcggccaggaggaggttcgacgccgcggcggtcctgggcgcggtggggaggttcgaagtgacgcgcctggcgctggcgccgcccgcgctgctcgccatcgtgcgcgccgccgaggaggacgcggcggcgcctgcccgcgcggcctcgctgcaggctgtgaggtgcggcggcgcccccgtcgcggctgacctcatcgcgcgcttctcgcgcgtgttccccggcgtaagcctcgcgcaggttggtcaagtcccaatgcctctgtctctctcggttcttgttccgttgtgtgtgtgtgtgtgttcatcgtagcaagcgtggttggcaacaggggtacggcctcacggagactacagccggattctgccgcgccgtcggggaggaggaaagcgcgcgagtgggatccgtggggcgtctctcatggggcgcccaggtgaaggtcgttgatccggagacgggggcagccctgcctcctggcgtggcaggggagctttgggtccgaggccctttcgtgatgaaaggtaggtgaggtcaggccaccatgcaatgctgtccgtgagctgagctcgatcagtaagtaacaaacagtgctctgtagcgtagcgtaggttaccttggcgacgacgattccacgtctgagatcttggacagccaaggatggctgaggacaggagatctctgctacatcgaccaggatggattcgtcttcatcgtagaccgtctcaaggagttgatcaagtacaaaggctaccaggttagtaatggtatagtaactatcttctgctgctgttgctagaaagttacgacagctttgccttgtcttctctgaatccttgtctgtttcattcaggtgcctcctgcagagctcgaaaacctgctgcagacacaccctgacattgatgaagccgcagttgtcccgtaagagcgcgcgcgcgcgcacacacacacacacagaaaaagcatgagaaatcagctagctaatgccatgttcatgctagctaactcatcttacatgtatgacgatacagataccgtagtgacgaggatggtggggagttgccggtagcgttcatcgtcagacgcccaggaagccaccacttgcaggaatcacacatcaaagacttcgtcgccaaacaggtttgtttaatttggccgctggctcaacagccaacacaacacaacacaattttgctgctgctgctgcttcttcttcttcttctggtgagtcgcttcatcagctatgataataaccactcgtcgtcatgcaggtcgcgcactacaagcggatccaccatgttttccttgtggattcgataccgaagaacgcgtcgggcaagattttacgcagggacctggccaagctagcgtcgcggcgcattagctccaagctataggtcaataggtgcattgtatgtgtgacgtccatttctttccttctcttgttgcaatgtactagcagacactgtcagacttgtagttattaccgtaccggtttatttaatcaagacatggagagtaatcgtgtagcctctctactagaaaaaagataagtactctgtactggcttggcaaaccatctgcactataccagaaaagactggataacattcgtcatatctacctgaactgctgaacgacaccatgctcgcctgcagctgatagacagatggggttgttcgttccccaatgttcatgagaaggcgataaatattcgagaatggataaatattcgagaatgaatgtagtagtttttaaatagaatctatttgttatataagctatgccacattaccaccagcagttacagtcatgccttcagatgcaatataagttcagtgctgaccggcaatttcaacaccttaacttatcaccagtgttgtagcatgcgcgttggaattggaagagagaaagagagatgagattctttccacccactaactgcgtcgtgattttatttcataactaatcgtgatcctcccatggtgagggtagacagtccatatagcgaatcaatgttatatgtcgttgcatgcaacttaatctggaacacaacatcgatatcttcgcctaatcaggtcttacctagtgctgtagaggtaccaagctgtacagggtatgcggaagagtgtaattagatatttatcatacta

SEQ ID NO: 18125 - DNA, 739 bp, Zea mays
  misc_feature (673)..(673): n is a, c, g, or t
  misc_feature (682)..(682): n is a, c, g, or t
  misc_feature (687)..(687): n is a, c, g, or t
  misc_feature (690)..(691): n is a, c, g, or t
  misc_feature (696)..(697): n is a, c, g, or t
  misc_feature (700)..(701): n is a, c, g, or t
  misc_feature (704)..(704): n is a, c, g, or t
  misc_feature (706)..(706): n is a, c, g, or t
  misc_feature (709)..(709): n is a, c, g, or t
  misc_feature (711)..(712): n is a, c, g, or t
  misc_feature (714)..(714): n is a, c, g, or t
  misc_feature (717)..(720): n is a, c, g, or t
  misc_feature (722)..(724): n is a, c, g, or t
  misc_feature (726)..(727): n is a, c, g, or t
  misc_feature (729)..(730): n is a, c, g, or t
  misc_feature (732)..(732): n is a, c, g, or t
  misc_feature (738)..(738): n is a, c, g, or t
aatgactcctcttttagcggcgagagactgagagcttggctcaacgcgtcctcggcttctgtggaggccattccatgcgctccgtgtagccagccattcggtacaaccaactaccctagaagtaacttttcttttcttttttgctctcgagatggatccggttggccccttcctcgtcgcctctataagaagcatccccacaccggacgctcgcgggccatcactgcagctcaaacacaaagcagcatcacactgactccactgctctgcctccataataagcacagaagcgccccaataatcagcagcgcaggagcgagcgatcgctatggctcagggaagaggcagtgcgacgcgggggcttgccctcggcagcctactcgccgccgctttcctcctcctcctcggcgtcgccgacgcggccacccacagggtcgactggtccttcaacgcggacagctggtccaagggcaagagcttccgtgccggcgacgtcctcgagttcaactacgacccctccgtgcacaacgtggtggccgtggacgccggcggctacaacggctgccggccctccggcacgtcgtacggctccgggagcgaccgcatcacgctcggccccggcaccagctacttcatctgcagcctcaacgggcactgcgggatggggatgaanaatggccgncaccnccnnttganncannacngntcnanntngtnnnnannngnncnntncatggnt

SEQ ID NO: 18126 - DNA, 1015 bp, Zea mays
aatgactcctcttttagcggcgagagactgagagcttggctcaacgcgtcctcggcttctgtggaaggccattccatgcgctccgtgtagccagccattcggtacaaccaactaccctagaagtaacttttcttttcttttttgctctcgagatggatccggttggccccttcctcgtcgcctctataagaagcatccccacacgttctctccacccatcactgcagctcaaacacaaagcagcatcacactgactccactcccatcactgcagctcaaacacagaagcgccccaagaagcagcagcgcaggagcgagcgatcgctatggctcagggaagaggcagtgcgacgcgggggcttgccctcggcgccctactcgccgccgctttcctcctcctcctcggcgtcgccgacgcggccacccacagggtcgactggtccttcaacgcggacagctggtccaagggcaagagcttccgtgccggcgacgtcctcgagttcaactacgacccctccgtgcacaacgtggtggccgtggacgccggcggctacaacggctgccggccctccggcacgtcgtacggctccgggagcgaccgcatcacgctcggccccggcaccagctacttcatctgcagcctcaacgggcactgcgggatggggatgaagatggtcgtcaatgccagctgagcacgacgcttatatgttagtactgcaaaaatatatgggctagtggtggtccgatagatcgtgcaagaactcaatcgtgtggcatactcgtaccgtgtgttcgatggacacggttcatgtgttgtgtatgcatgcgactgctggtaggtcaggcatgatgtacgtgtggctgatggcgtgttagtaaagcgtcctgcagctttgttgttactttgttcgatcgaagcagcggcttcttttgtttgttcatcaataacatctttcattaaattttttttaaaataaaaaaaaaaaaaaaaaaaaaaagaaaaaaaaaaaaaaaa

SEQ ID NO: 18127 - DNA, 3136 bp, Zea mays
  misc_feature (2401)..(2401): n is a, c, g, or t
gtgaaactagaatattttatgaatttttaatattgtggtgttggttctacaatgtcctcgtgcttagtaactttgaattgcatgatgtcaattttatcggtttcctttcctacatttgatctatcatatacatgattatgtattgcttaatttatgtatttgttgtatggttggacaattaatatcatcgggacgaactacccgacaattatctggtacctacccgagtagtatccgttatctgtttcttacccgcccggattattacccggtcctgtcctatatccgtcccgaattaactatctgtatccggtctcgtatccgagagaaatacattagggtaggatacgggataaccctgtatccggctatatctgtcccattttcatccttagaccttagctatatctttgctttaagacattgcattttgttttttttttctctttctatattgaacacttgattattctatatgtccattattaacattttctatgttatcactcatgctcaatcttggacatgacttgctcgatctcattcacattactagagtaaatcatcaaaccactagttgcctcgaaaactgatttccaatagtaaaaaaccggctttacggaataaaaaatagattttcttattgaatgaacgagaagaattggaagagcaaagttgaactgcaacgtgaaacggccacgtaggaaacagccgtgtctgcctcaggaaaaaaagaggaaatagccgtgtcgacggaacattccagaaggccgccgcgcaatgtgccaaagcgcatccaccccgtacgcgtccactcagctgccgcacgctgagatgctgacccgacccggcgagtcggctactcgctgtctctctctcccaccacaaatattcttcccgccacgatccctctcatccggaagaaaggggggaaaaaactcgcctttttctctctgctggttcaagaacgccatggaaaatctcgagcgctcgctgtgattcctgcgaatacccaagcccaaccaaaccctagcccggcagccattctcttcgttccctctttgctctgcgcgccacaccgcacgacctccccgaagcagacgtgcccgctgcccgtccgtcccccgtggccatggccgcgacgtggtcttcgtcttgctgcgccgcgaccgcgtcgagcagcgctctgcttcgtcatgcccgcgtcaagagcgcgccttgggtagccggtgccagccggagtagctacaggcagcggcggcggcggcgggagctgtccatccgcgccacggccgcggcgccgccgccgcccgtggtctacgcggacgccggcgccgacaacgtggcctcgctgaagatcaagctcctggtcggtgattatccagcaacttgtggttattgtttcacatcctagcgttttttttttgttgttgttggcccgtgtgtgactgaattgcgaacggatcgctcgtgctctgcttgggtgacttgcgcagagcgcggtgtccgggctgaaccgtggcctggcagcgagccaggaggacctggaccgcgcggacgcggcggcgcgggagctggaggcggcggcggggtgccccgtcgacctcagcagggacctcgataagctgcagggccggtggcggctgctgtacagcagcgcgttctcttcgcggacgctcggcggcagccgccctggcccgcccaccggccgcctcctccccatcacgctcggccaggtgttccagcggatcgacgtggtgagccgcgacttcgacaacatcgtggagctggagctcggcgcgccgtggcctctgccgccgctcgaggccacggcgacgctggcgcacaagttcgagatcatcggtgagtccactgtccaccagtcctgccctcctctgccacccatcccatcccaactctgatggcggacggacattgcagggtccgcgggcatcaagatcacgttcgagaagacgacggtgaagaccaagggcaacctgtcgcagcttcctccgctggaggtgccccgcatcccggacaacctccggccgccgtccaacaccgggagcggcgagttcgaggtgacctacctcgacgacgacacgcgcgtcacccgcggggacaggggggagctcagggtgtttgtcatcgcgtgacctgatcgcgcttgcggcgccgttctgctggtccgtgagattgccatccttcttcctccctgttgctccagtagatttgttggtttcttcgtctgaccaatgtataccgttctgttcttccgtgaactgaatctgcgattaacttagtaactatcttgtgtggtttacatgcttgctccgtccttatttactttgttaatttatggcccctactgattgccttgcaaattgcacctctaagaaanagggaaggtagcggagctgattggtattttttttgcttacccctttcatctcagttttgatgataatattttatttatcctctttcatcttacatttcggtcttccatgaattgattctaggatattaactgatattataatgtaaaatttgtagaaagttagatgcatagaactggaaaattgcaaaccaaaaccggtcttaactaagccaatcttattagttttgaacgttaaaaaaccaaaaatataataaaaggggcattccgagaatcgaactcgggacctcttgcacccaaagcaagaatcataccactagaccaaatgccctgtttggaactttgttgatttatattgaataaacacggtacgaaattgtttggaacttctaaaagacttgtatcaccgtaccaaatgactgttcatttgttgggattgctatagatttttttaagtggtggattatatagtaacaaaaactaatgtaatgcatttgtatggacagaaacgactgttgggttaagcttcctgtgcaatcactgtataacaaactaccaaaagtcatggtttttttaaattatatatctctactatataaaaagcactagtttctacggttttttaccgtcgtcttgttctcccacatttaaatggttaaaaagctaaatttatgcacaaaggtggattcgaactatggttattagttgcaaaccgcgtattcacactgatccaaccag

SEQ ID NO: 18128 - DNA, 1283 bp, Zea mays
cattgggtacctcgaggccggccgggaaaaataaaaaaaaaaaaaataaacgggaaatctcgagcgctcgctgtgattcctgcgaatacccaagcccaaccaaaccctagcccggcagccattctcttcgttccctctttgctctgcgcgccacagcgcacgacctccccgaagcagacgtgcccgctgcccgtccgtcccccgtggccatggccgcgacgtggtcttcgtcttgctgcgccgcgaccgcgtcgagcagcgctctgcttcgtcatgcccgcgtcaagagcgcgccttgggtagccggtgccagccggagtagttacaggcggcggcggcggcagcgggagctgtccatccgcgccacggccgcggcgccgccgcccgtggtctacgcggacgccggcgccggcgccggcgccgacaacgtggcctcgctgaagatcaagctcctgagcgcggtgtccgggctgaaccgtggcctggcagcgagccaggaggacctggaccgcgcggacgcggcggcgcgggagctggaggcggcggcggggtgccccgtcgacctcagcagggacctcgataagctgcagggcccggtggcggctgctgtacagcagcgcgttctcttcgcggacgctcggcggcagccgccctggcccgcccaccggccgcctcctccccatcacgctcggccaggtgttccagcggatcgacgtggtgagccgcgacttcgacaacatcgtggagctggagctcggcgcgccgtggcctctgccgccgctcgaggccacggcgacgctggcgcacaagttcgagatcatcgggacctcgggcatcaagatcacgttcgagaagacgacggtgaagaccaagggcaacctgtcgcagcttcctccgctggaggtgccccgcatcccggacaacctccggccgccgtccaacaccgggagcggcgagttcgaggtgacctacctcgacgacgacacgcgcgtcacccgcggggacaggggggagctcagggtgtttgtcatcgcgtgacctgatcgcgcttgcggcgccgttctgctggtccgtgagattgccatccttcttcctccctgttgctccagtagatttgttggtttcttcgtctgaccaatgtataccgttctgttcttccgtgaactgaatctgcgattaacttagtaactatcttgtgtggtttaaaaaaaaaaaaaaaaaaaaaaaaaaaaaaaaaaaaaaaaaaaaaagaaaaaaagaaaaaaaaaaaaaaaaaagcggcc

SEQ ID NO: 18129 - DNA, 1317 bp, Zea mays
cgtcgaaatcccgaccacgcggccggaaaaacttgcctttttctctctgctggttcaagaacgccatggaaaatctcgagcgctcgctgtgattcctgcgagtacccaagcccaaccaaaccctagcccggcagccattctcttcgttccctctttgctctgcgcgccacaccgcacgacctccccgaagcagacgtgcccgctgcccgtccgtcccccgtggccatggccgcgacgtggtcttcgtcttgctgcgccgcgaccgcgtcgagcagcgctctgcttcgtcatgcccgcgtcaagagcgcgccttgggtagccggtgccagccggagtagctacaggcagcggcggcggcggcgggagctgtccatccgcgccacggccgcggcgccgccgccgcccgtggtctacgcggacgccggcgccgacaacgtggcctcgctgaagatcaagctcctgagcgcggtgtccgggctgaaccgtggcctggcagcgagccaggaggacctggaccgcgcggacgcggcggcgcgggagctggaggcggcggcggggtgccccgtcgacctcagcagggacctcgataagctgcagggccggtggcggctgctgtacagcagcgcgttctcttcgcggacgctcggcggcagccgccctggcccgcccaccggccgcctcctccccatcacgctcggccaggtgttccagcggatcgacgtggtgagccgcgacttcgacaacatcgtggagctggagctcggcgcgccgtggcctctgccgccgctcgaggccacggcgacgctggcgcacaagttcgagatcatcgggacctcgggcatcaagatcacgttcgagaagacgacggtgaagaccaagggcaacctgtcgcagcttcctccgctggaggtgccccgcatcccggacaacctccggccgccgtccaacaccgggagcggcgagttcgaggtgacctacctcgacgacgacacgcgcgtcacccgcggggacaggggggagctcagggtgtttgtcatcgcgtgacctgatcgcgcttgcggcgccgttctgctggtccgtgagattgccatccttcttcctccctgttgctccagtagatttgttggtttcttcgtctgaccaatgtataccgttctgttcttccgtgaactgaatctgcgattaacttagtaactatcttgtgtggtttacatgcttgctccgtccttatttactttgttaatttataatttgaactgattgccttgcaaattgcacctctaagaaacagggaaggtagcggagctgattggtatt

SEQ ID NO: 18130 - DNA, 1116 bp, Zea mays
cattgggacctcgagccggccgggaatctgtgtcgctctcctccctcctcctcctcctcctcctccgtaggcaaggcaaggggggcaaggctctaacggagatcggatcgactggccggtccagccgcccgccctccctccctccctccctccctccctcatgtccatatataccaaaaaatctccgccgcgccgccattagctagctctcgtcgtcttcgttcctccgcaaataatttgttactcaagccgaaggaggacgagggcgacgggattggctaatcaaatcgaccgatctagtggctggtgcccaggagaagggacgcgggcagtgcggctcgtcgtggtcagcagcttgtggcgaccggtcgccagggaatcaatcaattcaatcagaaagttgcaattttgattgagctcgattcgtcatccacaagacattagggaatcgaaccaccacaaagcaagaaggcagtccagtgcagagagagagagagagaccaagaagagaaagagaaagggaaagagaagcaaagcaatggatgccgcctccgcttcgtcgtcttggcaagacctgcccccgcgcctgcaatcctacgacaacagggcgccgctcctcctgcccgtcaagatcatggacgccgccgccgacgacaagccggaaatctccgacgacacggcccaccagattagcgttgatccttggtatcaagttggcttcgtcctcacaaccggggtcaacagcgcatacgttctaggatactctggatcaatcatggtccctctaggctggatcggcggcacatgcggcctcctcctagctgccgccatatccatgtacgctaatgctcttcttgcacggcttcatgaagtcggtggcaaacgccatatcagatacagagaccttgctggacacatatatggaccgaaaattacgggcttacatgggctctgcagtacattaacctttacatgatcaacactggcttatatcatattagctggacaaagctctcagggacaccgtaaggactgttcagggatgatggagccctgaaactcccttactgcaatgcgaatatcaaggattccgacctgggctcttttcgccattgg

SEQ ID NO: 18131 - DNA, 2140 bp, Zea mays
aaaaacaatgatgcagcaacggaatgcgagaaatctgcgtcgctctcctcctcctcctcctcctcctccgtaggcaaggcaaggggggcaaggctctaacggagatcggatcgaactgcctgtgcagtctccctccctccctccctccctcatgtccatatataccaaaaaatctccgccgcgccgccattagctagctctcgtcgtcttcgttcctccgcaaataatttgttactcaagccgaaggaggacgagggcgacgggattggctaatcaaatcgaccgatctagtggctggtgcccaggagaagggacgcgggcagtgcggctcgtcgtggtcagcagcttgtggcgaccggtcgccagggaatcaatcaattcaatcagaaagttgcaattttgattgagctcgattcgtcatccacaagacattagggaatcgaaccaccacaaagcaagaaggcagtccagtgcagagagagagagagagaccaagaagagaaagagaaagggaaagagaagcaaagcaatggatccaccgcatcaccgtgctgtgctgcggcggcctcgtcctcctcctccctcctgccctttttataggccgcctccgcttcgtcgtcttggcaagacctgcccccgcgcctgcaatcctacgacaacagggcgccgctcctcctgcccgtcaagatcatggacgccgccgccgacgacaagccggaaatctccgacgatacggcccaccagattagcgttgatccttggtatcaagttggcttcgtcctcacaaccggggtcaacagcgcatacgttctaggatactctggatcaatcatggtccctctaggctggatcggcggcacatgcggcctcctcctagctgccgccatatccatgtacgctaatgctcttcttgcacggcttcatgaagtcggtggcaaacgccatatcagatacagagaccttgctggacacatatatggaccgaaaatttacgggcttacatgggctctgcagtacattaaccttttcatgatcaacactggctttatcatcttagctggacaagctctcaaggccacgtatggactgttcagtgatgatggagttctgaaactcccttactgcattgcgatatcaggattcgtctgtgctcttttcgccattggaatcccttatttatctgccctcaggatttggttggggttctccacgcttttcagcctcatgtatattgtgatagcagttgtgctgtcgtcgagagatgggataaccgcacctgcaagggattacagcatccccaaatcatcgcagtcaactcgagtcttcactacgataggttccatagcagaccttgtgtttgcttacaacaccggcatgctgccagaaattcaggcaaccatcaggcctcctgtggtgaagaacatggagaaagctctatggttccagttcaccattggctccttgcctctctatgctgtagtttttgtgggttactgggcttatgggtcctcaacatcaggctacctcctcaacagtgtcacaggcccagtctgggtgaaagcggttgcaaatctgtcggcattttttcagacagtcatagcgctgcacatctttgctagccccatgtatgaattcctggacacaaaatatggaagtgggcgtggtggcccttttgagatccacaacgtggcgttcagagtagcagtcagaggaggctacctgacggtgaacacgctggtggccgcggtgctcccattcctcggcgacttcatgagcctgacgggcgccctcagcaccttcccgctgacgtttgtgctcgcaaatcacatgtacctgatggtgaaggggcctaagctgggtgccatccagaaatcatggcactggctcaatgttcttgggttcactgcgctggctgttgcagcggcggtctccgcaataaggctcatcatgcgtgattccagcacctaccacttcttcgctgatctttgagatcgatcgttttcttttctttttgttggaatgctgagccagagctagtattttttcattttcagagaattattatccatgtatgtaaggatgacgcatatatatattgaatagatgatttaatatcaaaaaaaaaaaaaaaaaagcggcc

SEQ ID NO: 18132 - DNA, 1953 bp, Zea mays
gcagagatgtcatcgtcaatggctacgttcggaagctggaacagctagttcataaaaaatctcgcaaataattcctcttcaaatattctggaaaagtcctccttttccgcctccctctgtttttcctctcttttggcccaacccgaagcagcagcccgcttctcctttccctttggcagcacaccgccgcggcccaaaggcattgcccaggccgacccgggccgcttccctttgccccctccgcacccgcacattgggagtggcccaaccatccctagccctaacgcccgtccgcttccgtcgagccgccgagaggtccggcctcgctccgctccgctcgtcgccccgtccgtctccatcgaggactgcctccgcagagctcttattgattgcaggctgcggacatgccaaagaagcttgccccgaccataccattggcatttttgtggatcgccgccacgggtacgtatgagtggcgacacggagcgtcgtcgctccgccactggtacgttccaacaccttttcccttcttattttgtttttcccttcttattttgtctagtcccttttaacaagcctttcaagtttgaacccaattttttcacgactgacacccttctgtattagggcgtaagtcaactgtgtcgagggacttcggcgcgaggttcgaccttagcaagacgattcagtccgagaagttcgaagataggcgtacctggggcatctttgttgaaggtcggaacgcggtttcgattttggtggccattaacaatgtatccacattcattcatggccgtaatttcgattggcgatgtgtggatacatttgatgagcaatacatgaaagataaaatccgtagtttgatcacagataggcagcgactatcacagatacacaaggaagtacaaagtatccctgaagatgacatgaaagcattttttgatgtgattagtaacattcgcaaattcacactcagtccacgtttggctggcccatcagcttttgaagtgaatcaaccatatatgctactttgtcatctttttacccctgtgtttcatggttgggttgtaagccctgaattgagcagctatgatgcaattaaagggttcactcgtgatgagttgatacagtattgcaacgcgctgatagccttagaaggtgagtcagacaatgtgagagtgattcgagacttattgaatgattcagatcagctgctgacggcttatggctttgattgcctggttcaggagatgagagatgacaagtttggattatttttttggcgtagcagatatgatgtaattcataagcatgacggagatctttttttactggtttctgatgagagggttcgcagtgaaatgccccaggccacttggatgttatttgaacaatctccagaaagcagcatctacttcacatcagaatatctacctgttgaaaaccaacacagcattgacagagccagagaatggcaccagcaaaagcttcagcaaaagacttcgagctcgttagagacagtgaagaaagctaaaaagaaaaggaagaacaagaaatcagcaatggcgagcaaagaaatacctgaacaaggtggtccgaatgttgaagatgtggttgttgctgtcagtatcagtgctgagcttcgaaatgaaggtcaaccaacaacaacaagggagatggacaatcctaaacaaggtggtctgaatgttgaagatgtggttgctgctgttagtgtcagtgatgaaccaacaagggagatatttaactaatcaaacttacaagacctaatgtagcagatcctcatcctaaatatttgtattttttgttcagcatttctgcagatttgaaggaagcggctgttaagtatctgacaatgaacggattggactctgttgatgttgagttgaaaataatcggtctccctgagccgaaaagttaaaaaaaaaaaaaaaa

SEQ ID NO: 18133 - DNA, 1928 bp, Zea mays
attgggacctcgaggccggccggggacaataatgtccttattttggagctcgcgccgcccgccgccgcgcccgaccggagccatcgattccccatttctttcccgcctcctcactcccgcctcttctactcccaaaatcccaaaaccctagctcgctaacgaccccaggcagacgcgccgtcctcccctcccccatggcgctcaagcagaagggcaccgacgccgccgccgccaccgacaccggtaccaagaagcgccgccgcgtcttcttctccgacaccgatgctggtgttgaggcaaatgagtgtatgaaagtgtttctagtatggaatccaggcgaggtgggctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcacgttgcaaggataagatgacagagctggtggttcaatgaatctgggtgaggttcctacttcaaacgatgttaaaatgctgtcgtagcttatctggtgaggtctcttttatgggttggcttcttggtagaaagggaatgtttggttattgcactgtcatcgtagtgttagaaccaacacaagcataggcactgagtagattgtcacggcagattattatgtacttcaattctggaatatttgatgggaatgctattttagattgcttggtaagaaaaaaaaaaaaaaaatcacagaagtagaaccagcttctgattcagccggaaccatttattgaattttatggtgatcactgattagtaatc

SEQ ID NO: 18134 - DNA, 3933 bp, Zea mays
  misc_feature (1025)..(1025): n is a, c, g, or t
  misc_feature (2656)..(2657): n is a, c, g, or t
  misc_feature (3019)..(3019): n is a, c, g, or t
  misc_feature (3026)..(3026): n is a, c, g, or t
ccccctgcagggattacgtggctataaagatggatggctcgagtattctgcgacttctttagagtaaagtgctttcggcaaggagaactgcagtgggtttgctcatggaactgatctgcttaagaaggtgcagtttcattcagagtttttttcttaaaaaattatgacaaagcatatgtatatgtgatgccatcttaactgccgatcaccaccaacactctgatttcgaacaggagagaaatggttgaattgctcctgcatggatcgagagcagagtcgatcgtggaggcaatggatgtgctgctggagtacctccggagcttgcccgcagaagaacaagccccaatcgccgttctactgatgtgtttggatgcattggtatacagctttaaaccctgaatctcttcttgttgtacgcttacatttccacttccacgaaatcgtatttcgtttgctagccgcctcagacatcgcctggaatttaatagtctgcagagaactctaactgaaacgcattgcaggtggagccaaacagaaacagcacgtacagagaagaggcgatcaagaccatcgcacgttctctgagatgctgcctgtcagaggacactgccgctcccagcactcggagagctctgctgctgcttctcaggcgaccttcacgcagaggactggatgctggaacatgccggcttcgtcgaccactcacgggccaccactgccacttctgatgctgttgtacacgtacagtgctgcacacccggtcaccttttacacacaggaaggcacaacacagtatcgacgagtagtttctgaagttcgctttgcggtgcccaggacaaggaagcgaccgaaaacgatgcgtggctgagacacgtggccgcggcgctactcggcagccgtagcgagatcaggagaccgttcctggaggcgctgtccacgtgcctgggctcccccgacgccggcctggtgggggcgtgcctgacgatggcctggtggaggttatcagtgagaaagtagatatctgngataaaccacctcttcagctatgattttgcactctggttttatgcaaatgttgcctatcatattattgaattgcaattattttttttgtactggttaaatactaatagtgccatgagttaacgttagtgtttgtgattttttacaggctcttgggtgtctcttgtatagaatctgcactgaatattaactgttggttatggttatggaaggtcttgttttcagctcatgaatataggtttcaaattttagttgtttttttattaggatggtcgaatataaaagtaactgattttattgtatgtacctgattaatctaaaagcattgaaataattctgctcttggctcgagtatgtatctgaagtatacagagaaatggaacgtgctggatgcgctccagatagaaaggctagagaaatgtttcatataaaaaaatttactaccgtcgcaacgcacgagcacatacctagatgagtctgtctgttactgcgaaaagctacatacaaattataattgagggcacattttcattactaatagtttttttgttttccttctttttttacctgaggttacaaagggtgcagggtattctccacgtcagtgtgtccaataatcctaaacaaggcaatatgtatttgctctttattatcaattcatgtgaaaatctgaaagaacgtggaacctgaaactattgtctggtgggctggtggctgattttcattcaattgggctggtacacctctgttttgactcccatacaccaaggtatttagacacccaggtcctcctttgaatccttattgtcatggtcatcttgtgtcgtgtctagatccgacgaattgtgtattgtttaatgcacagaatcgagggcgcctgcatccgtgggagtaagactctccggctttgaaggaggagacaaaggccgaagggcagacacattgccttctgttcatgctgcttgatgttgaaacaccaaccactcaccagtcatttactctctcacttgctcattggatcatgtgcaccgccatagttagaaacctttatgtcatagttagagcaatgcattgggattttttttgctatgcacagaatacgaaggttatattatctctctatattttgaatgggagtcattgaagcctaggcaaggtacttgtatttggatctggcataattacaatcatcctgtcatcatcagtttcactcctctggctgctcctttgtgtgtgtgtgtccactaatgcgttcagcattgcaactgctgctgccaaatgctgaggtatgccctttatttttcaacaaaaagtgtctttgtgactacaaaacaagttaacgttcagcattgcagtaatgtagcaaattttgttctgaatttttttttatcttcaatgtctggtccgtccgtccgtataaaaaaatgtttgcattcttctatcttcaggcagcagtatacatagctggttcagtttgtgcagcattcgttgccaacatagatggtcactctgataaatcaaattgtatgctgtcatttccttgaattatactagaataaaatcagaagctcacaatgagatttattggtctaaagtgaatcagaagttagttcacataaaaaactatgaccanncagttacatgtgttgcatagctccagaaggtggtagcacaaatcccataggcccagtaacccatccataaaagttttttgactgattgcttgattccctattctcacttgtaggttttgagaccgaacctatatgtaccaccaaaacaatatcctaattgcaagtaagcgccagtgccagtgcgcagcggtctctccttgcatagttttgttgtgggtacctaatggcctcgtctcgctcttcttggttcggttgtgttatgctactagggaaggtgaccttcctctcatcatcgcgattgactagcaaccaatggccctgataggtgttatgcaagtgtagggcgacatcactaatgctcngacaacngatgtggtgagacggacgcaaaagaagtataggtttgcgttgcctgcagttagctggctgtgactaattagtatggatttggtgtcatgttattaggcatttcgatggatgcaaagcagacttggttgtttgcgatggaggcttcggatagtaagatatcatatgagtgcaagagaactactctcaccattaactataacaaattttgtcaccagtgaggattacatgattactgctcttttgggtgactatagttactggccaccctgatatttgatacaattgatctttttttatctcatgctaaagaaatttggtggctggtggatctacttaagaatcaaaagtcagacaaggtggacatcaccatccaaccggaggagcaggaagccatgaatgatgttctagcagccaggtgacgcctgatgtctttgttcagttgatatagttgtctgattttttccttcttccaagttagaacggtctttcttgtacgtgtatttctacttcaccctcaacgaccgggtgctccgcgcgttcggcagccatgaccgcgtccacgtcatcaactttgacatcaagcaggggctacagtggccgggcctcctccagaaaaagaggaattgaagcagtatctgactcggtatattcataataatattacatatttatattgtacataatgtttcctatctcctaagccttgtttattctataatagaacatttttgtagaaaacttggtagaaaaaggggaggcctgccctgcatacattttcgaaggaatgtgaatatatcaggtactcttgtttctgaacgagtacagtcgagtagtatgctgccgcagtattatttgttgcttcaggaagcatgatatggttactttctcttactgctacagaactgca

SEQ ID NO: 18135 - DNA, 1744 bp, Zea mays
tgcagttgaggtaatctttttttcctgtaatcctatgcatttgtgatttggatttgtaacacttatttaactttgttctatgattttaactcatccaattaaatctgttcatatgtaccctataaacttatgactatattttctcaatcaatataaagcccaatcacttactctgttaaaacacatgtattttccatgttcagaatgtttaatctggtatgtagtatgaatacgttagatccatgaaaatttacattcagcatgttctctgttctaaatgttttcccattcagttcccatcaattttgagattgttttgtatataattcccagattgttcgagttgaactccaaggtgctgctgcatttctttattctcgtctggtacctcttgttcttcttctggttgaaggtaactgaaggttttgaaatatgatagtctgttttactcaggacttctatttgcttatatcattgcactctaggttccacgcctatagatattggagaacatggatgggaaatgcttctggtagtaaagaaggcaacacaagaggctggttcaaaatttgaactgctaggttttgcagctgtgcataacttctttcattatcctgagagtattcgcttacgaatcagccaggttggtcctcttccagctttactttctgtttatggggggtgtcctgtatttagtcaatttccttgaagttattccatggcactgctaggttctttttgcttttgcacccatggacagtctgttgttttagatgttaaactgacattgacagagttgcataaccatatattttggaaagtaaagcacgctttctgtctggctaggtgtttatacgattttgttgtatttttcagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtctcgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcgtggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattggggatgaggatgaacaaactgttgagcagcagccagaggatctcaagacgcaggagcaacagctcaatgagcttgtggacatccaaatcgaggagattgctggggtcgccaagaacgtcacttcacgtcgcaaggataagatggcagagctggtggttcaatgaatctgggtgaggttcctacttcaaatgatgttaaaatgctgtcgtagcttatctggtgaggtctcttttatgggtaggcttcttggtagaaagggaatgtttggttattgcactgtcatcgtagtgttagaaccaacacaagcataggcactgagtagattgtcacggcagattattatgtact

SEQ ID NO: 18136 - DNA, 1489 bp, Zea mays
gtggtttttttaaaaattgaactaacaggccagattgaacgctaagagaaacatggacgggcaccaatcatttacaaaacgaggttagctgccaccaacaacccccttacatagtgcaggtttctgaaccgtgcaagtggtaagcccaagaagtacacaaatcagcaacaattggtaggagatactgggtttcatacatcagctaactttctgccaccaaaaagtttcaagacaccccagcgattcccagatgcaagcttgtccaacgcagccacctccataactgagctccaatcaccagattacaagctactagtttcatcagtcctcgctttcgtagtaggaacttgctctagttatgtagaccttgaactttgtttgctcaatcagctggaagaccaggcaatctccatccaccagcttctgctggacggcaaaccctctccatccagcactgagcccccgcttcattgcgaggtacagcgtgtcggactcgtcatcatcctcatccaccagggtgatcatctcgtcacgcttgggcagatacttccggcagaaatgaatcggaaggcccagccagaagcccccggtgacatgggactgggtcatgggcttgatgaagatggggaagctggagtccagctcttgctccagatcctccgccttagagatggcgtagctcctcgcatcgtcggtcgcgtacacccggttggtcagatctcttctcaccgatccgtacgtcctcctaatcttcatcccaaaatcgggaaccttctcgcggtacacgggcttatccgggaggttggcgagccggccggaccgccgtactggctccatcacggcgtcggcgacgtcgagaggcacccgcgccttccgcttcttgacctgcagtatgtgagatcatccgttgactgcctccgtttgctcatgtttgatccgatcaaacctgcacttggtgctattgtctcgtctctgaaggagaccaacctgtcaaaaagggcccaaagtttgagaatggttccaccggctgacctgatggagactgttcgttagaagctgaagataaagaagaaacagttcctccggtgctgggaaattctgatcttcctaagcctcgactctcaggatcataagagcatggacaacttcagggcctgcatatatgacctcatgaagggggagatccttggcagtgcctctggaactaacaggaagcgtctgttgcagatgccaaccagtttcaataaggaggcatcttttgctgtgtattggacacatgagattggggatgaggatgaacaaactgttgagcagcagccagaggatctcaggacgcaggagcaacagctcaataagctcgtggacatccaaatcgaggagattgatggggtcgccaagaacgtcacttcacgtggcaaggataagatggcagagctggcggttcaatgaatctgggtgaggttcctacttcaaacgatgttaaaatgct

SEQ ID NO: 18137 - DNA, 1083 bp, Zea mays
tttttttttttttttttttttttttttttttttttttttttttacaaaacgaggttagctgccaccaacaacccccttacatagtgcaggtttctgaaccgtgcaagtggtaagcccaagaagtacacaaatcagcaacaattggtaggagatactgggtttcatacatcagctaactttctgccaccaaaaagtttcaagacaccccagcgattcccagatgcaagcttgtccaacgcagccacctccataactgagctccaatcaccagattacaagctactagtttcatcagtcctcgctttcgtagtaggaacttgctctagttatgtagaccttgaactttgtttgctcaatcagctggaagaccaggcaatctccatccaccagcttctgctggacggcaaaccctctccatccagcactgagcccccgcttcattgcgaggtacagcgtgtcggactcgtcatcatcctcatccaccagggtgatcatctcgtcacgcttgggcagatacttccggcagaaatgaatcggaaggcccagccagaagcccccggtgacatgggactgggtcatgggcttgatgaagatggggaagctggagtccagctcttgctccagatcctccgccttagagatggcgtagctcctcgcatcgtcggtcgcgtacacccggttggtcagatctcttctcaccgatccgtacgtcctcctaatcttcatcccaaaatcgggaaccttctcgcggtacacgggcttatccgggaggttggcgagccggccggaccgccgtactggctccatcacggcgtcggcgacgtcgagaggcacccgcgccttccgcttcttgaccagcgagggcttggcggcggcggcggcctctctgatggcagcagagaggtggtggagctgcagctcctccagcttccgtttgttcgcctccacctgcctccgccgctgctcctcgtacggcgtcgcttccgccatctctcttctctctcccgtctttgtgtatattgttattgctgcggttatgttcttgtgtttttttactcagttttttattaagatcccggccgg

SEQ ID NO: 18138 - DNA, 2437 bp, Zea mays
  misc_feature (1000)..(1000): n is a, c, g, or t
  misc_feature (2411)..(2413): n is a, c, g, or t
  misc_feature (2418)..(2419): n is a, c, g, or t
  misc_feature (2421)..(2436): n is a, c, g, or t
ggttacaaagggtgcagggtattctccacgtcagtgtgtccaataatcctaaacaaggcaatatgtatttgctctttattatcaattcatgtgaaaatctgaaagaacgtggagcctgaaactattgtctggtgggctggtggctgattttcattcaattgggctggtacacctctgttttgactcccatacaccaagaacaagaatcgagggcgcctgcatccgtgggagtaagactctccggctttgaaggaggagacaaaggccgaagggcagacacattgccttctgttcatgttgcttgatgttgaaacaccaaccactcaccagtcatttactctctcacttgctcattggatcatgtgcaccaccatagttagaaacctttatgtcacagttagagcaatgcattgggattttttttgctatgcacagaatacttgtatttggatctggcataattacaatcatcctgccatcatcagtttcactcctctggctgctccttgtgtgtgtgtgtccactaatgcgttcagcattgcaactgctgctgccaaatgctgaggcagcagtatacataactggttcaatttgtgcagcattcgttgccaacatagatggtcactctgataaaactgtcaccttcaatgggaggatgctcaggttttgagaccgaacctatatgtaccaccaaaacaatatcctaattgcaaggaaggtgaccttcctctcatcatcgcgattgactagcaaccaatggccctgataggtgttatgcaagtgtagggcgacatcactaatgctcggacaacggatgtggcatttcgatggatgcaaagcagacttggttgtttgcgatggaggcttcggatagtaagatatcatatgagtgcaagagaactactctcaccattaactataacaaattttgtcaccaaaatttggtggctggtggatctacttaagaatcaaaagtcagacaaggtggacatcaccatcncaaccggaggagcaggaagccatgaatgatgttctagcagccagccatgaccgcgtccacgtcatcaactttgacatcaagcaggggctacagtggccgggcctcctccagaaaaagaggaattgaagcagtatctgactcgaacatttttgtagaaaacttggtagaaaaagaggaattcctgcatacattttcgaaggaatgtgaatatttcagaactgcagtgacaaatggtagtgccattaagcatgatggctcatatgaatcagatcctgcagttgagattgttcgagttgaactccaaggtgctgctgcatttcttttattctcgtctggtacctcttgtacttcttctggttgaaggttccacgcctatatatattggagaacatggatgggaaatgcttctggtagtaaaaaaggcaacacaagaggctggttcaaaatttgaactgctaggttttgcatctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgagatcatccattgactgcctctgtttgctcatgtttgatccgatcaaacctgcacttggtgctattgtctcgtctctgaaggagaccaacctgtcaaaaagggcccaaagtttgagaatggttccaccggttgacctgatggagactgtccgttagaagctgaagataaagaagaaacagttcctccggtgctgggaaattctggtcttcctaagcctcgactctcaggatcataagagcatggacaacttcagggcctgcatatatgacctcatgaagggggagatccttggcagtgcctctggaactaacaggaagcgtctattgcagatgccaaccagtttcaataaggaggcatcttttgctgtgtattggacacatgagattggggatgtggatgaacaaactgtttagcagcagccagaggatctcaggacgcaggagcaacagctcaatgagctcgtggacatccaaatcgaggagattgatggggtcgccaagaacgtcacttcacgtggcaaggataagatggcagagctggcggttcaatgaatctgggtgaggttcctacttcaaacgatgttaaaatgttgtcgtagcttatctggtgaggtctcttttacgagttggcttcttggtagaaagggaatgtcacggcataggcactgagtagattgtcccgacagattattatatacttcaattctggaatatttgatggaaatgctattttagattgcttggtaagtgggaaaaannnaaaannannnnnnnnnnnnnnnng

SEQ ID NO: 18139 - DNA, 5738 bp, Zea mays
  misc_feature (2496)..(2496): n is a, c, g, or t
  misc_feature (3446)..(3446): n is a, c, g, or t
  misc_feature (3489)..(3489): n is a, c, g, or t
  misc_feature (4041)..(4041): n is a, c, g, or t
ctgcagcttctttcggtgctttatactttatcgttgttgtgcaatatgttatacttgaatgcactttatgctttgtaattcttatcttgcttgtgtttgcagattgagggaacttggtcgtttcatctgtaacattataacagtcgtgcctaagggagttgttatgtttttttcttcatatgattatgaaaggcgtgtatatgatgcatggatgacaacaggcacaatttccaggatttctaaaaagaaacatgttttcagagatccaaggaacagtgctgatgtcgaggctgtcctcaacaaatacaaggaggcaattgaatcctgtagtaatttttcccaagacacaggtgtcaatggggcacttctattagctgttgttggtgggaagatttctgaaggcataaatttcagcaacgggatgggtcgttgtgtcataatggttggcttgccttatctaagtccatctgatgtgagctgatagagacgataaagcatatcgaaagtatttctagctcattttttgctggagatgataaggccttaagcagaaaatatgatgatgaatgtgaacttcagcctggttatgatatattacggaagtgcactagaggtggaagagagtattatgagaatttatgcatgaaagctgtgaatcaatctattggtaagctgcttctcctgagcatttgtcatgcatatagcactgtttaatttcatccttatatggtaagatgaaataattgcaggcagagcaatcaggcacataaatgactatgctacaatgctattggttgactcgcgttatgcacagacttcatcaaccaagagtttttcctgcccggctgataagcttcctcaatggataaaagcacgactctcttgtgctcaaaactatggagaagttcatagatcgttgcaattcggctcgaggttcaataaaaaaaatgttgaaatactctagaaaccaccaagcattgccattgttgattcattgcaaacaaaaatacaggtgtatgtactcgtaaaacgtagcattgtgtttgtgtatccttatgctgcttacttatgagcaaggcttcagcctgcgcctgcgaatgcgatcagagttatgtacagaattatggtgacagtaacgcttcctcttaaggaattatggttagatccatatttcttttgctcgagattgtaaaacaatatcacaaatgtgattattcagtccttatcattgtttcaattctttcatgatagcaaatcttatagacctcattttactgacgcagaacaaatgaaattcatgtgttactacactaatatgttggtatattttcgaagtgaagtgggatcagtgtactattttgatccttgcaagttatgggatttaaatttcatattcttgaattctacaacctaggcaagtgatatttatgtatgcagttttattagttctgctatttgtctgtttgtttttttttaaatagggagaggaattgggctaagcagaaagaaagttgcagtttgcagctttttataataccaaccgtgtgctgccaactccttcgctcgcccttgcttttttcctttctcacttattcctctcttcctcaaaaaacgccgatggtgggaaagagagatggcaaaggcaggaggcaggccaagggtgagaagaggaagcgtcctccttctccccggtcagtggactttagtgactcggagctctccgacgagaggactccttcgtcgtttcttggctctcgctgttcgtctgcatgaacgactccacggggctatcggtgggggagagggcctacctccgcaacatcgagcacgccgacctcaatgacttggacgagtccgaggaggaggatttcgaggtgaaggacgaggatgaggacaacaggtacgacgacggggatgaaggcgacgcgaccatcaaggtcgacaacggtggcaacaaggacggggcggtgacggcggcaaaggcggaggcgacgacaacatcagcggggcagcaacaacggcgacaacaagggcagtggtgatagcaaaggcgccaacggcggtggcaagggcaagggcggcgacgccggtggtgaggcaccaccggcttaagtagtagtagtaggtgtagtttaggggtagcaataggggtaggagtagggctgtaggagtacgagtcttttgtgaggatcagttcacaatgaactgattctactcgtgaaatgacacccctcttatataataaagttctcgtcttctatcctttgagtactgagttcttttttgatctcattctgcgtttgaggtccgatcgatggtattgagttcttcatttcgttcagttgaccgcatccctgtgccttagccttgatgactgacttctcctaaccgacttatacgccgaaacgagttctctgtccgacttaacttgtctgactcatcatcttttctttcgatctaaacaaatatttccctggtgctggtacttaaatatgngcttatgcctgacggtttccgcgctcacgagaggttgtaggaaacagtgatgcctaagagagagaggggggtgaattaagacttctaaaaactatctctaaactagaccacaaataaatcattagaacaaaaacctatgcaaataacttaactagattatgcaaattaggttttgtctaatttattaacttaagaaaagtttgttttttagttttatgagaacccacaaaatctagtttatggtggacccctcacaagcatcatccaacagttgtggacctcttacaagcaccatctatcagttaatcaataattttttagccatatcatgtactaacttgtgaaagagtgcaatagttattatcatgattatagaagttattggcagatttcaaactcaaaatacaaaattgagttatgtgcaccaattagtgaggacctagtagcaagagatggacactgatgcaaagttatcatgatcccttatttaatatttaaacaattgaataccaagttgattcatatagactaatgaaaccctaacttaaagcactaaaaccataatagcagtgaagtggacacatttgacaaaccctaaaacactaaccccaccaaaagggagaaatagtctaaccttcttcttacctaagcatgacctagtgcattggtgattgcctttcccaagcatcttgttactgatgtcgatgtcgctggacctttgattcacttcacagaggccatagttcccttctttttggcatctcatggcggaccattagtgttggttgtggttgacaccaccaagattttgccctgctctatggtgttctaaggggtcactatcctctcacgtcgattgcacgtgatgttgggtcattgcgtgtgggccctaggctcgcgcgtcagtgacccaccccgacgtcagaggatcccaacacgttctaagcgancacacctttgccccatcgattgacaatgctccaccatgcatantatgtgaggtgcaagatggaaggcttggcatgcatgctcacaagagtcgactaggtataacatgttttcatgcactaggatccaccacccctccgacaatttcttgatggctggtttgctagataggaaaatgtagtggatacatgtaggaggaatccccttgctactcaatattgaatagcaaggggattactctccataggtctcctccattttttgtccaccaaatcagctctgaaggggcgaactggtcatgtgtgttgcatggttgcgccttggtgatgaagtcgcgtcgctctcttgacattgctgggcgtgcgaggggtgacggaagtgacaggggttgggagagatgatggattttacaattttcagccctacttggtggtctttttattactagtacaatattagaattatattataaattgtgtacgaatcgagtcactgagtgaattcctaaggacatgtaaaaaactcagacgctgacttggttttctaagtacaagagacatttaagaaactctgtgatacaaccctgagcctctgtancataaatacagttaagagacaatattacatagagagttttgaaaagacggattgttcaccaatagcatgtctcttatattttgtttaatctaacccctagagaccctttaaaagactacatataaaatgggttgtacatgccctaattattgtattgcacacatcgcagtcgagtcgacactcgagactcgacatcatgcactaatgccaatgcccttgtgtgtagggttggtaatggatgacgatacaaatgtttctatacaataagagttaggattcttaaaaaatttagtttaaaaataaataaaaatagagtctgatcttaatttgattcgatcttaatttgattcgatttttaaattttatagtgtaattttagagcttgcctctattaacacccctactcatgtgtgactggctataaataaccataaccactatgagatggacaaaacagcagccagtatcagctgcctcctctctttctcgacccatagccacatcctcgccccgcgcggcggagcattcagtcatttgccactaccctcacggcctcaccaagctcttccaagcaatccatggagtgtagcaacaaaagtggtgaccggcggctaatggaccgcttcagccagctgctcctctgtccggccaacactttcctcggctcccggtacagctcatcctcgttgacctccacggttttcacagccaccgctgccgccgcctccacaacgctatcgatctcttccacttccaccaccgcagccaactacaccggccgcgccgatcctttctcagccgctctcgaccgccctcctcccgagcgcatgcgctgcaacaaggagcagcacaaggataaggggaagcttcaagaacgccgtcggcggcgcttcaagaacgccgtcgacaaagacggcgtccggacgctctcgtccaacccctacggcttcacctcttctggcgaggaggacgatggcaccgacggttacggcgacgacgaggacacagagactttcttgtcctcaagaagcctcttgtccttcgactcttctggcttctacgcgtacaggaagctgctgaagccaccgtccaagaacaggagccacctcggccgccaggggagacgccggcgttgctgtcggcggccatctgcgagctgcgtggagacgtgcaacgcaagagccgtgagggagcctgggttccgtcctctggtggtgacgacgacggccaccgctgccgcgctggagcaggtaccgaaggggctggccgtggtgaagcggtcacgggacccttacggcgacttcctggagtcgatggtggagatgatcatggggcgtcaggtgttcggcgcggcggagctgcagcggctgctgcggtcgtacctagcgctcaacgcgccacgcttccaccccgtcatcctccaggcgttctccgatatctgggtggtcatccacgtgcacggcggctagcgcctaacgctggccgccggcgttgttagatcaaactgcttagattgtgcatgcattgacgcagctgaacgtaattgcatagcactgtatgcttgttgggatgtaaaatgtggtgttaactaggctggtttgagcatctccaagagttctctcatgtgtttgtttctaagattattgaggtattcaagtcgccaaaatgtactaagagcacaaaagaccactttctgg

SEQ ID NO: 18140 - DNA, 1538 bp, Zea mays
cccacgcgtccgcccacgcgtccggcaggtgatccccgattcgctgccttatccgctgaccgctgctactgccgcaccaaagcgtgagcaagcttcccgcgagagcgctcaaccagccaagcgggcgtcggtcagaggtgagcagagtaatgtcgggagcgaacttcctctccaccgcggcgctcgtcgcccgcggcgtcgctgcctgctcttctatttcaaccccgacacggaggcacccgcaaatccggctgtgctgccgggttgacgctgaggcctatgcccatgaagagcgcctgcgattccgtcggagagatttcatcggcacctgcgtcggcaccgctgttgctttggaaatgatcgacggctctacgagtttctctggagtggctactgcagctgatctcattgagcgtagacaaaggtcggagttccaatcaaaaatcaaagacaccctttacgtagccataaaggctaagccagagctcgttccatcgttgttgaccatggcactgaatgatgccatgacatacgacaagaccacaaaaactggaggcgcaaatggatctatcaggctagaaacaagcagacctgagaacagtgggctctcttccgcgttggatttgctgactgaagccaaaaaggagatcgattccttttccaagggaggtcccatttcgtttgcagatctgatccagtttgcagcacaatcagcactgaagagatcgtttcttgacgctgccattgccaaatgtggtggaaatgaagagaagggaagaacactgtactctgcatatggttcaaatgggcagtggggtctgttcgatagaacgttcgggagagcagacgcacaggaagcagatccagagggaagagtgcctgactggagcaaggcttctgtgcaggagatgaaggataggttcgtcgctgttgggttgggtcctcgccagcttgctgttatgtcagcgttccttggacctgaccaggctgctacggagggacgactgatagctgatccggattgccgtccatgggtggagaagtaccagcggagccgcgagaccgtctcccggactgactatgaggttgacctgataaccacactcacaaagctgagctcccttggccagaagataaactacgaagcctacacataccctaagcagaagattgacctgggaaaactgaaactgtaagagttgattgccgggcacctgcatcggccgtatccaggaatcgggagctaattgtatggtaggctctgtctgctagagtgatttgattcggcgctgacgtccaagtattggctacttactggtcagctgtcagacattcttcccacggcaattaggatggtccctgtacatggttaaattggttctcccatttcgttttgtgtgaacttgaagaggcaaacgcttgtgagaagtgaggtgttgtgtcaatccccttacgtatacgagacgactgaagaattagtagaaaagaagtgcaagtgtcaaaaaaaaaaaaaaaaaaaaaaaaaaactcgggcccgg

SEQ ID NO: 18141 - DNA, 1521 bp, Zea mays
agggtgcagcccgcgatctgtaacgtgtggcgcagcgggcgatctccgattcgctgccttatcctctgctactgccgcaccggccggggagcaagcctgcctcccgcgagagcgctcaaccagccaagccggcgtcagaggcgagcagagaaatggcgggagcgaacttcctctccaccgcggcgctcgtcgcccgcggcgtcgctgcctgctcttctatttcaactccgacacggaggcacccgcaaatccgggtgtgctgccgggctgacgttgaggctatggaggcctatgcccatgaagagcgccttcgattccgtcggagagatttcatcggcacctgcgtcggcaccgctattggtttggaaatgatcgacggctctacgagtttctctggagtggctactgcagctgatctcattgagcgtagacaaaggtcggagttccaatcaaaaatcaaagacaccctttacgtagccataaaggctaagccagagctcgttccatcgttgttgaccatggcactgaatgatgccatgacatacgacaagaccacaaaaactggaggcgcaaatggatctatcaggctagaaacaagcagacctgagaacagtgggctctcttccgcgttggatttgctgactgaagccaaaaaggagatcgattccttttccaagggaggtcccatttcgtttgcagatctgatccagtttgcagcacaatcagcactgaagagatcgtttcttgacgctgccattgccaaatgtggtggaaatgaagagaagggaagaacactgtactctgcatatggttcaaatgggcagtggggtctgttcgatagaacgttcgggagagcagacgcacaggaagcagatccagagggaagagtgcctgactggagcaaggcttctgtgcaggagatgaaggataggttcgtcgctgttgggttgggtcctcgccagcttgctgttatgtcagcgttccttggacctgaccaggctgctacggagggacgactgatagctgatccggattgccgtccatgggtggagaagtaccagcggagccgcgagaccgtctcccggactgactatgaggttgacctgataactacactcacaaagctgagctcccttggccagaagataaactacgaagcctacacataccctaagcagaagattgacctgggaaaactgaaactgtaagagatgattgccgggcacctgcatcggccgtatccaggaatcgggagctaattgtatggtaggctctgtctgctagagtgatttgattcggcgctgacgtccaagtattggctacttactggtcagctgtcagacattcttcccacggcaattaggatggtccctgtacatggttaaattggttctcccatttcgttttgtgtgaacttgaagaggcaaacgcttgttataagcgaggtgttgtgtcaatccccgccccgtataccagatgtgtgccgaatcagtacaaaaaaagtgccagctgtcggaactt

SEQ ID NO: 18142 - DNA, 1432 bp, Zea mays
ttgggaccctcgaagccggccccacccggcctccccagctgcctgccactgcaactctgcgagtgccagaaaaaaaatactgccacccaccaccgcgccgccgcgccatggcttccccatccccttcctcgcccctccacccgcaccagcacccacctcctccgaatgttcaccaccaattccaatccctaccgccttcgatgccgccaccgccgccgtcaacggcgctgccaaaggcgctcgaccttgaggttaccgtcgtctgcgggaagcacctgaagaatgtcaactggcgccgtggcgacctccgtgcctacgtcgtggtgtaccttgacccctcccgccgcgccgctacccgccccgacgacggcggcgggtgcaaaccaacctggaacgagcgcctcgtcctcccgcttccgccccacctctccccgcacgacccctccatcctcctgtccctcgacgttttccactctaagccctccgattcgcccaagccgctcgtcggatccgcccgctctcctctccgcgacctcctcttccccgcaaaccctaaccctagccacgatcccgcagcctccgctctcgtcagcctgccactcctccgcccttccggccgcccacaggggaagatccggatccgcgtcgccatccgcgagcgctcgccgccgcctccggagccgcaataccctccgccttccagctccccgtactactttccaccgcctcctcccgcctactcggccccgcctcagtacggatctgaccagtactatcgccctagtggatactactctgcacctgcacctccaccacatccgtatgagtacaccggagggccctctgcaccggtggactacaacaggcaatatgagcagagagggaggactggggccgctggtagtggcagtgggaacggaaggtatggagcaggcactgggcttgcggtgggtgctgtggctggagccctcgggggtctagcaattgatgaagcggtgaagtacaaggaggataagggtgcagaacgggtggaagagaaggtggtacctgctgggagggatgattacagcgagtatcgtggcgactattgaaccgaagtttgtgtgagtgtggaagaaagcgctgtgagttgattcttcttccatgcctatgtgggaataaatccagtgttagtctatggctttccccatgtatgtatatatatttgtgatgttgtgaattattctgatacctataaactactccttcggttcttgtttatttgtcgctgtttagttcaaaaatgaactagcgggcgacaaatattcgagaacggaggtagtacaatgttttatgatgacagatttggtgtgtaacataaatatctcatggcttgctttgatggtgcaaaaaaaaaaaaaaatcttgatgagttctctctctctcctcgtgc

SEQ ID NO: 18143 - DNA, 1706 bp, Zea mays
  misc_feature (1698)..(1698): n is a, c, g, or t
gggacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcctctcgccaccacccgcccgcccgggacttcttaatcgttgcccactcgccctcacggcggcctcatcacccacccggccgccccagctgcctgccactgcaacactgcgagtgccagagaaaaaaatactgccacccaccaggccaccaccgcgccgccgcgccatggcttccccatccccttcctcgcccctccacccgcaccagcacccacctcctccgaatgttcaccaccaattccaatccctaccgccttcgatgccgccaccgccgccgtcaacggcgctgccaaaggcgctcgaccttgaggttaccgtcgtctgcgggaagcacctgaagaatgtcaactggcgccgtggcgacctccgtgcctacgtcgtggtgtaccttgacccctcccgccgcgccgctacccgccccgacgacggcggcgggtgcaaaccaacctggaacgagcgcctcgtcctcccgcttccgccccacctgtccccgcacgacccctccatcctcctgtccctcgacgttttccactctaagccctccgattcgcccaagccgctcgtcggatccgcccgctctcctctccgcgacctcctcttccccgcaaaccctaaccctagccacgatcccgcagcctccgctctcgtcagcctgccactcctccgcccttccggccgcccacaggggaagatccggatccgcgtcgccatccgcgagcgctcgccgccgcctcctgagccgcaataccctccgccttccagctccccgtactactttccaccgcctcctcccgcctactcggcccccgcctcagtacggatctgaccagtactatcgccctagtggatactactctgcacctgcacctccaccacatccgtatgagtacaccggagggccctctgcaccggtggactacaacaggcaatatgagcagagagggaggactggggccgctggtagtggcagtgggaacggaaggtatggagcaggcactgggcttgcggtgggtgctgtggctggagccctcgggggtctagcaattgatgaagcggtgaagtacaaggaggataagggtgcagaacgggtggaagagaaggtggtacctgctgggagggatgattacagcgagtatcgtggcgactattgaaccgaagtttgtgtgactgtggaactaagaaagcgctgtgagtcgattcttcttccatgcctatgtgggaataattccagtgttagtctatggctttccccatgtatgtgtatatatttgtgatgttgtgtattattctgatacctataaactactctctccgttcttttttatttttcgccgtttagttcaaaaatgaactagcgggcgactaatattcgagaacggaggtggtacaatgttttatgatgacagatttggtgtgtaacataaaggtatcatggcttgctttgatggtgtacttgtgtcttgatgaatgatgatgggtgttatctttaccagcaattgtattgctctgttttcagtttaaaaaaaaaaaaaggaaatccgnagggggaa

SEQ ID NO: 18144 - DNA, 888 bp, Zea mays
  misc_feature (702)..(702): n is a, c, g, or t
  misc_feature (712)..(712): n is a, c, g, or t
acaaccatcaggacgcggacgcggctcacatcaaacaccccctcctcccccttcagctgtgctcactgccgcaaaaccacacagccacacaggcaaccagcgcccagcgccctttgacatcaccacatccacgctccgttccatggccatgtcgagcagcgccagcaagaagcaagcccaggcccaggcccagaaggccgggcgaaggcccccggcggtgtcgtcggccgcggccgcggacgcggagatgcagagggtgttctcgcgcatcgacgcggacggcgacgggcggatctcgccgtcggagctggcggcggtgtcgcgcgccatctccccgccggcgagctcctcgcacgggcggcgcgaggtggcggccatgatggaggagctggacacggaccgcgacggcttcgtggacctgggcgagttcagggcgttccacgcgcgcggcgccggcggcgacgacgacgacgacgacgccgagctccgcgccgccttcgccgtgtacgacgccgacggcgacgggcgcatcacggcggccgagctgggcagcgtgctcgcccgcatcggcgaggggtgcagcgccgaggagtgccgccggatgatcgccggcgtcgacgccgacggcgacggctgcgtcgggttcgaggagttcaagatcatgatgcgccccccccagccccagccccagccccaggccgnccccggagtnacaccgtgccggacaaggccaagaaggagtgacgacaggtgtaggtgtactcatcagggcatcagtcggggggaagggatcgggttcctctgcctcttctgttgctttcacctagtctggactggaggaatggaaatactcaacttcctgcataagactacttattatctacagta

SEQ ID NO: 18145 - DNA, 1694 bp, Zea mays
atttttcggcccaaatcctctcacccaagccaacaatttcacgctgggtccctccgccccgcccctctaaagcataggcatagctcgccgaaacgccgacctaaacgcccacaattcgcctctccgatccggcacgacaccgccgccgatccccatcgtcacggtagccatgtccaaccccggctcgtcgcccgcctccgctcaccacgaccacgaacacacccctctctgccgctcctgcggggcgcccaccacggcgccgaccccggcaccctggtcagggaccaccgactccccgccgccggcgtaccgccccatccgtctcccagccatcaacgcgcccaccaacacagccgccatagtcctctccccggtcccacagccgctccccgtgcctcccgccgcgccgccccacgccttcctggtccctgccaagcggatcacctcaccggacgacatcgcccgcttccatgcctccgtccacggccttcacttcctcgggttcgtcgccgcgctgtccgcctccgtccacggccgcaagctctcggacccgctaccgtccccgccatcccccgccatagctgcgctgctcgatctcgtctcggctctcgccgctctcgtcgcttccacccctccgcttccacacagctctcggtacggcaaccctgctttccgcctgtggcacgagaagctcaccgactccgccagcgagctgatctcgcggatcacggccaccgcgtcttcccctgcggacctcgcaggcgccgatgtcgagctagcaccgtacctcctcgactccttcggcaacgccacccgcatcgactacgggacggggcacgaaaccaacttcgccgccttcctctactgcctcgcgaggctcggcctcatcaccgagcccgactacccggccgtcgttctgcgcgtcttcacagcttacctcgatctcatgcgcacgctgcaggacacgtaccagctggagcctgcaggctcccatggcgtgtggggacttgatgattaccatttcctgccgttcatatttgggtctgcacagctgattgaccacaagtacatgaagcccaagtcgattcacaacccagatatcttggaaaatttctccaaggagtacatgtatctggcgtgcgttgcatatgtgaagaaggtaaagaaggggccctttatggagcattcaccaatgttggatgatatcagtggagtggccaattggaagaaagttaacagtgggctgctaaagatgtacaaggctgaggtgcttgagaaagtaccgatcatgcagcatttcctctttggctcactaatcaaatgggaggactaataacatctttagggaagctcaccaatgatccgtgagaactcatgtatgatgtgaagactggcggtatagtggtgctactcaaagtttgtagaaaaaggaatacatatagaaggtcattttccatctagggtgaatgagcgttctatatgtttgcatagcgtgccatcacacttatcttctggtgctctaaattctgggaacctgtttgttagttcacgatcagctcaggattcccttggctccttgagggcaatgtaatgttagttgaacaacacctttgcactgaaactttcggcgtagatgacaagagcagtctctttggttttcctgaatggaagcctgtgctgtgcttgctatattc

SEQ ID NO: 18146 - DNA, 927 bp, Zea mays
ggccacggggtaccgggcccccccctagagggtcgacggtatcgataagcttcactagcagcagtagcatcatcactcctctcttgcctcctctcataatactgagtccccatgaaatcaacaagcagagtgatcaaagcagccaccatagcaaagaacccaggaaatggaaacttagaccaagggaactccggcaaacaagcattggtgagagcttcagtgccaccagcaagcatgtggacaaagccagttgctagtatgacaccagctgcaaaggccttagcagatacaaagaggttcccttccgtttgaaggaagcggcggttcttgccaacgagaggtatggctacaccagctgctccagataggaagatggatgcaatggctacgaatttgagtacaaacgcagctgagtcgtctctgcagaggtcagattcgccggcgtcacagaggattttgggagacgccatcatctgcaaaattgactctgagagagaatctgttcctgatccaccaccgaacaagtacagaggaaacgatttccaaagaatatcgacgatgatcatggggaacaaagagagagtatattcttcttctttctcgggatcaatgcgcagaaagccaaacctttattatatgtgagaaaccgaaaagaaggaagaatgttggagaaagagtgtcgacattgtcagcaagaacaggctgctccgtggcagctcaacactgatgagagactgacgcgatccaaatcctctctcaaactttgtctatacttagctaaatatgtcgacattctcatgttattcctctttttcttttccctttttccttgtgatttttagagacttttaagctagtgctattcttttctctcttttttcgattaaggaggttctagggagtggccccgataaagtgggaacgtgg

SEQ ID NO: 18147 - DNA, 2317 bp, Zea mays
aatgtagacattctagagtaatggtacatattagtgacacattttggttttgtcaatgcaggcacaaggatcacttgaaagagatgatgaggtaatacttgaggttgaactgtctcgtttattgctgtcctgttcattttagtttgttgtaacatgcaatgtgatagctgctgtttcctgaatatgaaagatttcaatggaatcagctttttatgtaggagagacataattaacctgttcttttggggggaatttggtcattttggtaatgaagtgcaataaatatgaaatatattgtttttgcgcacatagaaaacggttgaacgtttcccacatcttagtggactgtttcttcattctctttcaggatgtgtattttgatgatgaatcagctgaggtgggtatatcttctttgcgtctgggagatgaccaggaagggtaatttactatcttgaaatgttgtcacctttagttttcatgtgtaggctgatagattatgcatctatgtatttcagctccctctttacaaattcaaactggttcacatttgatggagagagaggcattgatgaccgatcatctgcctctgttccttcatcatcccccaattctgaggagacatcactaaagactgaggaagctgatgatggtaaagtcattggcactgaggatgaaatggaaacagtgtacctcgcgtccggtagtgttgaggaggtaaaagatgtagcagaatgtactgaacagccaaattgttgtactgaggaagagcgattgaaaaatgaagaagggatggaatggcatccaaatgcttcaaataacgataccgaggctgaggctgccgcagagtcttcagccccatcagttgagatagtggcagagaaaacagtagatgaaccattagaggtgggaagaaaattggatgaaccggcagaatcatctttggacagttctgtctctgtagctttgccagctcctgttaacggtagtgagcctgccaactcggaagtatcttctgaacaagtagcccatgccactgatgtgcagcaaccagtgaaggaagctcctgccgaggatgatgatgcaaagaaaactgatgcagccaaaacaaacgagtgaagtagcaacatgctgggctgagctgatcagagcgattgcttgtgaactgaaaactctgtagagtgcagcttgggcatccatcttgcttcatgtgtgctcagctgccacaagatagtctgaagcaaactgctgtacaataagcaagtaattgctctaccatcaaccgtggcatgccactgtacaaatgagcaccactgactaacgcacgtcagtcgccttgtctgaaactggtcattttctttgaagttcaccctccagtccatgtgctttggtggcagtcttcatggcatggtatatgatacctgaaagaacattctttgggtggcaactggttttggctacttagtcttctgttgctttaggttaactttggaactgtaatatgagatgtgattttatttctagtctagctattgtatttttttttcggactctacatgtgtcagttcgatttgaacatgttatttttttcataaagatttgaagacatcttgatcgacggctcctcgtctaccccaccccacgtcctcttttccctctctctagactttacagtcattagtcgcggacttctagcagtttttttttaaagacggcacgaattctgtctttcaattaggaaaggaaagactttgcaaacagcaaggatcaaaagtgttcagggagctaaggctatccactcgttataccccatttctctaccctaaaagtactctatcctaattagcaagatttcctattctatccaacaattctcctcggtcacaattacccgctgcccactgcagacaacctaagacatcctagagagagagtttgtgccaagaaacctcagcaaagcactcctagagagagagtttgtgccaagaaacctcaacaaagcacaagaccacatcaataaacacctcttgcataggtcgatatcctcttttgcttatgaacattatttatatagtagaacttaaaatagaagatatgatagtaggtgggatagaaaagctattaaggacagccttaacatatatcgttgaaatcaccgcccttggagtgccctacaccaaaagctgatctccaaggggccaagcatgcatgagatgaacatattaatgttttaagctgtaaaaatatgtatagtagcatcagttactcaaaagtatctcatcctcaagagaccattgattcgttttttaaaatcaaactt

SEQ ID NO: 18148 - DNA, 2762 bp, Zea mays
ctgcagatacattccagcccggttaacccccgatgcccctctcctttccctcatcagctcaacggataccaggcgcacaatgctgctgcctgcctggccgcacgagctactatgtagcacagatgagcacccccgcccaccggctgccagccacatgctccaccatgttggcaagcaatgcacctccacacccatgaagatcctccatgcctgcatcaaagcacgcacaaacgcagcatggacgaggtccacagtcaacaggtttccatcatgctgacgatgcacctccaccgtgattgttgcaatatgcacaggtgctgattcagtagcgagtcaacaacttgcagttccagtgaccttcctttccaaatcactatctagtttttttaagttcttgagcttttggttgattttcctgatctggtattgtatgttcccatcactttacccagaagcgagtaggtggcatggctgcatgacccaaaaaattcaagtagtagttgtgccactgtgctagtacttcatttacaccagggctcctacttctatgtttttgtgtgatttatgatctttatttgttgggaaattagtgaatggagatgcttaatattcttttcactgattggaaaactggaaaagaacaaaacaccaatattgcaggcaataacaatgctccttttgggcttttgactgctattgtttccagaaatctgatattccttatatttattttatttaagaaaaatactaaaatgtatccaccgtatccctgtatctgtgtccgcccgataataatgcatgtatccgttggcatcaagtgcaagtctgtcttctgcttgatgacattttattgtttttttattttgtcaatgttattatgcctgccatttttcttgttccttttagcactaagctggatttaattttgtatatttttcagattgttgagttcatctctgtgctgcttacaattggaagtgaaactgctgaaaaagagctaagaaggcagtcagcaataaagcgctcgattgatttgttctttgagtatccatataacaactttttgcaccatcatgttgagaatataattgttgcttgcctggagggtaaaagacctgaagttgttgagcatgttcttcatgaatgtgatattgttggtaaaattcttgtctcagagaggttttcatccttgtcgactgagtctaatgggcctactgttccctctgaagggaaaacccctccaagaattggaaatgttggtcacatgacaagaatagccaataaacttattcagttgggcaatagtaacaacacaatccaggctcacttacaggaaaataatgattgggttgaatggcaaacaaatgtgctggtcaaacgcaatgaagtggagaatgtttatcattgggcttgtgggcgcccgacatctttacatgaccgtggtagggacagcgatgatgatgacttccgggacagggattacgacgtggcagctcttgctaataacttaagtcaggcatttcgttatgggatatatagcaacgatgacattgaagaggcacaaggatcacttgaacgagatgatgaggatgtgtattttgatgatgaatcagctgaggttgtaatatcttctttgcgtctgggagatgaccaggacagctccctctttacaaattcaaattggttcacatttgatggagagagaggcattgatgatcgtttatctgcctctgttccttcatcatcccccaattctctggagacttcactagaggccgaggaagctgatgatggtaaagtcattggcactgaggatgaaatggaaacagtatatcttggaaatggtagtgctgaggaggtaaaagatgtagcagaatgtaatgaacagccaaattgttgtactgaggatgagcgattgaaaaatactgaagggattgaacggcatccagatgtttcaaatcactataccgacatatgtacaaacgaggctgcctctgttgcagcagaatcttcagccccatcagttgagatagtggcagagaaaacagtagatgaaccatcggaggcagaaagagcagtggatgaaccggcagaatcatctttggacagttctgtctctatacctttgcctgctcctgttaatagtagtgagcctgctaactcggaagcctcttccgaacaagttgcccatgacactgatgtgcagcaaccagtcaaggaagctcctgatgaggacgttgatgcaaagaaaactgatgtagccaaagcaagcgagtgaattagcaacatgttggactgagctgatcagagcaattacttgcgaactgaaaacactggagtgtagcctgtgctcagctgccacaagatagcctgaagcaaactgctgtacaataagcaagtgattgttctgccatcaacggtggcatatcactgtacaaatgagcaccattgactaacgcacataagtcgccttgtctgaaactggtcattttctttgaaattcaccctccagttcatgtgctttggtggcagacgtcgtggcatggtatatggtacctgagaacattctttgggtggcaactggttttggctacttagtcttctgttgcctgtaatatgagatgtgatgttatttctagtctagctattgttgtaatttttttggactctacatgtgtcagttcgacttcgaacaatttttttataaagattcgtcactgcattagaaaaaaaaaaaaaaaaaaaaacaaccccccgcccgc

SEQ ID NO: 18149 - DNA, 488 bp, Zea mays
ccacgcgtccgcagaaatctcccgcggcgaaggttgataaaagcacctcatccccctgcatatactaaccctgcaaaactgaagggtgatagcaaaatacaatgaggattgtgtacatggcagctgttatgtgtttggttcttgcaaccatgtcttctacctccccatcattctgccaagctgggggctgcatcggctgcccacgggctccaccaccgccgtccgatgagacatgctacgaggacctcaagtgttcggcttcgaggtgccacctgggttgcatacacaggggctacaagggtacgggttcgtactgccgtgggagggactgctgctgcaaacattgatgcaccgtagtgcatctatgcatttcatgaccatacaataaacctagatgtgtatcctttgcctccgacgactataaatgaaatgaaatactactaaggttcagcaaaaaaaaaaaaaatgcttatcaaaaaaaaaaaaaa

SEQ ID NO: 18150 - DNA, 762 bp, Zea mays
ttggggtatgaacacgaggtctccactctccagtctccacgttgcccttctcttccccactcgcctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagagaaagggctcgttcctcgacaagggcgaggtcgctgaccgtgtcgtctccgtcgtcaagaacttccagaaggtcgaaccctcaaaggtgacacctagtgctcattttcagaaggaccttggacttgatagcttggacactgtggagatcgtgatggcgtttgaggaagaattttcctttgagattcctgacaacgaagcagagaagattgactccatcaagacagcggttgatttcattgcttcgcatcctcaagcaaaataagaggatttcttttttttcgtatttcaaagtgtgttttgcatccagaacttatgcgacacgggactagttttctctagcttgccgcagtagataggaagtcatttctttacctttctgaatccgcgtgtaccaaacgattgttgtgttcttgtgacctcattggtacgctaatccataaatccatttgggcttcctttctgcttcaaaaaaaaaaaaaaaaaaaaggaagggaaaaaaaaaataaaaaacaaaaaaaaaaaaaaaacc

SEQ ID NO: 18151 - DNA, 769 bp, Zea mays
actcctaagggccacggggtgcgtactctccagtctccacgttgcccttctcttccccactcgcctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagacaaaggggtcgttcctcgacaagggcgaggtcgctgaccgtgtcgtctccgtcgtcaagaacttccagaaggttgaaccctcaaaggtgacacctagtgctcattttcagaaggaccttggacttgatagcttggacactgtggagatcgtgatggcgtttgaggaagaattttcctttgagattcctgacaacgatgcagagaagattgactccatcaagacagcggttgatttcattgcttcgcatcctcaagcaaaataagaggatttctttttttttcgtatttcaaagtgtgttttgcacttttgcatccagaactttatgcgacacgggactagttttatctagcttgccgcagtagataggaagtcatttctttacctttctgaatccgcgtgtaccaaacgattgttgtgttcttgtgacctcattggtacgctaatccataaatccatttggacttcctttctgctacaaaaaaaaaaaaaaaaagggcggcccgagactagttctctctctctctctctcctcgtgc

SEQ ID NO: 18152 - DNA, 1867 bp, Zea mays
ttgggaccctcgaggccggccggggcggagggactccattgggtacctcgaggccggccgggatctctaatccgccccctgtccctctcctctcagatcgcttccttgttctcgcctcgtcttccccgatcgtcgccgggagcctcccgatccttcttccaccttgcacggtcgtgccagggccggcacgcggacggtgcttggactgcccttgtcatggatcgcgccgagctcaccacggagcaggttctcaagcgagatattccatgggagcattacatgtcaactaagcttatctccggaacgtgccttcagcttttacggcgatatgaccacaaaccggagagccagcgagctcctttacttgaggaggatggaccagcatatgtccgagttttcctgaatatcctgtggagcatctccaaggaagagactgttgaatacgtgcttgccctcattgatgaaatgcttgcgacaaatcctaaacgtgcagcactgttttacgatcaatctctgtctggtgaagatatttatgagcctttcttaaggttgttatggaaaggcaactggtttgtacaagaaaaaagttgtaagatattgactgctataatcagtgcacgaccaaagcttcggaatggcacacttccaaatggagatgcttcgaattcgaagagcaagcttacttcaacacatgatgtattggagaggtttggtcaattggctctgttcacagctgaggaatcctacacacccgagctgctctattcctacttccatccattgcctctccacttcgctaagagaaccatatgttaggacattatttgttcaagctgatggcatcaagctgctcattccattaatttccccagctgccacacaacagtcaattcagctcctttatgaaacttgcctctgcatctggcttttatccttttatgatgctgcagttgattatttgtccaccacaagggttatgccaagacttgtagaggttgtcaagggctctactaaagagaaggtggtcagagttgttgtgttgtccttccgcaatttgctggcaaagggtgcatttgctgcccagatgatcgatcttggattgccacaaatggtacaaaacttgaaagctcaagcatggactgatgaggatctgttagatgctctgaatcaactagaggtgggactcaaagaaaacctcaagaagttgagttcctttgataagtacaaacagcaagttcttcttggtcatcttgactggtctccaatgcacaaagatccaagtttctggcgtgagaacattaacaattttgaagagaatgatttccagattctgcgagttctcatgacaatcattgacacatcaagtgacaccaccgctcttgccgtggcctgctacgacctctcacagttcctccagtaccatccatctggccgaatcgtggtggcagacctcaaggccaaggaccgagtcatgaaactcatgaatcatgagaacactgaagtgaggaaaaatgcattgatctgtgtgcagaggctcttccttggcgcaaagtatgccagtttcctgcaggcttgagaaaagctgagtcttgtatttagatccagagaacccctggtcatttttcagaatggctgttgagaaagaaaaaccttgaaaattcttgttcagtgtatcctattgttatttgatttctgaagccgatgtataataaataatcagagtcatagaatgctcgatgtaataaagtgtccatgggcttgttgattcatttatgtaaattttgacttgtaacattagcaaacctcttttttgttaatcctctgcctgacaacattgcctgattcgtgtgcaaaaaaaaaaaaaaaa

SEQ ID NO: 18153 - DNA, 1829 bp, Zea mays
cattgcgccccgccggcccgcgctaaccgccccctcgtgccctcccctcagatcgcttccttgttctcgcctcgtcttccccaatcgtcgccgggagcctcccgatccttcttccaccccgcacggtcgtgccagggccggcacgcggacggtgcttggactgcccttgtcatggatcgcgccgagctcaccacggagcaggttctcaagcgagatattccatgggagcattacatgtcaactaagcttatctccggaacgtgccttcagcttttacggcgatatgaccacaaaccggagagccagcgagctcctttacttgaggaggatggaccagcatatgtccgagttttcctgaatatcctgtggagcatctccaaggaagagactgttgaatacgtgcttgccctcattgatgaaatgcttgcgacaaatcctaaacgtgcagcactgttttacgaccaatctctgtctggtgaagatatttatgagcctttcttaaggttgttatggaaaggcaactggtttgtacaagaaaaaagttgtaagatattgactgctataatcagtgcacgaccaaagcttcggaatggcacacttccaaatggagatgcttcgaattcgaagagcaagcttacttcaacacatgatgtattgagaggtttggtcaattggctctgttcacagctgaggaatcctacacacccgagctgctctattcctacttccatccattgcctctccacttcgctaagagaaccatatgttaggacattatttgttcaagctgatggcatcaagctgctcattccattaatttccccagctgccacacaacagtcaattcagctcctttatgaaacttgcctctgcatctggcttttatcattttatgatgctgcagttgattatttgtccaccacaagagttatgccaagacttgttgaggttgtcaagggatctactaaagagaaggtggtcagagttgctgtgttgtctttctgtaatttgctggcaaagggtgcatttgctgcccagatgatcgatcttggattgccgcaaatagtacaaaacttgaaagctcaagcatggactgatgaggatctgttagatgctttgaatcaactagaggtgggactcaaagaaaacctcaagaagttgagttcctttgataagtacaaacagcaagttcttcttggtcatcttgactggtctccaatgcacaaagatccaagtttctggcgtgagaacattaacaattttgaagagaatgatttccagattctacgagttctcatgacaatcattgacacatcaagtgacaccaccgctcttgccgtggcctgctacgacctctcacagttcctccagtaccatccatctggccgaatcgtggtggcagacctcaaggccaaggaccgagtcatgaagctcatgaatcatgaaaacactgaagtgcagaaaaatgcgctgctctgtgtgcagaggctcttccttggcgcaaagtatgccagttttctgcgggcttgagagaaaccgagtcttttttgtatttagatccagagaactcctggccatttttcaaaatggctgttaagaaaaccttgaaaattcttgtccattatatcctattgttatttgatttctgagaccgatgtataataaataattagagccataccatgctcgatgtaataaagtgtccatgggcttgttgattcatttatgtaaattctgatctccaactttagcaatccttttttttccagtctgtacgcctgacttgtgtgaatatgggcgtacatgtttgcaattgtttcccagttttt

SEQ ID NO: 18154 - DNA, 1223 bp, Zea mays
ggccggccggggttggtttactaatccacgtacgtgtacgtctggccgttcgggccttgggcagtttccttgtggggttttgtggcaggagcgattggatctggccgttcgggccattggaggtgcttcaccaagcgtccaagcgtgagtgtattgggcttaggccgccggccgggcctggctggcccgttgcaatctcgagaagcaactccgtcgcgccgcactctaatcgcctccgattctgcggagacttcggaatggcggcggcggctcgtgccgggttccggcggctcttctccgtctcggccttcgctgcaccgcctcctcctgccgcgcgccccgcggcggacccttgcaacaacctcttcgtctcagggttaaataaacgcacaacgtccgagggacttaaggaagcattttctaaatttggtcaggttattgaagcaagagtaatcactgataggatatctggatactccagaggatttggctttgtcaaatatgcgactgtacaagaagctggtgaggccatagaaggcatggatggaaagttccttgacggttgggttattttcgctgagtatgccaagcaaagagaagccacacaaccatcacaacaaggagcaccagcttatgattgaagttgccatacacggtcgatgacatacactgtatttctttctttcttttttctgccgagtgtaatagtggatgtttcttgccggccaaacatttgcagagagaatgtagcttgatgtgctccttgaacttcctttgttgtggttaacattggacttactgctacttcatgcgtggcccataactttcgtctttaatttacaggtcactgcatttttttgaccactgtgttggaaggaggcccacctcctccttcggccaaaaacagtataaaataaatatgtcgaattatacaagaaaaaaaattgatccctcaaataaaattctaaataaaatattttgtacgccgctcgtgtccagtcataccagaccgggaacccgagtcttcgtccgccgcttcgggcagcaccagtggtctctatctatcgtcagtcgtcaccgtcctcgcgacctcgccggcctgcgctccaccatagatgccgcatggaccagcgtcctatccatccagccactgcatctttctggacaaaggtcccggaactccacttccgagactgcaggcatacttactaggatccccgggc

SEQ ID NO: 18155 - DNA, 1895 bp, Zea mays
tgaattcggcacgagggccccaacaaaccggtgcggactgtggagggactcggccacggaccacccgtctcgccctcatctaattacgccccgctcgctgtccctctcagatctcttccttgttctcgcctcgtcgtccccaatcgtcgccgggagtctcccgatccttcttccaccacctcaccggtggtgtcagggccggctcgcggacggtgcttggactgcccccgtcccgtcatggatcgcgccgagctcaccaccgaacaggttctgaagcgagatattccatgggagcattacatgtcaactaagcttatctccggaacgtgccttcagcttttacggcgatatgaccacaaaccggagagccagcgagctcctttgcttgaggaggatgggccagcatatatccgagttttcctgaatatcctgcggagcatctccaaggaagagactgtggaatacgtgcttgcactcattgatgaaatgcttgcaacaaatcctaagcgtgcagcactgttttatgatcaatctttgtcgggtgaagatatttatgaaccgttcttaaggttgttatggaaaggcaactggtttgtacaagaaaaaagttgtaagatattgactgttataattagtgcacgaccaaagcttcagaatggcacacttccaaatggagatgcttcgaattcgaagagcaagcttacttcaacacacgatgtattgagaggtttggttgattggctctgttcacagctgaggaatcctacacacccgagctgctctattcctacttctatccattgcctctccactttgctaagagaaccatatgttaggacattatttgttcaagctgatggcatcaagctgctcattcccttaatttccccagcttccacacaacagtcaattcagctcctttatgaaacttgcctctgcatctggcttttatccttttatgatgctgcagttgattatttgtccaccacaagggttatgccaagacttgtagaggttgtcaagggctctactaaagagaaggtggtcagagttgttgtgttgtccttccgcaatttgctggcaaagggtgcatttgctgcccagatgatcgatcttggattgccacaaatggtacaaaacttgaaagctcaagcatggactgatgaggatctgttagatgctctgaatcaactagaggtgggactcaaagaaaaccttaagaagttgagttcctttgataagtacaaacagcaagttcttcttggtcatctggactggtctccaatgcacaaagatccaagtttctggcgtgagaacattaacaattttgaagaaaatgatttccagattctgcgagttctcatgacaatcattgacacatcaagtgacaccaccgctcttgccgtggcctgctacgacctctcacaattccttcagtaccatccatctggccgaatcgtggtggcagacctcaaggctaaggaccgagtcatgaaactcatgaatcatgagaacactgaagtgaggaaaaatgcattgatctgtgtgcagaggctcttccttggcgcaaagtatgccagtttcctgcaggcttgagaaaagctgagtcttgtatttagatccagagaacccctggtcatttttcagaatggctgttgagaaagaaaaaccttgaaaattcttgttcagtgtatcctattgttatttgatttctgaagccgatgtataataaataatcagagtcatagaatgctcgatgtaataaagtgtccatgggcttgttgattcatttatgtaaattttgacttgtaacattagcaaacctcttttttgttattcttctgccctgacaacaaaaaaaaaaaaaaaaaaaaacaaggaggaaagccggtacc

SEQ ID NO: 18156 - DNA, 1046 bp, Zea mays
aagggccaacatcttagcccatttgattgactccaaaagtaaaaaaaaaacaattcacacagttttgtatccattttctatttttctcctctcgagtagcgtggcgggcgtggacgcggcggcgatgctgcggtcggcgctgcggcggggaggggcgtccgcgaggcaggtcgcgttggcgggagaagcctcgccgagagacctcctccggatgcgcgtggcggagcgggagcgcgcgaggcggcggcgtcgcgacccgggccgcgacgagttcttcgtgcccacgccagagtcgctggcgtggctcgactcggtctccctccccatggtgctcaccgccgccgccgtggccctcttcaccaagctcctcatgatggaacatgaagctacagatcaagaaaggagagagcgcaagataaagaatagccaccctgatcaaggaacagtaaggatgctatctcgtgaagaatgggaggaggtccaagaagtcaggccaaggaccccttttgaatcaaagttagctcgtccacatgcccggataagaacgggggagccagtgcgactggaggatgtcaaggattgggctactgatgtaatcgcagattcttttaccagagcagaagaagctaccaagaaaaaatgatttagaagaatctaaaacacccggtgtatctgctttatcgtttctctgaatctaaaacacccagttgtaaccgagttcttttacagatccatgaccatatgggtattacggccactatggtattctgagagtgaagccctgagtcccttggtctatgtttcggtgcaccatggtaaacaactgcttcacccgggcctcttggagaaagagcgatataataaagaatactaggtgaattgacacggtgcaatttctcttaaaattttgcgccatgtattgatataaggttaatcgtaccactactttgttcttgtttatatactccctccaatgtagtaaatgtagtcgtttaggacatgattgtgcataccaaggagtgattaattatcatagagttttccct

SEQ ID NO: 18157 - DNA, 1174 bp, Zea mays
acgccatcacgtctcgtatcgcatcttgcgcactggccggcgcgcgggcggcgccgctcagctctttcctatagatagggcacaggccccaggccgggaccgcaccagccggtgttggtttcagcttgtattcccactctgtcgcacagcgtcgcccgtcgccgctgagatcctaggaagaaatggagctctctcgcaagctcttcacggccgtcctcctcgtcatgctgctgctgctgtccgcagaggtcgggccggtggcggtggcggaggcgcggacgtgccagtcgcagagccacaggttccggggcccctgcctccgccggtccaactgcgccaacgtctgcaggaccgaggggttccccggcggcaggtgccgcggcttccgccgccgctgcttctgcaccacgcactgccactgattcgctcgcccagcggccggctggcgtcgccgtcgatcgcgtcgcgaccagtccatggctccatgcatgaataacaagggtgtgcgcggtttgtgatgccaaattgtatcctcgtcgtgtgttgaagcgttcgatcgtcggtctagtagtgtgcctgtgagcagcggcgtgctgttgtacgtacgtctgcctctgttccatgtttcgggattttccatagcaaatgcatgcgtcgagatctacactccgaaagaaattcgatagatttcgcataatttccattcaaaatacatatagatcgcgtcgcggccggtccgtggctccatgcatgaataacaagggtgtgcgcggtttgtgatgccaaattgtatcctcgtcgtgtgttgaagcgttcgatcgtcggtctagtagtgtgcctgtgagcagcggcgtgctgttgtacgtacgtctgcctctgttccatgtggcgggagtttccatagcaaatgcatgcgtcgagatctacatctaataaataaaaaaaaaaaaaaaacccatcggccggctggcgtcgccgtcgatcgcgtcgcgaccagcccatggctccatgcatgaataacaagggtgtgcgcggtttgtgatgccaaattgtatcctcgtcgtgtgttgaagcgttcgatcgtcggtctagtagtgtgcctgtgaacagcggcgtgctgttgtacgtacgtctgcctctgttcatgtttggggattttccatacaaaagcctg

SEQ ID NO: 18158 - DNA, 625 bp, Zea mays
ggtacccccgggttcggccgggccggcaccagccggtgttggtttcagcttgtattcccactctgtcgcacagcgtcgcccgtcgccgctgagatcctaggaagaaatggagctctctcgcaagctcttcacggccgtcctcctcgtcatgctgctgctgctgtccgcagaggtcgggccggtggcggtggcggaggcgcggacgtgccagtcgcagagccacaggttccggggcccctgcctccgccggtccaactgcgccaacgtctgcaggaccgaggggttccccggcggcaggtgccgcggcttccgccgccgctgcttctgcaccacgcactgccactgattcgctcgcccagcggccggctggcgtcgccgtcgatcgcgtcgcgaccagtccatggctccatgcatgaataacaagggtgtgcgcggtttgtgttgtgatgccaaattgtatcctcgtcgtgtgttgagcagcggcgtgctgttgtacgtacgtctgcctctgttccatgtttcgggattttccatagcaaatgcatgcgtcgatcgagatctactccgaatgaaatacaaaaaaaaagaggtcctaacagttccgccagctagcatggggtgagcc

SEQ ID NO: 18159 - DNA, 881 bp, Zea mays
  misc_feature (15)..(15): n is a, c, g, or t
tatatctacccaggnctagttcagtttgcagaaaattatgcaaggaaaggaattgttcgacttaaagaaatattcacacctggaacattacaggttcctaaaacagacaatcaactcaaggagcttgaatctgttcacaaggtcctagagttatatgtgtggttaagcttcagaatggatgattcctttccagaccgtgaagtagctgcctttcaaaagtcaatctgtagcatgttgatcgaagaatatctggagaggtttggatggcagccacaagaccgaagaaaggttttgggtggagcacaaaagctgctccaagaatacgatgtatcacaaatgaacaaatattttcaagaagtgaacccaggaccgaagtagaaggactatacaggaaatgagcctcaccacttccagtccagatttgaggaaccaaaaccatccagagcatttgcgttctgcctcactggttatggatcaccggcacaaagtggaactacacttcggacgaccgaagatatacgtggacgcatctcaaaccgtgatcatctagattgatttggcagcacgcatttccatcagccagatcgtgatcgactagtaggacttttttccccaaaaatgaaactacactccagtcttaagtcataatgaatacagagccatgagcccatgatagggccgcttctgagacggagattgtgtattaacaggtacacagacggtacttgcattctagtctgagttcgatgagttgcaccaatagcggctgtaatcctgtatataaagagagggaaaataatgttgcttgtgctgttatttattgcaagatctgaatgtttgtgtccaatgacaatttagtagacattttacatgcactaacc

SEQ ID NO: 18160 - DNA, 3337 bp, Zea mays
cctctccgcaggtgctagggaaaggcttgccatggtttatcctttttctagacccactcatgtgggagccttccgcaatgggtctgcccaaggtactaagggccgcttttgtttctttgcttttaataagtaaaatcatcggtataatacattggattaagaagttaaggatacagcaccattacaatgatctgagatcagccttaaagttcataagtagtcaggaagacatgagcaggtaaaataactagcatagaggattctactggaaaagcccaagcatatgatagaaggcgaaggagcagcttaccgagcactaatcctcatcatcttcttctgagctcccaacatcactactgtactcatcactactactgctctcaaaatcaagctgcacaggcttgacctgtattggctctgggcccattggcgccactggtctcactgaaacaggtgcctgcggcacagggggctgtggctctgcacccttgataccaggtagtatctcatcaagtggtatcgtgatcgggtcaccaggcttccatcccggtggcggctttagctccttagggaacatgggtggcaaggtgtttggtagcctcgatggcccctcctgaggtggctcatacagcggcgcagcctccacttctggtgcgattccctccttcgcatccaatggcttcttgggcacacctacatccaaatcagcaaaaagatacagctgcgacgccctcatctgattttcctgtggtacaggtggcaggctgacacggagaggcagcccagccccatgctccggcggagcaaaggttgtgtaacttatgcggtgcgcgtaggtcaggatgtcatccagcttaaggctggagtggagggacgtgccgaagtcgccttccgacgccggctcgggatcgtcagccgcagcggcgccacgtgggcgtttgggatcgcggcggtagtcagcgtaatcgtcgacgaggcggtcaagtacctggtgagcctcgtgcagcttcttcgcaaaggttaccagcgaagcatccttggcacgcgcctcacggacaaggcgagcgcgcgcatcctgcaggtcgagggtctcttgcagctcggcgacggcctcgaagagctgcgtctgcagggtggtgagaagagagagcgcgtccttggtagaggagatcgatgttgggagcggcggcgcggaggaggacgccgatgggaggaaggtggggagcgacccccggtacgataagatccacgcggcgcggttgggcgagagctcgaagaggttggtggcgagcgacgatataagctggagcagcgattgcgcgcgcggaagcggcggcaggagcggtagcagcgacggcgaggtgattagggttggggcagcgctggtgccggcggctgcactcgagggcaggctaccatgtgaaggcgaggatgtgggattcaaggggaccggattgggcgggagcgacggcgacgaggttgtgagccccagcctcgccggggagggcaggtgcgactgcatcatcgcggcggctcgacggcggagggtgctgcaaacggacgcgagttcgagagagtgcttgataagctcaagccaagcctctacttcgtgggctcatgagccgaaaatgggcgggcttgctctagtagttactagcatgtgtttgggccttttatgtcttgagacccaactagtccgcgttaaaagctctctccttacctacccacccgccgcttcgtccaaatccctgttggcgggagacaagcagcatgccgcctccggttctcgtgcaaatcatcaaatcaaagtaaccatggacggcggatcgtccacaccggcgagcaccccacctacggcggcggagatggagtaccggaactggaagaggaatgcggctgtgctttacgacctcgtcatctcccacccgctcgagtggccgtcgctcaccgtgaagtggctcactcgctcccatcgaagtcctcggctcgtcgtgggcactcacacctccgacgaggctcatggtcttggacgcggtgcttccgctcccacctcgcctcgctgcagccgccgctgcctcgggcggcgccgtcctgttcccgtccatgtccgtctccagcgtggcgccacatgccgtgcgaggtcaaccgcgcgcgctgcatgccgcaggccgcagcgtccctatacggtgccgaccaaaatgtgcgtcgacgaggtgcacgtgtaccatctcggcgatggctacgacaacggaaagagcggacgccgctgttgtgctcaggggacacgaggccggagggttatggcttgtcatggagcccgacgaaggaggggttatgaacagaagatttgcttgtggggtctctcctctaggagtggagctctgttctggatgcaacaacatgtgttttgagggtaatgtcccgtttggatgctcctgtttcaattaatgtgctcagtgctctttattcactgtccccgcattttcggctcatatagttacagtaacttgattatagtgtgacttgatgcatcggagcaatttgatttgtacttcttttcttttcctaatgatactatgtgcatttgtttgtattatattaaatgaaaatgggattagaacaatatgtgaagtaactcaagctcatatagatttttcataattatttatgataataactggtcaactgaaggggattgatatgtaggtttaagaaaaaaataagcctgttcagactgctgcaactgcaatccatagagacaaaatattgtagtagccgcagtcgcagccagattaaaatagcagaaagttgcagcaaacaagagggaaatttgagcaggcctgcatggattggtactttttatgtcttatcttattctgtaaactaactgattatgtttgaatagtgtccatagtaactccagttcatatagattttccataattgtttatgataatattctgaggtgattgagacggaggtttaaggaaaagtggcaagtataggcaccagcacaccttgagggaaatttgagcatggctttatacgttttgtgtcttatgttattctgattatgtctgatgtaagaagtttgtatgatttgtgatgttcaaccaaggaaataagaaaacttgtccagtaggggaatgaccgtcccacagtattatattaagaagaagctcaatcggagcctcgaccgagaaagttcacgaaagccggtcccccgtgcaacacgaccaagggaaccagcgagtgacattttttaacctcagcttgaaattcgctcccattgtaattcaaatttaggacctaaggagtgctaatcagaccacctaat

SEQ ID NO: 18161 - DNA, 3244 bp, Zea mays
accaaaggtaaacaattgatactaagcatataataagtaaaatcaatggtagaatacattggtttaagaagtacaggataaagcaccattacaatgatctgagatcagccctaaagttcataaatagtcagtaagacatgagcaggtaaaaatcgctagcatagaagattctactccaagcatacgatagaaaggcaactacaattgaaagccaacaaaatagagcagcttaccgagcactaatcctcatcatcttcttctgagctcccaacgtcactactgtactcgtcactactactgctcccaaaatcaagctgcacaggcttgacctgtattgtctctgggcccattggtgccactggtcgcactgaaacaggtgcctgcggcacaggggcctgtgcctcccgctcttcacccttgataccaggtagtatctcatcaagtggtagcgtgatcggatcaccaggcttccatcccggcggcggctttagctccttcgggaacatgggtgccaaggtgtttggtagcctcgacggcccctcctgtggtgcctcatacagcggcgcaacctccacttctgccgcgatcccgtccttcgcatccaatggcttcttgggtacccctaaatccaaatcagcaaacagatacagctgcgacgctctcatctgattctcctgtggtacaggtggcaggctaacacggagaggcaacccagcaccatgctccggcggagcaaaggttgtgtaacttatgcggtgcgcgtaggtcaggatgtcatcaagcttaaggctggagtggagggacgtgccgaagtcgccctctgacgccggctcgggatcgtcagcagcagcggcgccacgcgggcgtttgggatcgcgacggtagtcagcgtagtcgtcgacgaggcggtcaagtacttggtgagcctcgtgcagcttcttcgcaaaggctagcagcgcagcatccttgccacgcgcctcacggacaaggcgcgcgcgcgcatcctgcagatcgagggtctcttgcagctcggcgacggcctcgaagagctgcgtctgcagggtggtgacaagagagagcgcgtccttggtggaggagatcggggttgcgagcggcggcgcggaggacgccgatgggaggaaggtgggaagcgatcctcggtacgctgagatccacgcggcgcggttcgccgagagttccaagaggttggaagcgagcgacgatataagctggagcagcgattgcgcgcgcggaagcggcggcaggagcggtagcagcgacggcgaggtggttagggttggggcagcactggtgccagcggctgcgctcgagggcaggctaccgtgtgaaggcgaggatgtgggattcaaggggaccggattgggcgggagcgacggcgacgaggctgtgagccccagcctcgccggggagggcagatgcggctgcatcattgcggcggcggcggagggcgcagggcgcggaggcgcccagcaaacggacgcgacgcgagcgcgagacgctcgtgcttgctgatcctccacttcgtgggctcatgggacgggcttgctcaactagatgtgtttgggctttttatgtcttgaggcccaactaatccgcgttaaaagcccgctccccgtggcccgccgggacccatccgccgcttccgcttcgtcccaaatcccttttggcgggagacgagcagcaggctgcctccacttcccgcgcaaagcagtaaatcggagtaaccatggacggcggatcctccacaccggcgagccccccaccgacggtatccgcgtcggcggcgaatatggaggagtaccggaactggaagaagaacgcggcggtgctttacgacctcgtcatctcccacccgctcgagtggccatcgctcaccgtgcagtggctcccatcggagtcctcggcccgcagccaccggctcgtcgtgggtacgcacacctccgacgaggcccccaacaacctcatggtcttggacgcggtgctaccgctcccacctcgcctcgctgcagccgtcgctgcctcgggcggcgccgtcccgttcccatccgtatccgtctcgcgcgtggcgccacaccgtggcgaggtcaaccgcgcgcgctgcatgccgcagcgtccctatacggtggccaccaaaacgtgcgtcgacgaggtgcacgtgtaccatctcggcgatgacgacggcagcgggaagagcggcgccgaagttgtgctcaaggggcatgaggcggagggttatggcttgtcatggagcccgatgaaggaggggtggctgctgagcggctcgtatgataagaagatttgcttgtgggacatctcctctgggagtggcgctcctgttctggatgcacaacaggtgtttgtggctcatgaggatctcgttgaagatgttgcttggcacctgaaggatgaacatatatttggatctgttggggatgactgtaagttgatgatgtgggacttgcgtacaaacaaaccagaacaatctattcttgcacatcgaaaggaggtcaactctttgtcattcaatccattcaatgaatggatattggctacagcatctggagacacaactatcaacctatttgacatgcgaaaactatctagaagcttgcatacttttgacagtcatgaggcggaggtgtttcaggttgaatggaatccaaatttggctactgtattagcttcatctgccgcagacaagagagtgatgatatgggatattaataggattggcgatgagcagtcagaggaagacgcagacgacggaccaccggagctgctgttcgttcatggaggccacacagacaagatatcagagctgtcgtggaatcctagcgagaaatgggccattgccagcgtgtctgaagacaacatcctgcagatatgggagatggcagaaagcatatactgtgatgacctctccatgcaggttaactgactcgtgcctcgaagcataaagccagagtgggcatctataagaactctttaaatccgtgacatgcattaggctatctccagcagatctcctatcacatcctttatgttatcccctattttcaaacttctctctgcaaagagtcagttattgacttgagtaatcttgatagtctgaatctgattgagcctttaggcataaatgtaactttgaaattgtagggtcagggttgacttcttttccagtttggaacttactactccctgcagttcaaaaaaaaaaaaaaaa

SEQ ID NO: 18162 - DNA, 2312 bp, Zea mays
gcagaacagcctccttgccacgcgcctcagggataaggggcgcgcgcgcatcctgcagatcgaggtctcgttgcagctagcgacgggcctcgaagacctgcgtctccagggtggtgacaagagagagcgcgtcctcggtggaggagatcggggttgcgagcgccggcgcggagcacgccgatgggaggaaggtgggaagcgatcctcggtatgctgagatccacgcggcgcggttcgccgagagttccaagaggttggaagcgagcgacgatataagctggagcagcgattgcgcgcgcggaagcggcggcaggagcggtagcagcgatggcgaggtcgttagggttggggcagcactggtgccagcggctgcgctccagggcaggctaccgtgtgaaggcgaggatgtgggattcaaggggaccggattgggcgggagcgacggcgacgaggctgtgagccccagcctcgccggggagggcagatgcgactgcatcattgcggcggcggcggcggcggcggagggcgcaggcgcgcagaaaacggacgcgacgcgagctcgagacgctcgtgcttgctgatcctccacttcgtgggctcatgagcccaaaatgggacgggcttgctcaactagatgtgtttgggctttttttgtcttgaggcccaactaatccgcgttaaaagccctctctccttggtccttgcctacccatccgccgcttcgtcccaaatcccttttggcgggagacgagcagcaggctgcctccacttcccgcgcaaagcagtaaatcggagtaaccatggacggcggatcctccacaccggcgagccccccaccgacggtatccgcgtcggcggagaatatggaggagtaccggaactggaagaagaacgcggcggtgctttacgacctcgtcatctcccacccgctcgagtggccatcgctcaccgtgcagtggctcccatcggagtcctcggcccgcagccaccggctcgtcgtgggtacgcacacctccgacgaggcccccaacaacctcatggtcttggacgcggtgctaccgctcccacctcgcctcgctgcagccgtcgctgcctcgggcggcgccgtcccgttcccatccgtatccgtctcgcgcgtggcgccacaccgtggcgaggtcaaccgcgcgcgctgcatgccgcagcgtccctatacggtggccaccaaaacgtgcgtcgacgaggtgcacgtgtaccatctcggcgatgacgacggcagcgggaagagcggcgccgaagttgtgctcaaggggcatgaggcggagggttatggcttgtcatggagcccgatgaaggaggggtggctgctgagcggctcgtatgataagaagatttgcttgtgggacatctcctctgggagtggcgctcctgttctggatgcacaacaggtgtttgtggctcatgaggatctcgttgaagatgttgcttggcacctgaaggatgaacatatatttggatctgttggggatgactgtaagttgatgatgtgggacttgcgtacaaacaaaccagaacaatctattcttgcacatcgaaaggaggtcaactctttgtcattcaatccattcaatgaatggatattggctacagcatctggagacacaactatcaacctatttgacatgcgaaaactatctagaagcttgcatacttttgacagtcatgaggcggaggtgtttcaggttgaatggaatccaaatttggccactgtattagcttcatctgccgcagacaagagagtgatgatatgggatattaataggattggcgatgagcagtcagaggaagacgcagacgacggaccaccggagctgctgttcgttcatggaggccacacagacaagatatcagagctgtcgtggaatcctagcgagaaatgggccattgccagcgtgtctgaagacaacatcctgcagatatgggagatggcagaaagcatatactgtgatgacctctccatgcaggttaactgactcgtgcctcgaagcataaaggtgagttacctgaccaatgatgcaagcgtatctggaggggttatatacctgtatgatttgagagatttcaatttcgctatttttgttcactgcagagtgggcatctataagaactctttaaattcgtgacatgcattaggctatctccagcagatcccctatcacatcctttatgttatcccctattttcaaacttctctctgcaaagagtcagttattgacttgagcaatcttgatagtctgaatctgattgagcctttaggcataaatgtaactttg

SEQ ID NO: 18163 - DNA, 1690 bp, Zea mays
gaagacaatttatcccttgtcccaatatactcaagggtcaaaataagcaaatgctggaatgtggacgtgcagtatcgttgcaattgcgtatgataccttgcacttttttttttttttttaaataaagttccaggttgcatttaaacagctacatccccaaggttagacatgcaaacggagccaacaaatcatttactgaatagtgaatcgcacgtggatcatccaactagcctagactattcatcaacaaagtatatgcaataacaaggtagttggaatatctattaaaaatgattcaccaagttattcaattgtactcgagttcatccttacttcacaatgtgaatgataagcttccagtgattgagaagatctggcataaccccgagcactaatcctcatcatcttcttctgagctcccaacatcactactgtactcatcactactactgctctcaaaatcaagctgcacaggcttgacctgtattggctctgggcccattggcgccactggtctcactgaaacaggtgcctgcggcacagggggctgtggctctgcacccttgataccaggtagtatctcatcaagtggtatcgtgatcgggtcaccaggcttccatcccggtggcggctttagctccttagggaacatgggtggcaaggtgtttggtagcctcgatggcccctcctgaggtggctcatacagcggcgcagcctccacttctggtgcgattccctccttcgcatccaatggcttcttgggcacacctacatccaaatcagcaaaaagatacagctgcgacgccctcatctgattttcctgtggtacaggtggcaggctgacacggagaggcagcccagccccatgctccggcggagcaaaggttgtgtaacttatgcggtgcgcgtaggtcaggatgtcatccagcttaaggctggagtggagggacgtgccgaagtcgccttccgacgccggctcgggatcgtcagccgcagcggcgccacgtgggcgtttgggatcgcggcggtagtcagcgtaatcgtcgacgaggcggtcaagtacctggtgagcctcgtgcagcttcttcgcaaaggttaccagcgaagcatccttggcacgcgcctcacggacaaggcgagcgcgcgcatcctgcaggtcgagggtctcttgcagctcggcgacggcctcgaagagctgcgtctgcagggtggtgagaagagagagcgcgtccttggtagaggagatcgatgttgggagcggcggcgcggaggaggacgccgatgggaggaaggtggggagcgacccccggtacgataagatccacgcggcgcggttgggcgagagctcgaagaggttggtggcgagcgacgatataagctggagcagcgattgcgcgcgcggaagcggcggcaggagcggtagcagcgacggcgaggtgattagggttggggcagcgctggtgccggcggctgcactcgagggcaggctaccatgtgaaggcgaggatgtgggattcaaggggaccggattgggcgggagcgacggcgacgaggttgtgagccccagcctcgccggggagggcaggtgcgactgcatcatcgcggcggctcgacggcggagggtgctgcaaacggacgcgagttcgagagagtgcttgataagctcaagccaagcctctacttcgtgggc

SEQ ID NO: 18164 - DNA, 1099 bp, Zea mays
  misc_feature (1055)..(1055): n is a, c, g, or t
tgcatgcctgcaggaggggcacgaccggggcactcgtcaaagacagctcgaattttacagctcggcagcagggcaagcagcgggcgatgaccccccgcccaaacagaggtcatgcgggagggcattttcttaatgacgggggcttacgcgattaatactgacagggacagacatgttctcatgcgagccccacttggcagtattcttgaaaccggccgcgcacctactccctgccttcacgcggccaccggcttattcaagagcagcaaaaggggtttcggcatggatggatagcactagctagacatcacacagcgagcgagcgagagcggtgagcccggccaccagcgccggaggccgtcgtcgtcttactagccgacgctcgacttgggcatgaattgctagccgggtgagagattgctaggtagccagctaggtacggtgtgggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcacaggtggcgtatcccaaggacctgtcggcgaacccgtcggaccagaacaaggtgtaccactaccgggcgtacaacttcaccatcagcatggtctggtcgccgntcctggtgcgcgcccgggagccccgaccacgacggcccgcgcac

SEQ ID NO: 18165 - DNA, 891 bp, Zea mays
gggtacctcgaggccggccgggattcaagtgccgcgccggcccttccgggatggatggatagcactagctagacatcacacagcgagcgagcgagcgagcgagagcggtgagcccggccaccagcgccggaggccgtcgtcgtcttactagccggcgcgccgacgctcgacttgggcatgaattgctagccgggtgagagattgctaggttgccagctaggtacggtgtgggggagttgaatcggaggtctgccgctcgaggcgggaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacacttcaccatcagcatgttctggtcgccgttcctggtgcgcgcccgggagccccgaccacgacggccccgcgcaca

SEQ ID NO: 18166 - DNA, 2832 bp, Zea mays
ccccccccccccccccctctcccaaaacagaggtcaagcgggagggcattttcttaatgacgggggcttacgcgattaatattgacagggacagacatgttctcttgcgagacccacttggcagtattattgaaaccggccgcgcacctacgcgccggctgcctgcggccaccggcttattcaagagcaccaaaaggggtttcggcatggatggatagcacacagcgagcgagcgagagcggtgagcccggccaccagcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggaccccgaccacgacggccccgcgcacagcgggccaactggagcctcgcgaccactgtgtctccatggctggctgcaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctggagcgcctgcgagggcgcgtcatcgtgcgcatgctctccccgatgtcgcacttcgagaacgggacctgggaccacggcggcgactgcaggcgcacgcagccgctgcgggcgaaccagaccgccatggagggccgcgacctgcacttctacaccgcgcagatggaggagttccgcgccgcggagaaggccgccgccgagaaggggcggcgcctgatgctcatggacgccacggcggcgatgctgatgcggcccgacggccaccccagccgctacgggcactggcccaacgagaaggtgcagctctacaacgactgcatccactggtgcctcccgggacccatcgacatctggaacgacatgctcttccagatgctcctcgcctagcagcaagcagcaaagattaaaaaaaaaactcagcaattcggtcgccggtaaccgtgcacagattggccttcttttttttgccttgtttcgtttttttaaaaaaagaagaaaatggtgcaattttgacaagcaaggattcgaaattcgccggtaaccctccgagatcatccgttccctcctctgcttgttctgtggtgtcgaaattgctccctgtctgtcggtcggcgccgtggaaaggggcaaagcaaacaaccaaaagggggccgctcgcagtcgcagcggtggtgcctttgattctgttgtagagtagtatatgactggcgcacgcaagctgtcgaaaaaaaaaggtcacggccgtcctctgatcttcgaaccgaattgaaatgaaagtttactcccgcgccgcgcgtatcgtgttccggtcactgccatcgttggttgcagttcgaaatggtgtgtcgcgtcgcgtccggccgcactctcgaggaccgccggtggatggtggtcggtggatcgcactgatggcggccggggccgggccaaaggaaaagcggtgggtgcgcgcaccgcaagaccggaaaaagagtagccggccggcacgcgctttgtcggcgagcggggccggcgacccgtggaggtcatagaattccgtcgaaacagattacaacccttggagaatttaagatacaggcaagttatcaaataccaaagcacgttacattgttttaatctggatttttaaaatgcctgggaaccgaacggtgaagagagtgtgcagcaggggttggtgtgcgtgtggttattactggttgtaccagtgatgggtgacgctcactgcgcacacaggcacaggccaggcagtgctgctgcctgctgagctgctggcctctctaggctctggctttctggtggtgtgtgtactgcggcgttctagaatcggtccggcgcaggagaaccccgcgcacgcatcgcgaggagccgaggaccgtgccctgggccct

SEQ ID NO: 18167 - DNA, 1914 bp, Zea mays
gcggccaccggcttattcaagagcaccaaaaggggtttcggcatggatggatagcacacagcgagcgagcgagagcggtgagcccggccaccagcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctggagcgcctgcgagggcgcgtcatcgtgcgcatgctctccccgatgtcgcacttcgagaacgggacctgggaccacggcggcgactgcaggcgcacgcagccgctgcgggcgaaccagaccgccatggagggccgcgacctgcacttctacaccgcgcagatggaggagttccgcgccgcggagaaggccgccgccgagaaggggcggcgcctgatgctcatggacgccacggcggcgatgctgatgcggcccgacggccaccccagccgctacgggcactggcccaacgagaaggtgcagctctacaacgactgcatccactggtgcctcccgggacccatcgacatctggaacgacatgctcttccagatgctcctcgcctagcagcaagcagcaaagattaaaaaaaaaactcagcaattcggtcgccggtaaccgtgcacagattggccttcttttttttgccttgtttcgtttttttaaaaaaagaagaaaatggtgcaattttgacaagcaaggattcgaaattcgccggtaaccccccgagatcatccgttccctcctctgcttgttctgtggtgtcgaaattgctccctgtctgtcggtcggcgccgtggaaaggggcaaagcaaacaaccaaaaagggccgctcgcagtcgcagcggtggcgcctttgattctgttgtagagtagtatatggctggcgcatgcaagctgtcgaaaaaaaaaggtcacggccgtcctctgatcttcgaaccgaattgaaatgaaagttcactcccgcgccgcgcgtatcgtggccccctcactgccatcgttggctgca

SEQ ID NO: 18168 - DNA, 1310 bp, Zea mays
ccacgcgtccgcggacgcgtgggcttgtccccatgcatacagcatacttcagcctctctctcggttctcccgggcccctcgcgtgcgctctgtctctgtcgccgtcgccgtcgccgccgccgccaacctacgccaagtgcccagatctccaccctcgggaccttcgccggcagcgaacacccaccaccagaagaagatatatggcctgattggctgcccgcatatagtcgaaccaggctcacggtgagcctgattctcgtggtggcagaaaaggcctcaggctaggatctagagatgcgaccaaaatcaatgtatcttcagagccaggcccaggctgtcgcggtgtacagctgggctctcgctagcctggttagcaccaccagggtgcccaggtgcgggcaaccaatcagctgatatagggcatttacccttttgtgactatggcactagcggctatctataaccttttcatcattaacaaatcaggcggccttatatactacaaggactatggttcagcagggaggatggataccaatgacagtctaagattagcaagtctgtggcattcgatgcatgctatctcccagcaactcccccctacccctggctgtactggcattgatctcttacaagctcattactttgatctccattgctttcaatccctcacagggacaaaatttttcgttgtatgcgaaactggagctccaaacatggaaatgctgctgaaagtgatttatgagctgtacacggacttcgttttgaagaatccgttctatgagatggagatgccgatccggtgtgagctgtttgatcacaacctggctcagatgatccagaaggaccgtgttgcgcttctgggtcggtgaatcttgaaaactcatggtctcagcccttgaaaaccctacttttcccgttttcgacgcttggacttgctctgctggaaccctaaattctaccttgcggcactgctgtgctgtgcataaccgataacttgaatagtgtgttgctcgcttgtaatcttcttgcggtgtgatgaaatgtagagctttgcgggcataaatgccgctgcaaatagtaacaacatggaagcagcttttgttcttgcatgttttccctgcaatgagcttgagcagcttgatcagggctggttttgtggaagtggaattgaaggggatccatagagaggaatttccttgctatttttgaatcgaaagtgaatttctagatcccgttcaattccattttaccaaattggttatcagtgatttttcaattcccttttcccactagttctctcctcgtgc

SEQ ID NO: 18169 - DNA, 1414 bp, Zea mays
ccggccgcgctgttctctcccccgtccccatgcatacagcatacttcagcctctctctcggttctcccgggcccctcgcgtgcgctctgtcgccgtcgccgccgccgccaacctacgccaagtgcccagatctccaccctcgggaccttcgccggcagcgaacacccaccaccagctgatatagggcatttacccttttgtgactatggcactagcggctatctataaccttttcatcattaacaaatcaggcggccttatatactacaaggactatggttcagcagggaggatggataccaatgacagtctaagattagcaagtctgtggcattcgatgcatgctatctcccagcaactctcccctacccctggctgtactggcattgatctcttacaagctcataactttgatctccattgctttcaatccctcacagggacaaaatttttcgttgtatgcgaaactggagctccaaacatggaaatgctgctgaaagtgatttatgagctgtacacggacttcgttttgaagaatccgttctatgagatggagatgccgatccggtgtgagctgtttgatcacaacctggctcagatgatccagaaggaccgtgttgcgcttctgggtcggtgaatcttgaaaactcatggtctcagcccttgaaaaccctacttttcccgttttcgacgcttggacttgctctgctggaaccctaaattctaccttgcggcactgctgtgctgtgcataaccgataacttgaatagtgtgttgctcgcttgtaatcttcttgcggtgtgatgaaatgtagagctttgcgggcataaatgccgctgcaaatagtaacaacatggaagcagcttttgttcttgcatgttttccctgcaatgagcttgagcagcttgatcagggctggaagggccgccgcatagatccagggaaagagagacgcgtttgtggtccatccataattcatatgaccggagagcctgaccctgacgccaacggcaagcagcagtggcggcatccagatcctggcgcaccgactgcacccgcccgtccggcaccttctttcggcggcagcggcactccgcgcgacacggggccgtgtccgtgtgggatgggatgggatggaatggaacagtaggctttttgggcatttgcgaggacgcccaggcctgactcctctgaggccatctccatctccagcaggccgtataaacggctgtcgtttaggcatgcattaaccagagtatgagatttatgggagcaccttgagtggctcatggatcccctggactagcgtgcgcggtccatcacgcggtgtctgtttctgaattgagggtacgagggagcaataatggagcagccatggagatttcacccaacaacaacaaaaaaaaaaaaaaaa

SEQ ID NO: 18170 - DNA, 2279 bp, Zea mays
  misc_feature (1855)..(1855): n is a, c, g, or t
attaatgttcttttgatgtctgtttatactagtgtctgaatttcttcttttatttattatatcaacgcagaagcttcattaaaaactgggtttcaattgggaagagcgcaaggttaagctccatgcctgcagctggaaatatgagttttgacatacagtgcaaacattgtgaaaaggtgattcttgggtgatgtgtgatcacgagccttattatttttgtacaagaaagcattgcccaatgtagtggcagtgcacaggaccagtcaattccatggctttttactaattccgattcatctcaagatcttgcctgctgatcctattgttcttccatgttcattgtttgtatcaatattaggattagatttggatgttagtagttcaaatttatcttgacaaatatgttgttgcttttttgttaaatgtttatgtagtgatagtacgatattcattactaagtattactaagcacaacaactcacggtgtctgacatgcatcgatttcttcttctcttttgttacaggaatcaataaatagttctctgttgaacttgttaacatacccatggattgagaagagggtgaatgaaggcactttgaatcttcatggaggctactacaacttcgtcgattgcacatttgagaaatggacattgttgtaccgtgaagggttggaaggtggaagcaagtatgccataaagaaccggtccacctggtgttgaccaacgaaggtcgtgtttacttgggtaaatttcactctgccccccgctgttcagcatggtttcgctttgccactacgttgtccatttcccattgcacctttgctccattgtggcatcgatgttctccgggtcccggtatcaaataactgtggcaaggctgttggcatgccagcttgaactgcgtgttgtagtgtcgcatacacatgcgcaggcacgtctgcatcgtagcagttatttgatacaggaactttttgatactgtagaagcacaataccacaatggagtgaggtgcaacgcgcgatggacaatatggttgcaaggtgaaagtctgtggaactgccgggggcaaagtgaattttatccaactatctgtaatatgtgtgctgttttccggttgaaactattaagaaaaaaataggaataagctgcaggatcggtcgtaatgcgtgtaattgtcgccacatttggcattaccttgctattgtaaaatttgttctttttgttgtgtcattataactgagatatatacggtctcgtcaaatttgcttggtgacaatgttgtttgtttggaatggaagggtcggcaatggaaattccgtgatattctcacatgtaaaaaggtatgagtagcaccgtagcacacatgccagagtccttccctttcccttctgtctccaatcagtcacccgcttcgacagcgccactgcccactgtcctactaaaccctggcgaggtgcgccgagaagcgctgcctcttgtagcagcactcggcgccgagcatgtcctcccgggtgagcagcacggcccggagcgccgcctgcagcgctgggcgcgacgacgtgcccgcgtcgtcgccgttgtgctgcccgccgacgtccagctccaggacgctccgcgtccgcccaccgacggtggctatctcggcgcgcacggccctggcgctgacggagcgcacggcgcggcccagctcggacatgagccccgggcggtcggcgcagcacacccacgccctgacgcgcctggcgctggcggcggccgccctctccctctccccgccgccgtggtggcagaagcagcgctgctggccctcctcgacgccgaccttgtcgcctttccctgggacggccacggcncgcgcccgccgccgccgcgtccgcctcgccccgcagctcccgcacgtgccgcactacctccccgagcagcgccgccttgtccatccgcgacgcggcagggaggagcgtgcgcagcgtggcgaggtgggcgttgatgcgctgccgccgcttccgctccgcctcgctgtggcttctgctcgtcccaccgctccgcgtcgtcgctgccggcggtgaggactccctgtccatcgccacatccgctgtttcgtcatcactcccgacaggaaccatcatcgtacgtgttgctcgagcgagcctgagcagttttgtttgttttttgttttgaaaaggaaaaggaggcgggaagccggtggctcgagtcctacgtgcgaacacggcaacaagctagctcacacacgtcggtctgggtctggctgccgtttgc

SEQ ID NO: 18171 - DNA, 1349 bp, Zea mays
  misc_feature (1348)..(1348): n is a, c, g, or t
cccacgcgtccgcccacgcgtccgcccacgcgtccgcccacgcgtccgagatgaggtaggtgcagaacacggtccattcatggatttgaaagcgagattcatggacttcaaacagagaaactatgtggagaatttttcaaattaccaaaatcttgctgagcagcaaacgccaaagttcatggtgattgcttgtgctgactccagagtctgccctaccgctgttttggggtttcagcctggcgaacatttacggttcgtaatgtggcgaatttggtaccaccatatgagcatgagggatcagagactagtgcagcactagagtttgctatcaatacactcgaggtagagaatgtgctggtggtaggccacagtaggtgtgggggcatccaggcactaatgagcatgaaagatgattcaacgtccggaagcttcattaaaaactgggtttcaattgggaagagcgcaaggttaagcacaagagctgcagctggaaatttgagttttgacatgcagtgcaaacattgtgaaaaggaatcaataaatagctctctgttgaacttgttaacatacccatggatagagaagagggtgaatgaaggtactttgaatctccacggaggctactacaacttcgttgattgcacatttgagaaatggacattattgtaccgtgaagggttggaaggtggaagcaagtacgctataaagaataggtccacctggtcttgaccaatgaaggcctcatttacttgggtaaatttcactctgcgcccctgcagttcagcatggttttgctttgccactacgctgtgcatttccgtcgcacctttgctccattgtggtattggtgttctgcagaagcgagtccctgtatcaaataactgtgtccattgcgatgcatggcactatggcactagcatgtcagcttgctgtagtattgcatactcacgggcaggtgcatcggcattgtagcagctattgtttgatacgtacaggaactctccactgtggaagcacaaagccacaatggagtgaggtgcgacgcaatgaacaatatggtggcaaagtgaaagtctgtggaactaccgggggcaaagtggattttgtgcaactatttgtgtgtcgttttccggttgataccattgagaaaatacgaataagttacaggatcagtcatagtgcatgtaattgtcgccacatttggcgttaccttgttattgtaattgtaacatttgtaccatttgttgtatcattataactgtgagttacaatacaaatattatacggtctcggcaaatttgcttgaaaaaaaaaacttgggggggggccgggcccaatccccatgggng

SEQ ID NO: 18172 - DNA, 1737 bp, Zea mays
cattgggtacctcgaggccggccgggtaattaattactttccccccaaaaaaaagccccccaccgcctcgacctcgattcctccgcccccatcgccgtcgtctcctcctccgcctccctgtctgtccgctccgcacctcccctaaaaaacccccccggccattgccgcaccgagctccccttcctcaaatgccccaggcccggacgcctcgacgcccagctccgtgctcgcatggctagcggcgtcctccatcgctccgcctccctatgtctccgcccggccgccggctcctccgccgactccggccggggccacggcgcggttatgatcggtgattcgaggacgcgcgttgctgctctgcggctgggaggatctagccggagagagttattatctgtcacaatggcctccagagatcacactggcttgacccgacaacttcttgattttcaacatgatacaatagatgaggtaggcgcaggacatgacccattcattgatttgaaagcgagattcatggactttaaacagagaaactatgtggaaaaattttcaaattaccaaacccttgctgagcagcaaacaccaaagttcatggtggttgcttgtgctgactccagggtctgccctaccgctgttttggggtttcagcctggggaagcatttacagttcgtaatgtggcaaatttggtaccaccatatgagcatggggggacagagactagtgcagcactagagtttgctgtcaataccctccaggtagaaaatgtactggtgataggccacagtaggtgtgggggcatccaggcactaatgagcatgaaagatgattcgacctccggaagcttcattaaaaactgggtttcaattgggaagagcgcaaggttaagcacgaaagctgcagctggaaatatgagttttgacatacagtgcaaacattgtgaaaaggaatcaataaatagttctctgttgaacttgttaacatacccatggattgagaagagggtgaatgaaggcactttgaatcttcatggaggctactacaacttcgtcgattgcacatttgagaaatggacattgttgtaccgtgaagggttggaaggtggaagcaagtatgccataaagaaccggtccacctggtgttgaccaacgaaggtcgtgtttacttgggtaaatttcactctgccccccgctgttcagcatggtttcgctttgccactacgttgtccatttcccattgcacctttgctccattgtggcatcgatgttctccgggtcccggtatcaaataactgtggcaaggctgttggcatgccagcttgaactgcgtgttgtagtgtcgcatacacatgcgcaggcacgtctgcatcgtagcagttatttgatacaggaactttttgatactgtagaagcacaataccacaatggagtgaggtgcaacgcgcgatggacaatatggttgcaaggtgaaagtctgtggaactgccgggggcaaagtgaattttatccaactatctgtaatatgtgtgctgttttccggttgaaactattaagaaaaaaataggaataagctgcaggatcggtcgtaatgcgtgtaattgtcgccacatttggcattaccttgctattgtaacatttgtaccatttgttgtatcattataactgagatatatacggtctcgtcaaatttgcttggtgacaaaaaaaaaaaaaaagggcggccgccaccgcggtgga

SEQ ID NO: 18173 - DNA, 1942 bp, Zea mays
  misc_feature (23)..(23): n is a, c, g, or t
  misc_feature (25)..(25): n is a, c, g, or t
  misc_feature (28)..(28): n is a, c, g, or t
  misc_feature (1918)..(1918): n is a, c, g, or t
ctctctctctctctctctctctntnttnaatagagccaatcgcaaagcggtgctgtcatggaggttgggcgaggagcacgtggccgtccagaatccagtgatccaccacaacccgccagtccattctccaggccatgccgcgtacggcactgctccgcctcgcttctgcttcgacgacgcgcacgtcctcggcttccacggcggcgtggcgactatgcccgtcctcagagtcagacgacgtcggcgagcggcacgcgaccgctcggaaggatgagctcctcccaccgctccgcacgccgcgccccggcgagcggcggctgtctcggcgccgcgaggatcggtaactaatcactttgcacgaaaacagattaaaacagtaaaaccaccaccaccacctcgacctcgactcctccgccccatcgccgtcgtccccgtctcctccgccttgctgtctgtccgctgctcacctcccctaaaaggaggcacccccggccattgccgcaccaagctccccttcctcgaatgccccaggcccggacaccacgacgccctgccccgtgctcacatggctagcggcgtcctccaccgctccgcctcccgatgtctccgccctgccgccgcgccaacccccgactccggccggggccacggcgcggttatgatcggtgattcggggacgcgcggtgttgctctgcggatgggaggatctagccggagagagttattatctgtcacaatggcctccagagatcacactggcttgacccgacaacttttggattttcaacatgatacaatagatgaggtaggtgcagaacacggtccattcatggatttgaaagcgagattcatggacttcaaacagagaaactatgtggagaatttttcaaattaccaaaatcttgctgaacagcaaacaccaaagttcatggtgattgcttgtgctgactccagagtctgccctaccgctgttttggggtttcagcctggcgaagcatttacggttcgtaatgtggcgaatttggtaccaccatatgagcatgagggatcagagactagtgcagcactagagtttgctatcaatacactcgaggtagagaatgtactggtggtaggccacagtaggtgtgggggcatccaggcactaatgagcatgaaagatgattcaacgtccggaagcttcattaaaaactgggtttcaattgggaagagcgcaaggttaagcacaagagctgcagctggaaatttgagttttgacatgcagtgcaaacatttgtgaaagggagtcaataaatagctcgctgtctgacacgtattgttcccttccctttgttacaggagtcaataaatagctctctgttgaacttgttaacatacccatggatagagaagagggtgaatgaaggtactttgaatctccccggaggctactacaacttcgttgattgcacatttgagaaatggacctcattgtaccgtgaagggttggaaggcggaagcaggtaccctataaagaataggtccacctggtcttgaccaatgaaggccttgtttacttgggtaaatttcactctgtcccctgcagttcagcatggttttgctttgccactgcgatgttcatttccattgcaccttgctccattgtggtattgatgttctgcagaagcgagtccctgtatcaaataactgttgcaaggttgttggcatcgtccattgccacacatgatactatgccactagcagtcgtcagcttcaactgtgtgttgtcgtattgcatacacgggtagtaggtgcatcagcattatagcagttatttgatacaggaactctccactgtagaagtacaaacccacaatggagtgaggtgcaacgcaatgaacaatatggtagcagagtgaaagtctgtggaatttgccgnggcaaagtgaaatttatccgacta

SEQ ID NO: 18174 - DNA, 951 bp, Zea mays
cttccaattgttagtagatgaaaaatttataatagatgaaaaatatagaaaatgatattttataattgtagtggggtatagaggaaatatttagggggaaccgctacggtctgcgggagatgaaaaagtagggagtgaaatgttgatgatgtgacgtaaagaagtgatatggactgaaatcgtcgcttccgaccgcccacgccgccagattgctagtcaatgctatcctgcgttggacccaagccatatcagttacacttacacggcgacggcgttatataaggtagccacccagctaaagcttcctcgctagatatttcggccagccgtggcaccacattctccagcggcaaggcaaggacaagcggcggaaccgagcgcgtgatccacaccctcggcaggccgttgtgcgcgccgatccacccgatggacgatctggcggcgctggcgcgcggcgaggggtggacggaggagcggcacgcgcgttcctcgaccgcctggagctctccttcgtccagcaggtgctcggcggcaccgacgtgcgccaggcgtcccgtaggctcggtgtccggccggcgccgcgggaagaaggctggcgcggccaggtcctgtccccgctcccgctcccgctcgaccgaccactacccgacagcgccgtggagtccaaccggtcgggcctggccgcagctcggcgacgcgaggcaaacgacgcgcgccgccagcccgtcgacccagctggccagctgcaggttggtgaaggtgaagcctgtcgcacgcgcttgcctttggtattgcaaggtggaaatgtacgcgtccagtcacttgtttccgtgcataagtagcgttggacggcagatgtttcaagtggcaaaattcccaaaaaaaaattctgaacagttgattgcaagccctgagctgtttatatcttctgaaacaggaaagaaaaaaaaa

SEQ ID NO: 18175 - DNA, 604 bp, Zea mays
gggtacctcttcctcgctagatatttcggccagccgtggcaccacattctccagcggcaaggcaagtacaagcggcggaaccgtgcgtcatccacaccctcggcaggccgttgtgcgagccgatctacccgatggacgatctggcggcgctggcgcgcggcgaggggtggacggaggagcggcacgcgacgttcctcgaccgcctggagctctccttcgtccagcaggtgctcggcggcaccgacgtgcgccaggcgtcccgtaggctcggccgccggccggcgccgcgggaagaagtctggcgcggccaggtcctgtccccgctcccgctcccgctcccgctcgaccgaccactacccgacagcgccgttgagtccaaccggtcgggcccggccgcagctcggcgacgcgaggcaaacgacgcgcgccgccagcccgtcgacccagctgcaggttggtgaaggtgaagcctgtcgcacgcgcttgcctttggtattgcaaggtggaaatgtacgcgtccagtcacttgtttccgtgcataagtagcgatggacggaagatgtgtatgatcaccgacatcaacacaccttctgaacagcaacgg

SEQ ID NO: 18176 - DNA, 1493 bp, Zea mays
ccgggaccgatgatgaaatcgctctgtggcaacatgggtcgtcacaaccttgtcatcttcccagatgataccgagcacctctgagtttatgcacaccacacaacacaataatacagcaaaggagctagcagaggtgcaggattaataagctaagctagataaggctagctaccggccggccgggaagcaaagcataggcacagccatggctacctcctctggttcttgccttattagcctgttggtggtggtggcggcgctgtcggcctcaacggcgtcggcacagctgtcgtcgacgttctacgacacgtcgtgccccagcgcgatgtccaccatcagcagcggcgtgaactccgccgtggcgcagcaggctcgcgtgggggcgtcgctgctccggctccacttccacgactgcttcgtccaaggctgcgacgcgtccattctgctcaacgacacgtccggggagcagacccagccgccgaacctaactctgaacccgagggccttcgacgtcgtcaacagcatcaaggcgcaggtggaggcggcgtgcccgggcgtcgtctcctgcgccgacatcctcgccgtcgccgcccgcgacggagttgtcgcgctcggcgggccttcgtggaccgtgcttctgggcagaagggactcgaccggttcgttccctagccagacaagcgacctcccacctccgacgtcgagcctccaagcactgttagccgcgtacagcaagaagaacctcgacgcgaccgacatggtcgctctctcaggcgctcacacaatcgggcaggcccagtgctcgagcttcaacggccacatctacaacgacacgaacatcaacgcggccttcgcgacgtcgctcaaggccaactgccccatgtccggcggcagcagcctggcgccgctggacaccatgaccccgaccgtgttcgacaacgactactacaagaacctgctgtcgcagaaggggctgctgcactcggaccaggagctgttcaacaacggcagcaccgacagcacggtcagcaactttgcgtccagctcggccgccttcaccagcgccttcacggcggccatggtgaagatggggaacctcggcccgctcaccgggaccagtgggcagatcaggctcacctgctggaagctcaactcgtcctaataattaaggacggacgtccgatagacgatcctgcgcaatcgtatcgtacgtgcatgatacgcatacatctggaaactactataccaatgcaaacagagatctatacgtacgagtatgtataacgacgagtgatgtttgtatggatctacgtatgtaacaaggacctctcgtagcgcaaaggcgcgcgttgggagattaattaggtacacaagctattaccacattatatatcactctcattgtggctacaaaaaaaaaaaaaaaaaaaagtagggctaggacgtccagtactagtgagctctaattcagtgcgtatgcaagatttgtgggc

SEQ ID NO: 18177 - DNA, 2093 bp, Zea mays
  misc_feature (2083)..(2083): n is a, c, g, or t
catagaaataggagacataatttacatggatatagtaagtctcactggggccgctttaaggggagtcttcacattttctctttcgctagtagtatgggggaggagtggactctagggatactaccaattgattgagtagtcgaattgtagtatcaactcttttctttaattgatcgttttgcattaataattttgccaaactttattttttctctctttctttagttttgtttcactcttgtaagaaactcttttaagaaagtaagaaagagtcgttctattccagtataatagaatagaaagggcgattatagtaattcataacttctattctactagaaattatgagtaaaaagaaagttctatacataagaaaattagaacataagaaaattagactttcttacacgaagctattcacaatatatcgcacattttccatttatactattttcttattcttagaaaatttttgatgttctttttttttttttttgaaggatctcgattgaagcatctcgcaccttttttaagcatgaaagattcgtaggttttttccttttactttttttcttttactataatctattctagtctattctcgtattatttttctccccctccttggattctttcaatgaagaattatcttcgatttttttgattttgacttgattgaaattaagtggatgcagtgaaaaaagaagttgaattagactactatttcaatctactaatcgattctatgtagattcaagataatataatagaaagaatctaaagtgtggtagaaaaaactatatgtagttctttctaccacactttatgattccaaccagaccctttcatttaagacttggattttttattttctttaatccctttttcatttcttcaatgattaattggaattccaattaatcattttgactggctgtttttacataaataataagtaaaaaggcagtaggaactagaatgaacaatgctgtagcaataaatgcgagaatatttacttccataacctctttatttatttatttttttcacaataactcgggatgtaatcccatggagaggaaaaaggggtatcctgtaaattcaaggggaggacttgcattctgataatactgaatcaattcaatattatgaatattgcatctatcaaatcaattcatggtggatagtggaataatataacataggaagatctcttatccatactaagaccaaaataggttttttgattggattcgaaaccccctctattcttttttcattcttttctacttttgcttttctatatgtataacccaaaatctttcttatcttatccaatttcacttcctttttcttatagttatacatacaattatgtatgtattatatgaccaactttctatgggtcacatagacatcccaataagcagtagaagtagaaatgagatggagaaaagaggatcttaaataaaaaggatcccatatttaaatttaggaaaaagagcgtttgcttggtttttattttattaggttactatccatatacgctttttggggtctaaagatgagagcaaatccataaaaaaaggagtcggcaaatggagtgagaatgaggtggattctttccaattatatacacaaacaaagttggaactagaaaatggaaggggtgcggtttaacccccaaaaagtaactaattagatgaaattcattctctaacaataaacgaatacggtttatgtatggattccggtaaaataccggtactcgatttcataagagtcgaataggaagttaagatgagggtggtatcatcataaaaatggagtagtatcctaaattatactaatccacgtatgatatgtatgcctttccttatcaaccggaagtagtgcaaaaaaaattctatactgcactgctctctttttactgagaaatgcaaaaaaataaaagtgaagtaagggtgccccatagatatttgatcttgcctcctgtccccccccccccttttttcatcaaaaatttccatgaaaaaggaaaagatgaatttgtccattcattgaaccctagttcgggactgancggggctcgc

SEQ ID NO: 18178 - DNA, 1847 bp, Zea mays
ctggagctgccaggggagttcaaaagaacacacgtacaccaaccagctagtatctcctcaacgacatcggctaaattatcttgtcggtatgcatacttttcttcgcgcgcggggggcctttcattagatgcttgcacataaaactgcgctagctgatgctgaatctcagcctaacatatatactcctatatatatatattctcttgtattttatgccaattaatgtaacgcaattcagatgtgctggctggtcaacacactgtgtgcatatgctggctttcggagactaaacctggaccaagtttggcgcccgatttggatggtttctggtcccctagcggcatgcaggcatcagtggggccggccgcgtctgcggcccccggccggccgggatgcacaccacacaacacaacacaataatacagcaaaggaggctagcagaagtgcaggattaataagctaagctagtagaaattaagcaaagcataggcacagccatggctacctcctctggttcttgccttattattagcctgttggtggtggtggtggcggcggcgctgtcggcctcaacggcgtcggcacagctgtcgtcgacgttctacgacacgtcgtgccccagcgcgatgtccaccatcagcagcggcgtgaactccgccgtggcgcagcaggctcgtgtgggggcgtcgctgctccggctccacttccacgactgcttcgtccaaggctgcgacgcgtccattctgctgaacgacacgtccggggagcagacccagccgccgaacctaactctgaacccgagggccttcgacgtcgtcaacagcatcaaggcgcaggtggaggcggcgtgcccgggcgtcgtctcctgcgccgacatcctcgccgtcgccgcccgcgacggagttgtcgcgctcggcgggccttcgtggaccgtgcttctgggcagaagggactcgaccggttcgttccctagccagacaagcgacctcccacctccgacgtcgagcctccaagcactgttagccgcgtacagcaagaagaacctcgacgcgaccgacatggtcgctctctcaggcgctcacacaatcgggcaggcccagtgctcgagcttcaacggccacatctacaacgacacgaacatcaacgcggccttcgcgacgtcgctcaaggccaactgccccatgtccggcggcagcagcctggcgccgctggacaccatgaccccgaccgtgttcgacaacgactactacaagaacctgctgtcgcagaaggggctgctgcactcggaccaggagctgttcaacaacggcagcaccgacagcacggtcagcaactttgcgtccagctcggccgccttcaccagcgccttcacggcggccatggtgaagatggggaacctcggcccgctcaccgggaccagtgggcagatcaggctcacctgctggaagctcaactcgtcctaataattaaggacggacgtccgatagacgatcctgcgcaatcgtatcgtacgtgcatgatacgcatacatctggaaactactataccaatgcaaacagagatctatacgtacgagtatgtataacgacgagtgatgtttgtatggatctacgtatgtaacaaggacctctcgtagcgcaaaggcgcgcgttgggagattaattaggtacacaagctattaccacattatatatcactcgcattgtggctacatatctatatctcttaggccaaatgtgttggtccttgctctcagatgatatacatcaagaacaaaacaacacaattgttaatgatagaagtacttcgtcctttgaagcaaaaaaaaaaaaaaaaaaggggcggcc

SEQ ID NO: 18179 - DNA, 1282 bp, Zea mays
ggccgcggtcgccccggccgggcccgggaggcacaccacacaacacaataatacagcaaaaggagctagcagaggtgcaggattaagctaagctagataagggctagctaccaaggagaaattaagcaaagcataggcacagccatggctacctcctctggttcttgccttattagcctgttggtggtggtggcggcgctgtcggcctcaacggcgtcggcacagctgtcgtcgacgttctacgacacgtcgtgccccagcgcgatgtccaccatcagcagcggcgtgaactccgccgtggcgcagcaggctcgcgtgggggcgtcgctgctccggctccacttccacgactgcttcgtccaaggctgcgacgcgtccattctgctcaacgacacgtccggggagcagacccagccgccgaacctaactctgaacccgagggccttcgacgtcgtcaacagcatcaaggcgcaggtggaggcggcgtgcccgggcgtcgtctcctgcgccgacatcctcgccgtcgccgcccgcgacggagtcgtcgcgctcggcgggccttcgtggaccgtgcttctggggagaagggactcgaccggttcgttccctagccagacaagcgacctcccacctccgacgtcgagcctccaagcacttttagccgcgtacagcaagaagaacctcgacgcgaccgacatggtcgctctctcaggcgctcacacaatcgggcaggcgcagtgctcgagcttcaacgaccacatctacaacgacaccaacatcaacgcggccttcgcgacgtcgctcaaggccaactgccccatggccggcggcaccagcctggcgccgctggacaccatgaccccgaccgtgttcgacaacgactactacaagaacctgtgtcgcagaaggggctgctgcactcggaccaggagctgttcaacaacggcagcaccgacagcacggtcagcaacttcgcgtccagctcggccgccttcaccagcgccttcacggcggccatggtgaagatggggaacctcggaccgctcaccgggaccagtggccagatcaggctcacctgctggaagctcaactcgtcctaataattaaggacggacgtccgatagacgatcctgcgcaatcgtacgtgcatgcatctggactactatactacacaaacacatatatacgtacgagtatgtataacgcgtgatgtatatcaattgccgtgtgtatggatctacgtatgtaatgtaacaaggacccctcgtagcgcaaaggcgcg

SEQ ID NO: 18180 - DNA, 1365 bp, Zea mays
  misc_feature (911)..(911): n is a, c, g, or t
gggggtacccccgaggccggccgggccggcacaccacacaacacaataataatacagcaaaggaggctagcagaagtgcaggattaataagctaagctagataaggctagctaccgaggagaaattaagcaaagcataggcacagccatggctacctcctctggttcttgccttactattagcctgttggtggcggcggcggcggtggcactggcggcctcaacggcgtcggcacagctgtcgtcgacgttctacgacacgtcgtgccccagcgcgatgtccaccatcagcagcggcgtgaactccgccgtggcgcagcaggctcgcgtgggggcgtcgctgctcaggctccacttccacgactgcttcgtccaaggctgcgacgcgtccattctgctgaacgacacgtccggggagcagacccagccgccgaacctaactctgaacccgagggccttcgacgtcgtcaacaacatcaaggcgcaggtggaggccgcgtgcccgggcgtcgtctcctgcgccgacatcctcgccgtcgccgcccgcgacggagtcgtcgcgctcggcgggccttcgtggaccgtgcttctggggagaagggactcgaccggttcgttccctagccagacaagcgacctcccacctccgacgtcgagcctccaagcacttttagccgcgtacagcaagaagaacctcgacgcgaccgacatggtcgctctctcaggcgctcacacaatcgggcaggcccagtgctcgagcttcaacggccacatctacaacgacacgaacatcaacgcgggccttcgcgacgtcgctcaaggcaactgcccccatgtccggcggcagcagcctggcgccgctggacacatggaccccgaccgtgttcgacaacgactactacaagaacctgnctgtcgcagaaggggctgctgcactcgggaccaggagctgttcaacaacggcagcaccgacagcacggtcagcaactttgcgtccagctcggccgccttcaccagcgccttcacggcggccatggtgaagatggggaacctcggcccgctcaccgggaccagtgggcagatcaggctcacctgctggaagctcaactcgtcctaataattaaggacggacgtccgatagacgatcctgcgcaatcgtatcgtacgtgcatgatacgcacccctctggaaactactataccaatgcaaacagagatctatacgtacgagtatgtataacgacgagtgatgtttgtatggatctacgtatgtaacaaggacctctcgtagcgcaaaggcgcgcgttgggagattaattaggtaaaaaaaaaaaaaaaaaaagaaaaaaaaaaaaaaaaaagcggcc

SEQ ID NO: 18181 - DNA, 1029 bp, Zea mays
gggtacctcgaggccggccggtcggaagtatggcccggggactgagagaaaatacttcgccgagaaggaagaatcagccgtgcggttggacacggagactccggggagccgttgggacggagtcgccacgaacctatcgactttttatctccagatccagattagctaccacggcaccgccagcccggacggctataaagacgaggcccatctcgaaatcgacggcgatgaagaagaccagttcccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgccagcggcttctccgcgaagctcaccccccagcaggtcaaggatctcaaggagcaaccaggtgttctccaggttgtgccgagccagacttaccagctacatggtcctgggtctggcactcaccagggcacgacacacaccttgggccttatgtgaaggcgtatgagaatcaagaagactgtgtttagtatggctgtatggcacaggtctgacgaatgtgtatagtacagtactatgtaagaataagggacgtatcgtctatatactgctttgcgcatgctcagccctgttctaaagcttgtaatgcaccaatgcgtatgttttcaatacaatgacaagtatgctatcttgtttggtgcttaaaaaaaaaaaaaaaaaaggaaccaagggccaaaaataaccccccctcgccgcgtccgctttgtgttgcttatttgctatgttgttgagtttagggttgaaaacggaccggtaaaataccgacctgtatcgttttctatatttgacccgattgtatatttggtccgattgtttctatatttacggaaaaatatggaaacgggatgga

SEQ ID NO: 18182 - DNA, 846 bp, Zea mays
  misc_feature (708)..(708): n is a, c, g, or t
  misc_feature (711)..(711): n is a, c, g, or t
  misc_feature (720)..(720): n is a, c, g, or t
  misc_feature (758)..(758): n is a, c, g, or t
  misc_feature (828)..(828): n is a, c, g, or t
cattggggacccccgggcccgcccggggcgaggaagaagaccagttcccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgccagcggcttctccgcgaagctcaccccccagcaggtcaaggatctcaaggagcaaccaggtgttctccaggttgtgccgagccagacttaccagctacatggtcctgggtctggcactcaccagggcacgacacacaccttgggccttatgtgaaggcgtatgagaatcaagaagactgtgtttagtatggctgtatggcacaggtctgacgaatgtgtatagtacagtactatgtaagaataagggacgtatcgtctatatactgctttgcgcatgttcagccctgttctaaagcttgtaatgcaccaatgcgtatgttttcaatacaatgacaagtatgctatcttgtttggtgcttgatcggtccgtgtttgatccttgaatctggagtggagcactctgcctctctgcgtccgctttgtagttgcttatttgcggccntgntgagtttanggttgaaaacggaccggtaaaatactgatctgtaccgntttctatatttgacccgcttgtatatttgatccgattggttttggatttaccgaaaaaatggaaacatantagaaggtttatttcgtc

SEQ ID NO: 18183 - DNA, 819 bp, Zea mays
cctcgagccggcgggaagatcagccgtgcgcgtgggacacggagatgccgagaagatggacgcacggagtcaccacgaacctatcgactttttatctccagatccagattagctcccgccgcaccgccagtcccggacggctataaagacgaggcccatctcgaaatcgacgggcgatgaagaagaccagttcccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgccagcggcttctccgcgaagctcaccccccagcaggtcaaggatctcaaggagcaaccaggtgttctccaggttgtgccgagccagacttaccagctacatggtcctgggtctggcactcaccagggcacgacacacaccttgggccttatgtgaaggcgtatgagaatcaagaagactgtgtttagtatggctgtatggcacaggtctgacgaatgtgtatagtacagtactatgtaagaataagggacgtatcgtctatatactgctttgcgcatgctcagccctgttctaaagcttgtaatgcaccaatgcgtatgttttcaatacaatgacaagtatgctaaaaaaaaaaaaaaaaaaaaaaaaaaaaacaaaaaagggaaaaaaaaaggcccctaggccccta

SEQ ID NO: 18184 - DNA, 2830 bp, Zea mays
cattgggtacctcgaggccggccgggagtccactcccccacggcccgggccactgcactgcgccatccaaggacgactggacgaggaagaaaaaggatttcgaaaaagcgacgctcgggtatatatatacggcgccggcgccgaggagagaggaccccggccgatcccgcacccctgactgtcagccgcgatccgctcttttttgcgtgcagcggcggagcaggagatatggcgtcggaggccaaggacgtgggcatcctcgccatggacatctacttcccgcccaactgcgtgctccaggaagagttggaaacacatgatggcgtgagcaaagggaagtataccattgggcttgggcaggaaagtatggcattttgcactgaagttgaggatgttatttcgatgagcttgacagcggtgaagtccctcctgaaaaattataacattgacccaaagtgcattggacgtttggaagttggcagtgaaaccgtaatagacaagagcaagtctataaagacatggctgatgcagatatttgaggaatctggcaatactgatattgaaggagttgactcctcgaatgcatgttatggtggaacagctgcattgtttaattgtgttaactgggttgaaagcaagtcatgggatggtcgctatggacttgttgtttgcacagacagtgcggtttacgctgaaggtccggctcgccctactggtggtgcggctgctattgcaatgctgattggaccaaatgctcctatttgttttgaaagtaaatatagaggatctcatatggcccatgtatacgacttttacaagcccgatcttgcgagtgaatatccggtggttgatgggaagctatcacaaacatgctacctcatggcattggactcctgctacaatctattttgcaaaaagtatgaaaaacatgaggggaagcagttttcaatttctgatgcagattatgttgtgttccattctccatacaacaagcttgtacagaaaagcttcgctcgtttgtactacaatgatttcttgagaaactgcagcacggttgatggagagtcaagggaaaaattggcaccctatgcaggcttgtcatctgaagaaagctaccagagtcgcgaccttgaaaaggcatctcagcaagtcgcaaagaatctgtacgagtccaaggttcagccaacaacattgatcccaaaacaagttgggaatatgtatacagcatcactctacgcagctcttgcatcggttgtccacagtagacatgaaactctggcaggccagaggattgttatgttttcgtatggcagtgggttgacatcaacgatgttctctttcatgattaatgaaggccatcaccctttcagtctgctaaacatcgcaaacatactggatatttccaagaaactgaaggcaaggcacgtggttcccccagagaaatttgtggaggcactaaaactgatggagcaccgctatggggcaagagatttcgtgacgagtcaagatacaagtctgctacccgcaggcacatactatctcacgcacgttgactccaagtacagaaggttctacgacgtgaaaggtgacggtgtcgccactgcaatgtccaacggccactgatctttcttctgcccgaagctgcaacaagtcaaataacagaggcaagtgtcctaagcatccttagatgattatatctattaggaggggaagctggagttatagattaatctctgcccagctgtaaggttgtaaagttagttagagctgcgcatgcatgcttgtttagtaaaagctctgctgctcttcagttatttagcgaatcaagcacactgctgggctataagaattgtaaacaataatctgcagaatcactggctacatccaggctatgctgatgaatgcacgatttcatgtttagcacgatcaatgcatctggctaataaaaaaaaaaaattcgtttttttttttttttttttttttttttttacaccccaaaagtaagcctctgtgaggactgaggatatattgtacaagcaactggtacaagaagtcaaaccacttatacctattgtcagataatacagttgacaagaatgttgttcaagggaattaaaactatcttacagggactgaggaccagtatccatatatactaatattatcgaagaggaaaccaactctgcgatatcaatgaagaggtaggagcacaatcaacactcatcacgagcttcaattagcctgacgacaatcttggttttatcattaacaccgatatagtcggatagcttctggtccatggctagctctttcccagcccaccaaatctgtattctctcatgcttgttgtctgatgatgactcttgcagagacaacgcctccagaccgcgttctctgccttgttaccatttcttctcgatgttcttgatatgttcccttagagcacgaggagacaggaatctgttgcgctgcacctgctccttagaagcgtaggcctcggcctcgtccagcgccctctcgagctcgcccatcgcaccagcacacctcgctcgaaggcggcggcagagggagaggatggcgcctggaggcccgcgagcgcgcccagggcggccgcgacgtccgcgacgacgcagaggcggcgcactcgtacaggaactccgtctcctcgtccacgtcctgcatgggagaggaggcggcggcggcagcgggtggcgccaacttcacgtgcaacacgaccatctcggcccgaaggctctagaaacttcgggtctcgctcctgggagacggaacgggaacggccacacgaggcggcggcggacaggggttcatt

SEQ ID NO: 18185 - DNA, 859 bp, Zea mays
ttgggtacctcgaggccggccgggaccccggccgatcccgcacccctgactgtcagccgcgatccgctcttgtaggctccctccctctccgacccgcgtctccctcctcccactccactgctcctgttttgcgtgcagcggcggagcaggagagatggcgtcggaggccaaggacgtgggcatcctcgccatggacatctacttcccgcccaactgcgtgctccaggaagagttggaaacacatgatggcgtgagcaaagggaagtataccattgggcttgggcaggaaagtatggcattttgcactgaagttgaggatgttatttcgatgagcttgacagtggtgaagtccctcctgaaaaattataacattgacccaatgtgcattggacgtttggaagttggcagtgaaacagtaatagacaagagcaagtctataaagacatggctgatgcagatatttgaggaatctggcaatactgatattgaaggagttgactcctcgaatgcatgttatggtggaacagctgcattgtttaattgtgttaactgggttgaaagcaagtcatgggatggtcgctatggacttgttgtttgcacagacagtgcggtttacgctgaaggtccggctcgccctactggtggtgcggctgctattgcaatgctgattggaccaaatgctcctatttgttttgaaagtaaatatagaggatctcatatggcccatgtatacgacttttacaagcccgatcttgcgagtgaatatcccggtgggttgatgggaagctatcacaaacatgctacctcatggcattggactcctgctacaatgtattttgcaaaagtatgaaaaacatga

SEQ ID NO: 18186 - DNA, 1291 bp, Zea mays
cgcgtagaggcctcgcccggcccatcccgcaccccctacctccgaggctgcgatccgctcttgtaggctccctcgccaatccgctcctcctccctccctccctcccactgttgtgcgtgcagcggcgtcggagaagagatggcgtcggaggccaaggacgtgggcatcctcgccatggacatctacttcccgcccagctgcgtgctccaggaagagttggaaacacatgatggtgtgagcaaagggaagtacaccattgggcttgggcaggaaaatatggcattttgcactgaagttgaggatgttatttcgatgagcttgacagttgtgaagtccctcctgaaaaattataacattgacccaaagtgcattggacgtttggaagttggcagtgaaacagtaatagacaagagcaagtctataaagacatggctgatgcagatatttgaggaatctggcaatactgatattgaaggagtggactcctcaaatgcgtgctatggtggaacagctgcattgtttaattgtgttaactgggttgaaagcaactcatgggatgggcgttatggacttgttgtttgcacagacagtgcggtttatgctgaaggtccggctcgtcctactggtggtgcggctgctattgcaatgctgattggaccaaatgctcctatttcttttgaaagcaaatataggggatctcatatggcccatgtatacgacttttacaagcctgatctcgcgagtgaatatccggtggttgatgggaagctatcacagacatgctacctcatggcattggactcctgctacaatgtattttgtaaaaagtacgaaaagcatgagggaaagcagttttcaattttggatgcagattatgttgtgttccattctccatacaacaagcttgtacagaaaagctttgctcgtttgtactacaatgatttcttgagaaactgcagcacggttgatgaagaggcgagggaaaagttggcaccgtatgcaggcttgtcatctgaagaaagctaccagagtcgcgaccttgaaaaggcatctcagcaattttcaaagaacctgtacgagtccaaggttcagccaacaacattgatcccaaagcaagttgggaatatgtatacagcatcactctatgctgctcttgcatcggttatacataatagacatgaaactctggtatagtactatttgcagtgcgtgtttccctctgtttttttacaagattggctgaccaatgtcaaagtaatttcttttatcttccatgtactacttttgacat

SEQ ID NO: 18187 - DNA, 2676 bp, Zea mays
tcgagcggccgggccgggctgcggctcgtggtatggagaatggatcacaacaagcttgtacagaaaagctttgctcgtttgtactacaatgatttcttgagaaactgcagcacggttgatgaagagtcgagggaaaagttggcaccgtatgcaggcttgtcatctgaagaaagctaccagagtcgcgaccttgaaaaggcatctcagcaagttgcaaagaacctgtacgagtccaaggttcagccaacaacattgatcccaaagcaagttgggaatatgtatacagcatcactctatgctgctcttgcatcggttatacataatagacatgaaactctggcaggccagaggattgttatgttttcgtatggcagtgggttgacatcaacaatgttctctttcaagattaatgaaggccatcaccctttcagcttgctaaacattgcaaacataatggatgtttccaagaaattgaaggcaagacatgtggtcccgccaaagaaatttatcgaggtactgaaactgatggagcaccggtatggggcgaaagatttcgtgaccagtcaagacacaagtttgctatctgtaggcacatattatctcacgcacgttgactccaagtaccgaaggttctatgacgtgaaaggtgacggtgtcaccactactgcaatgtccaacggccactgatctgtcttctgcccggagctgcaacaagtcaaataacagaggcaggtgttcctaagcattctgactcttcttagattatctattaggaggggacgctggagcttagattaatctctgccaagttgtaaggttgtaaagttagttagagctgcgtcattgctgtaatgcttgcttggtaaaagttctggcgctcttcagttcttcagtgcttgcaaaattcaaatcaagctcactactggttgtaagaattctgaataatctgcagaatcactggttacatccaagttacgctgttgaatgcatgatttcatgtttaacccgattaatgcatctggattcagctgtgttgttggagtactcgtgtcgtgtcttgtacctttttaaaaagaagtttcttacattccattgtccggatgtatgagttgactggagggagctgaactgctgaagagctgaactgggtatgagcaaatgtttcttgccctgtgagttttctccggtattcgtattctagtttcagtacgcagaaaatatcgatgtacgaatagaatttaggcattccaaaaacaaggcacgtcaattattacattgaataatgtgtaaattggtcaatcctatcaatcgtcacatgatcatgatcacaagttcacaaccgtctatgcttcatcaaacggctagaagatggcacagcacagcgcggcgtgctccattttcttcctggcggccggcccagagcctaccagtctccagagccaaaacgactgggcacaacatgtctccatccgacgacggcgaggaaaccctcgccgcgctcatagaactgtctagaacgccggagggccgggagggtctcaccgacgtgctcatcgacaccctcttcctcctcccggcctccccgccgcgcctcttgctcctccgcctacgcctcctccgcaacctcctcgccggcgatgagctcaaccactacgccttcatcgagcactccggccccgccgccgtcgccgcctccgtgctctccttcccctcgctcgcccccgacgtggcgcgcgccgcgctccaggcgctcgggaacgccgcgctcgccggggagctccaccgcgacgccgtctggcaggcgctcttccctgaggcgctgcgggtgttcgcggggctcagggaccagggagtcctggatcccctgtgcatggttctcgacacgtgctgcggcggggaaggcggtcgcgggaggctccaggagctgtgtcacgaggagctgggcctgccaatcctcgtccaagctgtcactacggcgtcacaaggtgagatgagctcagtgttgtttacttgtttaggtgtcctgttagggtaaacaaaatactgtacgtgctatggacatcgatgatttattttcagatgctaggacattataggtctgtatgtgatttgtcagttggaataatgatgcactgtactagtatcagtttgttgcatgatgagatgcatgagcctgctatcattgttggaaattggaatgcatacttttgcttttacataatggcatggcaagaaaatctatggttattttgttgcaatgtgctgtagccttcaacaatcagcactgggatttattatgctgctatagtagttcctccatgttgtattatatgaccctaaccagaatcatgcaatgcagtggagcacaaggaagagtggttagagtggcttctgttcaaagtctgtgctgaggagcagaagtttgagagcttgttctatgccttatgctctgctaatgatgtgggcgagtataatgctaagcatatttttcttctggatacgttgtcaaggtgtttgaatagccatcccgaagaagttaccgtctcagacagttttgcacatgatgtttttaatctacacaagcatgctgctgaaactgtgaattttacttaccgaggtacctcccctcttccaaccgggcaccctgcaatcgatgtccttggatatacactgcag

SEQ ID NO: 18188 - DNA, 2265 bp, Zea mays
  misc_feature (2239)..(2239): n is a, c, g, or t
gcacgagaccattacctagaacatcctaatcaaaaacccggccgatcccgcacccctgactgtcagccgcgatccgctcttgtaggctccctccctctccgacccgcgtctccctcctcccactccactgctcctggtctctctctctctctccttctcctccccccgtccgtggccggagatcgacggtttccattttccagatcgcagttcattcagttgctctgttacctttacacggtctgcatgcctctattgtgtctgcagttttgcgtgcagcggcggagcaggagagatggcgtcggaggccaaggacgtgggcatcctcgccatggacatctacttcccgcccaactgcgtgctccaggaagagttggaaacacatgatggcgtgagcaaagggaagtataccattgggcttgggcaggaaagtatggcattttgcactgaagttgaggatgttatttcgatgagcttgacagtggtgaagtccctcctgaaaaattataacattgacccaatgtgcattggacgtttggaagttggcagtgaaacagtaatagacaagagcaagtctataaagacatggctgatgcagatatttgaggaatctggcaatactgatattgaaggagttgactcctctaatgcatgttatggtggaacagctgcattgtttaattgtgttaactgggttgaaagcaagtcatgggatggtcgctatggacttgttgtttgcacagacagtgcggtttacgctgaaggtccggctcgccctactggtggtgcggctgctattgcaatgctgattggaccaaatgctcctatttgttttgaaagtaaatatagaggatctcatatggcccatgtatacgacttttacaagcccgatcttgcgagtgaatatccggtggttgatgggaagctatcacaaacatgctacctcatggcattggactcctgctacaatgtattttgcaaaaagtatgaaaaacatgaggggaagcagttttcaatttctgatgcagattatgttgtgttccattctccatacaacaagcttgtacagaaaagcttcgctcgtttgtactacaatgatttcttgagaaactgcagcacggttgatggagagtcaagggaaaaattggcaccctatgcaggcttgtcatctgaagaaagctaccagagtcgcgaccttgaaaaggcatctcagcaagtcgcaaagaatctgtacgagtccaaggttcagccaacaacattgatcccaaaacaagttgggaatatgtatacagcatcactctacgcagctcttgcatcggttgtccatagtaggcatgaaactctggcaggccagaggattgttatgttttcgtatggcagtgggttgacatcaacaatgttctctttcatgattaatgaaggccatcaccctttcagtctgctaaacatcgcaaacatactggatatttccaagaaactgaaggcaaggcacgtggttcccccagagaaatttgtggaggcactgaaactgatggagcaccgctatggggcaagagatttcgtgacgagtcaagatacaagtctgctatccgcaggcacatactatctcacgcacgttgactccaagtacagaaggttctacgacgtgaaaggtgacggtgtcgccactgcaatgtccaacggccactgatctttcttctgcccgaagctgcaacaagtcaaataacagaggcaagtgtcctaagcatccttagattattatatctattaagaggggaagctcgagttatagattaatctatgcccagctgtaaggttgtaaagttagttagagctgcgcatgcttgtttagtaaaagctctgctgctcttcagttatttagcgaatcaagcacactgctgggctaataagaattgtaaacaataatctgcagaatcactggctacatccaggttatgctgatgaatgcacgatttcatgtttaacacgatcaatgcatctggttacatccaggttatgctgatgaaaaaataaaaaaaaaaaaaaaacatatcctaatgtaggcactatataattccttgccctctttgatgaagtttccatgacctagttgttcgtgtggaaaatcaaacaagggccttaagagtacctgtgttcgtgcggtacttgaccagcatccaagttatatcaaaatgcttcggaagatggccaaagctaggcatgatgtacgcacagtccngttccggtacaccgtacacaggcagt

SEQ ID NO: 18189 - DNA, 2676 bp, Zea mays
gcacgagaccattacctagaacatcctaatcaaaagcattctctctctgttctcttgtgcgtgcctgcgctctgtagtgacgacgactgggcggcggccgccgccgccgccgacctacgtgcgcaggtatccatcttccggaccttcgctggagacgagcacccaccaccagaaattttctatacatttaagatgtacagggcctcaaatttcatacctgatcctaatcaggtgcttctagatgccaatccattaaggtctttagctccaatgttccctgcccccatgggagtcaatgttaatcagtcaagtacaccaccattggtttgtgtcactccggttggtcaatttccaattgggtttggtgcagggaaccttcctgcctttggatcgttcactactttcagcgccactacaaacggtgtttcttatacgggcaccagtggtaatggtgccattgatgccactcctatctctgcatacaagacaagatcaagcatatcacttgatgatgatgatgatgagccttactcgggcaaccaaggtttggcatctgaacggaaggctaggagaggccgtcctcctggttctggtcgtgatggatcaaatggtaagttaaagcgccctaagcctacatacaagaattttgttgctggcaaagagcttgtctttctgtcttctacatccgatcccagggagtttgtggaatcagttcacatgacttttgaggccctcaggcgaagacatctgcagatggatgaaacacaggatgctagcagacgtgcagacctgaaggctggtgccatcatgatggccagtaacatcagggcgaattcaggcaagagggtaggaactgtacctggagttgaaataggagatattttctattttaggatggagctgtgtgtcattgggttgcatgcacctagtatgggaggcattgattacatgactactaaatttggaaaagatgaggattctgtagccatatgtattgtctctgcaggaggttatgagaatgaggatgatgacacagatgtgctcgtgtacagtggtcaaggtggaaataataggaatactgaggagaggcatgaccagaagcttgagaggggtaacctagctcttgagaggagtttgcataggaagaatgagataagggttgtacgtggcttcaaggatccattttgcctaactgggaaaatttacatatatgatggtctctacaagattcatgagtcctggaaggagagaacaaagtacggtgtcaattgcttcaagtacaagctgctgcgggaacctggacagcgtgatggagctgcattatggaagatgactcagagatggatagataatcctgctaccagaggcagggtcctactagctgatctgtcatctaaggctgaaattttgcctgtttgtcttgtcaatgaggtagaccatgagaaaggacctgtacatttcacttatactaatcaggtcaaatacttgaggcctctcagttctatgaaaaagttgcagggctgtggatgccagagcgtttgcttgcctggcgacgccagttgtgcttgtggacaacataatggaggcgatttacccttcagttcatcaggattgttgtcatgccgcaaaccaatagtctacgaatgtggtgaatcttgcaactgttctacaaattgcaggaacagagtgacccaaaaagggtccaggctacatttcgaggtcttcaggaccacaaatcgaggctggggtcttcgctgctgggaacctattcgtgctggttcatttatatgtgagtatgccggtgaggttattgatgagctcaaatttaatttgaatgatagtgaagatgattacatttttcaaactgtatgccctggcgagaagactttaaaatggaattatggacctgaactgataggtgaagtaagcacatatgtatcgcctgatgaatttgaaccactgcctgtcaagataagtgcaaaaaacatgggaaatgtctcccgtttcatgaaccacagttgctcacccaatgtcttttggcaaccagttcaatatgatcatggagatgatggacacccgcatataatgttctttgcactgaagcatattccacccatgacagaactgacttatgactatggtgttgctggagctgaatctagtggttcaggttctcgtagaacgaagaactgcgtgtgtggatcacaaaactgcaggggattattttgatgggttgagagacgtgctcttggtggttaatcatgcaaaccactttctgctagatcctttctatgaaaccaaatttagtctccggataatatgacagatgatgtcatttgccatgtgtactgtgaagacagtaagttgtcgagcgagctgtagaatttctgttgctctgaactgcatggtggtcgctttcccaccatttcctcggatgtttatgtgggcgtggattgctgcattgcttccgctaaacttgtccaccaattgcaccggcttttgtagacttgttatcagccccgcttgcgttggacgcctggttgttaggatatggtcttgtaaattatcctggttaaggatcatgttgctttcgactcgaattttcgtccacccttgaccatatgttcagcaatgttcaggtgtaaaaaaaaaaaaaaaaaaactacgagggggggc

SEQ ID NO: 18190 - DNA, 2628 bp, Zea mays
catcccagtccccccggcaaccacactcggttctcccgtgcctctcgccgtctcgcgtcgcaacgactggccggccgccgccgccaccgccgacctacgtgccaaggtccgcatattcggaaccttcgccggcgagcacccaccaggattttttttgtacatctaagatgtacagggcctcgaatttcatacctgatcctaatcaggtgctcctagatgccaaaccattaagatcgttagctccaatgttccctgcccccatgggagtcaatgttaatcagtcaagtacaccaccattggtctgtgtcactccggttggtcaattttcagcagggtttggtgcaggtaaccttcctgcctttggatcgttcactactttcagtgccacttcaaatggtgtttcttatgcaggcaccagtgctaatggtgccattgatgccacccctatctctgcatacaaaacaaggtcaaacatatcacttgatggtgatgatgatccttactcgggtaaccaaactgaacggaagcctaggagaggccgacctcccggttctggtcgtgatggctcaaatggtaagttaaagcgccctaagcccacttacaagaattttgttgctggcaaagagcttgcctttctggcagcttcatccgatcccagggatatcgtggaagcagttcacatgacctttgaggcactccggcgaagacatctgcagatggatgaaacacaggacgctagcaggcgtgcagacctgaaggctggtgccatcatgatggcaagtaacatcagggcaaattcgggcaagagggtaggaactgtccctggagttgaaataggagatattttctatttcaggatggagctgtgtgtcattggattgcatgcacctagtatgggaggcattgattacatgactagtaaatttggaaacgatgaggattctgtagccatatgtatcgtttccgcaggaggttatgagaatgatgatgatgacacagatgtgctggtatacagtggtcaagggggaaatagtaggaatactgaggagaggcaagaccagaagcttgagaggggtaacctagctcttgagaggagtttgcataggaagaatgagataagggttgtacgtggcttcaaggatccattttgcctaactgggaaaatttacatatatgatggcctgtacaaaattcatgagtcctggaaggagaaaacaaggtctggtatcaattgcttcaagtacaagctgctgcgtgaacctggacagcgtgatggagctgcattatggaagatgactcagaaatggatagatgatcctgctaccagaggcagggttctactagctgatctgtcatctaaggctgaaactattccagtttctcttgtcaatgaggttgaccatgagaaaggacctgcacatttcacctatactaaccaggtcaaatacgtgaggcctctcagttctatgaaaaagctgcagggctgtggatgccagagtgtttgcctgcccggtgatgccagttgtgcttgtggacaacataatggaggtgatttaccctacagttcattaggattattgtcatgccgcaaaccgatgatctatgaatgtggtgaatcttgcaactgttctacaaattgccggaacagagtgacccaaaaagggcccaggctacattttgaggtcttcaggaccaccaatcgaggctggggtcttcgttgctgggaacctgttcgtgctggttcatttatatgtgagtatgctggtgaggtcattgatgaactcaaagttaatttgaatgacaccgaagatgattacatttttcaaactgtatgccctggtgagaagactttaaaatggaattgtggacctgaactattaggtgaagctagcacatatgtatcggctgatgaatttgagccactgcctatcaagataagtgcaaaaaacatgggaaatgtctcccgtttcatgaaccacagttgctcacccaatgtcttctggcaacctgttcaatatgatcatggagatgatggacacccacatataatgttctttgcactgaaacatattccacccatgacagaactgacttatgactatggtgttgctggagctgaatctagtggttcaggctctcgtagaacgaagaactgcatgtgtggatcacaaaactgccgtggactattttgatgggttaagatccttgctctttgtggttaatcatacaaaccactttcagctagatcctttcttagtctccggatgatatgagtatgactgatgattccaattgctgccatgtgtactgtgaagacagcaagttgttgtcaaactgtagaatttctgttgccctgcacggcatggtggccgttctcccaccatttgttcaaatatttatgggggtgtgattgatgtatttcttctgctaatcttgtccacctgctgcaccggtttgtgtaaacttgttatgatccctgtttgctctggacgcctggttgtttaaccgtgactccttggatctggtcatgtaaattatcctggtttaggattatgttgcttttgactcgaattttctgcctcccttgctcgtttcatgtgatgcatcgtggccgatattttcagcaag

SEQ ID NO: 18191 - DNA, 2041 bp, Zea mays
gcacgaggttccccccggcaaacacactcggttctcccgtgcctctcgccgtctcgcgtcgcaacgactggccggccgccgccgccaccgccgacctacgtgccaaggtccgcatattcggaaccttcgccggcgagcacccaccaggattttttttttgtacatctaagatgtacagggcctcgaatttcatacctgatcctaatcaggtgctcctagatgccaaaccattaagatcgttagctccaatgttccctgcccccatgggagtcaatgttaatcagtcaagtacaccaccattggtctgtgtcactccggttggtcaattttcagcagggtttggtgcaggtaaccttcctgcctttggatcgttcactactttcagtgccacttcaaatggtgtttcttatgcaggcaccagtgctaatggtgccattgatgtgctggtatacagtggtcaagggggaaatagtaggaatactgaggagaggcaagaccagaagcttgagaggggtaacctagctcttgagaggagtttgcataggaagaatgagataagggttgtacgtggcttcaaggatccattttgcctaactgggaaaatttacatatatgatggcctgtacaaaattcatgagtcctggaaggagaaaacaaggtctggtatcaattgcttcaagtacaagctgctgcgtgaacctggacagcgtgatggagctgcattatggaagatgacccgcacgtggatagatgatcctgctaccagaggcagggttctactagctgatctgtcatctaaggctgaaactattccagtttctcttgtcaatgaggttgaccatgagaaaggacctgcacatttcacctatactaaccaggtcaaatacgtgaggcctctcagttctatgaaaaagctgcagggctgtggatgccagagtgtttgcctgcccggtgatgccagttgtgcttgtggacaacataatggaggtgatttaccctacagttcattaggattattgtcatgccgcaaaccgatgatctatgaatgtggtgaatcttgcaactgttctacaaattgccggaacagagtgacccaaaaagggcccaggctacattttgaggtcttcaggaccaccaatcgaggctggggtcttcgttgctgggaacctgttcgtgctggttcatttatatgtgagtatgctggtgaggtcattgatgaactcaaagttaatttgaatgacaccgaagatgattacatttttcaaactgtatgccctggtgagaagactttaaaatggaattgtggacctgaactgttaggtgaagatagcacatatgtatcggctgatgaatttgagccactgcctatcaagataagtgcaaaaaacatgggaaatgtctcccgtttcatgaaccacagttgctcacccaatgtcttctggcaaccggttcaatatgatcatggagatgatggacacccacatataatgttctttgcactgaaacatattccacccatgacagaactgacttatgactatggtgttgctggagctgaatctagtggttcaggctctcgtagaacgaagaactgcatgtgtggatcacaaaactgccgtggactattttgatgggttaagagccttgctctttgtggttaatcatgcaaaccactttcagctagatcctttcttagtctccggatgatatgagtatgactgatgattccaattgctgccatgtgtactgaagacagcaagttgttgtcaaactgtagaatttctgttgccctgcacggcatggtggccgttctcccaccatttgttcaaatatttatgggggtgtgattgatgtatttcttctgctaatcttgtccaccagctgcaccggtttgtgtaaacttgttatgatccctgtttgctctggacgcctggttgtttaaccgtgactccttggatctggtcatgtaaattatcctggtttaggattatgttgcttttgactcgaaaaaaaaaaaaaaaaaaaaaaaaaaaaaagaaag

SEQ ID NO: 18192 - DNA, 2071 bp, Zea mays
  misc_feature (2068)..(2068): n is a, c, g, or t
gcacgagcagcggcgcacggcgcgggcggggcggcattcgcgtgcgtctcgccgtctcgtcacatggtggtgagggtgggccggtggggcttgtacgctagccattaatacggcaggtcgcccatcccatcccatcccgcccgccgcgcccgccggtctccacccctccccccaccccctgcttaaaatcccgcgccccggggccgcccgcgactccgcctccgctccccgctcgccgccgcgattgctggattggctgccgccagcgccccggtgctagctcccgttcctcgcggtggtcgctggactagcctggacgccgcggcccgccgcctggtcgaagagatggactcggtcatggccgcccccgactcgccgccgcagactgtcgtgctcgtctctgccggcgccagccactccgtcgcgctcctcacgggcaatgtcctgtgctcgtggggcaggggcgaggacgggcagctcggccacggcgacgcggaggaccggctcgtgcccacggtgcttagcggcttcgacgcgcccgcgatcacgtccgtcatctgcggcgccgaccacaccaccgcctactccgaggacgagctgcaggtctacagctggggctggggagactttgggaggctggggcatggcaactccagcgacgtcttcacgccccagcctgtcaaggcgctgcaggggctcaagatcaaacagattgcctgcggggacagccattgtcttgccgtcaccatggccggagaagtgcagagttggggccgtaaccaaaacggacagctaggccttggaaccactgaagactcgctgctcccacaaaagattcaggcttttgagagtgtttgcgtgaaaatgattgctgccggtgccgaacatactgctgcagtaactgaagacggtgacctctacggatggggttggggtcgatatggaaacttaggtcttggtgaccgtaatgaccgtttgcttcctgaaaaagtatcttctgtggagggtgagaagatggtgcttgtggcatgtggatggcgccatacaattacggtttctgactctggtaatctgtacacttatggttggagcaaatatggtcagctagggcatggtgattttgaagatcatttagttccacataaagtagaagctttgaaagatagcactatatcccagatttcaggcggctggaggcatacgatggcacttacatcagagggaaagctttacggatggggatggaacaagttcggacaagtcggagtcggcaacaacgacgaccacagctcccccggacaagtcagttttccagaggatcagaaaatctcccaggttgcatgcggatggaggcatactctggccctctccgagaagaaaaatgtcttctcctgggggaggggcactagcggacagctcggcaacggtgaaatagtcgacaggaacacgcctgtgctgatcgatgccctgagctcagacggttctgcctgcaagaagctggagtcatccacggcagccccattcgcagccaaagtttgggtgtcgccgtcagaacgatacgccattgtccctgacgagaacgtccgtaaagcaggcggaggcacggcacgaggcaacggcgccgacgcgaacgtgccggagaacgacgtgaagaggatgcgcgtgcagtcgtcgtagtaggtcttctactaccgtccactccaccacccccccgttaaccctactagtagtaagtactacgaagacgaaccggtgccccatctagcggcgcccgatttttgtgcgttacgttctgcctaaaagtgctttccgtcgacggacggacctcctggtgttgagatggtagcggtagcactgcctcgcggcgatggtgtgtgtcgtgacgtgattcacctcttagagtagagaggtggctagcccagtcgacctgtgttgtgtgtgttgttaagatgtgtcctggatcttttgtgacattgcatggagggtacaataagcgcttcgtttctcgtttcataaaaaaaaaaaaaaaaaaaaaagaaaagggggggtggccgcgaaaaaaaaaaanagg

SEQ ID NO: 18193 - DNA, 1846 bp, Zea mays
gcacgagaccattacctagaacatcctaatcgaaaaactccgcctccgctccccgctcgccgccgagattgctggattggctgccgccagcgccccggtgctagctcccgttcctcgcggtggtcgctggactagcctggacgccgcggcccgccgcctggtcgaagagatggactcggtcatggccgcccccgactcgccgccgcagactgtcgtgctcgtctctgccggcgccagccactccgtcgcgctcctcacgggcaatgtcctgtgctcgtggggcaggggcgaggacgggcagctcggccacggcgacgcggaggaccggctcgtgcccacggtgcttagcggcttcgacgcgcccgcgatcacgtcagtcatctgcggtgccgaccacaccaccgcctactccgaggacgagctgcaggtctacagctggggctggggagacttcgggaggctggggcatggcaactccagcgacgtcttcacgccccagcctgtcaaggcgctgcaggggctcaagatcaaacagattgcctgcggggacagccattgtcttgccgtcaccatggccggagaagtgcagagttggggccgtaaccaaaacggacagctaggccttggaaccactgaagactcgctgctcccacagaagattcaggcttttgagagtgtttgcgtgaaaatgattgctgccggtgccgaacatactgctgcagtaactgaagacggtgacctctacggatggggttggggtcgatatggaaacttaggtcttggtgaccgtaatgaccgtttgcttcctgaaaaagtatcttctgtggagggtgagaagatggtgcttgtggcatgtggatggcgccatacaattactgtttctgactctggtaatctgtacacttatggttggagcaaatacggtcaactagggcatggtgattttgaagatcatttagttccacataaagtagaagctttgaaagatagcactatatcccagatttcaggcggctggaggcatacgatggcacttacatcagagggaaagctttacggatggggatggaacaagttcggacaagtcggagtcggcaacaacgacgaccacagctcccccggacaagtcagttttccaggatcagaaaatctcccaggttgcatgcggatggaggcacactctggccctctccgagaagaaaaatgtcttctcctgggggaggggcactagcggacagctcggcaacggtgaaatagtcgacaggaacacacctgtgctgatcgatgccctgagctcagatggttctgcctgcaagaagctagagtcatccacggcagccccgttcgcagccaaagtttgggtgtcgccgtcagaacgatacgccattgtccctgacgagaacgtccgtaaagcaggcggaggcacggcacgaggcaacggcgccgacgcgaacgtgccggagaacgacgtgaagaggatgcgcgtgcagtcgtcgtagtaggtcttctactaccgtccactccaccccacccccgttaaccctactactagtagtaagtactacgaagaaccggtgccccatctagcggcgcccgatttttgtgcgttacgttctgcctaaaagtgctttccgtcgacggacggacctcctggtgttgagatggtagcggtagcactgcctcgcggcgatggtgtgtgtgtgttgtgacgtgattcacctcttagagtagagaggtggctagcccagtcgacctgtgtgtgttgttaagatgtgtcctggatcttttgtgacattgcatggaagggtacaaataagcgcttcgtttctggttaaaaaaaaaaaaa

SEQ ID NO: 18194 - DNA, 960 bp, Zea mays
cgattgggtacctcgaggccggccggggcctccgctccccgctcgccgccgcgattgctggattggctgccgccagcgccccggtgctagctcccgttcctcgcggtggtcgctggactagcctggacgccgcggtccgccgcatggactcggtcatggccgcccccgactcgccgccgcagactgtcgtgctcgtctctgccggcgccagccactccgtcgcgctcctcacgggcaatgtcctgtgctcgtggggcaggggcgaggacgggcagctcggccacggcgacgcggaggaccggctcgtgcccacggtgcttagcggcttcgacgcgcccgcgatcacgtccgtcatctgcggcgccgaccacaccaccgcctactccgaggacgagctgcaggtctacagctggggctggggagactttgggaggctggggcatggcaactccagcgacgtcttcacgccccagcctgtcaaggcgctgcaggggctcaagatcaaacagattgcctgcggggacagccattgtcttgccgtcaccatggccggagaagtgcagagttggggccgtaaccaaaacggacagctaggacttggaaccactgaagactcgctgctcccacaaaagattcaggcttttgaagagtgtttgtgtgaaaatgattgctgccggtgccgaacatactgctgcagtaactgaagacggtgacctctacggatgggggttggggtcgatatggaaacttaggtcttggtgatcgtaatgaccgtttgcttcctgaaaaagatcttctgtggagggtgagaagatggtgcttgtggcatgtggatgggggcatacaattacggtttttgactgttgtaatgtgtacacttatggttggagcaaatatggttagttagggtatggtgatttttaagataatttagttttatataaaggagtaattttgaaa

SEQ ID NO: 18195 - DNA, 2762 bp, Zea mays
ggaccctcgaggccgcccccgccaggatccggcccccagacgagcgtgtcaaacgttatccggttcaaagccgagcggcgtctcctctctccagcggctccagccaatccggcaatcccgctcccccagctcgctgctcgcccgctctcctccgccctccgccatggcggccttcccctccgcctccccgtcgccggcgatctccgcctcgacctggagcatggcttccctccgtacgtccctccccgcactccgcccctcccccgcgggcaggctccgttcgtcgttctcgcccgcggcggcggccacggctgcatcggtcggctgcctcgggtccttctccggcctcgcgcccgtctcgaatctcctctccctcggcgctgagaactcaagctttgagcatcggttgtttggtattgatgcccgtggaaggatagttgcgatgcgacatgggagacgcgttcctaaacttaacaggcctccggatcaaaggaaagcgctgctgcgtgggcttaccacacagctgctgaagcacgggaggataaagactacaaagccaagggcaaaggcaatgcggaagtatgtcgagaagatgatcacgttggcaaaggatggatctcttcacaagaggagacaggctctggcatttatttatgagaagcatatcgtccatgccttgtttgctgaggttgcagacaggtatggagaccgagaaggtggctacacaaggatcatcccgacgttcccgaggcggggagataatgcacctatggcgtacattgagcttgtttaggtaattgaatatcttgctatgtgattcctgaaatctgaacttccaaggtcactaaaccgcacttactatttccatgtgttgacctagactgtcaacaagacaaactagtattcttatcgttaccagaagtatgcccgtgctaacgctgcgacctacgagggaaatcgttttttttttgaagagggaaataataatgtgaaaaaatgacacgagaaaaataccctctatttccaaacacactcaagattttccaatgtggctggtaaggtgttgtcaaggattatggtgtgtgttgacttctataaataatgtctctgctactagtttggtaaggtaacgctgctgcagtggggatgtgggatagtggccctagtactattggaaagggaaaaaaaatgaaaggtcgttcagctgcttgcccgtggggtattcagcaaattttattctgcttcctgatactttgttggagatgagtttcttacagcttatgttatttttatctgtaggattttccatcggttgctgtggtttcattggttggtgccatgcaggctgagtggtcatgtttgcgcattgccgttcggagatctgtttttttttccctttccttatcaagttgttctgtaccaaagtgtagatcacgcgtgaaatttggaactcgtcaaacttcgttctgtaattgacaaggcgccattatataatctggaaaataagttcgtggcctcacataaaaaaaagaataattatatacatgacattcaaaatttacaaaattggatgagtagttcattttgatgccatggagtgacataaagatgaattagtttccaatttttataaattttgagcggcatgttttaactgaccctaaagaaaaacaggacgtctctttctgatttatgtccacttctgttgctattttagtagcattacaatacatatatatgaatattaagtaatttgaaactacaaaaaaagcatcaacagtcaggatggccgagtggtctaaggcgccagactcaagttctggtcctctaacgagggcgtgggttcgaaccccacttctgacattattttttatttttagttattttattacatttcgttttcccctgttacataccatttagcaaatactttgtcatgtatggagtcctttttcttgttcagtttctggttacgattgttttgccaactgtgcgtttgtccggacgacccggacgcgcgcgtcgacggttctgcgcgctgcccctggcagttgccgctgagcctgagcgaaaggcgtcgtactgcgttagatatctttgtcatctcgtatctggcgaccgaccgaccgaccgatggttcgggtacgtacgtacgtgcgtgcgtggtcgtgccggcgggcgcattggatgcacttgcaccccgggggcaatgacgacgccgccacgtgcgcccgcaggtgcggtaggtggcggcaccccccctcgtgcgtggccgcgtgggcgagggagcacgaacaccggcaccggcagatcagaatcatcagattagcaggccgagcgcgcgaggcaggcacacgcagcgcagcagcagacacgaggcactgggctgggcgcggcgcggcaacgtgcgctgcctccctcccttgcaataaacgcccgagacggaatcctatgcggatactctggtggatacacgcgacgcgacgcgacgcgaatctcaggacgctgctggactctggacggagggcaggaggagcccctgcggcgccgaccacccgcgcactgtgcacatacgcgggccggtgccggtgggtcgttccttggcctcctgccttgcactgttgacgggacgcgaacgggatgggtgatgggtcatcatacgccccacccacccacccacacacccgttgggtgcaccgtgcccccggaaacagcgattaaaatccggcagcatgcagctgcaggttgcatctaagagtata

SEQ ID NO: 18196 - DNA, 951 bp, Zea mays
aggccggccgggggctccagccaatccggcaatcccgctcccccagctcgctgctcgcccgctctcctccgccctccgccatggcggccttcccctccgcctccccgtcgccggcgatctccgcctcgacctggagcatggcttccctccgtacgtccctccccgcactccgcccctcccccgcgggcaggctccgttcgtcgttctcgcccgcggcggcggccacggctgcatcggtcggctgcctcgggtccttctccggcctcgcgcccgtctcgaatctcctctccctcggcgctgagaactcaagctttgagcatcggttgtttggtattgatgcccgtggaaggatagttgcgatgcgacatgggagacgcgttcctaaacttaacaggcctccggatcaaaggaaagcactgctgcgtgggcttaccacccagctgctgaagcatgggaggataaagactacaaagccaagggcaaaggcaatgaggaagtatgtcgagaagatgatcacgttggcaaaggatggatctcttcacaagaggagacaagctctggcatttatttatgagaagcatatcgtccatgccttgtttgctgaggttgcagacaggtatggagaccgagaaggtggctacacaaggatcatcccgacgttcccgaggcggggagataatgcacctatggcgtacattgagcttgtttaggattttccatcggttgctgtggtttcattggtgccatgcaggctgggtggtctcatgtttgcgcattgtcatctggagatctgtttctttcttcccttatcaagttgttctgtaccaaagtgtagatcacgcgtgaaatttggaactcgtcaaacttcgtgctgtaattgacaaggcgccattatataatctggaaaataagttcgtggcctcgcaaaaaaaacacaaaaaaccgccccta

SEQ ID NO: 18197 - DNA, 2918 bp, Zea mays
tttctttaagacatttttgtctcagtggacagtacctagcttagggacatatgttttcttcacatgcatagtttcagcacgatcgatcatgttcatgttgtgaacaaccttttttgttggagttcaaacttcaaacatttatgcagagctttcattatatccctagcttttgatgccctacatgtatattgtatttcaaagttgtattctgatcgaaacctgatcctaacttgagtatggtgtctttgtaacaacaaattgttctatgatcatgctgagtttgtttatatgaattggttgctgcatcaacgaattttttttactcattgtaaactacaatttcatatgattatatgattatgtgaaagccatagcgcccgataggccgcagctttattctagttcattaaaaagctgcacaaaacaagccactgttagacgtcagcccattacaaaatcaaacccattttgccccggtcatgaagcccattacaacgtgcagaaacccaatccacagcacgagcgtgtcaaacgttatccggttcaaagccgagcggcgtctcctctctccagcggctccagccaatccggcaatcccgctcccccagctcgctgctcgcccgctctcctccgccctccgccatggcggccttcccctccgcctccccgtcgccggcgatctccgcctcgacctggagcatggcttccctccgtacgtccctccccgcactccgcccctcccccgcgggaaggctccgttcgtcgttctcgcccgcggcggcggccacggctgcatcggtcggctgcctcgggtccttctccggcctcgcgcccgtctcgaatctcctctccctcggcgctggtaaaggaatcgtagcaaatgcctgagttattaggcccgagattatagtgtgctgcatgttcgttgccgatggatgtcgtaccactgtaccaggaatgtcacagagtttgtagcgagtcagggaacagttataaattactataggagtgtcaattgttagttcataaatgcataatacaccacaaagtgcgacatgttgtgtcatgatataaatatattttaacaaaagtgaagtgcgcttttcaacctcgaacttaggctttgtttggaagcgaccttgtttttaagaatccattttctatctttagtttttagaaactgggttattgtgtttggaaccaactcaattttcataaactaattttagctagaggagcctagctttttggtttttaagaaaatggaaatctagtttctataaactaggacataaactgatatgtttgaaaccaactcaattttcataaaccagtttcttacaaattgggtgctttcaacaggaccttacatgatagtctgattttcaaatttgaactgtgaaaccggtgcccttcaactgtcaaaatgggatgcattggtactcttgctggttttaaggtggtttttccaatttcttaaaaataataaaattttggtttgatctctagaaattcataaataattcattgtaacactggttttattctaaaagggttatgtatctttcggtgctctattcagagttatttggatattattggtttgaaataaataatagtaacgaatatgagcaataaagcaattaaaaaagttcaaataactatatagattataaataggtagatagcattttttaggaaaaagttggtactagttttacctttttgttttaaaataatttatttataaatttttagatagttgaccagctttattatatttataaaatagaaagccacctttgaaccagcaagaggaccaaatttatccagttttgacagttaaaagttatgtattactacccggtttcatagttcaaggctggaaatcaaactgtcatgtaagttggaggttgaaaaatgcactttacccttttaacaaagctccaacagaaagaaagttagccactttgtataaagattatgttattttacttgattgcattatttatttgcggttagcacacagctgcagtttaattgccattcagcatgacagtatgtacatattttaaatactagttttacacacctgctgtggctgtatcagcttggtctggtttgttatgatgtcagaatatgtcattagatcagccttttcactcaaatttcataactacgatgcacactgaaaaaactaggattgtggttgaaccttcttttgaaatttcctcgcaagctccgtctcgaatctcctcttttttgtccctcggcgctgagaactcaagctttgagcatcggttgtttggtattgatgcccgtggaaggatagttgcgatgcgacatgggagacgcgttcctaaacttaacaggcctccggatcaaaggaaagcgctgctgcgtgggcttaccacacagctgctgaagcatgggaggataaagactacaaagccaagggcaaaggcaatgaggaagtatgtcgagaagatgatcacgttggcaaaggatggatctcttcacaagaggagacaggctctggcatttatttatgagaagcatatcgtccatgccttgtttgctgaggttgcagacaggtatggagaccgagaaggtggctacacaaggatcatcccgacgttcccgaggcggggagataatgcacctatggcgtacattgagcttgtttaggattttccatcggttgctgtggtttcattggtgccatgcaggctgagtggtcatgtttgcgcattgccgttcggagatctgtttccttttttcctttatcaagttgttctgtaccaaagtgtagatcacgcgtgatatttggaactcgtcaaacttcgtgctgtaattgacaaggcgccattatataatctgaaaactaagttcgtggcctcgcaaaaaaaaaaaaaaaa

SEQ ID NO: 18198 - DNA, 1006 bp, Zea mays
cattggccgactcccggccccccggacgagcgtgtcaaacgttatccggttcaaagccgagcggcgtctcctctctccagcggctccagccaatccggcaatcccgctcccccagctcgctgctcgcccgctctcctccgccctccgccatggcggccttcccctccgcctccccgtcgccggcgatctccgcctcgacctggagcatggcttccctccgtacgtccctccccgcactccgcccctcccccgcgggcaggctccgttcgtcgttctcgcccgcggcggcggccacggctgcatcggtcggctgcctcgggtccttctccggcctcgcgcccgtctcgaatctcctctccctcggcgctgagaactcaagctttgagcatcggttgtttggtattgatgcccgtggaaggatagttgcgatgcgacatgggagacgcgttcctaaacttaacaggcctccggatcaaaggaaagcgctgctgcgtgggcttaccacacagctgctgaagcatgggaggataaagactacaaagccaagggcaaaggcaatgaggaagtatgtcgagaagatgatcacgttggcaaaggatggatctcttcacaagaggagacaggctctggcatttatttatgagaagcatatcgtccatgccttgtttgctgaggttgcagacaggtatggagaccgagaaggtggctacacaaggatcatcccgacgttcccgaggcggggagataatgcacctatggcgtacattgagcttgtttaggattttccatcggttgctgtggtttcattggttggtgccatgcaggctgagtggtcatgtttgcgcattgccgttcggagatctgtttttttttccctttccttatcaagttgttctgtaccaaagtgtagatcacgcgtgaaatttggaactcgtcaaacttcgttctgtaattgacaaggcgccattatataatctggaaaataagttcgtggcctcccataaac

SEQ ID NO: 18199 - DNA, 943 bp, Zea mays
tatattataattttttgagaacaccgacactccttcctaataaaagaagtgaggagcaggcaaaggctgcatatagaatgctacgtgattgttttcactattctctgaatacttcaacatgtagagccaaaatattagtgaagtactttggcgaagactttggtcctgatggatgtcgcatgtgtgacatctgtactaatggccctcctcaaatgcatgatttcaaggaagaagcgattgtgttcatgaatgtgctccagggtcgaagtggcggtgaaactgatgagatgatttacagcagagtaccccattacagctctggcaggagagggtttggcgaggcacctaattttagaatggttgtcagtcatataagggaaaagcttcctaggtttgctgcgactgacaagatatggtggcaaggtctttccccgtatattagagggcctgagatacgtagaggaagcagctgaaactcctcgtgtctccatgcagtaccctgaactgacggaggacggattaaagtttcttagtagctcacagtcggaggcacctctgtatgcatacccggacgcggcaatgctcttggcaatgaaggagccaaggcccttctctggtttctccgattggggcaggggctgggccgatcccgagactcgccggcagcgtctggcgggcaagaaggccgggagaagaaagcggaagtggcgctcccgggggcggcagcagcagcagcagccgggcggcttcaccacggcgagggagagactgactgcgatactggcaaagaagaaaaaaaggtgatgctgtgcaaggttggtggtagtaggattacattacatgtatcgtttgctgttatcgtcgaactttatatgagaatctttctgatagaagcaaagattttttttggggccattgtgcttctatcgtatggtatgatgat

SEQ ID NO: 18200 - DNA, 5040 bp, Zea mays
gtgctacatttttactatagggttgtgagacgaatattgtcatgtaagttatagattagaaaccaattcttgtaatgcataaaatcatttcccaccctctactccatgaatttgagatagacttatatctgaactttagaaagtggtggaatgtcaaattccaaactaaataagttactttattgagtgaattccaatttctctaaaatgaagggatctaaacgccccgtaatttgatttcggttccgataaatttggggcgcctcgtcggcccccatttattttgttgagacctagatacgggcccttgctctcctcggcccaccgatccacgccccgcacgcacacgacccgcagaccgcaccctgtcggcgagctcgctcccgttcccgtccgctgctctccgctcgacgccgccgtcttccgcgcagctagtgtctacactcccggcgacgatggcggaggacttggttttggacacggcgatccgagactgggtcctgatcccgctctccgtggttatggtcctcatcggcgtgctccgctactttgtctccaagctcatgcgctccccggcgacctctccgtctcccgaccccaagctcgttaaggaagggcaggtggtcatcagggcgaggaacctgaggaccaacgcacagttcatcccggccaaggctttcaaggcacgcaaggtttattacaccaacgaggaaaatggattacttcatgttccaaaggaagacgcgcagaaggctcaggcagccatgttttctgatccaaacatggccatggacatgatgaagaagaacctatccatgatagttcctcagacacttacatttgcatgggtgaactttttcttttcaggtttcgttgcagcaaaaatcccctttccgcgaggaacctgaggaccaacgcacagttcatcccggccaaggctttcaaggcacgcaaggtttattacaccaacgaggtaattcaccaagtccagttaagaaaggatcaaggaaacgattaagcttaccatgtgcagtaacatgaatgccacgatgagtgtgatgatgcttagttattatgatttcaaacactgaatggactattccacatgacttctccagtgtatatcgtgtttacggtatctagtgactgtaggaaaatggattacttcatgttccaaaggaagacgcgcagaaggctcaggcagccatgttttctgatccaaacatggccatggacatgatgaagaagaacctatccatgatagttcctcaggttctgtgttccgtacactgatttacttgtggtgcactatagttggctaatcgtgtggcattctaccgtatgttatattaacatcataacttgtgtttttgcagacacttacatttgcatgggtgaactttttcttttcaggtttcgttgcaggtatgttcatatttgcttaatatgtatatgatttgagaaacctgatcttttcacatggcagatacacagtttaattctcatattaatttcacgctgttgtaagatcatctctgtttgttccagaagctcaattctgcctttcaagtctttgcaaagttattttgtataaacacatctcaacttatcttatggtatcattaatagatgatggaaatgctttttaatacattttggtatgacaattttcggaagaaacctaataccgaaactatgctctgaagtcgacatttcttttcacttttaaaattgaaaattgtagggtaagatgctattttatggtcacgttaagcattttcaacttctggtttgtgatcccaataaaaatagagatgcattctttaagaattggcagttttcatgtaatagagcagacatatacccacacatattatttgcttctgctggttttggtatcatgtgttatatatcctatcggatgtagttgaagcatactcacatatatgcaaatatcttttcagcaaaaatcccctttccattgactcagagattcaggggaatgctgcaaaatgggattgacctgagcactgttgatgtcagctatgttagtagccggtcatggtatgtataaaatatttacctttatgtcaatgaattaccttgatggtatagcgactaggatctctaaatctctaatgtctgctgttaccgataggtatttcctcaatttattcggcttgaggggtcttttcagtctgatccttggtgaagaaaacggtactgatgctcaccttgacatgtctctgcaaaacttgtcagtagcatttattgaccattttgcattgcctgggagtttgattatctttgcctgtatgtgcagcaactgatgatgcacagaagatgatgcaaatgggtggtggatttggatttaacccaacaatggtaaggtgctctatgttttttatgcaattcttggtgcttgttcttgattgatacatgatgatgcattgtacaccacacgacactcacttttggattcgaaggaaacaaaaaagctctgcttagcgtttagtccttcacttctttatttgccagtcccgtgtttaattcagcattcttacaaattagattaattcatcttacatagaagtttgtggttagagggagcatttgtgaatgaatgttgacttacatgtatcataagttattatggtatgcagttacagtaaatcagcgagctcatacaaatgttgttccaaggatcctaatgtacagtggaaattgaagctgatttcctcttgctctggtgtcagacatctgattctgcaagaacttaattgctccaatgcccagcttttggaatcttgagatatctatgttatgaactcagaagttttcgccgctgtttttttatttttcacttagttttgatggtgtcttgctgccatagttatctagagcagatttcttggtgtgtacggttactggatttgtttgtttattttacatgtctatatttgtgacaagtaattttttgaacttgtgtcttgacaagatttgagaactttactttttcgattggcaatatccagagtttgggagcagagaaagacagcctggatatcatgcagcatgactgggctctacctaagatggagcggcacgcagaagatgtgttgaaacagttgctgaagaaatgactcgaacggttgggcttctgggaagcaacactcgcgtcgcgtcttccagtttttgttgaagccagtttggaccaggaattttaccatttctaaatgtattatttataactagctactataacacccttagaaggtggagacccggtgttgtgatacttaatataagtagaaaaaacgtaattctgttactttattctcctgatatttatgagcatcgtttaagcactcgtgtggtgatttctttctcctgctgatgaaatctgccaggtttttttttttttttttttgttgtactatctgtaaccttatcgatcgccaagataagacatcatcttatcgggaaagaggaacgccctttgttcaaaagatggccaacataatgactgattgttcttagagctgcagctgtaggtctcgacggcggcagccgccggatcacatgaccgggtagctcgggagcatagcgatgccgcagaggccagacgcgacgctggcttcgcgttgcatgaggatgtagccggcgtcgccccactcgggcccccacgagttcttgacgatccagtacttcttcccgggcacgccgctaccgtcgccgtccgtgtccccctgggtctcgccgtacccgaccaccgtgacgccgtggttcagctcggcggtgcagggtcccgtgaagacgccgccgccgtagagctgccacacgaagctgccggcgtccacggccacggacaccggctgcgccgcggcggcccgcaggaggtccggctcgctgctgggcgtcacgttcatgtacccggagatgctcaccgcgctctccttcagcttcggcgtctggcaggcgccgttcagccctgcaccgcgaacgcaacggacgtggagctagctagaaatgcaaatctttgatctcttggtacgtttcccctcgtcccggattcgggtagttccgttcggtggtgaggccgcggttcttcatgacgaactcgaaggcccagctcatgtacccgccggcgcagccgatggccttggtgtcgcagtccaccagctcctgctccgacagggacaccagcttcccgttcttgatctggttgatgccctcgatggccgcaacggcggagaacgcccagcaagagcctgcatgcaggacgcgcgcgcaaagtctcatcaaaccaggcgaggcgggcatcgcactcgtcattctccggatcatccatcgttcaccgacgaacgctatatatcactcaccacagtccccctggctcttcaccggcgcgacagctcccttctctcgccagtccacgcttttcggtagatcagaataaccctgacgacccatcagtccacttccaatctataaccagcacgaacatcatgaaaaagttaattaacatgggatggctgagaaacttgcgtggattgccgcgattactgagtactgacaatgcaagctagctcagatggtttcagagaaagagagtacagacacaagccacggtgctcggcgctgtggagtgcccggctccgcctccgctgcgaggccgtccgaagcccagcatcttggccctgaactcctcgttcgtcaggtcggcgaacttgttgtcggccagcctgtacccgttgcccatggagttgaaggtctcgaccagctcgacgttcctccggtacacctcgagccgcctctgcttctctccggcgtcagcgtacagccggccgtgcctgcccatccactgctcgaacctctcgagcatcgggtcggcacgcgctactagggccgcgccgcatatccagacgacagccagcagcagcgcgagaagccggggagacctcgccattgctggacctttggcttggcctctggggagtggggaggaggacgacgatcggcaacggtgcatgcacggag

SEQ ID NO: 18201 - DNA, 2019 bp, Zea mays
  misc_feature (157)..(157): n is a, c, g, or t
gccgcgtcgacttttttttttttttttaggtagaaaaaacgtaattctgttactttattctcctgatatttatgagcatcgtttaagcattcgtgtggtgatttctttctcctgctgatgaaatctgccaggtttttgacacgatcttaaatgttgnactatctgtaaccttatcgatcgccaagataagacatcatcttatcgggaaagaggaacgccctttgttcaaaagatggccaacataatgactgattgttcttagagctgcagctgtaggtctcgacggcggcagccgccggatcacatgaccgggtagctcgggagcatagcgatgccgcagaggccagacgcgacgctggcttcgcgttgcatgaggatgtagccggcgtcgccccactcgggcccccacgagttcttgacgatccagtacttcttcccgggcacgccgctaccgtcgccgtccgtgtccccctgggtctcgccgtacccgaccaccgtgacgccgtggttcagctcggcggtgcagggtcccgtgaagacgccgccgccgtagagctgccacacgaagctgccggcgtccacggccacggacaccggctgcgccgcggcggcccgcaggaggtccggctcgctgctgggcgtcacgttcatgtacccggagatgctcaccgcgctctccttcagcttcggcgtctggcaggcgccgttcagcccttgatacgggtagttccgttcggtggtgaggccgcggttcttcatgacgaactcgaaggcccagctcatgtacccgccggcgcagccgatggccttggtgtcgcagtccaccagctcctgctccgacagggacaccagcttcccgttcttgatctggttgatgccctcgatggccgcaacggcggagaacgcccagcaagagccacagtccccctggctcttcaccggcgcgacagctcccttctctcgccagtccacgcttttcggtagatcagaataaccctgacgacccatcagtccacttccaatacaagccacggtgctcggcgctgtggagtgcccggctccgcctccgctgcgaggccgtccgaagcccagcatcttggccctgaactcctcgttcgtcaggtcggcgaacttgttgtcggccagcctgtacccgttgcccatggagttgaaggtctcgaccagctcgacgttcctccggtacacctcgagccgcctctgcttctctccggcgtcagcgtacagccggccgtgcctgcccatccactgctcgaacctctcgagcatcgggtcggcacgcgctactagggccgcgccgcatatccagacgacagccagcagcagcgcgagaagccggggagacctcgccattgctggacctttggcttggcctctggggagtggggaggaggacgacgatcggcaacggtgcatgcacggaggcgcgatgattgttggaatgtggaagtacttgtagtcgtccgcccggacgttgcttgcgacaagcctggggacattgcgagaaaggtcgttatggactgtcgtcatgccgcgagcgtgaaattggggacgaatctctcttgctgatttgcacaaagctagcttgcaccgttgcatgtgaactgcgctggaaagaacaatgctgcacggggctttcgtttctgacggcaacctgtcctggctcttccgttgtctttcgaccttcaccttgttccgtgaagacatgcttgccttcaatggaaagaacactgcgccttgccatacatggaaaggtaagcttgttgccctagagtgtaaatcatccagcatgcagcatgcaggaaacaatgtggaaattaggagcaaaacattagatatatacaccacccataacttttacatcatcctacaccagattgactatatgaagattaaagaacaatcaaccaatttcttcttcttcttctgaaaaacaaaccgatcgagcagttattggaagctgaaaaaaaaaacagaaacggggcagtgctgaaactgcag

SEQ ID NO: 18202 - DNA, 2532 bp, Zea mays
  misc_feature (1223)..(1227): n is a, c, g, or t
  misc_feature (1493)..(1497): n is a, c, g, or t
  misc_feature (1683)..(1713): n is a, c, g, or t
  misc_feature (2014)..(2018): n is a, c, g, or t
  misc_feature (2143)..(2165): n is a, c, g, or t
  misc_feature (2486)..(2507): n is a, c, g, or t
cctcgaggccggcccggccggtattttgttgagacctagatacgggcgccttgctctcctcggcccaccgatccacgccccgcacgcacacgacccgcagaccgcaccctgtcggcgagctcgctcccgttcccgtccgctgctctccgctcgacgccgccgtcttccgcgcagctagtgtctacactcccggcgacgatggcggaggacttggttttggacacggcgatccgagactgggtcctgatcccgctctccgtggttatggtcctcatcggcgtgctccgctactttgtctccaagctcatgcgctccccggcgacctctccgtctcccgaccccaagctcgttaaggaagggcaggtggtcatcagggcgaggaacctgaggaccaacgcacagttcatcccggccaaggctttcaaggcacgcaaggtttattacaccaacgaggaaaatggattacttcatgttccaaaggaagacgcgcagaaggctcaggcagccatgttttctgatccaaacatggccatggacatgatgaagaagaacctatccatgatagttcctcagacacttacatttgcatgggtgaactttttcttttcaggtttcgttgcagcaaaaatcccctttccattgactcagagattcaggggaatgctgcaaaatgggattgacctgagcactgttgatgtcagctatgttagtagccggtcatggtatttcctcaatttattcggcttgaggggtcttttcagtctgatccttggtgaagaaaacgcaactgatgatgcacagaagatgatgcaaatgggtggtggatttggatttaacccaacaatgagtttgggagcagagaaagacagcctggatatcatgcagcatgactgggctctacctaagatggagcggcacgcagaagatgtgttgaaacagttgctgaagaaatgactcgaacggttgggcttctgggaagcaacactcgcgtcgcgtcttccagtttttgttgaagccagtttggaccaggaattttaccatttctaaatgtattatttataactagctactataacacccttagaaggtggagacccggtgttgtgatacttaatataagtagaaaaaacgtaattctgttactttattctcctgatatttatgagcatcgtttaagcactaaaaaaaaaaaaaaattctaccactgatgaaagcggccaggnnnnngacacgatcttaaatgttgtactatctgtaaccttatcgatcgccaagataagacatcatcttatcgggaaagaggaacgccctttgttcaaaagatggccaacataatgactgattgttcttagagctgcagctgtaggtctcgacggcggcagccgccggatcacatgaccgggtagctcgggagcatagcgatgccgcagaggccagacgcgacgctggcttcgcgttgcatgaggatgtagccggcgtcgccccactcgggnnnnnacgagttcttgacgatccagtacttcttcccgggcacgccgctaccgtcgccgtccgtgtccccttgggtctcgccgtacccgaccaccgtgacgccgtggttcagctcggcggtgcagggtcccgtgaagacgccgccgccgtagagctgccacacgaagctgccggcgtccacggccacggacnnnnnnnnnnnnnnnnnnnnnnnnnnnnnnnccggctcgctgctgggcgtcacgttcatgtacccggagatgctcaccgcgctctccttcagcttcggcgtctggcaggcgccgttcagcccttgatacgggtagttccgttcggtggtgaagctagaaatgcaaatctttgatctcaaggcccagctcatgtacccgccggcgcagccgatggccttggtgtcgcagtccaccagctcctgctccgacagggacaccagcttcccgttcttgatctggttgatgccctcgatggccgcaacggcggagaacgcccagcaagagccacagtnnnnntggctcttcaccggcgcgacagctcccttctctcgccagtccacgcttttcggtagatcagaataaccctgacgacccatcagtccacttccaatacaagccacggtgctcggcgctgtggagtnnnnnnnnnnnnnnnnnnnnnnnggccgtccgaagcccagcatcttggccctgaactcctcgttcgtcaggtcggcgaacttgttgtcggccagcctgtacccgttgcccatggagttgaaggtctcgaccagctcgacgttcctccggtacacctcgagccgcctctgcttctctccggcgtcagcgtacagccggccgtgcctgcccatccactgctcgaacctctcgagcatcgggtcggcacgcgctactagggccgcgccgcatatccagacgacagccagcagcagcgcgagaagccggggagacctcgccattgctggacctttggcttggcctctnnnnnnnnnnnnnnnnnnnnnngatcggcaacggtgcggacgcgtgg

SEQ ID NO: 18203 - DNA, 4332 bp, Zea mays
gtttacatccaaattacaaccagtgatcaaagggatgattctagcatccaatcacgtgtgtatttgttttaatctcctttgttgactccttaacaaacacaagcttcgtagaactatacatacattccatctagtctcacaagcagaaaaataatttcgtatagaagttgctgcttattatattaactttctaaaaccattagtttaacaagtaaattatataaaatttctggacatactttataaggccgttatcaaacacatttacattccaggagacactaacgaacccctcattcatcaaatcatttgatgggcatcgtgcatagtagtttagctaactaagtctatgccaaaaaaaaaagaactaactaactctcaggctgcgcatgggcatggcagacacagcaccgagcggccgcttgtttcttgacgacgagtatgtggagtaggctgtcgtcccacacgtccacgccgaagaggcggaaccgccgctgcacgaaggcccatatcgcgacgtcgtcgccctccttaaatgtgcactggcgggtgaattggaggtacccctctcccttgacgatcgtgccctggctgctatcccaccgcgataaccgcagctccttggcgccggcttggaggtccacgagcatcacgggcagcccgccgtgtgccttccccttcttcttggctgtcgtcctcctgttgttgccatcctgcggttcaggctgctgccccctcggccgcctcctcggcccctccaggaggttggcggcctcgagctcttgggggctcaggatcgggcgaaggtggcgctcgacaccgtccagcgggatgcggaaccggctctggtgcccgtccagatcggtcttcgacacgcgcttgtcgtgtatgaagtgcaccggcaggtcggcgcggagccccaacgcctggaggaaatgcctgcgcaggcatgggggcgcttctcggctgccggcagccggctgtggcggctgtagcgagggcgggacgacgacgacgctattgatgggtgcgacgtcatgaacggccccaacgtacggaactatcgcacctgctgacgccgtcgcctcctccagcaacgatgatgaggaggaggacgacgacttggcgctggcctcgtcctgccgcgcccgcttgttggcgcgctgctgggactcggcgaaggcacggtcgtatactacgatctcgagagagcgcttggcgtcgacgagacacatctgctggtgcgttgttgcgcggcagaatggaacgtggaatggattgatggcctcgctgccccgccgccgtgaaatatatatagtggccatccttcgggacacggatcggaggcggagtccgtccgagtccgactggcattaggcggagtccgcctcgctcgcctcactctaacaacccattcgaattcgaattacgcggggcctcgcggtcgcgtgggcgtgggcggcacgagtgcgaggcggcggcgttggcgcgagatggaaggatggcgcaggaggaaaacggaaaaacaaactggtgccgctgcacgtgggatgctcgtgctatactggactctggcccccacttagcccaaattcatttttctatggattttgaatagaaaagaaattaagaaaaaagggaagaaaggttatcttctccggttcctccctccccccccctgtccggctgtcccctcgctgtacacagggtgtctgtcaccgagcagcgggcagccggcaggcaatgcgatgatagtagctgctgctgcccctgcgccgccagttccagcaccgccgggcaaaccgcccttttctctctcctcctccagctcctccttctccctccgccgccgctccttcagcttgtggttctcaaacggcaacgcgcatggaagagacagcgccaccgccaccacgagcagcagggcgacgaggaggtggtggtggtccgatcccggcggcagccgagaagactacggctcctcttctctagaggaggaggacgtttacgattacgaggatgaggctgcgttccccagatttggaggggccgcggaactgttcgatgagccctggctctccaaggtatcctacatacatacttactgtatataatttatgttcctgtattttttttcctttccttattggtacgctatctcgttatactatcgataatttcgattttcctgcgtgcctgaaccttgatagatactgagtctccaaagagtttttctgaattttgctttagaataaaagttgctttctatgtctctgtacttttcaacagcttttctataggtcataagagtcgttattactgtctttcgctaccgataaatctgaaacggtggatgtatatatttggagattcaattaaagatatttatagagtttatttaatcaaaatctctattcgtatagattggggaaaatggtacaaagagtcttgagtcgctctaatgttacctaactgaacattgaacgtatagtgggattgggaccatagatcctttgccagtcattgtgagttacaattacaaatgcttgaaattaaaccaaactatccttcattttttttctggtataaaatcaagcaacaatatatttatttttcctagtatatatctaattagaccaaaaaatctacttatagtagttctctaatttggggatcttaactgatcactacaataaattcacccagacttgtcagcttccattcctgctgcttttcattttatcagtaacttagcatgcatacgagatcagtactgcaataatttaatcaatcaacggacggataattgtgcttcattgttgtagtgactgatcaatgggcctgctgctttctatacttgtggctaggtatataagacttacggaatcctgctaccgttgatgcttgcgtccatgcttgctgcgacaggccaaaggcctttctaatggccatggtgatcccactcagtcagtcggccatatcgtttctgcttgacgctgtatggggaaggaggaaaggcaaccgcgacgacaggaggagaccattccaagaggaagattaccctgaggacgccgctggctttgcggcaggtggtcgaggcaatggataccgcagccgcagcagcagcagcagcaactattatgaggggagaaggaggacgagcaactaccagtcaagtgtttctaacaattttgctggtgctgcctcaactggtgttggagctgacgataacaccaagagcagcagcagtggatatggaggatgggatgagcttctggacaacgacactgctgctcaggagacaaagaggaggagctcattctcagctggcaccactgatcgaagcacaaaatcgcagccttcagcgactggggaggaagatgcagattatactgccactccttcaacaagaacgagaatgagacgacggcggacgccaggaacgatggggttgggcagtaccatgtacaagcaggcaccactcgtgatgcgcttgttggtggcagtcttcccgttcctgggatcatggttcaggctgctctgaattgattgttatatattcgtccacggtggttcgtttatgatttcagaaaaatatatatataagtggccagtggcattaacaaaggattatgattgtgaaaaatatataagcgtactgaagaagatcgattggttcaggcagtgtgcctgcagcatcagctctgtactgctgcatccgccattgcgaagggaaagaatcacagcatctgacttgctggtgcatgtgtgaacctttgcttcctcgcgcttgtgcagctgataatatgtttgtggtcacggtgaacattaactaattgtgtaagtggccagcttagtgttgtgttgcttgtgtgtgtggtgtaagtgatgttgggttcttgcacccattcttcctttttaatataatgatgatacaaaaaaaaaaaaaaaaaggacgtcaatagtgagagcaaagcaaaaaagaaaagtactacctcttttctcgaatatttgtccgccgttagtttatttttaaactaaaccgcgagttagtttatttttaaactaaaccgcgacaaataaaaagtatggaaaatttatatgtagctgttagcgcagtggttttcacttgcatgtggtagtgatggatagacagttggcttgtcaattttgtcctggcagaacggaacggaacagtgaggagggcctttgttctgacaggaggagagcaaagcgaaaacgttggtactttttctataaattcgatcaaacacaaaacaatttgattcaaggtaatttagtatttggagagaaatatatggtggtgataat

SEQ ID NO: 18204 - DNA, 1504 bp, Zea mays
aagaaaaagggaagaaaggttatcttctccggttctccctcccctccctgtccggctgtcccctcgctgtacacagggtgcctgtcaccgagcagcgggcagccggcaggcaatgcgatgatagtagctgctgctgcccctgcgccgccagttccagcaccgccgggcaaaccgcccttttctctctcctccttctccctccgccgccgctccttcagcttgtggttctcaaacggcaacgcgcatggaagagacagcgccaccgccaccacgagcagcagggcgacgaggaggtggtggtggtccgatcccggcggcagccgcgaagactacggctcctcttctctagaggaggaggacggttacgattacgaggatgaggctgcgttccccagatttggaggggccgcggaactgttcgatgagccctggttctccaaggtatataagacttacggaatcctgctaccgttgatgcttgcgtccatgcttgctgcgacagggccaaaggcctttctaatggccatggtgatcccactcagtcagtcggccatatcgtttctgcttgacgctgtatggggaaggaggaaaggcaaccgcgacgacaggaggagaccattccgagaggaagattaccccgaggacgccgctggctttgcggcaggtggtcgaggcaatggataccgcagccgcaggagcagcagcaactattatgaggggagaaggaggacgagcaactaccagtcaagtgtttctaacaattttgctggtgctgcctcaactggtgttggagctgacggtaacaccaagagcagcagcagtggatatggaggatgggatgagcttctggacaacgacactgctgctcaggagacaaagaggaggagctcattctcagctggcaccactgatcaaagcacaaaatcgcagccttcagcgactggggaggaagatgcagattatactgccactccttcaacaagaacgagaatgagacgacggcggacgccaggaacgatggggttgggcagtaccatgtacaagcaggcaccactcgtgatgcgcttgttggtggcagtcttcccgttcctgggatcatggttcaggctgctgtgaattgattgttatatattcgtccacggtggttcatttatgatttcagaaaaatatatatataagtggccagtggcattaacaaaggattatgattgtgaaaaatatataagcgtactgaagaagatcgattggttcaggcagtgtgcctgcagcatcagctctgtactgctgcatccgccattgcgaagggaaagaatcacagcatctgacttgctggtgcatgtgtgaacctttgcttcctcgcgcttgtgcagctgataatatgtttgtggtcacggtgaacattaactaattgtgtaagtggccagcttagtgttgtgttgcttgtgtgtgtggtgtaagtgatgttgggttcttgcacccattcttcctttttaatataatgatg

SEQ ID NO: 18205 - DNA, 4847 bp, Zea mays
cggccgggccgggattctcttcgccgtggggtcggcaggcagggcaaggctaggcagcgcctctccgcgtgtggtccgtgtgcgagggtccgctcctcctcccctccgggcaccccgccggcagcggcgtctcttcttcctggtcgaatctccccgcggctgtgaataggaggaggtcgacgacgccatagcaaaaaacaaatccttggaatgctttcggagggtcggggattcgtcgccggctgcctgcactgatgcttggagcgcgcgaatctgctcaagttttgatcttggcgtgctcttgagtctggaatccgggcattcattggggctttgttctcagtttgcaaggctgcaaggccgtgctagtttgaacccatggagactactagcacaacaaatgaacagactgataggggggcgatgtgggagttggaaaggaatctcgatcagcccatggatgcagaggccggcagattgagaaatatgtacagggaaaagtcctaccctacacttgtgctgttacaacttgctttccaaagccttggtgtggtgtttggggatttaggcacatcacctttatatgtcttctccaacattttccctcatgaaattgaagacacggaacaaattattggagcactctcgcttgttatttactcccttaccctgattccacttgttaagtacgtgttcattgtcttgagggcaaatgataatggccaaggtggaacatttgctctttactcgttgctttgccggcatgcaaagataaacactattccgaatcagcatagaacagatgaagaactaacaacatacagccgccacacatatgatgagaaatctcttgctgcaaagatcaaaaggtggttagaggggcaccaattcagaaagaatgtcattcttattcttgttctttttggtacttgtatggcagttggagatggaatcctcactcctgcaatatcagttctttctgcaactggaggaatacaagtggaagagaaaaaaatgaaaaatgatgcggttgtcatcgtctctgtggtcatattgattggattattcagcatgcagcactttggtactgataaagtcagttggctttttgcgccgatagtatttgtttggttcatactcattggagtcctgggcgctgtaaacatttccaaatatgaccaatctgttctcaaggcttttaatcctatctatgtatatcggtactttaagcgagggaagactagctgggcttctttgggaggaattatgcttagcattacaggaacagaagcactgtttgctgatctctcatatttccctgtacaagctattcagattgctttcacggtggttgtgtttccatgtcttcttttgcagtatacaggccaagctgcctatatagctcagaacaaagatcatgtctcccatgccttctatttttcccttccagattctgtactctggccatcattcattgttgcaacagctgctgcaatagttgctagtcaggcaactatatcgatgacatattcgattatcaagcaagcacttgctctagggtgcttccccagagtgagaattatccatacttccaagaagtatctaggccagatatacagtcccgatattaattggatccttctggtattctgcattgctgtcactgctggatttaaaaaccaaagccagatagcaaatgcatacggtactgccgtgataatggttatgcttgtgacaacatttctcatgatccctataatgctgttggtgtggcgcagccactggaccttggtcatcctgttcaccgtgctgtcactgtttgttgaaattccgtacttcaccgctgtggtgcggaagatcgaccagggtggctgggttccacttgtgtttgctgttgccttcctcatcatcatgtatgtatggcactatggtacgctcaagcggtatgagtttgagatgcacagcaaggtgtccatggcatggatcctaggccttggtccaagcctcggtctggtcagggtgcctggtgtgggcctggtgtacaccgagctggcaagtggtgttcctcacatcttctcacacttcatcaccaacctccctgccatccactccaccctggtctttgtgtgtgtgaaataccttcctgtctacactgtgccactggatgaaaggttccttgtgaagcgaattggtcccaagaacttccacatgtttagatgcgtggcgcggtatggctacaaggacatccacaagaaggatgatgacttcgagcagatgctcttcgacagcctgatgctattcgtcaggctggagagcatgatggaagagtacacggattctgatgagtacagcacccgtgagacgaacctgtcaggcagcgccaacccaagaatcaatggcatcagcgccggttcaaacatggatctcagctacacatcccatgactccattatacaggtgcagtccccaaattatacggggaacagccaggcggtgtcaccaggtcagctgtaccataccgtgggcgacgagattgcgttcctgaacgcgtgcagggacgccggggtggtgcacatcctcgggaacacagtcatcagggcccgcagagattcagggttcatcaagaagattgctatcaattacttgtatgctttccttaggaagatctgcagggagaacagcgccatcttcaatgttccccatgagagcctactgaatgttgggcaggtgttctatgtgtaagcactaaaaccaaacacatgtagtagatgagagttcagcttcggaaccactggagagaatctagctgtgttttgttcataggtaataggagtataatagttgaaagaattgtacagcaaaacagcatctttaatgtgaccatttggagcctgatcagtagtggctagggctggacgaaatactcgtggctcgataactcgctcgactcggctcgttttgattctgtagcgagccaagctagcattttagctcggttctctaatgagccagctcggattagctcgtgagctagctcacgagccaaacgagccaagccacaacacaagtttgtctagtcgtaagtgtcgtctcatctcttatagtctcgatttctcgtagttatgatcagtgatatggacatgtgtggatgcgtcatatgcgtacatgtttgcattattgtatggctacatacctacattgcatatttaatatttgatcattggttatggttttgtgaactttgtttctagcagcatatgatgttagtgttgtgcaatgaaatgttacatgtttgtggaatgtatgatgaattgctttataatgatgcttgttgctattttattataataagggtctgttaatatgtaagttaatatatatttggttatttaatttaatatcaaaagttagaagctagtatgatgattcgataataatattataaaggttttaggtttgtagcgttaaacactcaaaatatgatttttcggttatatatatatttatgtacatagatctttgtatttagttgtgtggctcgcgagcctaacgagctggctcgagctttctaacgagccgagccgagctagatgtttagcttattagtataacgagccgagccgagctggctcgttacagtaacgagctataatgagccgagccataacgagccgagctggctcgatatccacccctagtagtggctgtgttcatcatgtaacttgtactgtatgcacatctgaaatagctggttattaaatccagagtaattttggcgcttccttggccattgttccttgtaagagttaacagcacgtacagccgtacgtcgcacatatcacgagaaaatctgctatatgcaaatagagaaatacatgcaactcgatgcggtactgagcctaacaaccgttctatagaagccggagtttttttttctccctatctcatgggagaggcaagaacttgtacccaaaaagcaactgtttgccgcccaggttttcaacgtcaccttactctcactcaaaaagacatttgaaaaaagattgtatcaccatatttcggtttcagtttgcgtctggaatgtgctgtggtatacccctgctcggctgccgtttttagaagcggctgaagctgtggctgcttgattactacagttcctggtgctgctgctgcagacagttcccatcaggcttaatgtttcttcaaatacgaacgtcgtttcagttcagacatttccattcgggaaccaaatccaaccaatcagcgtagtatcttgagatggagataggaaatgtgcgataccgataaagcaggggtaaaatcttcacggcagcagaaaaacagattacgaggtgtctatatgtatactattctattaagaacttaatatggacatgataccacggcttcaccatctcaatgtccagcgcccgcaaaaatagtacagaacgagcactcgaaccagaacttaatgtggacatgataccatggcttcaccatccccatgtccagcgcccgcaaaaaatagtgcagaacgagcactcaaacctccagaaatttgaggctagccatcacatacgtactttagtatatacatataaacaaaatatatatttgtagtgtatacgctgctcccctgcctcgtgccaactaagatcacatacctagtgagagatgatgaagcaaagacagcaagagatttctttcttttttttctatgatatcattgtgtgtgctttattattaaaaaaaacaaaaaagaaagcaagggagctcacaattcttgtgcttctgcacacacactctggggcccaggaggcgttttcctgagggtcgtcggcctgcag

SEQ ID NO: 18206 - DNA, 1234 bp, Zea mays
aaaacacgactagagtgggtgggagactgggaaagacgagacagcgagacaccactgagacgagagtcagccggcaggtgagacatcgcaggggaaccagctctcaagacggccgacggccggcttgcctacctgctcccatccttcccgagggaccgagaaagataagaaaggcggtggtcaacttgtgtcctgaggtgcccgtagaagcccaaggacaagaaacaaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcaggacaagaagattacaatagactgcgtccgttgagctatcgtggtgctgatgtttttctgctcgccttttctcttatcagcaaagcaagctatgagaatgtctctaagaagtgggttcctgaattaaggcactatgctcctggcgtgcccataatccttgttgggacaaaacttgatctgcgtgatgataagcagttttttgttgatcaccctggtgctgttccaatttccactgcccagggcgaagagctgaggaagctaattggtgctgccgcctacatcgaatgcagttcaaaaacccagcagaacataaaagcagtgtttgacgcagcaattaaggtggttctccagccaccaaagcaaaagaagaggaagaagaaggtgcagaagggatgcaccattttgtaactacaaacggtagagggcaacagtctggctgcggcgctgctgccaatgataaccatcgcctccttgctgtataatatatcgcctgatcatgccaccagcatgcacaagggagatggtggttttaggatccttgtcctactgtgttgtgtagaccaccgggtgtagttgactgtatctggttgtttgtatgtatggacaagacaaaactagcactgcagatggtatggtaaggcgtaagcaaatacaatatgacactggtccagttccaggaatgaatggaatatgacattggtccgagatttgcaataaaaaaaaaaaaaatcaaccaaaaaaaaaaaaaaaaaaaaaaaaaaaaaaaaaaaaaaaaaaaaaaaaaaaaaa

SEQ ID NO: 18207 - DNA, 1169 bp, Zea mays
cggacgcgtgggcggacgcgtgggcggacgcgtgggtgccaccagcatgcacaagggagatggtggttttaggatccttgtcctactgtgttgtgtagaccaccgggtgtagttgactgtatctggttgtttgtatgtatggacaagacaaaactagcactgcagatggtatggtaaggcgtaagcaaatacaatatgacactggtccagttccaggaatgaatggaatatgacattggtccgagatttgcaatacaatacaatatcatcatccaggaagctcatagctgctgctagtaggatactccggtcggagtagctaggtggagacaaggcaacggaagagcagcacagccgccgctgcggtaatggtgcacatgagctggccggggcgcggcggcgtggcgttgcacgaggggcgatccggagcgctgaagcagccatgggtctggtcgatgcccttgccgccggcctccaggagaaaggtggagttggggctgccgctgctgaagaggaggcaccagaagaagggcccgcggcggtcgaagccggcgcccacctgggtgtgctccttgccgcggatcaccgagagcgcggtggctgatgccagcgcgtcctccgggccgtcgcggtcccggtggcagccgaagaggcggccggagatgacgtccaccgtggggagctccacgccgcagttggcggcgtagacctccgtgatgtgggcctcgggggtctggcacgccatcgtgttgccgctgctgcaggcggcgccgcccgtggtggccgccatgcactcggagatgtactgcagcgccatgcacccgaggcctctgctgttgcgcagcgcaggcagcctgctcgcctccctcttgccgttgatgagggccacgaggtcgttggctgggttcccatggatctttgcagaggatacgcccgccggcagcgtcctggtgcagagcagcagaagaatcacaagcttggggatgcagattcgccgcattctgttgctgcggtgacccggtggccgtgccgtacgaattgaattgaagagacggggggaaggaaaaagggggcggtggctcctgttgtgctgtgctgtgtttcgactttcggggagggagggagtacggtctggcccccgccggcaagtgggacaatgtcaacccgaa

SEQ ID NO: 18208 - DNA, 3566 bp, Zea mays
  misc_feature (2741)..(2741): n is a, c, g, or t
  misc_feature (3215)..(3215): n is a, c, g, or t
ccatgtttagaaatcctatagctaatagttagctagttaacaaattattgactgggctgagtctgttaataaactaattgatagctgtttgatagctcaaaattagctgggtattagtcacggatatttgtaacctctacagttaaatttgacagctaactatttgctctgtagattctaatagggccttagtctagacgcgagcgtgaaagggaaataattcccgtttttgttgctgttattgtttgctatacacaacggctagctgagttgtgaaatcgaatctttgtttcgtcatcttcatcactgaatttcagccgccaatttgatttgatgccctttatttgagctcctccggacccgccaggccgggcaccctttcctcggctcttgttcaaataaagaagacaaaacacccggccagcacacagaatgacaggaagcagcaaacctttcggtttctcgagcgcaatgcctctcgctgcagtgctccttcccctcctcgtcctcggcgcgtcgtcggtgtgtcaaggtcaaggcgctgcgagccacaacatcacggccatcctggcggcgtacccggagttcaccgacttcagcgctgccctggtcagcaccggcgccgcggcggagatcgaccgccgcagcaccgtcaccgtcctcgccgtcgacaacgccgtcatggcgcggctaaaggcgcagaagctgcagctcgacgacctgcagcgcgtgatctacctccacgtcctcctggactacttcgacgccgccaagctaggcagcatccagggcggtttcgcccaggccgctagcctctaccaggcctccggcaaggcgcaggggagcgacgggatcgtcaacatcaccgtgttccccgacggccgcgtggcggcgttcacgccgtcgggcccctccaacaggttgccgaccgccttctaccaacgatccatcaaggaacaaccgtactacatcgccgtcctgcaggtgagggacctgatctggtctccggcgccggcggacggggtgcaggctccaccgcccgcgccgcagcccgacgcggcgccggggttgacggatctgctgtccaagaacggctgcgggggcttcgccagcctcctcgccgcgacggccgacgcagtcaccaagtacgacagcagcgccgccgggctcaccgtcttctgcccggccgacgaggcggtggaggccttcaactccaccttcaagaacctcaccgccgacgcccagctcgcgctcctgctgtaccacggcgtggcggaacactactccgcgcagtctctcaaggcgatcaatggggacgtaagcacgcttgcctccgacggatccaagaacaacaacgggtacaacctaacgatacgtgccgacggggacacagtgaaaatctcgtctgcatctgccagcgccgccacggtgaccaagacgctgctcgacaaggcgccgctctccgtctacctcatcgacgcggtgctcctgccaaggcagcagtctaacgacgaccagggacacactgcgcccgcccctgcgccggcctcctcgcctgcacatgcacctacacctgcccttgcgccggtctcgccgtcgcctgcccctgtaccggtctcgccgtcgccgtcgccgtcgcctgcacatgcacccacacccccacttgcccctgctccggtgactgcacctgcgcccaggcgtcgcccagcgccatcgccagagcacactaccccagctccttcgccagacgcggacggccaaccgcctgcagatcagaagaacaacgcagcaagggacacggcatcttggactatcggcgcggcgctggcgatcgtgtgcctcttgtcgtgaagggtttaaggctttaagcttagatatattgacgccgattgggatccgtcatctcgccgccaataccagtgtacactgaagacaatgtttatgggcatgcattggccaaaataatattattctgcttccgcctgctgaactatcctgcgattgctaatcgagctcttgccatcagctccagtttcaaacgggcccaattatgcaagagcaatcgattttttttctggacttcactgaaatctagtgttttaaatctctggacaagacaatttagcgatcgacagaatgaaaaaacagcaaagtgccggctacagtggactgtctcgtttgggacaagtgtaatggatgggatcgaagaaattactaaatactcttgaaacagctatagccagatatagtggtagctagctatagcggaagatttagaaccttgctgaaaaatcgccttatgcaatactatcatggcaacaaattcctaagcatcccatctccttaaaaaatccctaaattcctcataaaagaggaaaatatttctgaatacctcatcttacaatctgacatccatgatattcatcaaagacaagacaacctcctcattcctgaacaccccaacccctaaacataccgcaagctgctaaaaagttatagctgatttaaactggtcagcttattggtaaagtaataaaagtcagcaatttaagcagcaataatccattaactgcccccaataagctaatagggacatctatatgattatatcaataaccaactttacacctagctagatgcattagttgtttggtttgaggaatgagctagttcatcatcttctcactcctcacttttttgtttggtttgtggaatggaatgagttgatccattatcatctnattcattatacttagttagtcagtattaatatgaggaatgaggtcatcccaccaaatttgaggaatagactcatgatgcatcaccacattttgaatggagtgattcctcaaaccaaacaccccctaagtgatccagacagtcccaattttttataatactagtgtaagtgtactgcgtaattaaaaaaatattaaatacaagatatttatatatatccttataatattaaatttattaatatgttggtcttacaacataattgttacgataattgtttaaatcaacagctaatctagttctctgatgaggtgtatcgttgtctgttgtgcagaccatcctgcactttcactttctacccttcttgcatagttgcataagctgccaattataaaaaagtcaccaaaatctcaattatggaaaaccagaaatctgctaattgtagcttggttctatgtcagtgaaaaccaccagcntcctatctttaagctaattatgggctgccactaaattatgagctggcaatgagaaacagatgtgcgcttcgcacatggtagagggggaaacagatgtgcgcttcacgcgtgacgtagttgttaggcgagaaacgaaagcggaaaacagatgtgtccagttgttacatgagaagcgctagaagaggaaacatgtgtgcttcgcgcatgccgcagaacgatcgtcacatgtgatgcaattgttaaggaaaaaagcgagggagagagaaacagatgtgcacttcgtgcgtggcatagaacaaccgttgaaacgagtccttttaagaagtagagataggtaaaataaacctcgaa

SEQ ID NO: 18209 - DNA, 1697 bp, Zea mays
  misc_feature (14)..(14): n is a, c, g, or t
  misc_feature (27)..(30): n is a, c, g, or t
  misc_feature (32)..(38): n is a, c, g, or t
agggccggccgggnaataatgtttccnnnnannnnnnnaaaaaaaaaaaaaaaaaaaaaaaaaaaaaaaaaaaaaaaagttcaaataaagaagacaaaacacccggccagcacacagaatgacaggaagcagcaaacctttcggtttctcgagcgcaatgcctctcgctgcagtgctccttcccctcctcgtcctcggcgcgtcgtcggtgtgtcaaggtcaaggcgctgcgagccacaacatcacggccatcctggcggcgtacccggagttcaccgacttcagcgctgccctggtcagcaccggcgccgcggcggagatcgaccgccgcagcaccgtcaccgtcctcgccgtcgacaacgccgtcatggcgcggctaaaggcgcagaagctgcagctcgacgacctgcagcgcgtgatctacctccacgtcctcctggactacttcgacgccgccaagctaggcagcatccagggcggtttcgcccaggccgctagcctctaccaggcctccggcaaggcgcaggggagcgacgggatcgtcaacatcaccgtgttccgcgacggccgcgtggcggcgttcacgccgtcgggcccctccaacaggttgccgaccgccttctaccagcgatccatcaaggaacaaccatattacatcgccgtcctgcaggtgagggacctgatctggtctccggcgccggcggacggggtgcaggctccaccgcccgcgccgcagcccgacgcggcgccggggttgacggatctgctgtccaagaacggctgcgggggcttcgccagcctcctcgccgcgacggccgacgcagtcaccaagtacgacagcagcgccgccgggctcaccgtcttctgcccggccgacgaggcggtggaggccttcaactccaccttcaagaacctcaccgccgacgcccagctcgcgctcctgctgtaccacggcgtggcggaacactactccgcgcagtctctcaaggcgatcaatggggacgtaagcacgcttgcctccgacggatccaagaacaacaacgggtacaacctaacggtacgtgccgacggggacacagtgaaaatctcgtccgcatctgccagcgccgccacggtgaccaagacgctgctcgacaaggcgccgctcgccgtctacctcatcgacgcggtgctcctgccaaggcagcagtctaacgacgaccagggacacactgcgcccgcccctgcgccggcctcctcgcctgcacatgcacctacacctgcccttgcgccggtctcgccgtcgcctgcccctgtaccggtctcgccgtcgccgtcgcctgcacatgcacccacacccccacttgcccctgctccggtgactgcacctgcgcccaggcgtcgcccagcgccatcgccagaggacactaccccagctccttcgccggacgcggacggccaaccgcctgcagatcagaagaacaacgcagcaagggacactgcatcttggactatcggcgcggcgctggcgatcgtgtgcctcttgtcgtgaagggtttaagctcagatagattgacgccgattgggatccgtcatctcgccgccaataccagtgtacactgaagacaatgtttatgggcatgcattggccaaaataatattattctgcttccgccaaaaaaaaaaaaaaaaagaccccgggggggggccgggtaccc

SEQ ID NO: 18210 - DNA, 2372 bp, Zea mays
ttgggtacctcgccccccccccccccccgcaccttcggcttttgctccgacgccggcgagcgagaccgagagacgaggcgagccaccgcggcggcggttgcagcgatggggtccatgacgatcggtgccaagtacaagaccacgatcaaggaccccggcaccccgggcatcctccgcatgaacggtgataggttcaccttcacccctaatgatccacgatcggcaatgaagttcaatgttgatttccgaaccatcaaaggtcacaagttcaataaagtagagggtaacaaagcagcattattgaacctttcaaaagaagacaaggctggaggctacatatttgagtttgacaatgttggtaaccgtgaccaatgtcgagactttgtagctagggttttaggcaaacatcaagggatagtgcctcctagaccaactgtggctcctgaaaactcagttgcttccgctgctctggaacaactcagtgccgcagaagtggagagacgggttaaactgttgcgagaagacagcgaattgcagaaactacataagaagtttgttcttggaaatattctgcaagaatctgaattttgggcaacaagaaagaatttacttgatgatgaagcaaataagagatcaaaacaaaagccaggtttcaagagtgcacttgtagatattaggccaacaactgatggtcggacaaacaaggttactttccagatcacacctgagatgatacatcagatttttgcagaaaagcctgctgtccgtagagcatatttagattttgttccaaaaaagatgtcagaaacccgattttgggaaaaatactgtagagctgagtatctagtcaggacaaaaaacactgcagcagcaacagctgaggcagctggagatgaggaattagctatcttcctgaagaatgatgatatactggccaaggaggcaaagttgaagataaaacgagtcgatccaacattagacatggaggcagacactggagatgattacattcatcttccggaccatgggattcaccgtgatggtagcaaagagacagtcgatgctgacagtgagttggcgaggaggacgctgtctcaggacctgaaccgtcatgcagctgttgttcttgaagggagatctcttgatgtcgagtcatctgatccaaagactttagctgaagcccttgcaagatccaagaaagaaccaccttctacttctaatgttgatgatgataatcatgagagactaatgaaggtggctagaatgacagagatagaggatctgcaagctccacgaagtcttctgtatgcaccactttgtataaaggatcctagagaatattttgattcccaacaagcaaatgctctgagatctctaggtggcagcaatggtggaagaaaagcccatagttgcagcttgagcactgaagaagtgttccatcatttaatggatcaaatgtcttctgttaaagttaataggcttaactgtccgattgttcagtctgatatggctcttaaggttcttaatgaattaaacgaagggatttctcgttcaaggagacttaacctcaagaatcctcaagaaggtctccttggtcagctgcctcaacatacacgggacgagcttatggatcattggacggctatccaggaattgctacgccatttttggtcatcgtatccaataacaagtgcagtactttataacaaggttcaaagagttaaagaagctatgacacagatatatcaaaagctgcagcttataaaggaattggcacagcctgatgtaagacatgaaatatctcggctagtaaagcccatgactcaggccttggatgccgccttcaaccatgatttggaacagcagcagaaatcgtccaaggccggaaacaggcacaacgggttttgagcctaggagattggtttgaccaacacatgaagcgagacggacggacgggctgtgcccgaatacacaagagctgctgcagaattcttgaggcttgtacgattttgttctttttcccctcgcttattaatagctgccggaggagcctgctgtttgcagccccggaatcttgatctatgcatcaattgtttgtaactgactgaatagtgaagactcgcaacgcatgatgctgccgacgcgttgtacttgtacatggcagtaatggctattcgagatagaaccaaagctttaccattttgttttatgcggtttttttcatggccgccgggcagaattatacacatgtatgtcatctacagcgttacaaacataccattatacaaaaaaaaaaaaaaaaaaaactcgagggggggcccggtacccaatttcgccctaagggggagccgtattaactcccccggccggcg

SEQ ID NO: 18211 - DNA, 4653 bp, Zea mays
agtaaattattatattcatgcagagtcctgtttttaaattttactgccctagtttgtgaagatttcacatttgttttcttttggagacacctagtttagtaagtgaaaatttggtctgttccattgcaatttatgaatgtggtgcgtggtgtggttcaacattgttgataaagttagtgacagagctaggattagatgattaagggggtagctaagttgattcaggaagcacttaagttctcactttcgaaggcttagtatcaatcaatagaaaaattgattgtgagggtgccatggccctgccagcaaccccctactaggttccatcgctagataaaatcataggaatttctctcattctctgtttaagatgtgtgctgagtagcgctgatctccaagatagttggcaattatattctggttcctgctttttgttataaaatatttttcatgtgatatgtctgctgatcatattccgctgtatccatcagtacgtgtaatacttcatagataatttataattcgctcaagtgagtaaattaggtagagtgctacatatgccatacatgaatgtgatgcatggtgtcctagaaatagtacttcttagtctccttattgttttttctggtggggctggttttgtacctctggtaataacttgttgcgcaatttctgtttagggatgctattggtgtgtctagtgttgtggctgcaatgcttgggctctccattcttctcgtcctcgcggtctcggtgtgctagactgggatgattgcttgaatgagaaatcagcatgggatacattggcttggtttgcagttctggttggaatggcaggacaactcactaacctgggaattgtttcttggatgtcaaactgtgttgccaagctgcttcagtcgttctcattgagttggccagtggcattttgtgttctggaggcctcctactttctgatccactacctatttgcaagccagactggacatgttggagccttatactctgcatttctggctatgcatatagcggccggtgttcctagtgtgctgtcagcacttgctttggcattcaacacaaatctgttcggtgcaatcactcattatagtagtgggcaggctgcagtatacttcggaggtaatgttttttctctctccctggaaattctggttgtttttttacctcaagtagttaaccctgccaactaaattttttggtttccttcacaagggatctggtactaaaaaataaaaaaggcagacgtgcaagaggctcccacttgagtagtttctaaggaagggataagttgaggcaagtcttctcctatagatggagagactgcttcaaggccgtgacatggtgactcagtgagaaactgagaattctcaccattgcactaggcctgtttttttatataaaaaacaatgaaagaaaaaaacacgtcatgaataatactgtagaacagggatatctttttttaaagcgggcaagcggtccttcttttgtatatagagataaccccttgaaattggtatgcagattaacctgttacttttgttgtgcagccgggtatatggagcttccagatgttttcaggctgggttttataacagccttggctaacacgttaatctggggagttgttggaaccatctggtggaaatttttgggtctgtactgacagtggcagacatgtggttgaccaaaattttcatttggcactggtcgaattgctcttgctcattgttaggaagggcagaacatctagttaactaccgtttgctcgctccggtcagcttgcgctgaggtgatcagcagttagcaattacgcctgtgtcgtgcagttccttgttttctctttggttccgtagaagtccttgggcaatttttctgcggtatgttcctctctgatgcttatacagtccgctctgtaaaagttgcgcggctgcactgaaagcagtgtacagcgttccggcccccccaaatgtgttcgctccattctacagctcccagctaactatgattctcaacttacagcttggaaccaacgaattctcacaaaacatcagcgagctcgtcggcttgatggtcgtagaggctttgcgtcgcaatctggataatcacatttatttattttggcacgaatcctggatggccgcagcatctgtgtcagttgtcacctctgtttctttcactcctacagctacagatgaaggaacaacgatcctgctactgcactcagaagtcaaaaaaattgattcatgaatggatgtagccaaacaatacagaccacagtaggaacttgggctacgaacagtaagacaaggcagtttgtggtaggaatgaacttgtcacaaacacacgcgtgacacacccgatcgacatggatgacccaggcccagcgcagcattaatgcattgcgccggacccggtaccgtgccacctcgtcagtgcatataccctgcacctgcgcgtctgcagacggggacaaatggacatgctccagcgcccgcccgcccgccaggacgcgcgcggaccaccaactcaaaaaggcatggtccctccgctctctcgtgtgttcctctcggttccccctccactttttccccagacgcgacggggggcggcgtgccgcgacgccgcgtaggtccggccacacggcgggcgaacccagatcgtgttgcctgttgttgctggtgcgaagtgacgccgaaataccctggaccctggtcctgggctcctggccgcggccggcgtggcgacccgagtacccgacgcatcgtcatgcgcggtcgagaaccgcgcggtgccagtgcagtgcagcgcagcgcagctgtggtggccggagtgctcgcgagccgtcgtattcaatgtccttggcggcctgaacgagggcgcacgtacggtacggggggaatctgttgcatgcatgtacgagtaggagaaacagaaacgggttcagcgtctctgcaagtaggaaggatagagtacacaaatacacaatgcaatgctgctggcgaacgctggaaagactcggctggagcgatctcgacgcaacacggcacctagactcctagaggagggcaacatcgcacgccgtcgttatacggcaatcagaggcagacacgaaatctgcttttgccgaaaagcctactagctcttgcagttgcagataacggcaagcctaacgccactctccaaacatgagggggaggagccgaggaggagctttccgctcccctgcccccagtttggcaccagctgcctgctagcaactcaggcgagtggcgtccacagatggacgtgggcagaaaaggcgagatgcatgggccagaccggaacagagccgagctccagcagcagcagcgatgcgcgtcgtccgcccccacagcccacagccagccaaccctgctggcgcgcatggcgcatcgctttcttcgccgccctgtacccttttcttagccttggcctgtggcctgtggcctgtggcctgtggccgatcccatcccattccctcctcgccagcgcctcgtttggactttggactctggacaattccctgacagctcgggaaagggtcgttattcctccgggacacgtcgctcgcccgttgggtaccgcgaccgcaagcgcacgttcccagtctttgaatatgtcccgggattccagcggacgcatgtggcatgcatacatacagtacgcgaacaggcctggccaacagggtagtgtgtttacgtgaatagagcatgtacatgtgctgatctgatcaaccttttggtccccggctgccaagagcccgggcgggcgccgctgccacactgtgcctgaactcaaccgtccgccgcgccacagcggaagcagcgtctcgcagtgaaatccagtcacccatttaattctgcaggcctgcctgccgccctactctttggctccataaaacttaggtgcttcagaaaatcttggaagtggagctacgtacctttataatacatttagataattcatttcgtttattatttagatttagtatatttttaaaactatttaaatttatattataaactatagctttacactgtcgcgttattagagccattccaaatatccccttttctcttttccgcgcggcatcacaacggttcttgtcacgaattccgagatgtccccgctctcgctgatcggatttggtcgcttgtgttgtgactaggagtgataataagctctaaattttacaatataagttttgaagaacgaatcgaattaagatcaagttctatttatattcatttttgaattaaaatgtatttagtatcttaatattttgtaaagaaatatttagattacgatctattaccatctctagttgtgtcacaaccgtccattcgccaccgttaacaagcggggtggtggctttcacggaacaagacgaatctaatgaacacgcgaatcggggttgccttatcgccggtgctacgactagagccaatgagcctaaaaaaatctagacgctatagaacccgattttttctaaattaaccccttttttcttaaaaaaatcatgtctggctctctcttccttggacgacttaatttcgttttggactctttaatcgacgccatagaccatagcgtcaagttaacatggctgatcgctgt

SEQ ID NO: 18212 - DNA, 3024 bp, Zea mays
  misc_feature (390)..(390): n is a, c, g, or t
tttccggaaatatgggtctacgtttttttgcaaatagtcctttaaacatccttaagagtctactgtatatgcccttacagagttcgtgctatcgtttcagatctctgcaggcgcgaagcactcgtgttactatttgtttgactttattccaaaataatttatattgtttattctataaattacagcggccagaacagtcgtcgactttaatggctacgagaccaacgatggcagcggtgggccggtggcgcggcgcagaagggctgcaacaaaagcgcgtggtccgtggtggccaagggctgcagcggcacggcgcggcgcggcgggacgcgcagtgcaggactaggcgaatctatactagtgtgtttggtttgaggaatgaaatggtcnatcttcttttaactcctcacttttttatttggtttgtggaatagaatgagttgatccatcatcactttattccttgtaagctaataattagtatatacatcaagaatagattgattccaccaaaattaatagaataaacttatgatacattacctcgtatatcccttcttttgagtgccgggcagcggactgacacggcacggacacggccgaccagcggacgttactgttcaagtgcgctgccgcgatggctgcgcgttgcgtgcgggaggggccggtcggccggagggcggcggcagcagcggttcaacgtgaaatgatgaggctagtttttgagccgtcggatgttgcctcgacgtcggatatatagactcgggtgcctcgaggccgcccccgaagagcattaccgaatgtgatggtgactacaccgccactgctctgctcaacacggttcaccggtgatgaccccggttcctccgactgcaaccgggcgccacgtccgcacctccatctcgctttcagccgttcgtacctaggctacactacatcatagggcgcgccccggccggcccgggagtctgaaaccaccgcccagcgctcgcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctcacccggagcctgaacctgagcccgagcccactggtgcgaagctactgccgctcgtcatctccatcgccatcggcctcgccgtgcggttcctcgcgccgcggcccgtcgaggttagcccgcaggcgtggcagctcctctccatcttcctctccacaatcgcggggctggtgcttggccctctccctgtcggcgcatgggccttcctcgggctcacagccgccgtcgccactcgcacgctccccttcaccgccgccttctccgccttcaccaacgaggtcatctggctcatcgtcatttccttcttcttcgcgcgcgggttcgtcaagacgggcctcggcgaccgaatcgccacctacttcgtcaagtggctcgggagcagcacgctgggcctttcctacgggcttaccctcagcgaggcctgcatcgcgccggccatgcccagcaccacggcgagggccggaggcgtgttcctacccatcatcaagtcgctctcgctgtcggctgagagcaagcccaaccatccatcgtcgcggaagcttgggtcctatcttgtgatgacgcaattccaggcatctggtaactcgagtgctttattcctcactgctgcagcacaaaacctgttgtgcttgaagctagcagaggagcttggtgtaatcattgcaaatccatgggtatcatggttcaaagctgctagtttgccagctcttgtttctctgctagcaacaccatatttgctgtacaaaatcttcccccctgaaacaaaggacacccctgatgccccagcactggctgaaaagaaactgaagctcatgggccctgtgactaaaaatgaatcggttatgattggcacaatgattcttgcagtctccttatgggtttttggggatgctattggtgtgtctagtgttgtggctgcaatgcttgggctctccattcttctcgttctcggtgtgctagactgggatgattgcttgaatgagaaatcagcatgggatacattggcttggtttgcagttctggttggaatggcaggacaactcactaacctgggaattgtttcttggatgtcaaactgtgttgccaagctgcttcagtcgttctcattgagttggccagtggcattttgtgttctggaggcctcctactttctgatccactacctatttgcgagccagactggacatgttggagccttatactctgcatttctggctatgcatatagcggccggtgttcctagtgtgctgtcagcacttgctttggcattcaacacaaatctgttcggtgcaatcactcattatagtagtgggcaggctgcagtatacttcggagccgggtatatggagcttccagatgttttcaggctgggttttataacagccttggctaacacgttaatctggggagttgttggaaccatctggtggaaatttttgggtctgtactgacagtggcagacatgtggttgaccaaaattttcatttggcactggtcgaattgctcttgctcattgttaggaagggcagaatatctagttaactaccgttgctccctccggtcagctatcgctgaggtgatcagcagttagcaattacgcctgtgtcgtgcagttccttgttttctctttggttccgtagaagtccttgggcaatttttctgcggtatgttcctctctgatgcttatacagtccgctctgtaaaagttgcgcggctgcactgaaagcagtgtacagcgttgcggccctcaaaaatgtgttcgctccgcaaaaaaaaaaaaaaaaggcccagctcccagct

SEQ ID NO: 18213 - DNA, 2081 bp, Zea mays
gttgggtgatattttttactaaaatctatatttatattaattgttcattcatccttagttataagatttttttatttttatactatttttatcatatatctagatataatatatatatattgaaatatactactcttctaaaattgtagtcattttatctcttcgttttatatctatattcaaatggacgaagataaatataaatataaatataaatatatatatatatatataatgaatctattaattaaataaaaccaattaatttggtagggagggaatattatataagctatatagcttaaaaagctaaagcatcttataacttaaaatgatgaaagaaaattcagaggtgggaaaaaggagcttgaagttgctttgatgtgtccacgtgttgcaatagaaaaaaaaagataatggcatatttaatgacgggggatttttcaggcagaaagcactactagcatcacatcagatcttctagaagaaagtgaattcctcttctcgtgtgtggaagagaaaaaaaattgaaggatacgtatatgcgagacttgtgcgtccacaaacaggttccatcaaggccggataactggacaccgcacatctttcgggtcacagcgaatcgacaagctagcagtgccggccctcacgtagtcagcagtcagcactgccggcgacgcgtagaccgagtccctcatcaaagagtccgcaacctaccaagtaccaaccaaccgcctgggctgggcaggcgagcaagacaaagcacgccaagcggcaagcgcaagtccaacagcccgcatcgctcactccgtcactcactcggcgcggcgcccatccccgcggttctcacgagcgcgcgcgcctgcgtccggcgccgtccgccatggcgtcgtccaagcctttattccccttccccgtccccgcccccgacccgtccgacgaggtcgtgcgcgagttcggcccgctgctccgggtctacaagagcggccgcatcgagcggcccctggtggctccgcccgtggagcctggccacgacgccgccacgggggtccaatccaaggacgtccacctcggctcctactcggcccgcctctacctgccccccgtggccgacgccggtgccaagctgcccgtcgtcgtgttcgtgcacggcggcggcttcgtggccgagtccgccgcctcgcccaactaccacctcttcctcaacaggctcgccgccgcctgccccgcgctcgcggtctccgtcgactaccgcctggcgcccgagcacccgctcccggcggggtacgacgactgcctcgccgcgctcaagtgggtgctttccgccgccgacccctgggtcgccgcccacggggatctcgcgcgcgtcttcgtcgccggggacagcgccggcggcaacgtctgccactacctcgccatccacccggacgtcgtccaggcgcagcagcagggctgcccgccgccgctcaagggcgccgtgctcatccacccctggttctggggctccgaggccgtgggcgaggagcccagggaccccgccgtgcgcaccatgggcgccggactctggttcttcgcgtgccccgatgctaatagcatggaagacccgcggatgaaccccatggcgcccgccgcaccgggactccacacgctggcgtgtgagcgcgtcatggtgtgtaccgcggagggcgacttcctcaggtggcgcggccgcgcgtacgccgaggcggtggccgcggcgaggggaggccgcctggggcaggccgccggcgtcgagctgctggagaccatgggagagggccatgtcttcttcctcttcaaacccgactgcgacaaggccaaggagatgctggacaagatggcggctttcatcaatgcgccgtgaacgtgaacgtgatccgtgacgcgtgcgcccttgttcctttgtgtttgcgtgacaatgtggaaaataaaataatatatttcagctgttttgggaatttttgcccacgcatcgactagccaacttgatgccaaattcatcgttcacgcaaaattggactacttcaggtgaagagcatataatctatgctaacgttacaatc

SEQ ID NO: 18214 - DNA, 1475 bp, Zea mays
cgccaagcgcgagtccgtccaacaaacagcccatcactcactcgccgcggcgaccatccccgcagttctcactccagtctccacacacctctcacgagcgcgcgcgcgcgcgtccgccatggcgccgtctaagcctttattccccgtcgccgtccccgcccccgacccgtccgacgaggtcgtgcgcgagttcggcccactgctccggatctacaagagcggccgcatcgagcggcccctggtggccccgcccgtggagcctggccacgacgccgccacgggcgtccagtccaaggacgtccacctcggctcctactccgcgcggctctacctgcccccaagcgccggcgccggcgccaagctgcccgtcgtcgtgtacgtccacggcggcggcttcgtggccgagtccgccgcctcgcccaactaccacctcttcctcaacaggctcgccgccgcctgccccgcgctcgccgtctccgtcgactaccgcctggcgcccgagcaccctctgccggcgggctacgacgactgcctcgccgcgctcaagtgggtgctctccgccgccgacccatgggtcgccgcccacggggacctcgcccgcgtcttcgtcgccggggacagcgccggcggcaacgtctgccaccacctcgccatccacccggacgtcgtccaggcccagcgcgcgcgacaggccggcgcgccgccgctcaagggcgccgtgctcatccacccctggttctggggctccgaggccgtgggcgaggagcccagggaccccgccgcgcgcgccatgggcgtcggactctggctcttcgcgtgccccgagaccaacggtctggacgacccgcggataaaccccttggcgcccgccgcgccgggactccacacgctggcgtgcgagcgcgtgatggtgtgcgccgcggagggcgacttccttaggtggcgcggccgcgcgtacgccgaggcggtggccgcggccaggggcggtgacctcggcgaggccgctggcgtcgagctgttggagaccatgggagagggccacgtcttcttcctcttcaaacccgactgccacgaggctaaggagatgatgcacaagatggtcgccttcatcaatgccccctgaggcgtgaggtgcttgtgtcgcgtctcagaatcatcgttggcgtggctagctgtacgccaccgtctcagacaattatcgtgacagcggggaaaataaaggccttggatccgtgacaaaaaaaaaaaaaaaaataggttgtttagtttggaatttaactttttaaaatttaaatataaactcaccttaaatttatagatcgagggaattaaattgattttacgtattacatgttatatttctactccgcagtttataacatattttttttgtctcgaattcctatagtaaaaatataacatataaatatatcttatatattgctaaccatactatacaaatatatttaaaaaac

SEQ ID NO: 18215 - DNA, 1292 bp, Zea mays
  misc_feature (938)..(938): n is a, c, g, or t
  misc_feature (940)..(940): n is a, c, g, or t
  misc_feature (955)..(955): n is a, c, g, or t
  misc_feature (965)..(965): n is a, c, g, or t
  misc_feature (969)..(969): n is a, c, g, or t
  misc_feature (987)..(987): n is a, c, g, or t
  misc_feature (1014)..(1014): n is a, c, g, or t
  misc_feature (1027)..(1027): n is a, c, g, or t
  misc_feature (1038)..(1038): n is a, c, g, or t
  misc_feature (1051)..(1051): n is a, c, g, or t
  misc_feature (1075)..(1075): n is a, c, g, or t
  misc_feature (1081)..(1081): n is a, c, g, or t
  misc_feature (1090)..(1090): n is a, c, g, or t
  misc_feature (1141)..(1141): n is a, c, g, or t
  misc_feature (1143)..(1143): n is a, c, g, or t
  misc_feature (1163)..(1163): n is a, c, g, or t
  misc_feature (1223)..(1223): n is a, c, g, or t
  misc_feature (1232)..(1232): n is a, c, g, or t
  misc_feature (1234)..(1234): n is a, c, g, or t
  misc_feature (1247)..(1247): n is a, c, g, or t
  misc_feature (1253)..(1253): n is a, c, g, or t
aacgagcagggcgggcaggcgagcaaggcaaagcacgccaagcgcgagtccgtccaacaaacagcccatcactcactcgccgcggcgaccatccccgcagttctcactccagtctccacacacctctcacgagcgcgcgcgcgcgcgtccgccatggcgccgtctaagcctttattccccgtcgccgtccccgcccccgacccgtccgacgaggtcgtgcgcgagttcggcccactgctccggatctacaagagcggccgcatcgagcggcccctggtggccccgcccgtggagcctggccacgacgccgccacgggcgtccagtccaaggacgtccacctcggctcctactccgcgcggctctacctgcccccaagcgccggcgccggcgccaagctgcccgtcgtcgtgtacgtccacggcggcggcttcgtggccgagtccgccgcctcgcccaactaccacctcttcctcaacaggctcgccgccgcctgccccgcgctcgccgtctccgtcgactaccgcctggcgcccgagcaccctctgccggcgggctacgacgactgcctcgccgcgctcaagtgggtgctctccgccgccgacccatgggtcgccgcccacggggacctcgcccgcgtcttcgtcgccggggacagcgccggcggcaacgtctgccaccacctcgccatccacccggacgtcgtccaggcccagcgcgcgcgacaggccggcgcgccgccgctcaagggcgccgtgctcatccacccctggttctggggctccgaggccgtgggcgaggagcccagggaccccgccgcgcgcgccatgggcgtcggactctggctcttcgcgtgccccgagacccacggtctggacgacccgcggatgaaccccttggcgcccgccgcgccgggaactccacacgctggcgtgcgagngngtgatggtgtgcgcngcggagggcnactnccttaggtggccggcggngcgtacgccgaggcggtggcggcggcnaggggcggtgacntcggggaggcngctggcgtcgagntgttggagaccatgggagagggcnacgtcntcttcctcntcaaacccgagctgctacgaggctaaggagatgatgcaccaagatggtcgncncttacatcaacgcgcgcacnctgaggcgtgaggtgcttgtgttcgcgtctcagaatcatcgttggcgtggctaggtatgncagcacacncngtagtcagacatnttatcngtgacagcgtgcaaaataaaggccttggatccgtgagaa

SEQ ID NO: 18216 - DNA, 3205 bp, Zea mays
gcatccgccctgctctcccctccaaaccatgccgtcttcttcctccccgagatctcgccatgcccgctctcccgcctcctgctagctagcctagcctagccagctgcgtgcgtgcgtgcacggagcggtcgatcgtttcctgcatgcgatatcaccaacgcttcgctggaagaaggcgtcgtcacaggcagggaattcggcacgagagctgatcgatggtagagagcaagagccagctagggtttgggagctgaggctaggaccgtacgtcgtacgtacgtgctgccattgttcatgacgccggcaaggcgcgtgccgccggcggcgatgatcggccggaatggcttcgcgtttgggtcctcgtccgcgctgtctttaagccaggctgacctcctagacagccatcagctgcagcaagcgttccagcagcagctcttcgatcagatcccgaccaccaccacagtggacgatagcagcgacaacctcatccatggccgctctgacacgctggtagatgagttcgagagcaagtcctgcagcgagaatcccgacggaacctctggtgacgatggcctggaggaagaccccaaccagcggccgaacaagaagaagcgataccaccgccacacccagcaccagatccaagagatggaggcgttcttcaaggagtgcccgcacccggacgacaagcagcggaaggagctgagccgggagctcggcctcgagccgctgcaggtcaagttttggttccagaacaagcgcacacagatgaagaaccagcacgagcggcacgagaacgcgcagctgcgcgcggagaacgacaagctgcgagccgagaacatgcggtacaaggaggcgctgggcacggcctcgtgccccagctgcggcggcccggctgccctcggcgagatgtccttcgacgagcaccacctccgcctcgagaacgctcgcctccgtgacgagatcgaccggatctcgggcatcgccgccaagcacgtgggaaagcccatggtctccttccccgtgctctccagcccgctcgccgccgccgccgccgctgccgcccggtccccactcgacctcgccggcgcctacggcgtccagtcagctgctgcgggcctcggcgccgaccacctgttcggcgccggtgccggcgatctgctgaggagcgtgtcagccgggcagctcgacgcggacaagcccatgatcgtggagctggccgtcgcggccatggacgagctcctccggatggcgcggcctgacgcgctgctgtggggtggcggcgcgtcggcaggggcgcagcagcagcagctggacgaggaggagtacgtccggacgttccccgctgggctcgggccgaggcagtacgggctccgtccggaggcgtctcgggacagcgccgtcgtgatcatgacctgcgacagcctcatcgagatactcatggacgcgaaccgattcgcggcagtgttctcgagcatcgtgtcgagggcttccacgcacgaggtgctgtcaactggtgtggcagggagctacaatggtgcattacaagtgatgtcgatggagtttcaggtgccgtcgccgctggtgccgacgcgcgagagctacttcgtgaggtactgcaagaacaacccggacgggacatgggccgtcgtcgacgtctcgctcgacagcctccgccctagcccggtcatcaagtgccggcgcaggccgtcaggttgcctcatccaagagatgcccaatggctactcaaaggtgacctgggtggagcatgttgaggtcgacgacagatcagtgcacaacctctacaggcctttggtcaattcaggcctcgcgtttggcgcgaagaggtgggttggcacactggaccggcagtgcgagcggctcgccagcgccatggccagcaacatccccaacggcgacctcggtgtgatcacaagcatagaggggaggaagagcatgctgaagctggcggagaggatggtggcgagcttctgcggcggcgtgacggcgtctgcggcgcaccagtggacgacgctgtcgggaagcggcgcggaggacgtccgtgttatgaccaggaagagcgtggacgacccgggcaggccgccgggcatcgtcctcaatgctgccacctccttctggctgcccgtcccacccaagagggtcttcgacttcctccgcgatgagacctctcgcagcgagtgggacatcctctcgaacggtggtgctgtccaagaaatggctcatattgccaacggccgggaccatggcaactgtgtctccctccttcgtgtcaatagtgcaaactcgaaccagagcaacatgctgatcctccaggagagctgcaccgacgcctcgggctcgtacgtggtgtacgcgccggtggacgtggtggcgatgaacgtggtgctcaacggcggcgacccggactacgtggccctgctgccgtcgggcttcgccatcctccccgacggaccaccgccggccggtgcggctccgtcccacggagagggcttggacgctggcggcggcgggtccctcctgacggtggcgttccagatcttggtggactccgtccccaccgccaagctctccctcggctccgtagccaccgtgaacagcctcatcgcctgcaccgtcgagcgcatcaaggccgccgtctgcgcggaagccggcaacccgcagtagacatccatccatgcgatatcgaggagggagaaggggggcatgcagcaaggttttgtggaaatgttagtggggagtcaagaacgcacctcagactctccttgccgtgtggtgctcatactgaaaggaaaaagaaggcgtcaccactatgcaaggggggatggttcgggtattgacttcgccgtccaatcaaactactacagaaaggacgtacgggtgctgtggagaagatggatcgatgctgtttctagggtttacttcctcattgttcgtggtgctgccgtagttcaggctaaggtgcctgtgcctgctcgcagtcgtagctagagaacacagagatttgttgcctctgatctttcctttttggatttgcaaagatttgtagatcagtcatttcgtaaaccgatgcgccttggctaaaacgcgcccgttcgttgttgttcgatcgtagctgccttttgctattcataaaacgatgcaatttcaaccactgagtttcttctagaaaaaaaaaaaaaaaaaa

SEQ ID NO: 18217 - DNA, 1012 bp, Zea mays
gcacgagaccattacctagaacatcctaatcgaaaaaaaaaaaaacaataagcacttgttcatcatcatcagagtaaacacagcagaaccctagcgcgccgttcctccgacgactcacatcccacccactcacccaccccatggcggccaagctctccaccagcgccgacgccccggcctcggtgcggctctccgcagcagcgcaggcggctgcgatccagccctcctctccgccggaccgccggcgccgggcatggctccccatcacggaggaagcagtggtaacaacgcagagtacgcgggtggaggccgccggcgggtccctcttgacggtggcgttccagatcctggtggactccgtccccaccgccaagctctcgctgggctctgtagccacggtgaacagcctcatcgcctgcaccgtggagcgcatcaaagctgccgtctgcggcgctgaaggcaacccacagtagtagccatccataagatagagagagcgagaggaggggtggtgcagcttttggggatcggagatatttatcagtggggagtcaagaacgcacctcagactctccttgccatgtggtgctctgatactgatgcaagcagggaaaaagaaggcgtcaccactatgcaaggggggatggttcgggtattgacttctccgtcgagtcaactagagaaaggatgcgtgctgcagagaagatgctgtttcttctggatctctttccatattttctagggtttacttcgtcatgttcgtcgtgttgttgttgttcaggctaaaaggtgcctgtgcctgctcgtaggctcgtagctagagaacagagatttgtttacctcttttattttattttttttggattgcaaagatttgtagaatctaggaccagtcatttcatcaccaatgcttggctaaaacgtgtaccgttgttgttcgtagctttcttgctatttaaaacgatgcaatttcaatcgctgagtttctaaaaaaaaaaaaaaaaaaaaaaaa

SEQ ID NO: 18218 - DNA, 6885 bp, Zea mays
  misc_feature (711)..(711): n is a, c, g, or t
  misc_feature (1127)..(1127): n is a, c, g, or t
  misc_feature (1142)..(1142): n is a, c, g, or t
  misc_feature (1343)..(1343): n is a, c, g, or t
  misc_feature (2897)..(2897): n is a, c, g, or t
  misc_feature (5537)..(5537): n is a, c, g, or t
  misc_feature (5802)..(5802): n is a, c, g, or t
  misc_feature (6125)..(6125): n is a, c, g, or t
  misc_feature (6621)..(6621): n is a, c, g, or t
gccggccgggctgcgactgcccagctcgcaataactccttcctccccatctccacattctcccatccgccgttcccctccgcttcctcctaccatggcgtcttcttcctccccgagatctcgccatgctagctctcccgccttctgctagccagctgcgagcacggagcgctcgttttcgggcttcctgcatgcgatatcaccgacgaaacgtgtctctggaagaaggcatcacaggccgggatcggagaatgaaagctgacgatatagagcaagatgagctagggttcgcgaggcactagctgggaccgtacgtaccgtgctgccattgttcatgactccggcaaggcgcatgccggcgatgatcggccggaataatggcgtcgcgttcgggtcctcgtcagcgctatctttaagccaggtgattattccggctgacttcctagacagccatcatctgcagcaagcgttcgagcagcaactctttgaacagatcccatccaccgcagtggatagcagcgacaacattatccacggtcgctccgacgcgctggtggacgagtttgagagcaagtcgtgcagcgagaatcccgatggcaccgcctccggcgatgatggccagggggacgaagaccctaaccagcggccaaacaagaagaagcggtatcaccgccacacccagcaccagatcgaagagatggaggccttcttncaaggagtgtccacacccggatgacaagcagcgaaaggagctgagccgggagctcggtctcgagccgctgcagggtcaagttctggttcccagaaacaagcgcacacagatgaagaaccagccacgagcggcaggagaacgcgcagctgcgcgcagagaacgacaagctgcgagccgagaacatgcggtacaaggacgcgctgggcacggcctcccgccccagctgcggcggcccggctgccctcggcgagatgtccttcgacgagcaccacctccgcctcgagaacgctcgcctccgtgacgagatcgaccggatctcgggcatcgccgccaagcacgtgggaaagcccatggtgtccttccccgtgctctccagcccgctcgccgccgccgccgccgccgcccggtccccactngacctcgccggcgcntacggcgtccagtcagctgctgcgggcctcggcgccgaccacgtgctgttcggcgccggtgccggcgatctgctgaggagcgtgtcggccgggcagctcgacgcggacaagcccatgatcgtggagctggccgtcgcggccatggacgagctcctccggatggcgcggcctgacgcgctgctgtggggtggcggcgcgtcngcaggggcgcagcagcagcagctggacgaggaggagtacgtccggacgttccccgctgggctcgggccgaggcagtacgggctccgtccggaggcgtctcgggacagcgccgtcgtgatcatgacctgcgacagcctcatcgagatactcatggacgcggtcagtgacggactgattgatggacgggtttccttgatcgatctatgctgcttgccgatgatcgatccatgtgacgactcatcaataattaatcatctgcgttgcttgcttgcagaaccgattcgcggcagtgttctcgagcatcgtgtcgagggcttccacgcacgaggtgctgtcaactggtgtggcagggagctacaatggtgcattacaagtggtgtgtatcttccattcctgttgagggcctgtagcattgtccctgatcagtagtgtcaaagtatatatgaagagtgacgatgactaacaatgtataggttgccattttttttttttttttgcagatgtcgatggagtttcaggtgccgtcgccgctggtgccgacgcgcgagagctacttcgtgaggtactgcaagaacaacccggacgggacatgggccgtcgtcgacgtctcgctcgacagcctccgccctagcccggtcatcaaatgccggcgcaggccgtcaggttgcctcatccaagagatgcccaatggctactcaaaggtaataagtgaacattttccttcttgttggccggccagtttactgcgtgcatggaaactcatgttcatatctcgtgcaggtgacctgggtggagcatgttgaggtcgacgacagatcagtgcacaacctctacaggcctttggtcaattcaggcctcgcgtttggcgcgaagaggtgggttggcacactggaccggcagtgcgagcggctcgccagcgccatggccagcaacatccccaacggcgacctcggtggtaagtgctgccacgctcgcacacccatgacccatgccatgcatgtggattttttatacccaattaagcaacgaccgatcgatcgaggtgtgcatccatgaaactgcatgcatgcagtgatcacaagcatagaggggaggaagagcatgctgaagctggcggagaggatggtggcgagcttctgcggcggcgtgacggcgtctgcggcgcaccagtggacgacgctgtcgggaagcggcgcggaggacgtccgtgttatgaccaggaagagcgtggacgacccgggcaggccgccgggcatcgtcctcaatgctgccacctccttctggctgcccgtcccacccaagagggtcttcgatttcctccgcgatgagacctctcgcagcgaggtatgtcacagcgcaccagattatattggtacttatacaattgagactaaaacagttagaagccgaaactaaagagacacatttaatatcaggtgtatccatcaatcggtacgtgattgatggctagaactggtactaaaaaggttgtctaactatggcttctctgttgtcacgtaactcttattgtactactagttcgtggctagtacngatactaaactagaaagcacggcgcgtcatatcacggaacttttgatatggatattaatacctggattatttatgctttggaaaagaagttggctttttgagatggatatcaacaccctgaattatttatgctttggaaaagaaattgatcgagctgatctatttcacactttttcagtttcagaaatgaatttgtacaaatgttttcaacgtaacaaagacgtcatagaaagtaaaagttggccgtaatcaactatatataagggctcaaggacagattatcaaagttgaaatgagtcactatatatgatatgacaattaaattattatttttaagatagtgttacaattttttttacatttatactttcagtaagaaggcttctaataccaaattaaccctagtgatgccaaaattgatgaacaattgtagtgacaaaaaacttcaagtgtttatttttaagataatatatatcctcggtcactgtataaaatttgaactcaaacctcaattagtctgaagtgaaataaaataaggttgatggcatataacagacttgggatcaagaacaaacaaaatctcaagaactattgcagctcatgaaagtaaatatgctatataccacacgaattagtaggaagcaagtagaaaaaggaaaacggagtccaagaacgtaacattgtcttgctgactttcatttttattttgatccatgcctaataagcatcttagaaaagtcttgagatcaataaaatagtcagtcgttttgctacctacggaaacactaaaatttcaacgcctttaaatttagaatgattttagaaaatgtgagcacgtaccctaatattgtggcactgccttggcgtcaggcaccgttatgattgttaatctgctggtagtgtagtcggtttcaaaccgatgatgatactgcgttctccaaacgtcaatcgtttgtgcttcgagctacgacctattttcctgacgaaatttaaatctgcagtgggacatcctctcgaacggtggtgctgtccaagaaatggctcacattgccaacggccgggaccatggcaactgtgtctccctccttcgtgtcaatgtaagtgctcctcttggtgccttattttctttcagaaaaattagtggccaattttgatccgcgccctgagaaaaattcctgaattaacaatcattttttttgtcactgctgttacgcatgcagagtgcaaactcgaaccagagcaacatgctgatcctccaggagagctgcaccgacgcctcgggctcgtacgtggtgtacgcgccggtggacgtggtggcgatgaacgtggtgctcaacggcggcgacccggactacgtggccctgctgccgtcgggcttcgccatcctccccgacggaccaccgccggccggtgcggctccgtcccacggagagggcttggacactggcggcggcgggtccctcctgacggtggcgttccagatcttggtggactccgtccccaccgccaagctctccctcggctccgtagccaccgtgaacagcctcatcgcctgcaccgtcgagcgcatcaaggccgccgtctgtgcggaagccggcaacccgcagtagccatccatgcgatatagaggtataccttacatacatgtagccatccatacacagctagcttcagtaatttgagtcgaaattaaatacaattacacgtcgaatttgaaccgtttgaatgttttgtaggagggagaagggggacatgcagcaaggttttgtggaaatgttagtggggagtcaagaacgcacctcagactctccttgccgtgtggtgctcatactgaaaggaaaaagaaggcgtcaccactatgcaaggggggatggttcgggtattgacttcgccgtccaatcaaactactacagaaaggacgtacgggtgctgtggagaagatggatcgatgctgtttctagggtttacttcctcattgttcgtggtgctgccgtagttcaggctaaggtgcctgtgcctgctcgcagtcgtagctagagaacacagagatttgttgcctctgatctttcctttttggatttgcaaagatttgtagatcagtcatttcgtaaaccgatgcgccttggctaaaacgcgcccgttcgttgttgttcgatcgtagctgccttttgctattcataaaacgatgcaatttcaaccactgagtttcttctagcttcttgttttcagagaattttgaaaacggaaacagcaggggtgaaaaatccgatggaggcggctgcaggagatacaaattccgtcaacttttttttttgcatggtacgaatatatcatcgttgataaataagaagagaagcaattgcacaattaccatccaatccaggtggaaatgaaataactgaacaatgcctaattgagtcacattccaggattagattctaatgattggattccatacaccacttctccgaaggttctattaaaatcgatggctataatatatcaccatcattttgtgagttggttcctcgccactttggcatggtgaaccactcgcaaccgtgtacaacacacgagtcgggtcacccacaacctcttcgagtgatcacgacactccaatcgccaccaagttgtctaggntgatgccaatcgcaaaagttaacaaacactatactctcacttgaccatgacgagccaattgtgagtggtggatgcacacgaatagctctatatgcactaataaagttgctaatagcaagatcaacacttttctaatctcctcacttattcaaatggtctccctaactctcaaatggttgctctatctgttggagagacaagaccccttgtagagcaataagggggtatatatatatccctaaagggctcaagagtagccattagntattccacctagaattttcgtgtggaccagacatatccagtgatgacatagaaaacgtcggctctgctcaaacgattaattctgcagaaactagtcattattatacaaacgatcggtgatatcaccggtgttacaccggacacgtctagtatgtacaactgaattgagtgcaatttacatcgtccctgagtgttctgtctggtgccacgtttggtgtcacaccgaataagtcctatgagtacttggctgaagtgcataaaaacatgcttactaagtgtcatgtccggtgacacactagacatgttccatgagtgtaaggagtnaatatgcacaaaaaacaagcttattgaatgccttgtctcgtgcaacagatttggtgcacactggacacatctatgtaactcagctatagcacaagaactaactggtacccggtgtggcatctcgtgctgtatcgaacacgtctgatgatatgctactgtagtatgtgtgggacttggttttttgtgtttttatttgattttcactccaaactttatgtgagctctgataggttaccctaaaccataaacccctaactagacccgactaggttgagttactcatctcatgcccctttttatagtacaactaaacaaaataaaggtcctatcactactctaagtgtgtccaacatctctattggcacttagaactagctgatccttatcctttcgaggtgtatactcaaactgcatcagaagagcatcctcatctaaatctgaagaagcacacaccttttaaagttgttgtgactgagtggctgactggttaactagntgactgactggcaggaataggtggaatttgtgagggatctgacgatgatactgaggaagtgaggaaggtaatgtcacgatggtctcgtccataggagatatagaaggcgtcggttcaggtgctaaagatacatcaactataggtggagccctggtgacctgactggttaacattgtctatgtagttggagcagcggtaatcgtcactctgatagatggtgtctaaagagtcataactatccgagcatgagacactccatcaaag

SEQ ID NO: 18219 - DNA, 1722 bp, Zea mays
cacgagaccaacggcactattgccgcgacccacccgcgcaactccaaattcttccacatcaacatcgacacttctaaggacatcaccgtgaaggatgtgaacatcacggcgcccgcggacgtcgagaacacggacggcgtccatgtcggcgggtcctccaatgtacgcatcaccaactcgaccattggcaccggcgacgactgcgtctccatcggccccgggagcgacggtgtcatggtgaacaacatcacctgtggccccgggcagggcatcagtgtgggctgcctaggccgctacaaggatgagaaggacgtgagcgacgtgacggtgcgggattgcgtgcttaggaacaccaccaacggcgtgcgcatcaagtcgtacgaggatgccgagtctgtgctcacggcgtcccatctcaccttcgagaacatcaggatggaggaggtggccaaccccatcatcatcgaccagtacttctgcccccagaaggtctgccccggcaagcgaagcaactcctcgcatgtctccatcaagaacgtcaccttccgcaacatctccggcacgtcgtccacgcccgaagccgtcagcctgctctgctccgagacgcagccgtgcagcggcgtctcgctcatcgatgtcaacgtcgagtacgccggcaagaacaacaagaccatggctgtgtgcagcaacgccaagggaaccgccaagggaagcctccaggccctggattgcctcgtctgatcgatgaccttgcatttgcatgcattcttcttccgtttcacttttccatattctattgcgttccagctaagcatcttgtttcttgcagaatatatatatatatctctactacttattaagtaaaaaaaaaaaaatatatagcgccccctatatatatatatgcaggcaattatattaatggtggagacgacacatatatctgggcgtttgtctgccttcccagctggtttagagcactgtaatattattagatataacagggcgttatgttgtatttttacatcactataccttaccatgaggtcctttctcctctgtgaggggtcaggcattgtattggaaccttgtacggcgtttgcctttttaatgcaatgacatacactactcgcaccaatttcttgctgacgaagacatccaaattaatactccggccattcttttttatttgtcacgttctagttcaaaaataactagcgtacaacaaatatttaagaacggaggtattatatatgtttggtcatcattttatgagaaattaaaatggttttctaatttctaaaatttacaggacattcttttggttatcagaagtgtttcggatgatgttgaggcttggtcatcttcttcatcatcattattatattcctcttcttcacttgagcttggagtattcttcttgtctttcatccttttgtgttcattacatgcaaaagcatatggctttgaagaagttggcttctcctcttaacccattttcaaagacatctcgaatgccacaattttcccaattacaatggcttgactcatttggctcaagtcctccaaattatgaagtatggtgataatgctcccatgtttcctttgtggtaataaggagatgatctttcttacaatatctgcatcacctattttattaattccaatagaattgagctcattgataattagattcaagcgagagtacatatatataacaagctc

SEQ ID NO: 18220 - DNA, 1578 bp, Zea mays
  misc_feature (1372)..(1392): n is a, c, g, or t
  misc_feature (1394)..(1410): n is a, c, g, or t
  misc_feature (1472)..(1540): n is a, c, g, or t
  misc_feature (1558)..(1562): n is a, c, g, or t
cactcctatgggcggcgtgtgcgctcccccccggccggggcaatcttccggaacatccatcgatctccccccagcggcgaggagagccggcggccacaggaaggagaaatggcttccgcacacaacgctctccgggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaaggggagcaacatcgccatccagctggatggcaacctgctgggatcaaacgacctggacaagtacacggcgagctggatcgaattgtctcacgttaacaacatcgggatcaccggctcgggcacgctggacggccaggggaccgccgtttatagcaagagcaagaccgacaacgtgaaggcgatgcccaacacactggtgctgtttcacgtgatcaacgccactgtcgccggaatcaaactactcaactccaagttcttccacatcaacatcgacaactcagagagcatcaccgtgaaggacgtgaacatcaccgcgcccgccgacgttgagaacacggacggcgtccacgtcggaggctcctccaagatcagcatcctcaactcgaccatcggcaccggcgacgactgcgtctcgattgggcccgggtgcgccgccgtgtcatggtgaacaacatcacctgtggccccgggcagggcatcagtgtgggctgcctaggccgctacaaggatgagaaggacgtgagcgacgtgacggtgcgggattgcgtgcttaggaacaccaccaacggcgtgcgcatcaagtcgtacgaggatgccgagtctgtgctcacggcgtcccatctcaccttcgagaacatcaggatggaggaggtggccaaccccatcatcatcgaccagtacttctgcccgcagaaggtctgccccggcaagcgaagcaactcctcgcatgtctccatcaaggacgtcaccttccgcaacatctccggcacgtcgtccacgcccgaagccgtcagcctgctctgctccgagacgcagccgtgcagcggcgtctcgctcatcgatgtcaacgtcgagtacgccggcaagaacaacaagaccatggctgtgtgcagcaacgccaagggaaccgccaagggaagcctccaggccctggattgcctcgtctgatcgatgacctnnnnnnnnnnnnnnnnnnnnncnnnnnnnnnnnnnnnnnattctattgcgttccagctaagcatcttgtttcttgcagaatatatatatattctctactannnnnnnnnnnnnnnnnnnnnnnnnnnnnnnnnnnnnnnnnnnnnnnnnnnnnnnnnnnnnnnnnnnnncaggcacttatattaatnnnnnagacgacacatatatc

SEQ ID NO: 18221 - DNA, 1669 bp, Zea mays
atcctacgagccggccggggcaatcttccggaacatccatcgatctccccccagcggcgaggagagccggcggccacaggaaggagaaatggcttccgcacacaacgctctccgggtgtttttcatcctagccgtggtatgtgccgtatgcacagcgaaaaggacaggagccaagaaggaagaatcggcggcagcccctggtggtgctgctggaggcagcggcgggacgttcgacatctccaagctcggcgcgaccagcgacggcaagacggactgcacaaaggcagtccaggacgcgtggacgtcagcgtgcgaagcgaccggaagcgccacggtggtgatccccaagggcgactacctggtcggccctctcaacttcactgggccatgcaagggcagcagcatcgccatccagctggatggcaacctgctgggatcaaacgacctgaacaagtacacggcgagctggatcgaattgtctcacgttaacaacatcgggatcaccggctcgggcacgctggacggccaggggaccgccgtttatagcaagagcaagaccgacaacgtgaaggcgatgcccaacacactggtgctgtttcacgtgatcaacgccactgtcgccggaatcaaactactcaactccaagttcttccacatcaacatcgacaactcagagagcatcaccgtgaaggacgtgaacgtcaccgcgcccgccgacgttgagaacacggacggcgtccacgtcggaggctcctccaagatcagcatcctcaactcgaccatcggcaccggcgacgactgcgtctcgattgggcccgggtgcaacggcgtcttggtggacagcatcacctgcggccccgggcagggcatcagcgtcggctgcctaggccgctacaaggacgagaaggacgtgagcgacatcacggtgcggaactgcgtgctcaagaacaccaccaacggcgtgcgcatcaagtcgtacgtggacgccgagtccgtgctgacggcctcccatctcaccttcgagaacatcaggatggaggaggtggccaaccccatcgtcatcgaccagtacttctgcccgcagaaggtatgccctggcaagcggagcaactcctcgcatgtctccgtcaaggacgtcacgttccgcaacatcaccggcacgtcgtccacgcccgaggccatcagcctgctctgctcggagacgcagccatgcagcggcgtctccctcatcgatgtcaacgtggagtacgccggcaagaacaacaaaaccatggccgtctgcagcaacgccaagggcaccgccaagggaagcatcgaggcactggcttgcctggtctgatgatgaccttccttttgcatgcatgcatggtatctcatccttgatgatgatctagctcactagttctttttaatttccgcttcattcgcttttccaaattcgattgtgtttcagccaagttgtttagcgggacatctcttgtctgatcttcctgctaaatagagttggactcctatatatagaggccttccggcacatataatatacgtcggaccaatattattgtgatcaaaaaaaaaaaaaaaaaagggcgccccggggataaaaaatttgaatgaaacatagatactgaacgacaaacatcaccatgatatataaaatttacgtggc

SEQ ID NO: 18222 - DNA, 5281 bp, Zea mays
  misc_feature (3675)..(3675): n is a, c, g, or t
  misc_feature (4096)..(4096): n is a, c, g, or t
tacctacagcctacaatggtcgttgccttccatccgaccttaccggcctacccttcctcttccaatttgctactgatctcccctgttatcgtcggatttctcgtgacggtgagtccgtgacacgccggcgccatggcgagcaggtgcctagcggctgcatcggaggccgccgtcgtcttcctcatccggcccatcctcgccatcgttttcgtcttcaccctcatcctcctcggtacgccacccgcttccttctccatcggttgcctagtttcgcaggttccctgatccgcttcgtctccttaggctggtacgtggcgtggacgacggtgctggtgcacgtgccgctggtgcaggagatcgccggcctgcgcccgaagaagccctctaaacccaagccagccaaccgcggccgcgtcgccaagttctaccggaaccaggccgaggccgcacaaaggtgaaatctttactccgcacgaccacacaaccctcttccctcctttcgttgctctcctggatgtttaagtgctgatttatgtggaaacaaaagctgctcagcttttgttcaatccgatccagattgaatgctaagcgtcgtattcctgaaccaaacctggaatggagcttttgttccattcgatgcagtaccgttgtaatcttgtagattaggattctgtctgcaacttcgcatactgcatgcccacccactatctaacctggttaggcgtatgttgatgctgcagctcttcatgtcgtcatggttgcaattatggttaattgaaacggggaaagttgtttaagctgtctatttcagtatttcaaacttgattcaacatcatttgcagtttggtacaatgcctaaaggacctggaggcatcattaactgcatttttatgttcttcatgtttaccctctgggtctgggatgcctatctcaaattcctatcatttcttgtcatgcctactgttggtgctaaagtaaaactgtttgatgcaattcaaagaaaagcctagacattttcaaacttcagtgttcaatccatacaaattgatatattggtacttgattggaaaccactccatttttttactggaactataactatgtccatgtttgttccttaaaaaatgagtttttttttgtacatcttgtattgtgaatacctgcagttatattgtctcagaaactgtattttgctattgaattacttaggcatagctgggaactggatacttggatagggatggaagaaaaataaagccaatatcattagcaggatcaatctggtttatctagtaaaaacgggctgtgatcgaaatagtttatgtatcctttcttatttaaaccactatcatgggtatgtattccggaaaaatggctatctgaaaagtcttatattttgatttaccttgctgtctctttgcaccctgaagttttcttattttatcttgacctgcaatgccagcactaatattacaagaaagtaagtaccactctttggttcatcatacattttcaatctggttcgaagcagcctctgcgtatttataggggaaggctttctcagtttataccttttctgtaccttactcatgtgggagtatccagcaccgggtgtaccccttaatgtccttcgttcctttctgtggtcggcaatatacttggatagggatggtaccgtatcaattgcttgtagttgtaggttatgatagctgtttaagtttgctgcggctccatttgctacctgctacatcatataacagttgttatggtcctagatcggtgagagacttgagaggggtatcgatggcaggaacaccggccgggggcctctgcccacggtcgagcaagagaagggtttctctcttctaattcttgtctgttttatttctcatccattaattacataaataggccggctgaccgcccctatctagctagagattcttatcttcttaaaactcttctaaaaactctcaacaaactactgataacctttctagataatcttaactaatctcctaaatccgcccggctaatcttctaatcttatctctaactatccttatctaatcccctttggagggcccatggctactgctgccgcagcccctccgtgggctccttaggccctgacactaggccctgacaacagtggtcagtggtttgatgctttctagaagactagaaccttttgattactcacagagctgagcttgttgtttaatccatcctataactttacggtataccatgcttactagcaaattttatcatgagttctgtaatgtattttgggtgctcgaaaaccatttgctgtttagacttttagagtgtccgcttccgttttcagatattacgccaatgtttcaatcatagtgtgcttactgcaaaagttgcagtgtgccactgtgtgtgcaactacaatttgttttagcttcaggcagatagtgaccgtactctttcacttgtacacatgtccacaagtgacaaagtcactaacctgatttttgttatctgttaacaggaactgcaaatcagaaggggcaccttaagagaaaatctgctgcacactagtatgcaaattccctggtagttctaattagaatgcaatactactaatgatgacggttttctaggagagaatgtatatctgcatttgatgggagcttcctgcatgacgacttctctaggagagaatgtgtatcagcatttgacgggagcttcctgcatgacgacacatcaggcttatgatactagcgtatcaacttttagttgcatgaccttgtaaaatgaggaccttttaattgtagattgtacatatacttgtacatgacttttagttgcaacgacaacgatcatctattcaatcagccaataattccgtaactgattccctctgggaagaacgaagatctggactcacctggcaagagggaagccgatcattcttcaaattcaactatatggggtgcaaaatgctagcgtggttgaacactatgattgaggtaaggaaatactgagaaagccaatgcatttaagaaagaaaaaaaaatctatagaaatccaaacctaaagacatgtttgggacgactccatcagcgaaaaaatggatctgaatctaagatttaatgtggagcggctccactagtgattttgagatcaaccataaaactatttaggacataaggacattttagttggaatggcctcttttgcctctggaataagccttacatgtcaataactttctcgagtaaaaaaagtgtccaaggaaaaacaaaagaatgaaatggtagattgtataacgagtgtcaaaagtaggcaattttcatcaactccaccaaatctaagttggtggaacattcatctccactaaaataataaatctaacctttgacttcatcaatttggtgagcctaaattttgttgatctggacggcttggtcattttttcataaattcaagatgtttttgatgaatctggagttagacaagctcttcaggtcttgagagcatctccattaattctctaaaaagctctataaacatggatttagtcagctgctaaatacatattggaaacgaaaacaatcttatcattcgacagtttccaatttttaggttattaaatatgtttaaattacactaactcattttttctatttattcctttancttcaaatttggttttcatttgtatgctaaagttcaataatcattatttttttaataattactattttcattcgatatgaaccacgactgactatttttctctaattttttgatggattatctacaggcttatcaaatgagaacaatattcatcctttccgtcgctcaaataattcaaaatgcgtcacttatattcaagcgtgaaatcgatggcagacaattgatttcatagcatgattaacgtgtgaaataggctattgagagtacgaaacaacactctaagtctaagactaaatatggatatttaggaaattgatatatttaggaatttcatttaaagaacgttggagtgtgtttttattaataatatcctaaattaatttagagactctttttgaaaaccaccggagatattcatgcntttggttgcgggacagttagggacagacaggacagagacgtccctaggcgttctttcttgtccctctaattttgagggacaaccgaggataatactgggataatcatatcccaacccctgaccatgaaccaacaaccttatttaaaggatcgttttgtcccatctcgttctgttattacaaccaaacgcaccctaagtgtactataggggtatttgtttcggtttatttataacttctgtcggtcaaaaccaaaagctgttgtgaaccgtcaaacgtccagttttccagccagcttttataagaatcgttttaatgaaaactatttaaaatcagtgtgagcatagaatcgattgagtcgttataaaagtaggaatcaatcactttctaaatcataaatcctatgatacttagattctcccctgtaccacagatagattgtcagaaaaactcgtcgagaaaatccaaaacaaacaaacccattttttttttttgtggtctcaaacataaacctattccatttccattccaaaggcgaattactatataatacaatggctaagatgtcaagtccaattcacgccaagatatcaacagatcgctggagatactacggctgttcaagttacaaacagtaacaaatagctcctgaactaaaacgggaagtgcaaatgttcagaaaatcactggcgagcccgcacagctacgaacatgagccctcgctatgaacacaggccctcgttttcaagatcagcctgaaccttcgttcgcttgatccttcccggcgatttgcattctgcgtctacacccgggttcctgttcttgggtggccgcggagaaatggtgtctacctcggattcagttctctcgtctgacgtcgattcaggtgacgactttgttgcttgtgctttggttggagcttttagtggcacattgccggccttctgctgctcttctagtattttctgcaagtatcttgcatgttcctctatccgtagctgcaactgcctttgcacctctaattgttcatgaagctgtttctgaacctctatttgcatccttagagcttctgccacttgtaaattcttgtttttgcttgaatcaatgctgccctttcctaattgtgcttttttatcctccgaggaagccttcttatcggctgttggctctgcacttgataaattgtt

SEQ ID NO: 18223 - DNA, 744 bp, Zea mays
caacggcgctccaactgcactactgcagccaggctttttgcttgcttccgcgggctccgcgtccgcgtgcgataggctcaatatcctcgccagcggatcccctccttgcgaggccggaactgagctgccgccggcgctatggcgagcggcggcctggcggctgcgtcggaagtcgccgtcgttttcctcatccgccctgtccttgccatcgccttcgtcttcaccctcatcctcctcagctggtacgtggcgtggaggacggtgctggtgcacgtgccgctggtgcaggagatcgccggcctgcgcccgaaaaagccctctaaacccaagccagccaaccgcggccgcttcgccaagttctaccagaaccaggccgaagccgcacaaaggaacagcaaatcagaaggggcatcatcttaagagaaagcagtcaccgccttgtaatgagtacctgccgcagactttgttatgcagttctaattagaatgcaagtactaccagtgacggcgtctttttaggagagaatgtatatcagcatgtgatgggagcatccctgcctgacgatacatcaggcttatgatagtagcgtatcaactgtttattgcatgaccttgtaaaggaccttatgattgtacatatatatacacctgtatacaagaaataaagagaagcacatgtcctttggaataataaaaaaaaaaagcgccccgcgtaaaaaaaaaaaaaaaaaaggcccctagggcc

SEQ ID NO: 18224 - DNA, 955 bp, Zea mays
aggtaccggtccggaattcccgggtcgacccacgcccccgcggccgcccgcctcgtcgtcatctccccctcaacctgtcggataagccgcgcgccgtcgccgtggccatggcgtccctctcccccgcgctcctccccggcgccggcgtgaccctcctccgagcgccgcccgtgttccgcgtcaccgcctcttcctcgagctcggggagcaagaagggcaagaagcccaagagcggcagcaagggcaaggacaccaaggcgctggagcctccagcgcccgtggtccgccgcgcgccgccgggaagcgcctccatattccagcagcagaagaatgaggcggcgtccagggccgggggcgccggtgggaaggggcccacggaggaggagctacggcagcggcaggccaacgagaacgccttcctcctcgcctggcttgggctaggcatcatcatccttgtcgagggcatcgcactcgccgcctccggttttctgccagaggaatatgacagcttctttgttaagtacctttatccatcgttcactccaacagttgttctgtttttggctggtacggttgggtatggtgtcctcaaatactttgaaagcgagaaaagcaaaagctagatgacagcacgaagcatgtttggagcaatgatgagggtagagttagcaaatgtgcttgttatgtatgaagtagcttaaagcagcagatatgtgccagagaataggctggtgtttttatttatttttccttatatcctgcatcccaaattcctaattattcttttttgtttgtttgtaaattaacgatcaatggatactttcctgaatatgtattaagttgagttgtatattggtttttggcgatcaaaaaaaaaaaaaaaaacaagttgaccaaaaaaaaaaaaaaaaaaaaaaaaaaaaaaaggaaaaaaaaaaaaaaaaaagggccctaa

SEQ ID NO: 18225 - DNA, 2211 bp, Zea mays
cccacgcttccgggagaatccatctgacaaagatttaaaccagggaactcttgttatttttaacttggatccatcggtttctaatgaagaggttcgccagatttttggggcatatggggaagtaaaggagataagagagacaccaaacaagaaacatcataagtttatagagttctatgatgtaagagcagcagaggctgctcttcggtcactgaataaaagtgagatagctggaaaacgaatcaagttggaaccaagtcgtcctggtggaacacgcagaaacttgatgcagcagctcggtcacgatttggaccaagaggagcccagaagctacagacatcctcatgttggttcacctattgctaactctcctccaggggcatgggctcactatagtagtccaacagataacaatatgctgcaagctttcactaggtctccaactggaaatggaatgagtcctatcggaatgccttcactgatctcaaatgctccaaagattgctccaattggcaaggatagcaatcggtctaaatatgatcaagtcttctcaaatggtaaccagtcactgggagctgcatttcagcactcccactcatatcaagatcacaacagtgaacagatgagttctagtcctgggactttatcagggccccagtttctctggggaagtccaaagccatattcagaacattcaaaatcccctatttggcgtccaccagcaaacggacctgcattgtcatccagtagtcgcactcagggccaaggattcttgtacagtagccgtcaggcttcattatttggttctttagatcagcaccatcatcatgttggctctgccccttcaggtgctccattcgagaaccattttggctttttatcagaatcgccagagacatcttatatgaagcaactcaagtttgggaacatgggtaatgttggtattggtagaaacgggggaggcctcatgctgggcatggctagtcatgcttctgtgaatcctggttcttctctgattggaagtctgacagataacgtatcttctagcttcagaccgatattgtcaccgagattgggacaggcattttacactaatcctccataccatgggcctggtacattcggacttgacagctccattgaccatgcccgtaaccgcagagttgacagcagtgtgttgcaagctgatagcaagaggcagtatctgcttgacttggagaagattcgcagaggtgatgatactcggacaacattgatgattaagaacatcccgaacaaatatacatctaagatgctcctggctgcaattgatgagcttcacaaaggaatttatgacttcttctacctgccaattgatttcaagaacaaatgcaatgttggatatgcgttcattaacatggtatcaccggtgcacattatatccttctaccaggcttttaatggtaagaaatgggagaagttcaacagtgagaaggtagcatctttggcttatgctagaattcaaggacggtctgcactgatatcacattttcaaaattcaagtttgatgaatgaggataagaggtgccgccccattctttttaatcccaatggtcaggactctgtgaatcaggaagcattcccaattaatggtatatgcatccacatgcccctggaagatgattgccttgacaatgaagaaaacaagagtctgaacgagaagacaggagagaactctgctgatatcgctgggagcttgtgactgtcggccatgatagcaaacatgatcagaatggccacatatataaatctaactgtctagagagtatccacctccaaattgtataaaaactgatgaaggttgatggttaggcgttgaattttgtggtctttcggttttagttgcaacagatgtggcccctggaagcggaagcgaaagcgagggagcttcgaaccggagctgggagcttgcttgtcgaatccccctcactctttacagatgtggggatgagcaaccgctgctgctcatagttgtgcttgcttttggttgcttgctgtaaaaaggtgaactgaactgaagaaatttagccaaactgtacagtttagaacttttgtgcatattttgcattctagtatgttaatgtgtatgggtggagcagtagttcagagatccttttttctgcgtgagatcttttttcttaatgcaatatcggggctgtcatactcaggtcg

SEQ ID NO: 18226 - DNA, 3250 bp, Zea mays
ggccgttctctctacaactacaagtctacaactacaaaacacacacacacctgcatgcaggccgtgtctcacgagatgtgtgcagcagctgcgcttggtggtcactgccatcccggacagcatccccttcccccccagcggccagatcctcatcctcctcgctccattattgacgcctcgatgcttccgcctcattatcccgcgcctccccccccggacccgatttggttctcgctttccctttcgcctttctcggccggtcccagctgctgttttttcttcgtcgtaatccccgtccagcgagctgcagcgcaccacagtccacaaactcctgatcgatcctagctgctaggctggctggagcaggaattgaagcaggcagctagctagctagcattgcgtgatgaagaagaacaactcgagcattgagagcacgggcggcggcgtcggcggctccggcggcacggtgtcgggatccggctccggctccttcaacctccggaacctgtccaaggtcatcctcccgccgctcggcgggccgtccggcggccaaagccagtcgcatggcgggtcggacaagtgggtcgtctcgccgctcgactccagatacaggtggtgggatacgttcatggtggtcctggtggcgtactcggcgtgggtgtacccgttcgaggtggccttcatgaacgcgtcccccaagggcgggctggaggtggcggacatcgtcgtggacctcttcttcgccgtcgacatagtgctcaccttcttcgttgcctacatcgacggcaggacccagctcctcgtccgtgacaggaagaagataacactcaggtacctatcgacgttcttcatcatggacgtggcatcgacgatcccgttccagggccttgcctacctcatcaccggcgaggtcagggaaaacgccgtgtacagtatgctgggcgtcctacgcctttggcgtctgcgaagggtcaagcagttcttcaccaggctcgagaaggacatccgcttcagctacttctggatccgcagcgcgcgtctcgtcgcggtgaccttgttcctggtccactgcgccgggtgcctgtactacctgatcgccgaccggtacccggaccggcagaagacgtggatcggcgcggtgatccccaacttccggcaggccagcctgcggatccgctacatctcttccatctactggtccatcaccaccatgaccaccgtcggctacggcgacctgcacgcccagaacaacgtcgagatgatcttcaacattttctacatgctcttcaacctcgggctcaccgcctacctcatcggcaacatgaccaacctcgtcgtcgagggcacccgccgcaccatggagtttaggaacagcatcagggcggcgtcgagcttcgtgggccggaaccacctgcctccgcggctgaagcagcagatcctggcctacatgtgcctcaagttcagggcggagagcctgaaccagcagcagctcatggaccagctgcccaagtccatctgcaagagcatctgcgagcacctcttcgtgccggtcgtcaaggacgtctacctcttcaggggggtctcaagagaaatgctcctgtccctggtcaccaagatgaaaccggagtacatcccgcccaaggaggacgtgatagtgcagaacgaggccccggacgacgtgtacgtcgtcgtctccggcgaggtggaggtcatactgttcgacggcatctacgagcaggtgcaggccacgctgggggcgcgggacatcttcggcgaggtgagcgcgctgagcgaccgggcgcaggccttcacgttccggacgaggactctcagccagctgctgcggctgaagcaggctacgctcaaggaggccatgcagagcaggcccgaagacagcgtcgtcgtcatcaagaacttcctcaagcatcaggtcgagatgcatggcatgaaggtcgaggacttgctgggagacaacaccggcgagcacgacgacgacgcgaatgtgctgacggtcgccgcgatgggaaacagcggcttactcgaggacctcctcagggcaggcaaggccgccgacgtcggtgacgccaagggcagaacagcattgcacatcgcggcgtccaaggggtacgaggactgcgtgctggtgctactcaagcacgcgtgcaatgtgaacatcagggacgcgcagggcaacacggcgatgtggaacgccatcgcggcggggcaccacaagatcttcaacctcctgtaccaattcgggcgcgcgtcgaacccgcgcgccggcggagacgtgatgtgcctcgcggcgcgccgcggccacctcggcgcgctccaggagctcctcaagctcggcctggacgtggactcggaggaccacgacggcgccaccgcgctgcgcgtcgcgatggccgagggccacgcggacgcggccaggttcctgatcttgaacggggccagcgtggacaaggcgagcctcgacgacgacgacggctcaggttcaggctccggctctggcgccgcgcggctagcaatgtcgcccaccgagctgcgcgagctgctgcagaagcgggagctcggccactcgataacgatccacgactcgccagcggtggtcccgaacggcggctcgtcggggcacagccgtccaggcagattacagagcacaagttcggacagccagcgctggcctcgggtgagcgtatacaagggccaccctttcctcagaaaccgcacctctgaagctggcaagctgatcaacctaccaggcaccatggaagaattcaaagtcatcgtcggtgagaaactgaaagttgacgcggagaaggcgttgatcgtgagcgacgaaggagcggagatcgactcgatcgacgtgatccgggacaacgacaagctgttcatggtcaccgaagaagatctgaggcggctggcatcaatggactggctgtcgtgcgagtgatttggttcctcccaagataattggaggctaaatatagaatacagtacaagagtattgtgcttctacgatgtctaggattgatagattgatggcaactactgagtggcatgagctctatccagcgactaatttgcaggcaatgtgtaccatgagttcggaccactgtccgttattaatgcagggtcattcttcttgtaatgtctataaggggtttcattggcccccatattgggtacacacagacggttcaaagatgtagttcaacaagctaaaaaaaaaaaaaaaaaagcggcc

SEQ ID NO: 18227 - DNA, 1496 bp, Zea mays
cctttgttttgatcctattgggtacacattgacgggttcaaagatgtagttcaacaagcttggacggccacagttaactcctctaatgccattcttcggctatatgttaaaatggtccgcacggccagagcccttaaagcctggagacgacacacggtcggtaacatcaaagtgcaattggctatcattaagattgtccttaccatgctggaaaaggcacaggaaaatagaacactttctagtgaggaacttgacttcaggagaaggctaaaaatcaaaattcttggccttgcaggcatccaattatcaattgctagacaacattccaaacagacctgggtgcggttgggtgatgcgaacacaattttttttcatttgatggccaaccacaaaaaaagaaaaaactttattagatccctgaatcgtggagactgcctgttaactagtcaggaagataagctacaagaggcccatagacatttccttgagattctcggcactagaggtgggaggaacaatgttgttcgttgggaaaatctaggctactcgccttttgagttatccgatttggacaccatgatcaatgatgatgagatcaagaatgcagttatgggcatgcattcagagaaagcgcctggacctgatggttttatagggcttttctacaagggttgttttgaggtgattagagaagacctttccaacgcgattaatgatttttatcatcacaaattcaaaagactgcatctggtcaatgaggcaaacatcgttcttctaccaaaaatggagaatcctgacatgatagatctatttagactaatcagccttatcaatagttgtatgaagattataaccaaaataatggcaacaaggctggtgccgcgtatgaatgaaattgtctccactacccaaaatgattccattcaaaagcgatcaattcatgataacttcctctacatccagaaggtgattaaaaaacttcacaagagcaaacaagcagccctattcgtcaagctagacatatcaaaagcttttgactctcttaattgggcatatcttctagacgtcttaagagccctaggcttcacccaaaaatggagagattggattgctaccatccttggatcatcttcatccaaaatcatcattaatggccagcaaaccaaagaaatcaagcacatgagaggggtgcgtcagggtgacccactatcgccttttctcttcatccttgcaatggatcccctacaacgaatgattgaaagggcagctcatgaggggctactgggccaggtattacccaatggggcaaagtttcgttgttctctttatgcagacgatgcgggggtgtttgttagagcagacaaactagatctcaaagttctaaaaagaattctagaagctttcgaatggtggtcaggtctgaagatcaattttgagaaaacagagattttcccaatacgttaccctgaatctttatggtcaaatttaatggaagt

SEQ ID NO: 18228 - DNA, 1161 bp, Zea mays
aaaacagctattattcgatccaaaacataaaatcattgggtcaaacctcgaggccggccgggaattcttctcgtctcgctcggctcctctgggcccacagcggccagcaaactgcctccgtcctccctgcgggctgtgccgcctcttcttcgcgtcggcgccgccctccttccttctcttctgctgctgatggaactggatcctcgcctctacgagaacgtctctgtcagcgacaacgatgtccgaaacatagttctatcttatcttatgcacaactgttttaaagagacggcagaggcattcctatctagcaccgggttgaatttacctgtcgactatagtgtggatgtggataagcgtaaagcaatttttaattttgtgctagaagggaatgcccttaaagccatagagctgacagaagaaatggcacctaacttgctagagaatgatatggatctacattttgatcttcttagtctccacttcattgagctagttcgctccaaaaaattcacagaagctcttgactttggccagaaaaaattgacatcatttcagaaggttaccaagtatattgagaaactagaggactttatggccctcctggcttatgaagagcctgagaagtcacctatgtttcatctactaagcccagagcacaggcagaatgttgcagagggcttgaatcgggctgtccttgcacatgctaatcttccagcatattcatcgttggagagggtggtccagcaagcgactgtggttagacaatacctacagcaggaagttggcaaggattcttacccaccattttctttgaaggcctttctgagcaagtaaatgtgcaaatggtcacttcttcagaacagggtaaccacctctccaggccatcatgtacatgtacccttgtggagtgcatacacgatgaagtagtttatacagttcaggtgttgttgacaccacttatacagttgcaatggtgttgtactttgaaaaggagggtgctgtatgctgtctgcttccttgatttacattctgttttacttgtctctctgccttagacatggtgatagcatgtatgtatgacctgttgagctattctgtgcgttcgttcggtgaactcaaaaaaaaaaaaaaagtaattggtctttttattactcccgt

SEQ ID NO: 18229 - DNA, 1186 bp, Zea mays
ggacaataccgcgaacccgggagggcctggggaccggcaattcttctcgtctcgctcggctcctctgggcccacagcggccagcaaactgcctccgtcctccctgcgggctgtgccgcctcttcttcgcgtcggcgccgccctccttccttctcttctgctgctgatggaactggatcctcgcctctacgagaacgtctctgtcagcgacaacgatgtccgaaacatagttctatcttatcttatgcacaactgttttaaagagacggcagaggcattcctatctagcaccgggttgaatttacctgtcgactatagtgtggatgtggataagcgtaaagcaatttttaattttgtgctagaagggaatgcccttaaagccatagagctgacagaagaaatggcacctaacttgctagagaatgatatggatctacattttgatcttcttagtctccacttcattgagctagttcgctccaaaaaattcacagaagctcttgactttggccagaaaaaattgacatcatttcagaaggttaccaagtatattgagaaactagaggactttatggccctcctggcttatgaagagcctgagaagtcacctatgtttcatctactaagcccagagcacaggcagaatgttgcagagggcttgaatcgggctgtccttgcacatgctaatcttccggcatattcatcgttggagagggtggtccagcaagcgactgtggttagacaatacctacagcaggaagttggcaaggcctttctgagcaagtaaaatgtgcaaatggtcacttcttgagaacagggtaccacctctccaggccatcatgtacatgtacccttgtggagtgcatacacgatgaagtagtttatacagttcaggtgttgttgacaccacttatacagttggcattcggctcgagctttgaaaaggagggtgctgtatgctgtctgcttccttgatttacattctgttttacttgtctctctgccttcgacatggcgaaagcatgtatgtattgacctgttgagctattttgtgcgttcgttcggtgaactcagttcgagtcggtttgtaattggtctttttttattactaccgccatgtgcagaggctaaaggtccgaactctggatgcgtaagcgtaacgggttattctgtccgccgtactcctt

SEQ ID NO: 18230 - DNA, 6280 bp, Zea mays
gggtacacgcgcactgtctctctcgtatcactctccattctacctctctcttccccaatccaggccagccaaccctagcgcaccggcgatggcgtcggacccggcccctgacgacgcggccgcggccgtgaatgggcacggcaacgacaacggacacggtaacggcccgtccccgtcgaagcgcccccgggcggtgatctcggaagccgagatccgcgtcgagttcgcacaccacgacgcagccgtggcgcgcgtcaacaacggcagcttcggctgctgcccggcctcggtcctcgccgcgcaggcccactggcagcgcctcttcctcgcgcagcccgacgccttctacttccacgttctccagcagggccttctccgctcgcgcgccgccgtcgccgaggtggtgggcgctggcgacgtctccgaggtctccctcgtcgataacgccaccacggccgccgccatcgtcctgcagcacgcagcctggagcttcgccgagggtcacttcgcgcgcggggatgcggtgctgatgctccactacgcctatggtgcggtcaagaagtccatccacgcgtacgtcgcgcgtgcgggggccaccgtcgtcgaggtgcccctcccattccccgtcgcgtccgccgacgcaatcattgccgagttccgtgctgcgctcgcggtcgccaaggaaggagggcgtagggtcaggctcgcagtcatcgaccacattacctccatgcccagtgtcgtcatcccagtcaaggagctcgtcgccatctgtcgagaagagggcgttgacaaggtatttgttgacgctgcccactctattgggcaggtgcctgtggacgtgcgcgacattggagccgatttctatacaagcaaccttcataagtggttcttttgcccccctgctgtggcctttttgcatactcgcaaggatgacccgatagcctcccaactccatcaccctgttgtttcccatgagtatgggaatgggctgcctatggagagcggatggattggaacacgggattacagtgcccagcttgttgtgtccgaggctatagattttgtgaatcgatttgagggtggaattgaggctatacgaaaccggaatcatgagaaagttattgagatgggtaggatgcttgctgaggcatgggggacttttcttggctcacctccggaactgtgtggtagcatggttatggtggggatgcctggttgccttggtgttgagagtgatgatgatgcaatgagagtgaggacaatgttgagaaaggatttccaggtggaggtgccggtatactacaactcaagaagggtggaaggacaggagatgacaaaggataaaaatggtgatccagtgacagggtatgtgaggatctcacaccaggtttacaatgtcacagaggactatgagagactgagggatgttgtcaataaacttgtttctgaagggttcaccagcagcaagttgcggccttctgagaaggtacactctcagctgaaaatacttgcatatttagtcccttaattttctttgttggctggcttgggttcctctgttaatgattaatcaggttaatctatattttaatagatgatactaggaacactttatgcggttctgttattttggtggatttaatccttgtttccttgagaaggcatgcttgtacaaagatattaagttaatgtgagaagatattcttatgaatactgtttctagaccgtaagaactttgaaactctgaaactgaatattcatatgaaactgtttccttgatattcttatgaatacgactaatcagtcctggtgtatatatatagtacaaagtacacaaaggcaaataggcaatactgaaactctgaaactgaatattcatgccaagttcaatactgcaatactgaatgtaaataagatcttcatctaaacaagcaaatacacactcactagtgatctagagcggcatatcttcatccaagtgaaatgcgtctcccaactgattcaggttcatcctggtctatttctcttgctgtttctggttgtacttgttgttcagctgtagcaggagcatcttcttaatgatcgctgccatcttcttcaccaatatcttgagctgttgtatttcttgaacgtttccttgtcttaagtcctaacataggtcatttgaggatgagaagaggaaccagcacctgcaacagcagtcctaggcaaatttctgccctggagaccctgtgcacctaacgcatcatccatggcacccataggttgttatcaccatcaggttcaacagactcttcaacccattcattttcccacataaacttttgaagcaccagcgggttgcttctctttcccttgaaacctatctctcttagatttgaaaacctattttccatcttcctgttgtagcttacatagaccaatttatttagcctctggttctctagtcggttcctcttctttgtatggacatacacgaaatcaacaagcaatagcgagttatattgctccatatgaaccaacaaaaattgtacttactgctgcaaattcactccagtttttctctcaaccaaatgctgaacaacggagtcttctaactctttgcttagctttttagttcatatgccagtcctccatatgcaaattcagtgtttggtgccaaagaacagaaatgaaaggaagccaaatactgacgagcagataagaaaaatgaagagcaaagagttaacagggggggggggggtgaacattcagatgaggagttcatctcaggacggtgaacaggaactgctgctggcgatttggagaagaggccgatcagctgccggtgctgggaaacagaagcgttgagagggttttgagggggcggcggctgtgccttttactctactgtagacgggccaaaaatagaagcccacaaataaaaccctagcccagtaaaacctggtcagtttctcgcctaatcggatgactaattgctctgggtcgatgattagttggacgccaggacgacgaggacacctggtcgggtcaccgatcctgatcgtgcccttccaggcgacctagacgactaatcgcgattagttggatgacttgaaaacaatgtcaactacgacgttgacacatctgtagcaacagcatgacacttttccctttatccgtggtttgttttcaaactgctatactacacaggtttgtgtttaggatgctccctacatatgcataatcattttttagtttgtgaaaatgtggtgagtcaataacttccaagttagttgagagtcatgagaaattttttttttctgaacaattgctgtcttttcttgttttagtgtaatataagatgttctcagttatcattttttggacatgaaagcagctgcttctgattgttaacttgttgcttttcaaagagtgtaaaatgcatgcaggttagttcagtgccatgtatatttgtttgtatttcttattggaaatttgtgcagtttaggattgtattcacacaacattttgtttgtttcataaaagtatgtctataatatggtaatcgatttacaaagttattggaatataagcatcgctttgtgcatgccatgagggatatagacatcgctttgtgcatactgtgagggatatagactttggtttgcccaagattcacattaaaagttttatgattttgtgaatgaatttatgctgtatgtcaaggtgtctgattcacggtttgagacccagtatcctactaaagtttaagttatggaatcatctccatattgagcaagtacctttgctagcacctagagaataaggagcttctgcactcacaattttcttgataactaagaaggtttgaaatcttaaattccctttgaaaaacgtttggttttcatcatttcttaaatggttccgtgatgttgttttttttggatggtttcctgtgtggataggccatgtcagattagaagttgagaacgaatcttaagagaaggataagtgaatctgagaactagaatataagaacaagtagtttaattttaagagtattgtaactaaatgcttcacacacttaacagttagggccatttactgtgaaatcagatcgttatacctatagatattgaactcttatttcttgtgtatgccttcctatttctattggtttccactatccattattgggagcacacaccaatgccgtagtggcaacactggggtgtttggtttgaggaaccactccatccaaaataagatgatgcatcatgagttcaatcctcaaatttggtggatgacctcatttctcatattagtaactaactaactatgaggaatgaggtggtgatggatctactcatttcattccacaaaccaaacaaagaagtaaggagtgagaagattatggactagctcatttctcaaaccaaacactccataaatgaatcatattggtgtattgcatatgctgtttagaggtatgcttcgtcttggattcaccaaatgaaataaattggctctcctgcatgtcaccagacatagtcccacagcccatagttgaaaagcatgacgcatggatgctcaatttcacacacctattgcttacttcacactgtgacaactatagtggtaagcattttaatctggcagtgattgccactatgccgacaagctaattgttggttgatgccctcagtatttactgatacctgatttttctatctgatttaaattctcctatgtctgatgtttttttccacgattatgtttacagcaagaagcttaggtgtaatgaccttccagccaggtagcatccacctgaaggcgctgtggccgactacttaggtgtggaccggatcagcgcagccagtacggcttcgtgatcgtgacgttgaagaatgtagtgtaccgccaggaactgacatgtgttgtatttggcgttcagtgtaagtaacaataatgccctggcatgttgtcttctctcacattttgggagctgctgtaacctcagaataatctggaatataaggatatttacagctgctgtagattgattgctggttaccgatcgcattgatcacaaatacatcgaagtggcagtggattactttgggttgtgccaaagctgcagctccgttgacgcgttctataagaaaaacattttctttgcaggcacgaacgctgcaacttgtgagcccgtgtgtcagtttgaatttgtatagtgggcgaagatacccgggggcaacaagtggccgctgacatgtacctgttcgttttccataaatccatatgcattgaagggatcaaatcctctacaattcaaaatctttctcaatctcttttaatctgtatggtttagggataaagtgaacatggcctaaagtagcgcaggctgcggactgcctgcaagcaagggtgccggccgcaaccactctttgccggcttaatgcatgtaagtggtgcgggtttaggctatctccaacaatttctctatcttactttatttcaaatcttactatgtaaatagtacattctatagtgtaaaatattgttttgtatagtcatatgtatgctctgctgaacatggctttatggtgtctctttaacagtctctagtggtaaatgaatagtttgagcggggtctgtaggcaataaataaataaaaaatcaagagcaacacaaagttacaaataaaagatacaacattgtctctcattgcacgagttttatcttctatagttatgttttttgctaagagatattcgatacaactaataaaatttatttaccaaaaacttattgtagagacactttatagtttgttaactgtcgtttttacttggacaacctttctatgagctctaggttgtgttaggttgatctaatccggttcgatcaaagtaccgaactgtgatcaaactcccacgccttgattaggggcgcaataactttatagttgcaaccctttttacaccatatatattaatatggagagggctgacacatgaactaacattattcgtaacctcctttccaatacactactcgtaagatctaatttatctctcttcatggttagttaaggaaatatcgtcgccgaagttctaccttaccacctctgagttgaacttcatcgtcctaagggcattgcagtccaaccccgaaggtataaaccatgttctaacacatctagtggctaaggtttgtgagcaagtttatattagacctcacagtggtactagagctaaggttggtacccagacattaaccctacatgtaaaaaacc

SEQ ID NO: 18231 - DNA, 1870 bp, Zea mays
gcacgagaccattacctagaacatcctaatcgaaaaacgcgcactgtctctctcgtatcactctccattctacctctctcttccccaatccaggccagccaaccctagcgcaccggcgatggcgtcggacccggcccctgacgacgcggccgcggccgtgaatgggcacggcaacgacaacggacacggtaacggcccgtccccgtcgaagcgcccccgggcggtgatctcggaagccgagatccgcgtcgagttcgcacaccacgacgcagccgtggcgcgcgtcaacaacggcagcttcggctgctgcccggcctcggtcctcgccgcgcaggcccactggcagcgcctcttcctcgcgcagcccgacgccttctacttccacgttctccagcagggccttctccgctcgcgcgccgccgtcgccgaggtggtgggcgctggcgacgtctccgaggtctccctcgtcgataacgccaccacggccgccgccatcgtcctgcagcacgcagcctggagcttcgccgagggtcacttcgcgcgcggggatgcggtgctgatgctccactacgcctatggtgcggtcaagaagtccatccacgcgtacgtcgcgcgtgcgggggccaccgtcgtcgaggtgcccctcccattccccgtcgcgtccgccgacgcaatcattgccgagttccgtgctgcgctcgcggtcgccaaggaaggagggcgtagggtcaggctcgcagtcatcgaccacattacctccatgcccagtgtcgtcatcccagtcaaggagctcgtcgccatctgtcgagaagagggcgttgacaaggtatttgttgacgctgcccactctattgggcaggtgcctgtggacgtgcgcgacattggagccgatttctatacaagcaaccttcataagtggttcttttgcccccctgctgtggcctttttgcatactcgcaaggatgacccgatagcctcccaactccatcaccctgttgtttcccatgagtatgggaatgggctgcctatggagagcggatggattggaacacgggattacagtgcccagcttgttgtgtccgaggctatagattttgtgaatcgatttgagggtggaattgaggctatacgaaaccggaatcatgagaaagttattgagatgggtaggatgcttgctgaggcatgggggacttttcttggctcacctccggaactgtgtggtagcatggttatggtggggatgcctggttgccttggtgttgagagtgatgatgatgcaatgagagtgaggacaatgttgagaaaggatttccaggtggaggtgccggtatactacaactcaagaagggtggaaggacaggagatgacaaaggataaaaatggtgatccagtgacagggtatgtgaggatctcacaccaggtttacaatgtcacagaggactatgagagactgagggatgttgtcaataaacttgtttctgaagggttcaccagcagcaagttgcggccttctgagaagcaagaagcttaggtgtaatgaccttccagccaggtagcatccacctgaaggcgctgtggccgactacttaggtgtggaccggatcagcgcagccagtacggcttcgtgatcgtgacgttgaagaatgtagtgtaccgccaggaactgacatgtgttgtatttggcgttcagtgtaagtaacaataatgccctggcatgttgtcttctctcacattttgggagctgctgtaacctcagaataatctggaatataaggatatttacagctgctgtagattgattgctggttaacgatcgcattgatcacaaatacatcgaagtggcagtggattaaaaaaaaaaaaaaaaaaa

SEQ ID NO: 18232 - DNA, 1510 bp, Zea mays
ccggccgggatccgtcccgatcccgaccagctttgagatcgtttgagatcgcgatggcggacggccgctgctgcaccttcctggagatcctcttcgccatcatcctcccgcccctcggcgtcttcctccgattcggctgctgcagaatagagttctgcatctgcctgctgctcacaatccttggctacgtccccggaatcatctacgcgatctatgtccttgttgctctcgactctgaccagcacgagagggaatactacacccttgcttagagcatctggttgtgccaggcgggcctgcacagttgagtcgaaatcagtattttttttctcatgtggattgtctgacatggcataagcggcaatgggtaaccaagtgttgtggtctatatctctgttacccaacttgtgagctctctttattgtgctccagttattcaatctgtaattgtgatactacaagagaataagatgcgcatgtatctctgagagcaactgtgatttatgattggtgctaccttgggctcaaaaacatgtgaacagtcgttctatgaaatgcgatgtgtacacacatgttctttgtgctcgcctgcagaccaaaaggggatactgccagatgtatcgtgcagtaattttgacgtatgttgctctgggccacttctttcttgcacacacagaatagaactgatataaattatgccccttctggacggcggcagctggtaaacaccttcatgtcgacgatggttcagtgtgcaggcagtaaaatatgtatcaaaatgactcgtttcccgtgctgcgtgttcgtgaccatgtgcaacccagcggtttgtttgtgtgctttgtttaatgactcttcggattgagcctatgaccctgtttgacacagcttattcaacttctttataaatttaaataaaagttctgctaaacagacaacttctgcagcaacttattagttcagctgcttctcagaacgaactaaaagtagccaataagcattagctgcttctcaccagcttctcagataagctactttttcaacaagcagcagctgtaccaaacagggtctatatatatgtttgcttgtcctgaaaatctggtagtcatacgctggttgattcaggaggttttggtagtgtatttattctgaacaatacatctgattctcttctggatttttaacaccgccgcttctgaaacttttttttgttactgattaattggaccggtcgtcatccgtggcctacaagttctgggaagaatggaagatcattggggagaatataatcagcgaacgagacagatccatggtgcaggtgtaccgcgccgcacggctggttcatgttgcaccgtcactgtcaccactaaaattagtcactgtcagcctcaccaaagttaaggcgccgccgagtcgacccgtgtagacagaagccttcgtgcccggtggtcgttccaccctgatcacgacaacgcgaggctagagaagctgccagccgagcagccgaaca

SEQ ID NO: 18233 - DNA, 765 bp, Zea mays
gccggccggtttccggatgtgtccctacccggccccgcccgggaagggaaacggagacgaaacccgctcgcgttttcttctttcatcagaaaacgaaatccactcaggagcgaggaaagagggacagaggagggatagatccccgggctccacgcctccacaaccatccgtcccgatcccgaccagctttgagatcgcgatggcggacggccgctgctgcaccttcctggagatcctcttcgccatcatcctcccgcccctcggcgtcttcctccgattcggctgctgcagaatagagttctgcatctgcctgctgctcacaatccttggctacgtccccggaatcatctacgcgatctatgtccttgttgctctcgactctgaccagcacgagagggaatactacacccttgcttagagcatctggttgtgccaggcgggcctgcacagttgagtcgaaatcagtattttttttctcatgtggattgtctgacatggcataagcggcaatgggtaaccaagtgttgtggtctatatctctgttacccaacttgtgagctctctttattgtgctccagttattcaatctgtaattgtgatactacaagagaataagatgcgcatgtatctctgagagcaaaaaaaaaaaaagattggtgctaccttgggctcaaaaacatgtgaacagtcgttctatgaaatgcgatgtgtacacacatgttctttgaaaaaaaaaaaaaaaaaaaaaaaaaaaaacttgcggcc

SEQ ID NO: 18234 - DNA, 2347 bp, Zea mays
gcacgaggagagagagagtgtggacgtaaaggaactatatgttacataattattgaaatctgatctggacaaaacttgctttgatatcgccaaaaaatggaaggcatggcactagtttctaccagcccaaaatgctcagaagaacaagattgaatcagaatgtgaccaatatacatgttaatttctgtagccaacaccaaagtgaaatctgcttgcttgcctatcattaaaggcgtactcaagccgtagaggtcccagaggggagtccacgcggacgccaacaccatagccaaagccactccctggctttccacgagctccggctgggtcaccaggaactttaggaccagaaccaagatcactaccatagtctccaaagaccacgccttccagtggcccaaacatgcggcatgacacttcaccactacctacagcataagaacgcccagagccaacagcaccttcttcatatcctcttacactatttgtcccaccaattgcaaatgcttcatgaggtggaaaatttccctccatgtgacctccagaggcacttagaagaagcctagcaggaccaatttcatagccctgcctcaagcgtgctgtcagtcggttgaagcttagccactccgggagaacagggagaccttgctcaatgttgaaaacaaacattgtagagctatggtctccagaatctgtgtagatactttcaaacttagctaacagtgtatcatcataatcatgtccactggcagtcaattggctgttatagaaatccctgatgaccggattccctttatcatcacgagcaccagcatgctgaaaaattaagccaagtgtcccactccacttgggtctgaatggtcgactatattctaagccagcaataacacgtccaattgttataggcgcatggtcaggatgatcaccaccatgaacaagtgttccaggagtcctagagttctgaaccataacagttctagaggttctcttgttgtctccatcaatccaagggtcagtaaagttcaatctaaatattgaatcgatttgccccctttccaaagagagatttaatttcttgttcctcccaaaaacattccgatgtgaatatgcaaagctgccaataagtccagaaaggggtccatttgttatcccacttgaaattccaccaccagcagagaaaccacccgaagggcgttcaacaagattcatgacaaggtctactttattagaatctccaactggctgtgggattatcgtaacatcctccatgattcccatagtaagtattgtttctacatcccttttcacttgtgctctattgtaagcctgccctttcttggtggtaagctgccgaaggatggtttccgtctgtgtttttccaacagttggttcaccggtcttcctgtctagaaagcgaatgctaatgttattaacctcagcttctgaaacctgcagcctcagaatccctccagaaagtatctcagcatatgaaaccaacccagttaggccacgctcctgataccatctgttaacagacttgatcacttgatccagatgcctaatgttaataatttttccatggcgatcgcgaaatgcatcttccatgaacttggacggtagcatgttggcgccctcgcataccagcccatggaagtcttggttcggctccacctcaaagacgaggcgaatgccatcgcgggtgtcgacagcgacgggcatacacgatcggaagagtccgctctcgacgatgcggtgcacgtcctcctgcacctcccgcacggtgagcgcggcgttggggcggcacgcgcgcagcgccgcggcggccgcggcctccagctcgggcagctccaggggctccccgtcctttccccgcaccgcgacctcgctgatcagcacccgctcctcgggccctccgccgtccttgccgtgccgccgtggcggggacggagccgggtcggcccgcgcaacagggacgcgtgggaggcaggagcccaggcggcgggcggcggcatcgatggcgcggccgatgtgcgcgaacgggagcgctgcggagaggagcgcgggtgccggagacggggacggggacggggccagcgcggaggtggactcgcacgggagcttgacaccggaggagacaaaacggacatcgcaactgcggaccatggcggcggcgcgggaaggctagggttccgaaatggaggtcgactagggtttagggctttgccgacgagaccgagtacgaggacgagggcgcgagggtttcctccgccatgggcgccggaggaggatgcggagcagatggtggctgactttttcgattaggatgttctaggtaatggtctcgtgc

SEQ ID NO: 18235 - DNA, 2488 bp, Zea mays
tttttaactaaaccgtaataaataaaaaagaacgaagtgagtataattctcagctaggaattaaacctagttaggcgggtggaaggtgtggcgtgggtctgctattgtaccgtacaagtttgatgatttttatttttgaactcctccattctagatttgttgattttactttaaatacagctgtcgtgtgacctgtgtatacctctatgaactggtgatttgtcttcagaaaataagcgtgctagtatggagcgtacgacaagttcgagaaaaggattactaatgtactcgtagatgatatatactctttcacaataatggctttccgttagggatgaattaagggaattaaatcacctcctataaacttgtttgagagaaagatacgaggagattggagagactcttactagcccctccaatcttctcctgtatccctgctaccaaacaagctatattcaaaattgtatagaaaattatttaattcccccttaaattccctccaatcaagatacaaccaaaaaaaggcctatcacagattgcaatgaccgtaactcatcatccgaaatccggctaccagggtggagaattcaaatgccagttaaggtgttacataagaatatagtgttgatggtctatttatttagcagaacaacgcatgagctttaaatgccagattacttttctatttatttagcataagaaatgaggcttgattttctcttgtgcccttggttttttggagccaaaaaaggcagctgatataatatagacctgaacaaaaggtactgacgcaggtcacttctctgaatgatgaacactaacagcaaattatctagtgctatccatctctgctcagaatatcatatcctcttacagaaacagcaccagattcgccctgtaacctgttacaacaaccgtacagacgtttgtttcattgcccagacaaccagagagtccgaaatcatcttcaggtgcgaaattgacgtgtcattgcttggacttgtcatcgtcatctgagccttcgtcatcgtcagacgactccactctgttaggttcttcaccaccattatcaccagttttagctcgcttctctttcttacgctgtttcttcttttgccgtttcaggcgcttcttggctgtccgctcctcagctgctttcatcctctcctccctccgcagttcgaactcagctatctcttttctcttctggtagtccgcatccattcgtgctagacggtcctgctctctcctcctcatttgccgatactggtggttgaagagtgtttgcatagttgcagatcagaatattctcatactaattatcatgcctcaaaacactaaatgcgcaatttgttaaattggaatatcaatctataatcatattacaagattcaataaacagaattgtttagaatacatgtgtaaagaaactttaagggcatggcatggctgtaagtttcatgatttgccaatcacatcctgatatatgttcacttactgcacatctgatctcaactactccctctgttccaaattatagttcactttggcttttcctgagtccaatttctctttgaccaaatttgtacaaaaaatgcaccaatatttcattaaattctccatgaaatatgttttgatggtgcatttatttgaacttgcagatgttaatagatttttctaaaccaatgctaactactacctctgttctcgaatatttgtcgtccgctagttcatttttgaactaaacggtgacaaataaaaaagaacggagggaatataatttaagggagtgcctacctaaaatactggcagctaccaaccaacaactacacccatatatgaaagatgccaaggtttcatgttgaataaagctgacaacagatgctcaatcaaaacctcatgcaatagcaggtttgcattcaatggatagactaagtagtccagtcacattcagtgtgtttggttgcctgtattttctagtgcttgcatcgtgggatgcaatgtccatgtgattggttacctgtacagacacaatcaggctctctgtatactttgaccagatatgagatcgtgattggttccatatataagaggataccggcctgcgtatactcatgcagcctaggctttttttctaccatccgcttgcatctgtggagaagtggtcagccggcatggctggtgagccaggcgcgcggaaggccgacgtgtgggagactgcaaccaatcacgcgttgtttgattgttgtcaaccagactctactcgtgcgaggtgtgtgtttggttacatgcgtgcagatatggagccaggctcgcacgatactcaaagcaccctgggccaggctctgtaggcgcgagcaaattggtcgcatctctggagccaggctcccgccagcttggctcatgcaaccaggctacggagagaagccaaccaaacatgctaattatgacgatcatgttaactaagaattgacacatactcgac

SEQ ID NO: 18236 - DNA, 1294 bp, Zea mays
agcataagaaatgaggctggggtttctcttgagcccatggtaaaatggagccaaaaaaggcagctgatataatatagacctgaacaaaaggtactgacgcaggtcacttctctgaatgatgaacactaacagcaaattatctagtgctatccatctctgctcagaatatcatatcctcttacagaaacagcaccagattcgccctgtaacctgttacaacaaccgtacagacgtttgtttcattgcccagacaaccagagagtccgaaatcatcttcaggtgcgaaattgacgtgtcattgcttggacttgtcatcgtcatctgagccttcgtcatcgtcagacgactccactctgttaggttcttcaccaccattatcaccagttttagctcgcttctctttcttacgctgtttcttcttttgccgtttcaggcgcttcttggctgtccgctcctcagctgctttcatcctctcctccctccgcagttcgaactcagctatctcttttctcttctggtagtccgcatccattcgtgctagacggtcctgctctctcctcctcatttgccgatactggtggaaatcaccagagccagagccagcagatgaccctgatgtgttactgacacgcacagggacattctccatgatgcgcctgagcttcacctccaggtcttcctcatcctctcgcagttttacacctcctgatctcttacctgcaggatctgccacaaccagctccttcccactgtcaccaccagaagcctttcctggtggtgctatagggactagctgctgcatgttgctatcactgttgggagctgacattgtgggatgcaaccctgctgtctttcaagttgccttgtaaatcactaatataaatcctcacttcctctctcgtctatcctcagctgcagaacgccagaaccgttgcggagtgcggacctcgtcacctggactactgggctggacctggccagctgtccgccgcccaccgcgccgcgccgccgcccttgcagcctagcagcagaagcgtggaggcggaggcggaggccgcgcccgtggcccgtgttgctgtgcagcttgcctcgcaccgccgccccccgccgcctacgcttagggacttagggttagggagttcggcgtcgcaccgtcgcggctctccgggaaacggggtcgcgagtcgattaggatgtgttttgttggaggtgaaagaccgggacgagatccaaccaaacacaccatgtgtccgtgactttttcgattaggatgttctaggtaatggtctcgtgc

SEQ ID NO: 18237 - DNA, 1224 bp, Zea mays
  misc_feature (17)..(17): n is a, c, g, or t
tttttttttttttttcntttttttttttttttttttttttttttttttttttttttttttttttttttttttttttttttttttcggagccaaaaaaggcagctgatataatatagacctgaacaaaaggtactgacgcaggtcacttctctgaatgatgaacactaacagcaaattatctagtgctatccatctctgctcagaatatcatatcctcttacagaaacagcaccagattcgccctgtaacctgttacaacgcccggacagacgtttgtttaattgcccagacaaccagagagtccgaaatcatcttcaggtgcgaaattgacgtgtaattgattggacttgtcatcgtcatatgaacctttacaatgggcagacgactacactctgttaggttcttaaccaccattatcaccagttttagctcgcttctctttattacgctgctacttcttttgccgattcaggctcttcttggctgaccgctcctcagctgctttcatcctctactccctccgcagttcgaactcacctatctcttttctcttctggtagaccgcattcattcgtgctagccgggcctgctctctcctcctcatttgccgatactggtggaaatcaccagagccagagcctgcagacgaccctgatgtgttactgacacgcacagggacattctccatgatgcgcctgagcttcacctccaggtcttcctcatcctctcgtagttttacacctcctgatctcttacctgcaagatccaccacaaccagccccttctcactgtcaccaccagaagcctttcctggtggtgctatagggactagctgctgcatgttgctatcgctgttgggagctgacattgcgggatgaaaccctgcttgtcttccaagttgccttgtaaatcgctaatgtaaatccccaattcctctgtcgtctgtactcagccgcagaacgccagaaccgttgcggagcgcggacctgccgacctggtcacctggagtcctgggctggacctgaccggatggccgccccccgcctcccaccgcgccgagccgccgcccttgcagcccaggcgcggagacgaggccgcgcccgtgctgccgtgcagctttccgcgcgcgccgccggcgtttacgttagggagccgtcgcggctcaccgcgaagccgaccgcggctcggagctcgcccgtgggcgacgagaggaagggtgtcact

SEQ ID NO: 18238 - DNA, 991 bp, Zea mays
cccccctcccgttcccactgtcttgcgtggaaccagctgcgtgggcccccccgcaaggtcgaagcgtcgtctctctcggcacggagcctagtgcccggcctcgtgagatccgaaattcagaatcgaggatggcgacgaccgcgactaggcggtggtggaggcggcacgacggcggcgacgatgacccagacgacctcgtccccatggacacccaagagcaagaagagctggtccggtctctggaggctaagcaggcgcagcaaggccgccgttggaggcgcgtcttcgcggggttcctcctaggttacgcggccttccttgtctactccagtttccatcatgcttggtctccctgggagctgcggtaccatgcttacttcatggaagatttgcctgcaccaatggtcataattgcagattggatagctgctctagcatgcctatttgctgtgaaaggattactacagaattcaggcccatcaaagaagtggatgtggtattcttgctatgttggcattttggtagccatcttttggacatactacatcttgaggttgccaagaattcgatgggatgttgcatggctcccactcggtcctttgatggctggtgcattgagcctgtatgtggaccatgtgctgctggagtcaatgcaagatatcagcacattgagaagttacatgtataacttcaaggccttgtagttttgagcatagtttcccttgcacctatatgcagctatatgtggaacaggttcaggtcatttctccttttttttagtggcagagttgcggtggtaccttgttaaatggtgtgttagcatgaatttttaacctcagagaatacttgtgcatcacttccgctctgtggcgggtgtatgtacaagctgtggtgccaataggcaccgcggctgtttgaaacacccccctgcttcagtgcttctactgatgtccatatttgttgtagaaattgatgatttttgagaggctta

SEQ ID NO: 18239 - DNA, 851 bp, Zea mays
tcgaggcttggccgggcagcattacccacgcagcatggacagagaacatgagtcagatgaacccaaccttccatccgttcggccctcagcaaaatgccactaccctggccatcgttggacgcaacgcacgtgctcgccactggtcctacaacactctccctaccacaccgaaccaacaagaggagcaagaggtagctatagcagcctagcacacaccaccacccaccaccgccaccgcgccacagagctgccgagagtgtgctgtgctttgctcatcgaccgaccgatcgatctcggcatggcggactgggggccggtgctgatcgggctggtgctcttcatcctgctctccccgggcctgctcttccagatccccggcaagggccggatcatcgagttcggcaacttccagaccagcggcctctccatcctcgtccacgccgtcatctacttcgccctcctcgccatcttcctcctcgccgtcggcgtccacatttacctcggctagctagtcgccggcgggcggccggctgagcgaggctagctgctggcgcgcggcggcccggcccggctttatttgacatcatctgggtggctggattaggtactgcgtggttcagaggcatatactactatatacatttacatgttcatctccatctgcttgctagctgtatgttgatttatttagctactactttatcaacgacatcctcgagtccagatacagtatatccaattaatcccttatgagcatgcttctgatgtccattaataatacatatgtcgtgtttttaaaaaaaaaaaaaaaaaaaaaaaaagccgcccttcgggcctccgccggccgtccc

SEQ ID NO: 18240 - DNA, 2453 bp, Zea mays
  misc_feature (1217)..(1217): n is a, c, g, or t
  misc_feature (1827)..(1827): n is a, c, g, or t
gctggaagtgtttaggagttgtgcgcgtgagtgtgtggtagcgctatttatcactaccgtgataaaccaaaaatccatcatctcgaccctactgaacacattcgatttagttagtcactatgtctgcgtcagagagagacgtgacaagtgtcacatacatctatcttgcttccctgatgatggaattttaacggtgaacgaaaggtccaagtaagctagtaacggttaggaattgtttcgacccattaattcggcaccaacgaacaagaccttaattctcttgtcatcaaattagtcctaaagaaaataaaccacgcggctttaatcgacaggggcaagcgagaagccacccacaccagcattacccacgcagcatggacagacaacatgagtcagatgaacccaaccttccatccgttcggccctcagcaaaatgccactacgctatatatcgcgggacgcaacgcacgttctcgccactggtcctacaacactctccctaccacaccgaaccaacaagaggagcaagaggtagctatagcagcctagcacacaccaccacccaccaccaccgcgccacagagctgccgagagtgtgctgtgcttcgctcatcgaccgaccgatcgatctcggcatggcggactgggggccggtgctgatcgggctggtgctcttcatcctgctctccccgggcctgctcttccagatccccggcaagggccggatcatcgagttcggcaacttccagaccagcggcctctccatcctcatccacgccgtcatctacttcgccctcctcgccatcttcctcctcgccgtcggcgtccacatttacctcggctagctagtcgcccgtcgtcgccgccgggctgagcgaggctagctgctggcgcgcggcggcccggcccggcctggctttatttgacatcaatctgggtggctggattaggtactgcgtggtgcggaggcatatactactatatacatttacatgttcatctccatctgcttgctagctgtatgttgatttatttagctactactttatcaacgacatcctcgagtccagatacagtatatccaattaatcccttatgagcatgcttctgatagatggccattaataatacatatgtcatgtttttttaaaaaaaaaaaaaaaaaaaaggggacccccttttgccaggcccgctaataatcgtattcaattaatttngtcagcttttcaaaggttggttcaatttgttgttgttttttcctttctttttccaaaggccgcttctattttcaaagtcgcatcaccctcagcaactattccctcggttttaaattacaaggcattctaattttcttaaagagccaaagcatatcttaggtttgatcgaagttgctgagagatcgaattgcagggatttacaacatcaaataggcggtgaacgtaggatgaaaatataattggtaaaggacctaatgatacttaattggtactataaatgttacacttttattatataaatttaatctaatttgagatgttttcattctctgactaaatcggaatgacttgcaatttaaaagtgagggagtacctcgcttcatcgtcgtcttttgcactgtgtatggtattctacagaagttgacgtttcaccgaaactttgctggagagtcaactaaaatggaacggctccattctagtttttttataatagagttgttctattccgtgtttagcaaacagaatagagcctctccattttttatttagttgccacttcgttatctatttggttgaatagctatatgaatgtgtagaagataggagaggnaggagagctctcgcatccgagagagcgcttgtatccattcgttttttagagttggagcattctaattatttatggtaaattattatataaagattttaggagctgttccgctcctcttttattttaaattaaatatctaaaaaatagaaatggagtcactccccaaccaaacacacttattcgatttgcatttgtattgacgcccctaccagccataaatgacgactcaatcgctatgtttctactgcaaaccgtcctgaaaggctgaaacgcaattccgtctatttggaactcgtaacaagcatatccatgggtcaaatcatcctgaaaggtgaaactttttttttttgctagcttctgtactaagaaagctgaaataaacagctcgctgttgagcagtgtaggcatttgaaaagttcgaaaagctgctttctgagaaaaatgaactgagagctaagaaagcaggtccaagtgactccaagaccaagtatatgcttaggcatttgaaaagttcgaaaagctgctttttgagaaaatgaactaagagctaagaaagcaggtggaagtgactccaagtatgctaagaaggtagggaatattacaaaagacaacagcaaagagttaac

SEQ ID NO: 18241 - DNA, 782 bp, Zea mays
aaaaatgttcctacgctatatagtcccgtcgcgcctcgagccggcgcgccactggtcctacaacactctccctaccacaccgaaccaacaagaggagcaagaggtagctatagcagcctagcacacaccaccacccaccaccgccaccgcgccacagagctgccgagagtgtgctgtgctttgctcatcgaccgaccgatcgatctcggcatggcggactgggggccggtgctgatcgggctggtgctcttcatcctgctctccccgggcctgctcttccagatccccggcaagggccggatcatcgagttcggcaacttccagaccagcggcctctccatcctcatccacgccgtcatctacttcgccctcctcgccatcttcctcctcgccgtcggcgtccacatttacctcggctagctcgtcgccggcgggctgagcgaggctagctgctggcgcgcggcggcccggcccggcctggctttatttgacatcaatctgggtggctggattaggtactgcgtggtgcggaggcatatactactatatacatttacatgttcatctcgatctgcttgctagctgtatgttgatttatttagctactactttatcaacgacatcctcgagtccagatacagtatatccaattaatcccttatgagcatgcttctgatagatggccattaataatacatatgtcatgtttttttattaccaaaataacaagttctgggaaacactacccccagacccgcccaaaaaaaaaaaaaaaagcggcc

SEQ ID NO: 18242 - DNA, 772 bp, Zea mays
actcctcctggcgacgggttccatcgtcgacggcggccgccagccatcagatcaaacaataacaatccccaaacgcctcccagccatcagatcagatcaaacaatccgcctccgcctccgcctccctagggttttgctctcggctcgtcggatccagttcgggggatcctccatggcgtcgcgtccgtcgctgaagtcgaagcccaagggcaagggcgggaagaaggccaccgctgacgacgaggacgccaccgcggcggcgaccacggtgaggctcatgaaggagtggaccacgtggacgatgaagaaggcgaaggtggtggcgcactacggcttcatccccctcgtcatcgtcatcggcatgaactccgagcccaagccctccgtcttccagctcctctcccccgtctgatcggatcatgacagggcccggatgaggtcggtccgtagtagtttgtagctggtacttcatttgcttacatatgtccgagatcgagttgaagaaggtggatcatgctttctgggcgaatttgaaggatttggtttaataattttgtagtggcggatgtcttctatacatcggatcaaaaatgtcttggttatgtgatctgcagtgcttatgattgtatgaactatatccgttttcgtctgcgtgtactgattttgttgcgcgtctttaaaaaaaaaaaaaaaaaaaagccaagcggccgccgccgtggcttaagggcattgggttttgctaaagcaaaaaaaaaaaaaaaaacccgcggcc

SEQ ID NO: 18243 - DNA, 1298 bp, Zea mays
cccacgcccgtccgaaaaaacctaatagaaaaaataaaaagaatccattgactcgcagcttcccctgctcctgctctcaccatttccacctataaagtcggccgcagcctcctgcgcgacaaacacctcccaacccaatctcctcagtcctcactcctcagagagagccccaagccaagatccgcgcggagcaagtcaccaggcgaagcaccggctcccatggccgtggacctgatgggctgctacgccccgcgccgcgccaacgaccagctcgccatccaggaggcggcggcggccgggctccgcaacctggagctgctggtgacgtccctgtccacgcaggccgccgcgccgcacagggccgctgatcagccgttcggcgagatcgccggccaggccgtctccaagttccgcaaggtcatctccatcctcgaccgcacggggcacgcccgcttccgccgcgggcccgtcgagccgccgccgccgacgccgacgccgccgacgcctcctgtcgtccccggtcctgcccccctggcgcccgtcagcgtggcgcagccgccgcagagcctgacgctggacttcacgaagccgaacctggccgtgtcggccgccacgtccgtcacctccacgtccttcttctcgtcggtcacggccggcgagggcagcgtctccaagggccggagcctcatgtcctccgggaagccgccgctgtctggccacaagcggaagccctgcgccggcgcccactccgaggccaccaccaacggcagccggtgccactgctccaagagaaggaagaaccgcgtgaagaggagcatcagagtgccggcgatcagctcgaaggtcgccgacatcccgccggacgagtactcgtggaggaagtacggccagaagcctatcaagggctccccttacccacgtggctactacaagtgcagcactgtgcggggatgcccggcgaggaagcacgtggagcgggccaccgacgacccggccatgctggtggtgacgtacgagggcgagcaccgccacacgccgggcgcggtccaggggccgagccccctggcgaccgcgtcgccggtgcccgtcgccgtctccgccggcaacgggctcgttgtctagtctactaaaagctaggattagcttctcgtcttctttgttttttttttgtttgagctgatgtccgtgtaaaacaaggaagaaggttgtagaaagagggagaggaggacaccggaatttcgatgccgcaaaactcaaacctttgtgtcgtgtcctaaaaaaaaaaaaaaaaaaaaaaa

SEQ ID NO: 18244 - DNA, 1167 bp, Zea mays
gcacgagaccattacctagaacatcctaatcgaaaaaagcaccaaacacctcccaacccaatctcctcactcctcagagagagccccaagccaagatctgcgcgggcaagtcaccaggcgaagcaccggctcccatggccgtggacctgatgggctgctacgccccgcgccgcgccaacgaccagctcgccatccaggaggcggcggcggccgggctccgcaacctggagctgctggtgacgtccctgtccacgcaggccgccgcgccgcacagggccgctgatcagccgttcggcgagatcgccggccgggccgtctccaagttccgcaaggtcatctccatcctcgaccgcacggggcacgcccgcttccgccgcgggcccgtcgagccgtcgccgccgccggcgcctcctgtcgtccccggtccgcccgtcagcgtggcgcagccgccgcagagcctgacgctggatttcacgaagccgaacctggccgtgtcggccgccacgtccgtcacctccacgtccttcttctcgtcggtcacggccggcgagggcagcgtctccaagggccggagcctcatgtcctccgggaagccgccgctgtctggccacaagcggaagccctgcgccggcgcccactccgaggccaccaccaacggcagccgttgccactgctccaagagaaggaagaaccgcgtgaagaggagcatcagagtgccggcgatcagctcgaaggtcgccgacatcccgccggacgagtactcgtggaggaagtacggccagaagcctatcaagggctccccttacccacggggctactacaagtgcagcactgtgcggggatgcccggcgaggaagcacgtggagcgggccaccgacgacccggccatgctggtggtgacgtacgagggcgagcaccgccacacgccgggcgcggtccaggggccgagccccctggcgaccgcgtcgccggtgcccgtcgccgtctccgccggcaacgggctcgttgtctagtctactaaaagctaggattagcttctcgtcttctttgttttttttttttgtttgagctgatgtccgtgtaaaacaaggaagaaggttgtagaaagagggagaggaggacaccggaatttcgatgccgcaaaactcaaacctttgtgtcgtgtct

SEQ ID NO: 18245 - DNA, 994 bp, Zea mays
gaggccgacccaattctcctcaatcaaagaaagtccccacgcagagcaagccaagatctgcgccgcggcgaggcgaggcgaagcaaagcaccggctggctcccatggccgtggacctgatggggtgctacgccccgcgccgcgccaacgaccagctcgccatccaggaggcggcggcggcggggctccgcagcctggagctcctcgtgtcgtcgctgtccacgcaggccgccgcgccgcacagggccgcggctcaccagctgcagaagccgccttcgcagccgccgatcggcgagatcgccgaccaggccgtctccaggttccgcaaggtcatctccatcctggaccgcaccggccacgcccgcttccgccgcgggcccgtcgtcgagccgccaccggtgcctgctccggccgtcgccgctcccgctccggcccccgctctccacgtggtggctcccgtcgccgtggcgcagccccagagcctgaccctggacttcaccaagccgaacctggccgtgtcgggcggcgccacgtccgtcacctccacgtccttcttctcctcggtcacggccggcgagggcagcgtgtccaagggccgcagcctggtgtcctccggcaagccgccgctgtccggccacaagcggaagccctgcgccggcgcgcactccgaggccaccaccaacggcagccgctgccactgctccaagagaaggaaaaaccgcgtgaagaggaccatcagagtgccggcgatcagcgccaagatcgcggacatcccgccggacgagtactcgtggaggaagtacggccagaagcccatcaagggctccccctacccacggggctactacaagtgcagcaccgtgcggcgggtgcccggcgaggaagcacgtggagcgcgccaccgacgacccggccatgctggtggtgacgtacgagggcgagcaccgccacacgccgggcgcgcccgcgcccgcgcccagccccctggcggccga

SEQ ID NO: 18246 - DNA, 2193 bp, Zea mays
cgccactatagagcctctgtgtactagtgcatattagcagtttatatatatttagtaccactttttattggttgcttctcttaagacgtgagacaaacattaaatttgagacggaaagggtactgctggtctattcaaaagaaagtcatgctgtctcaatccctattattattgccacaatgacgacatgcatgcatgttcttgtcaatcatctcctttattttgtgtcaatatgaaaaggaattgtatggatcgcgtgggaatggtcactttgtatatttgtaatagaaggtttgttttcttggagtaactggtaggtgctattttgggcgtctttgtacatataggctcctcttgcgactaaaaaaatagtggttttacttggctatgcaagttgcaaggagagagggaaaaattgaatagtgcactatcagatggatctgaaaccgtttagagctctaaaaaacctttattgacatgtggactaatggagctaccgacgaagagctagtgataagcaagaagctagatcgagacgataataatatatatatgcagccatgcaggcctgccttatggtgttgcgctgcctgcgttttacagttataagtcaacctgcttctttcttcttttgttttttttttttttttttataatggatcaaatcaaccaatatattgaagaacaaaccaatcagctagctaggattatctgtgtgtacgtacaaggctacaagctagcttggtcgccacacgggccggaggggtgcgtgtcttaacaattaatcccctcagtgctcagcttgatcagctagcagccactcaatctccttctcttgttcacgccaagctgatcccgcatctgtgcatggcgccgtcgaggacctggcggaagtggccggcgtcgcagggcacccgcagcacgcccggctggccgtacccgtaccgctgcgccgccatgtcgagaagctccgcgatggatgggtcgctgagaagccgcaccggcaccagcacccgctggccaccatcgccgtcgtcgtccccgccagcgaccagcatcgggacgtggcctctcgggaccttctccgcctcctcgtagccggcgccggccccgcgtgcgggcgacccgctggcgctgccgttcttcctcttccacgccatggccagatgttccgtttattatttgcccgaccccgctcgagagagagagagagagagagagagagagagagagatctaggtagctctcgatcggcgctggagttcttagctagctagctagggcgactgggcgagtggtgatgattggatcgcgtcttgttctttgggcgcgcggtcgttagctgcgggaaaaagggcgagggctggctggatttatagggttggaatggatgatggatggaatggaacgagcgcgcggcttcgcggcgggcgggagctgttatggcagttgccgaatcttttgaccgagttgggtccaaattgttgacctggacggactgttatggagtctatcatggttaattcctctagtttttttttttgctccgatggtcctctcgaaaagtttgcatagatcttaaacaagctattaactttactgttcaattgacacgtgctacttgtttgcggatcgagggaggcgacggtggatccgcgcgcccgcgaggtggtgactggtgacaccagggcaccaggcgcatgcggcgagcagctccagctgatgtgaggcggcgcaggcactaggtaagtgttctccagaaatgcagatgcatgctctcttttttttgagagaggcagatgcattcttattgaacacacaaataactgatcaataagctatctgtcaaatagcagcagtatattccaaggtcctcgatcttttctacggcaaccaaatcaacactctagttcagccgcagtagacttgtttttttttttggttgccaaattccagaattaatttagcaaaaaaagtatgcatgcatggcgagagggagaagtcattggcggcgagcaacacgtactggttcgtctccgtgggagttgcccgtgaacgcacatgcagccgtccgcgcctgggcctgggaccgcacgagatcgaggtcaccctagcggcactgtagcgctctgtggtacagtcactgttatcgtcgtcgagttatcattgttttaatacagttgttatatatca

SEQ ID NO: 18247 - DNA, 3044 bp, Zea mays
  misc_feature (704)..(704): n is a, c, g, or t
ggtggaggtctgaggagtcaatctcttgttgggaattttccattcatatctctaatattattagattgatatgagcagagaagcgtgatataggcatatccaccaaaggataatgtcacatttttatctgtacgcgtacatgtcgcatctgtcataattaactgtcgtatactcattatcgaaatctggctctttgttgagacttatgtttgtgaaacttgtttgatgtggtgatatttgtgagatttctggtctttgtgagatatgtgtatgatgtatgtgatgattctatgatatatgtgatgtatatgtgatgattttgttatatatcttttgtttggatggaacgacaaaaacaaataaaaagggtaatctggtcactttgctaagtgttacactcggtagagaggttctttgttgagtgctatgaccataacactcggcaaagaaggtacgcctaggaaccggtaaagcttttttgtcgagtgttgtggccccggtacttgacaaaggaaccggctaaggagcccactggagtcttatttgctgagcgctagtccaacagccactcggcaaaggctctgtcactatcacttgacgccgtgacgacgacttttatttgctgagtgtcaggtgacactagcaaagactttgacaagtatcagataaaaagtattcgactaaaaaactgttgccgatgtacnatacaccgggaccttgttgccgagaatcacattcgacaaaaagtttattaagtgttctctaaactttgccaaatgtctaaagtactcagcaaagtaattgtctccgatagtgccgggattacacggactatgcatgtttggtagccaccaaccttgtcacgccacaccttagacgccctaacgttttttaagcgattgattctatggcacgtgatgtcagcaaagcttacacacaattttttttttttttttgtatgaagatgcacaagtgtacaacagtaactaattcatgctccatgtctccatcaaacttgaaactttgaaacagccagtgcaagtggatttgtatcaaacagatttgtcaggcttaattatgcagatgagtatgtgttactcaaataattaagtctctattggcaccgccgcgccgtgagggacatgatgtggttcaccagcttgtcgacgttgaggtcggacgagccggccttggccacgcactccgccgctcttctacagagctcccgtgccctcccacgcagcgccgtggcgggctcgcctgcccccatcatcgtcgagatggccgcctccaccttgcccctctccagctcgccgtggagcgcgaggccggtccgccacacgtggtccacgtacctggcgttccccatctggtcgccgaagcaggggcggcacagcatcggcacgccggcgcacacgccctccagcgtggagttccagccgcagtgcgtccagaacgcgcccacggcagggtgcgccaggacctcctcctgcggcgcccagctcaccaccgtgccgcgaccgcgcgtctcggcgtggaagccgtcgggcagcggcggcggctgactcggcggcgcgccgcggacgaggcccggccggagcacccacaggaaagggcggccgctgttggcgatgccccatgccgtctccaccaggtccgccgcggacatgctggccaggctgccgaagctgacgtagagcacggacgcggggccccgcgcgtccagccagtccaggcaccctcggtcctgccgcagcaggctgctcgaggccgccggcgagtgcacgtgcagcggcccgatgtcgaacaccgggacggcgaggccgcgccggagcgacgccagctcgtccgtctccagcgcgtcgaacgtgttgatgatgagacccgacgaggcgttcacggccgtcaccgctcgcgaaatcaggtcccgcattagcccgagggtggccccgctggcggacggcatgtcacggacgcggtacggcggcagctccgtcaccagcatgtccggctcctgcgactctgccgcgggccgcgtgcccttgtcgcgcagcctggctctcgccatgaaccagcggaagcacgcggcgctgccggtgcggagcgcgagagtcggcacgccgagcccgcgtgccacgtccatgagcgtgacccggtgcgcgtcggcgacgaggcacgcgacctcctcctcctcctcctccagcagcgcggccaggcgctcccggaacggggcctcgcacgcgcggttcacggcgaggacgtgctccacggtcacccgcaccgtgtccgcgctgtccgccggcgtcccgtcgaactggacggggacgaagtcgtaggccgggtgctgggacgcgtccggcgcgttgaagtgggtgtggaagacggtgacggcgaagccgcgcgcgtggagcaggccggcgagctggaacatggggttgatgtggccctggtacgggagcgagatgaagagcacgcgccgccggtggccggtggcggtttggcctacggagcccattcggtggttcttggagtcctcctgagtcctgaccctgtctttgtgaacctgccacctgacctgaagccatttgatggttcttggatttatcttgcccccacactgattgcccatttgactgatgttagccaaatcgtcggcacgcgcggccaaatcctgcgacaattaacaaacgcgccctatgactggacccttacatagaaatgatgacacacgttggattagcttttttttagttaagaaactacagaattgggctcgatttctcactagctccaataccaagtgacacacgggatgagccggcatttgtggatctagtggatggacgagagactgagagcaaggtggccggatcatttgcgtcccgtcgtctgctggctagattgtggtctgcgtccggttttcccagctctccgtacatcgttgttttcgctcccagcaaaagcgtgaagtatggttgggggtactgtaaatggccggtgttgcagccacggaagcgctagtccatgctcattcaaaacagggg

SEQ ID NO: 18248 - DNA, 3360 bp, Zea mays
tgacagatagagccttttactattgagtggggttacaacagaaccgcggctgcttacaaacttctcggcagcactccggcagagtaacgatacgctcaagaccttgctctagctcttagcagcactactcctctctctaaaggcttatagctgtgccttctacacaaactagggagttacacacaagagggagagcgagaattgattccagtgaagtctacacttgttggctacacttctgctctcttggaggcgcctaggagtcccttttatagacccaaggggcctaggagccgttggacttcatttggaaggcaatatcagctttctgtcgggtggtgcaccggacagtccggtgcacaccggacactgtccggtgcccgatttctttccttctgtgtcgaagccgaccgttggcagtcttggagccgttggcgcaccggacatgtccggtgcacaccggacagtccggtgcctccatctagccgttggctcggccacgtgtcccgcgcagattgcgcggccgaccgttggcccggccgaccgttggctcaccggacagtccggtgcacaccggacagtccggtgaattttagccgtacgccgtcagccaattcccgagagcggccagttcgcccgagttcagcctggcgcaccggacactgtccggtgcaccaccggacactgtccggtgcaccaccggacagtccggtgtgccagactgagctgccttggctgtacatagccaagccctttgcacctctcttcttttcttcttctttctgtttctaacacttagacaagtatattagtccacaaaaccaatgtactaagtatagaaacataccttctcttaatcattaaatctatagcattccacatgcttgagctttgatgttggactcataaatcatcaagtcggcttgtcttgatctagattgacattacttggctccaacatcctgtaaaggtcacatagaacatctccaaacataggaacaacccaaactaaagatcaaggtgaacttagctcttttgggctgcttccagttctggttttgacacttgttctccttctagtgaccttgatctccttcttagagcttggtcttgagccttatgacttacaccacataactgtagctgttacctcattggctgtaagtcacgtccttatgtagtgatccttgatgtgccgtagctgttctcaactcgatcacccttgactttgcaagccttcttcttcacccttggctttgggttcctcagcctccttgaccttctcccgtgcacttggtacctcgaagctcttcttgcctccgtccttggcttgatcagttgtctccgagctacgcacccgagtctcacttttgcaatgtccatcttacttgtgatgtccattatgtatccataatccagttcttggaccatcacatttgttcacttgtgttgaaccttgtaggctttaccttaagcacctgttcaacacttagtacacttgttagtcctttaattgagttgtcatccaaacaccaaaactcacaagagagctttcaatctccccctttttggcgattgatggcaacacaattaaagcttacataagaataagatttgaagcacaaattttaattctaagattatagaatgctccccctaaataagtgcttacttcaaaaacataattttggcctcagacgccaatttgcacatacttagccaaatcgaaacatttctacaccttagcactttttagtatgcattgtggcaagaatcaaaccatgatgctataacacacaaatgcacataatcagagttaaacaccattcagaatagtagatatatcacaggaatatcaacctaccagtattcatcattaagataccaattcaaactaataccaatttaaactaagacactaatttaagacaatcttaaagcaccattaaccacatgactatctattgcactatagaagccaaataattcatcgcagcggaaacactagtccatatgaacaacattgcaagaaacatatgaatatcacacttggcaaagctaacacatcacccattaggataagctttcctctcaggttgagataagctttaatacacaaattctccccctttgacatcaaacaccaatcaccatactcaagcaagaacatatgatgatgtcaagggacagcagggtgttaaggaggaaaacgactatcaaaactcccccttacttattgagcatatgcccgatcaacatttaggcgcgatacatatatgcaaaaagattaatactccctttgtacctttaccatgttgtagtgtacttcccatcttgaaagtatctaatctctcaagagcttcttcacacttgtgcctgattctttatccttactttttcttgttgctcagacaccaaacttagaacaagttatagtattgggcacaagaagaaacttctattctcatgattatcaagagatgtcaattgaagcgaactatcacgactaccaattgaaagataccaattgcaagagttcatttattatcatggctccatgatttttaagaataagcatctattatcaccagatattatagagcaagagtaatctaaaaatatgcacttactcacgacttgagataccaatttcttgacttacagaggtacccaagtcctgattgctccatttcttgcttatcttctcttttccacctagagactatacaagattgctcaagaaacagttagtctcaaaagacacaagttatgtgtgctccccctcaagttgtgcatcaagtatttgaatgacttgcactttgcacattctagcttccttagaactagaggggatcacaacataccttggtcaaggcatactctatcactttcatcacacagagatgccagtttgaatatcaaatgaaaggccacttaacacctattgaaggctaaatgaaaggttgactaaatacaacaatgcatgcctcagtggcacctaagccaattgaatactcacaggaagtataacatttacacgcaacttagacatgctttatacttaactatcattgcatcacatatactaattgaaaaacaacatgatcatgtctaagcacatcatagttaagaaagttctttaggtacaccaaaagaaacaacattttaaggcataagtctcctaagccacgatactaccaatgaaatgcaagaacatagctatgatcacaatggaatttcaagaatatttaatgaaatttcatagctccattttccatacctttgcctttatgagagcacttgttatcaccaattcaggactccttttgctcacacacctcaagctcaaaaaggcacgac

SEQ ID NO: 18249 - DNA, 5584 bp, Zea mays
  misc_feature (98)..(98): n is a, c, g, or t
  misc_feature (115)..(115): n is a, c, g, or t
  misc_feature (222)..(222): n is a, c, g, or t
  misc_feature (247)..(247): n is a, c, g, or t
  misc_feature (481)..(481): n is a, c, g, or t
  misc_feature (884)..(884): n is a, c, g, or t
  misc_feature (963)..(963): n is a, c, g, or t
  misc_feature (974)..(974): n is a, c, g, or t
  misc_feature (1020)..(1020): n is a, c, g, or t
  misc_feature (1022)..(1023): n is a, c, g, or t
  misc_feature (1350)..(1350): n is a, c, g, or t
  misc_feature (1383)..(1383): n is a, c, g, or t
  misc_feature (1386)..(1386): n is a, c, g, or t
  misc_feature (1424)..(1424): n is a, c, g, or t
  misc_feature (1696)..(1696): n is a, c, g, or t
  misc_feature (3551)..(3551): n is a, c, g, or t
catgattatttctttgctcaaataaaatagattcataccgttggaccaaattatcatgagagcactttagctcctcatgttctttggtcatcttctcnaggctgtcgttggtttngatgagagtctcctctagcctgagaagcgtctcgcctgttcctgttcctactcaacaacttaaccaagagcactttgtcttctttgttgagattggtgtagaaccgncgaatctcctcttcttccacatcancggtctcattttccctgtcattattattagtggaagcaatacaggaaaatgtaccttgtggtgatgaagactcatcctcgctatcatcctcatattcctcctcatcatcgctttcgtctccactatcattgttagcaataagacatttataactagtggaagacaaacctgtcggtgaggtggattcatcgtttggttgccatcgtttttcttctccctttgaaaggttagtancacaagcaacatagggagtagaagtagtacaattggccacaaaatatttttctttaatcctattccataaatcatgagcatcaacaaataaatcattatcactactcatgatggcaaaataagcacctctagaaagagattcaactaagatgttgcaagcacggtgattgagagataaacatcttagttcatcattagagggatttttactaatatcagatggaaaaatacttctactaaagatctgtctcaaatcagaatcaacactcatgaaagcattataaatagagacagaccaagatttgtaattagagccatcgcctaaaagaatttctacagttacctcttgtgacgacatcgttatctccggacggctaagcccacactggagaggcctagctcngataccaattgaaagttccctttgcccgggaacaggatctggatgtcgcctagaggggggtgaataggcgaataaaaantatcactttanaacttaaattcttactctactcgaaggctggatcgcagtggaatgnannacccttcgagtaggttgcagcggaatagaagatcctgtcttaaaatgccctgcacttcaaatataacttgtaccacaaataagtattgaagtgcagatataaatagtaagtaagacagagagtcagcacacaatacagagcgaagcacacagacgcaggaatttatcccgaggttcggccaagcctgaaatgcttgcctagtcctcgttggagttagccacacctgggcttggagtctatttcaactccttcctccgtttgctcagatctgtcagtatgacagatagagccttccactatgttgagttgggttacaacaaagccgcngctgcttacaatcttcttgacagcactccggcngantaacaatgcgctcaagactttgctctagctctttgcancacctctccactctctaaaggcttataactttgccttcacacaaactagagagatttacacaagagggagagagagaatcgatccgagtgatgtatacaattgttggctgcacttgtgttgttgtttgaggcgcctaggggtcccttttatagccccaaatggcctaggagccgttagagcttcatttggaagctcccagccttccctggttgcgggtgcaccggactgtccggtggcgcaccggacagtgaacagtaacagatctgattgncagtttccttctctggaacagctagccgttggtgcaccggacaggttactattcactgtcctgtgcaccggacaagtcactattcactgtcctgtgccccggacgcagctactattcattgtcctgtgcaccggacacggttactattcactgtcctgtgcaccggacaggttactattcactgtcctgtgcaccggacaggttactattcactgtcctgtgcaccggacagctactattcactgtcctgtgcaccagccaacagcacactaagtgatttttcctccgttctttctccgtttgacttcaacttttgggaggattttcctgagacttaaacaaacacatttagagtataatccaattgatttagtcctagaaacttacatctttcttgttcttctcctagcttttctgtttctcctccagcagagctcagaatggcactttctctacagaaagagttagagagcaaaccaaagcaccaaacttgtagtaagaggtgtatgcaacatggttgaacactcaaaccttacatacttaacctttttcatcgttttacccaatttggcatgtttgaggtcgatgttggactctaaaccattaagtcaacttgacttgatctagattgacatatctgagctccaactcccgttcacttctcgagcttgatcttgagccttatgacttacaccacataactgtagatgttacctcattggttgtaagtcatgtccttatgtagtgatccttgatgcaccataactcttcttaactcgatcaaccttgactttgcaagtcttcttcttcacccctggctttgggttcctggtctccttgaccttctcccgtgcactcggtacctcgaagctcttcttgcctccatccttggcttgatcggttgtctctgagttacgcacaccgagtctcacttaagcaatgtccatcttacttgtgatgtccattatctatagataatctagtctttggaccatcacacttgttcacttgtgttgaaccctgttagctttgcattaagcacctgttcaacacttagcacacttgttagtcctttaattgggttgtcatccaaaccaccaaaacccacaagagagctttcagttatcataaagtctaggttatataactagtattgctgctcaatttatgtgcctacttaatactgaacaagggcacatgttgactagcacctagtttaaagaaaaagtccacattctcgcgggtggtccgaagctgattaaccgcctagcatggtctcgtaccataagtctaccccttccaccgccccagaatagctgacctagtactttccggaccaggtacctaaaaggcctacgtctcgttccgagaaagggtcaaaatgcaaaaaaatcggtcgttcccaaccagttctttctccggctgtgtgttgtgtgcgtttgtacaagtgagggtgctcatgttataagcctttacgttatattttgtaattaaaaaactaacaattttagattccactagcaaacacgtgacagtagaaaagagaggcgctcacacctccatgtcgacctcagatgttgaagcgagcaaaaattatcggagacagcgctgacaagacaaattctacggagtacaaaactagtgctataagcatcgtacttccacattccaactcttcgtcccaattagacgtcgttattatattattcatgacgttcaaatttttaaatctaaataaacattaacaacgtttatatctatagattaatttaataatattaattatatactgtaatgattaatatttatatgtatatatatttgatcagatttagaagtgtgaacgacgacaccnccttccaggactgacggagtatcgtcaacaatcgagcatgcggcagacgtgcacgcttcgtccggttccatggcatcttgcgcatgtcgccttcaccaatcgacttcaggagttattatcggcgccctgcatgcattcaaaccaacggagtacacgagaccttcgttttctcggtgtaaacatgcttcgagtcctaagaaaggattagttcattgactagtagtatataaatctcgggaggcactttgttgcacttgcacgtgctccgttccgtgatgactgccagtttataaaagttatgagacgctcattagctaaactaattaaagttcgttcaaacatgaaacacgtttgctcagaagagtagaaaaatctgttgcttattcgcatcgaacgaaactgcacgcgtcacggatgacgcacgcaacacgtcatgccctcttggccttaactgttccttacttttgattgacagtgcacccccacagtccgagcatttcgagcttttacaggtccaaaagcgtcggtgtcgcagctacccacttcattctcacagaaactatttactttaatattatttcaagttttttttttaaaaaagagtgttacctctgctttttttaagaaagaatccgatgaggatacctaccagctacaaaacagttcagaccatcagccagaaaacaactaatcaacattcatagctcaaatacatcagtaagcgcaacaaaaggtggcgtaagattgtttggctgtatcaagcagatccttcatatggtcacacaaaacattgttttgcactgtatagcgcattatttatagagtgaattttgaaatataagatgaggtaagaggataggtaaactgctatagacgatcttagagatggcaatgggtagtattgctatctcatatctgtatcagcgacaaaaaaaaacaacaccgccaggtcacctatacccatgggttgatggatatgcgtgatatatggcagaacatttcaatactcatagagacccattgtgtgaatgtttttgtctaataaaagactcgtgagtatgatatttagtccatatacatcgtctaatgaaataagtacttatcgagtgtcgagtcataagtacccattgccatctctatatggcatgaaagtctacatcaagcccatgaagaatccttcacttgcataaagtgctacatgtatgtatcattaagcaagacaccccccattttgcatcaaggagaacgtaacatagatgacattatttggtgttttggaaaattgtttctggatcgccatcttgctccgatagtcgtccataagatccatgtgaagcctacaaaaataaaggtaagcaatctggctagcaaaggccccttgccttgaagccaagaactattgacctaatcaatgaagtcagacacatgtttaagtgtttaactgaaaacttcctccaatgatgcaccaaataaacttggaaggatgacatagttgaacaaaatatggtccatagtatttgggaaatcacatacacaatactttcgagaccctttacgtctctttcaataaaactttggccaacctgatgtaatttattattgaaaatttgaaacaaaaaattaatgttctgaagaactttgcttttctaatatagctagtaagctctatcagtgataaacctgtagagactttattggctacccctctatcagggatttggttgaaaacactctagatttatccaaaacccaaatagactaatgtgcgttgtttgtgtgtatgggtctagtgtctagtccatgtggcctgctagtaggttataaccctagactggttagcatatatattgttgcattctctaatccatttcacactcctctaacatggtatcagatagctaatcctaacctagctagcggcgaccttcctaggcgccgccaccgattgaccacctcctaagcgttgtcgatggcgacaaccatctaatagttgcaccaccctctggggatgctttccctcctcataccccatc

SEQ ID NO: 18250 - DNA, 2180 bp, Zea mays
gccgtacgtcgccggtgaattcccgagagcggccagttcactcgagccagcctggcgcaccggacactgtccgatgcaccaccggacactgtccggtgcaccaccggacagtccggtgtgccaagcctgagctgagtgacttggctgtacacagccaagccctttgcacctctttccttttcttcttctttctgtttctaacacttagacaagtatattagtccacaaaaccaatgtactaagtctagaaacataccttctcttaattattacatctatagcatttcacatgcttgagctttgatgttggactcataaatcatcaagtcggcttgacttgatctagattgacattacttagctccaacatcctgcaaaggtcacatagaacatctccaaacataggaacaacccaaactaaagatcaaggtgaacttagctcttttgggctgcttccagttctggttttgacacttgttctccttctagtgaccttgatctccttcttagagcttggtcttgagccttatgacttacaccacataactgtagctgttacctcattggctgtaagtcacgtccttatgtagtgatccttgatgtgccgtagctgttctcaactcgatcacccttgactttgcaagccttcttcttcacccttggctttgggttcctcagcctccttgaccttctcccgtgcacttggtacctcgaagctcttcttgcctccgtccttggcttgatcagttgtctccgagctacgcacccgagtctcacttttgcaatgtccatcttacttgtgatgtccattatgtatccataatccagttcttggaccatcacatttgttcacttgtgttgaaccctgtaggctttaccttaagcacctgttcaacacttagtacacttgttagtcctttaattgagttgtcatccaaacaccaaaactcacaagagagctttcaatctccccctttttggtgattgatggcaacacaattaaagcttacataagaataagatttgaagcacaaattttgaattctaagtttatagaatgctccccctaaatatgtgcttacttcaaaaacataattttggcctcagacgccaatttgcacatacttaggcaattcgaaacatttctacaccttagcactttttaggatgcattgtgtcaagaatcaaaccatgatgctataacacacaaatgcacataatcagagttaaacaccattcaaattagtggatatatcacaggaatatcaacctaccactattcaccattaagataccaattcaaactaagataccaatttaaaccaagacactaatttaagacaatcttaaagcaccattaaccacatgactatctattacactatagaagccaaataattcatcgcagcggaaacactagtccatatgagcaacattgcaagaaacatgaatatcacacttggcaaagctcaaactaacacatcacccccttaggataagctttcctctcaggttgagataagctttaatgcacaaattctccccctttgacatcaaacaccaaaaaccatactcaagcaagaacataggatgatgtcaagggacagcagggtgttaaggaggaaaaacgactatcaagaactcccccttacttattgaacatatgccctatcaacatttaggtaagatacatatatgcaaaaagattaatactccctttgtacctttaccatgttgtagtgtacttcccatcttgaaagcatctaatctctcaagagcttcttcacacttgtgcctgattctttatcctaactttttcttgttgctaagacaccaaacttagaacaagttatagtattgggcacaagaagaaacttctattctaatgattattaaaaggtgtcaattgaagcagactatcacggctaccaattgagagatgccaattgcaaagttcatttattgtcatagctctatgatatttaagaataggcatctattatcaccagatattatagagcatgagcaatctaaagaaatgcacttactcacaacttgagataccaatttcttgacttacagaggtacccaagtccagattgctccatttcttgcttatcttctcttttccacctagagactatacaagatcgctcaagaccagttagtctcaaaggaca

SEQ ID NO: 18251 - DNA, 1468 bp, Zea mays
gtccggtgtacaccggacagtccggtgaattatagccgatcgtcgccagacttctcccgagagcggcctgttcactggagttcagcctggcgcaccggacactgtccggtgcaccaccggacactgtccggtgcaccaccggacagtccggtgtgccagactgagctaccttggctgtacatagccaagccctttgcacctctcttcttttcttcttctttctgtttctaacacttagacaagtatattagtccacaaaaccaatgtactaagtatagaaacataccttctcttaaccattaaatctatagcattccacatgcttgagctttgatgttggactcataaatcatcaagttggcttgacttgatctagattgacatttcttagctccaacatcctgcaaaggtcacatagaacatctccaaacataggaacaacccaaactaaagatcaagatgaacttagctcttttgggctgcttccagttctggttttgacacttgttctccttctagtgaccttgatctccttcttagagcttgatcttgagccttatgacttacaccacatgactgtagcttttacctcattggttgtaagtcacgtccttatgtagtgatccttgatgtgtcgtagctgttctcaactcgatcacccttgactttgcaagccttcttcttcacccttggctttgggttcctcagtctccttgaccttctcccgtgcacttggtacctcgaagctcttcttgcctcagtccttggcttgatcagttgtctccgagctactcacccgagtatcacttttgcaatgtccatcttacttgtgatgtccatcatgtatccataatccagttcttggaccatcacatttgttcacttgtgttgaaccctgtcagctttacactaagcacctgttcaacacttaacacacttgttagtcctttaattgagttgtcatccaaacaccaaaaccacaagagagctttcaatctccccctttttggtgattgatggcaacgcaattaaagcttacattagaatatgatttaaagcacaaactttgaaatctaagtttatagaattgctccccctaaatatgtgcttacttcaaaatcataattttggcctaatatgccaatttgcacatacttaggcaattcgaagcatttctacaccttagcactttttggaatgcattgtgtcaaagatcaaaccatgatgctataacacacaaatgcacgtaatcagagttaagcaccattcaatttagtggatatctcacaggaatatcaacctaccactattcaccattaagataccaatttaaactcagatactaatttaaagcaatcttaagcaccataaaccacatgcatcattatccacatgactgtctatttcagaatgaacacaatagatgccaattaattcatagcaacggaagcactagtccatatgatgc

SEQ ID NO: 18252 - DNA, 697 bp, Zea mays
cgaaacatcatcccttttttcgcagcagacgcatttattaagcgcgcctccgccctccgcgctctccccgccggaagcggcgtcgggccacctcgcactcgcgcgcgcctcaaagatgcacaggcagctcagcctctccgccagcccgaagcagcagcagccgcctcctgacggcaccagcaccggcggcggcgacgcggcggcgaaggcgatggcggcggcggaggacgagtcgtcggcctcgcactccagctccaaggccagcagggggtggtcggcgagggacgagagggccatccacctcgtcccgctgctcaccttcctctgcttcctcctgctcttcctctgctcccacgacccgtcccccgccgatatgtcgagcttcgccggaggcggcggcggcgcgagatctgggaaccggaggttaaggatgctttagtgtgcttattacctacccattggagtattatccgcgatgcggatgttgtacttgtccagcagtaaccaagtatgggaccaaagtatgtcaccatacaaaacactgttgctgtggtaatactaccaacctacatcagcgtgttcctgattaccatttgagctggattcgaaatacctcgcacgtccagcaggcagcagtgcatggcaatggcattccaaaattcagaaacaaagcgttccggcaaaaaaaaaaaaaaaa

SEQ ID NO: 18253 - DNA, 796 bp, Zea mays
gaaaaattacaaaaaaggaggaaaaaaaaaaaaaatttacccaaaacgccctgctccaccccaaaaccatcatcccttttttcgcagcaggacgcatttattaagcgcgcctccgccaaccgcactctgcccgccgaaagcgtcgtcgggccacctcgcactcgcgcgcgcctcaaagatgcacaggcagctcagcctctccgccagcccgaagcagcagcagccgcctcctgacggcaccagcaccggcggcggcgacgcggcggcgaaggcgatggcggcggcggaggacgagtcgtcggcctcgcactccagctccaaggccagcagggggtggtcggcgagggacgagagggccatccacctcgtcccgctgctcaccttcctctgcttcctcctgctcttcctctgctcccacgacccgtcccccgccgatatgtcgagcttcgctggaggcggcggcggaggaggaggagcgagatctgggaaccggaggttaaggatgctttagtgtgcgtattacctacccattggagtattattatccgcgatgcggatgttgtacttgtccagcagtaaccaagtatgggaccaaagtatgtcaccatacaaaacactcttgctgtggtaatactaccaacctacatcagcatgttcctgattaccatttgagctggattcgaaatacctggcacgtccaacaggcagcagtacatggcaatggcattccaaaattcagaaacaaagccgttccggctgatcttcaaaatcgaaaaaaaaaaaaaaaaaagcggcc

SEQ ID NO: 18254 - DNA, 1829 bp, Zea mays
  misc_feature (1783)..(1783): n is a, c, g, or t
tcatttcttaaatttaagatttagagagttgtttagagaactattgaagttgctcttagaggcccttgttgtcttgttgaagagttgaagacaccgcagttccggaaacttctgtagcagctgaaatagtacggacgtgtttgaacatgtacaggatctcgaggccacatctgtaaaacgaccacccctcacgcggaagcggagactggaaatcgggagggagaccggagacgagaccgccggagatggagccgagatctgcaatctacagatccggcgccttccttctcctcgccgccatccttgcggaggtcgtcatccctgcatccgccatcggagacaagtgcgccgcctgcaaggccgttgctgcggagctagagattggaatttcgagtgagaagccgagaaatcacttggacttgcgcaaccgcttaaattctaaaggccagagggaggggaaggtcattgattatagggtcagtgagcttcgggttgtggaacttctggatggcctatgcgataagatgcaagattataccttaaagaagttggaatcaggcgaaaagggatgggttaaagtaacagactggaatagctttcaaactgaaaataaggcagcagcaagagctcactccaaaaaattgtccaccttctgtggaaggctactggaggaaacggaggatgagctctctgagtggatcaaaacaacctccacagaatcagaatatgtaagcaaggccctttgtgaagatattagcaaacactgccgatctacaagtgctaccatccagattgatgatgagctatgacatgccgggggcaggtcgttgtttcgcaaaaagcaaaacaggcgacaggttggaaaatgttaaagaacacagctctagtagtccctgacaccatttagagagacatgcagctgccaattctgattgtttgtgttgcactcatatttcctgtaaacaaaagcttagactgatctgtagagaaagcaactggacatcaatttttgcataccgatgaactacagtttaaaacggccggttgaattatcatgtcaggggctataggaaatttgaatgcttctattctaaggtcttgttgttgagtactgagtatagtttgatgactgcatgttggtcaatgacagcatcaaagattacatgcatttttttgggaaaaaaaaaaaaaaaagccggccagaagatcgcaaaagatcatatgcatttcgatcaaagtttaggtcaattggtcaaagatcacagaagatcatatgtatttcgatagaatatcatcaccaaaggctgtgcatctttgattgaagacgcaatttgctaatacacttggactgccatgccaagctagaaattttgaataagtcgagccggtcaagcttagtaaaaaaagttaaatgatttataaattgagacgggtgaagtatataaacaattatatgtgcaatagtctatagaactcagttattatagaaaaataaaagaaataattatatacatgctactcaaattttataaaacaaattttataaaattagataggtagttcatgttaatgccatgaagtggcgtgaaaattaactagttttcaatttttttaaaaaaaattaagtggcatgttttcaactgaccacgccaattgtcacattttaggggtgtttgaatgcactaaaactaatagttagggtaatgacggttgtgtaagcagtccttctgtgtaagcaaaccatctgatccattaaattacgatccaaccacatatacaaccncggtttgttaggagtttttttataaagattattgagatggtggtgg

SEQ ID NO: 18255 - DNA, 1615 bp, Zea mays
agtcgccgttggatcgtaccgctcggagcggacgacgcagattgcgagactgtacactgtagagagagacgtcgtcggcctgagcgccgtgcaagcaagcaagcggcggcaatggcggcggctcttcaagccacgccgatcaaaaccctagccacctcccgctggcgcgtcgaaggtgcggaggcgcggccgcggccgcggccgattgcggtgagcttccgttgctccgcggcggcgaggagctacaacatcacgctcttacctggggacggcatcggcccggaggtggtcgccgtcgccaaggacgtgctatccttcgccggagccctcgaaggcgtcgagctccggtttcaggagaagctggtgggcggctcggcgctggacgccaccggcgtgccactccctgacgagacgctcgacgaggccaagggttccgacgctgttctcctcggcgccattggaggctataagtgggataccaatgagaagcacctcaagcctgagaccgggctgctgcagctacgtgccggactcggggtctttgccaatctgcgaccagctgcagttttgccgcagttggtagacgcatccactctgaagaaagaggtagctgaaggtgttgacatcatggttgtcagggagcttactggaggcatctactttggcaaacccaggggttttggaacaaatgacaagggagacgatattggcttcaacacagaagtttattcagcttctgagatcgatcgtattgcacgagttgcatttgaggtcgctcgcaagagaagagggaaactatgctcggttgataaagcaaatgtgctggaggcatccatgctttggaggaaaaaggtgactgcactagcctctgaattccctgacattgagctctcacacatgtatgttgacaatgctgcaatgcagcttgtcaggaatcctaagcagtttgatacaattgtcacaaacaatatttttggtgacatattatctgatgaagcatcaatgattacgggaagcattggaatgcttccatctgcgagtgtcggtgaatcgggacctggtctttttgaacctattcatggctctgcccctgatattgctggacaggacaaggccaatccattagctacaattcttagcgcagcgatgctattgcgatatggcctaggagaagaaaatgctgcgaggagaattgaagctgcagttacagaaacactgaaccatgggttccgaactggggacatatattctcctggaacaacactggttggatgcaagcggatgggggaggaagtcttgaagacagtggagtcactgaaggaagtggctgctgtgaactgatgcatgctggtacttgattcattgcattttattagaagtcgagccgagcgtaagagagcatggtgtctgggttattgttgatgttgaattgaaagtttagtggctgaaccgatagccacttcgcatttctgtggtttgtttgtctccctgtagttttttctttggtacaaggaaaggataggcatatgtttgctcaataaaatgggatagtttatgccgctttgaataaaagatggagttctgttttggaccaaaaaaaaaaaaaaaaccccgc

SEQ ID NO: 18256 - DNA, 4351 bp, Zea mays
tgattacaagcctagcatgttaagatttttgagcagaagaagaaagcaacaatatcattagaacaagataattgagatagttaccaagtaagagaaaaggaaagctctgtaaaaagatgatccatccattcgcatttgtctgacgtgcgcataatgttcactaagaatctgcacaaagggtgattttcaggaattcagaaagcaattaacaacgacagtgcttctagagtcaagtttataaggtaaaaacaaaccttaaacttttgctgaactatagaattttctgcatatttccgaccaaaatcagatagcggctcctatggttgtaagatagttagcatcacataggcacattaattgattcataagattcataaaatttaaaatgacccagataagtcatgctgaggcaaggcatggggcacacgagtttatttttctaacaaaaatgctattagaaccacaaggcaaaatgtctttgcgtataaaggctaggaagctagctagtgcttgcagtaaacattatgaatccatggagtttctggtggccaagtattcaaaatcgtttaagacacactgaactttatggttgacgttcatgttattttattgtacaaatagtgcagggcacattgtatctgttcatgaaaatatttataaaattttccagggacacaaaaataataaattgtttcagcggtaaggatcaaatctatttttatgagtaagggtaacattttctcgatattgaaatagaaacgtccagcctgattgagagatgcatcagctgaaacttttatatttatgaaatcataactagcatatttaagtcaagacttaggacgcgctcaaggaatccgcaaacagtccaaaaaaatgtttagtgcaaatcatcatcacatattatattgccattgattagcaaatcttatctcgaaatacaatgaacagttatgtcatgacatcttaaaaccgtagtattccaaaactatggttttgaaatactttacttccaaacacgccctaaggaacaaacaagtacattcaattaagtagcttatgaggatacaatatttatacctgacattgtagtgccttctcaagaggttctggggttacaaaggtgcggttagcataactgtgcttggcaacacggttgttctttggtgggcggaggtatgtcttcttgccatcgagcagctgttgccaattgtggcgcagtgaaaaaaactcctgtgcggtgagcggctcataattttgccggccaatacgaggggggttttgtggatcactcgagtccatacaaagaacttgaggatcactcaagaatgtagaaccccatccgaaggcgctttcgaatttgtccagctcttcgtctgtgaagccctcataatccttgtgagttgcaatcatcaggtaatttattattttattttatttccaaatggaagcagggagagcacaacgaaataatcccagtaattcacctattttatcctactcgaattttttttttttttttaaaaaaactttccagaagacatgcaagtcatggcatgacctctggtatcatgatatgtccatttacaacaaaaacacgtaaaaaaagaatccaaataatgtgctcaacatgtaccgagttttctcgcggaattctaaacggaaaaagaaaaaaacgcttcacatgattcacacctcgaatttgctaaatttacctatctacaaaaactaagtcatcctgcaaatggatcaaatccctgaaggaagcccaaattatgacacacaaaatgtaaacggatgattgaataaagcgacgaaaaacttcagagggcaagaatcagccagaacgggacaaaaaacggacactcgaaattgccatggcaccactccgcgatattcaataactggcattgcggtttccccttccttccttcttttctgggtttccccgtaaaatcaaaaacccgacccaatggtcaatcaaatcgaggacgtgttcaaacgaaaaccagcctacgaccgacccagtcgatgagccatcgccttctatcagaacgggagaaattaatccccaagaaattgggtgccgcgaatcaagaaatccagaacctgccaacgcacacaaaccccaagagacccgcgtgaagctggaaacaaacccaaacctcgtcgtcctcgtcgtcgtcgtcgtcgtcgtcgtcgtcgtcgtcgtcgtcgtcgtcgtcgtcatcgtcatcgtcaatttcttcatcgtcatcgtcgccgtcatggacctcgggcggaggcgatgaacgtggccgatgagaagagggttccggttgcgtcgcggtccccggtgctgctgcgccatcgctgggacgcggtcctgggaaccggtggatccccaatttctcgacctcggtacaaaccgcgtcaatggaggagaagagactgtcgatcgacaagtcgacgtgaggacgccacagctcgaaggcgtgggcagtcgactcgagcgcagcgacgcgaatgatggtccccgtctcaagcaggcggatccggaaatccacacccgcctcggccgccgccaactgcgccaccaccccgtcgcggatctccttggagatcgtctccagatttcgagcagagtccgcaactttcgtttcgaggacgccgacgcgggtctcccacttggaatcaatctcgcggagccggttgtcgaattcggacagcagcgcccgggcctgggtgagttggaaatcgattgcgttggtggacgccattgatcggagccgaggatcggcggatgcctgctacggtgttaccaaatgttaaccccgccggtacagaagaataggtaaattgtctattgtctgaatgtttcttaatcctccctagagttttttgctattatagtactcttattaacatgtttctttcttatggtactctaaatataaccttctctataatagtatttataagtgttattgttctctaaaatagtattctaacctgttttctaattatttccttttcctcacctaataatctgaccgtattgcccccggttcccaatttgcatctgttggttcgtttcttcagagagtactgtccggtttgttcacagaataagagcagatccctgcacgccaaatcaagcagcggtgagaaccctgcgagcaacctgaacatgaggcagatctcttgcaagcaatctgagaagcctctgtatccagcagagtactgtccgatataaagagaaaaatgacccaagagcaatgctaatgctaaaactacttggcctcatgcctctgtacccagcagaataaaagtacttggcctcatgcctctgtaaaaggagaaagaatgaacctgacaatgtacaatatcctttcaaattatcatttcaaaggagaaagaatgaccccatagaaaacaatggcttacagtcttgaaacaatggcatcatatatttatagtggtcctgctatcattctacgaacctgacaatgtataactataatgtctgtgacaaaaaataactactagttccaagacatctgcatatgtaaaagacaatttcactaacagtttattgctgcactaacatctttctctaagtgtctttaaaaagtcaatttcacaactttctcttcgcctttcttggagtcatctttcttggagctgttgtcgtagtctctaaagcctacgaagaagaagcctcatgtgttgtcacctctcccatcaaaattccaagacgtctgcatatgtaaccatatatttatcaaaattcacttgttttcaacacaatgtatgcatggtgacaaacatgaaatatgtaccttcttgtcattattccaggactctcttgcattagttgttctcttgtagtttctgctctctccggcgtagactctttaggaaaccattctttggtactatttttccttggctttctttataaaaaaacttgtccatgacttgtgtttgttgcccccaacaaacttgatgtgtttccaaccagctcttagcactagagagcgccgcataaactatagccatgtggctctcataaacatgtttgtcgtatgccctagctgctggccacatgtgtccactgctgtcacccgaatatctcttaacaaaattctgagtatagaaactgccttggaggcaacccacttacacgaaggtgtagttgtccttctcctactgctagatgtacacgtgtgtacatcattcaacactgtgacctgcatatgcaacataagaaattgcatgaggcaaatatgtacaaaaaatacaattcaaatacacttgtatgttgtgttaggagttcgtaccacaacagacacttcaccctccttcttga

SEQ ID NO: 18257 - DNA, 1358 bp, Zea mays
aaaaaaactttccagaagacatgcaagtcatggcatgacctctggtatcatgatatgtccatttacaacaaaaacacgtaaaaaaagaatccaaataatgtgctcaacatgtaccgagttttctcgcggaattctaaacggaaaaagaaaaaaacgcttcacatgattcacacctcgaatttgctaaatttacctatctacaaaaactaagtcatcctgcaaatggatcaaatccctgaaggaagcccaaattatgacacacaaaatgtaaacggatgattgaataaagcgacgaaaaacttcagagggcaagaatcagccagaacgggacaaaaaacggacactcgaaattgccatggcaccactccgcgatattcaataactggcattgcggtttccccttccttccttcttttctgggtttccccgtaaaatcaaaaacccgacccaatggtcaatcaaatcgaggacgtgttcaaacgaaaaccagcctacgaccgacccagtcgatgagccatcgccttctatcagaacgggagaaattaatccccaagaaattgggtgccgcgaatcaagaaatccagaacctgccaacgcacacaaccccaagagacccgcgtgaagctggaaacaaacccaaacctcgtcgtcatcgtcgtcgtcgtcgtcgtcgtcgtcgtcgtcgtcgtcatcgtcatcgtcaatttcttcatcgtcatcgtcgccgtcatggacctcgggcggaggcgatgaacgtggccgatgagaagagggttccggttgcgtcgcggtccccggtgctgctgcgccatcgctgggacgcggtcctgggaaccggtggatccccaatttctcgacctcggtacaaaccgcgtcaatggaggagaagagactgtcgatcgacaagtcgacgtgaggacgccacagctcgaaggcgtgggcagtcgactcgagcgcagcgacgcgaatgatggtccccgtctcaagcaggcggatccggaaatccacacccgcctcggccgccgccaactgcgccaccaccccgtcgcggatctccttggagatcgtctccagatttcgagcagagtccgcaactttcgtttcgaggacgccgacgcgggtctcccacttggaatcaatctcgcggagccggttgtcgaattcggacagcagcgcccgggcctggctgagttggaaatcgattgcgttggtggacgccattgatcggagccgaggatcggcggatgcctgctacggtgttagaccaactccagccggtacagaagaataggaaataaattgtctattgtctgaatgtttcttaatcctccctagggtcaccgaacgtatttacatcc

SEQ ID NO: 18258 - DNA, 1600 bp, Zea mays
gtagcggacaacgcggattgcgcgactgcggcctgagagacgtgaatccaagcgtgcaagcaagcggcggtaatggcggcggctctgcaagccacgccgctcaaaaccctatccatctcccgccggcgcgtcggcggcgcgggggcgcggccgcgtccgatggcggcgagcttccgatgctccgcggcggcgaggagctacaatatcacgctcctccccggagacggcatcggccctgaggtggtcgccgtcgccaaggacgtgctgtccctcgccggcgccctcgaaggcgtcgagctccggttccaggagaagcttgtgggtggctcggccctggacgccaccggcgtgccgctccccgacgagacactcgacgcggccaagggttccgacgccgtcctcctcggcgccattggaggctataagtgggataacaatgagaagcacctcaagcctgagaccgggctgctgcagctccgtgccggacttggggtctttgccaatctgcgaccagctgcagtattgccgcagttggtagatgcatccactctgaagaaagaggtagctgaaggtgttgacatcatggttgtcagagagcttactggaggcatctacttcggcaaacccaggggttttggaacaaatgacaatggagatgacattgggttcaacacagaagtttattcagcttctgagattgatcgtatcgcacgagtcgcatttgaggttgctcgcaagagaagagggagactatgctcggttgacaaagcaaatgtcttggaggcatctatgctttggaggaaaagggtgactgcactagcttcggaattccctgatattgagctctcacacatgtatgttgataatgctgcgatgcagcttgttaggaatcctaagcagtttgacacaattgtcacaaacaatatttttggtgacatattatctgatgaagcatcaatgattacgggaagtattggaatgctcccatctgccagtgttggtgaatcgggacctggtctttttgaacctattcatggctctgcccctgatattgctggacaggacaaggccaatccattggctacaattcttagtgcagcgatgctattgagatatggcctaggagaagaaaatgctgcgaacagaattgaagctgcagttactgaaacactgaaccatgggttccgaactggggacatatattctcctggaacaacattggttggatgcaagcggatgggggaagaagtcctgaagacagtgaactcactgaaggaagtggctgctgtaaactgatgcatgttggtacttaatttataaccctacaggatgagatggttgaaagggacttgcattttattagaagttgagcctggtgaaagagagcactgcgtctggttttgaatcgcaactgtagcggctgaaccgacggtcttttttcatttctggtgtttgttggccttcctgtaactcaattttgtacaaggaaggataagcatatgtatgataaaatgggatagtttatgccagttgaataaaatatgttctataacttctattaaaaaaaaaaaaaaaaaacttgagggggggcccggtaccc

SEQ ID NO: 18259 - DNA, 2863 bp, Zea mays
gggtaattgtggccgacatgtgatgcacgatattttagtaacagctatttgcagcagtacagctgtggctactgcagccagcttttgctgtcgttacagtatgcctacagtatccaaaatacccggtttttttccggcctttcaggacagcacataaaccttgaaatatgtagaatcataagaaacaagtcaccaacaaaaattgtttgtgttcgaccgcaaaacaaatataaccggttcctcttgtttaacctaggcaccctcagtacatcagtgctctattactcccagcactgctttattggggaggtggggtggcctccaagctcaccacaatgtctacacaaacaatgactgaacatccatggattcacagtcctcaatcgaaaagattcaccattctatgctcctgcctgatgaaactatcaaacatcactggatagacacgaatcctgatcaagcacaaaaacagcctcattgtaagggaaggttcttatgggtgtatgcaacattcttgtcaccattcaccacttgcccacttcctcgcatgatccagcgtgttgttaagagaccttcaacacccacaggcccgcgagcatgtatacgccctgtgcttatgccaacctcggcacccaatccaaaacgagccccatcagagaatcgtgtactcgcattatgaaatacagcagcactatcaacttgacgcagaaaagtttctgctactttatcatctgtggtgataatgcaatctgtatgtgcacttccataacgatgtatatggttaattgctgactgtacatcatcaacgaactcaattgtgcaggccatagagctatattcatgatggaatgaatctgctttcggaatacacagtacttcatgtgcaacaggccctccataaatagcaactccttctgttttgagtgataggagtatatcatcaagacctggagcctttataaggtctttatgaacaagcaatgtctccatagcattgcaggctgctgggtaatcagttttggcatccatcactattcgttttgccatattcatgtcagctgatttgtcaatgtatacatgacaaataccatccgcatgaccgaggacaggtatcttagttgatgctttgatttgcgaaaccagcttattgctgcctcttggaatgacaagatcaatgacatcatcaagctttagtaaatcagcgatttcatctctacttgtaacaaggccaataagtttttgacccacgttgtcaggaattgcgccagttataaccttatgtaatactgtgttcgatctcatggcttcttttccacctttcaggagaagaccattgccacttcgaactgctaaagacgcaatctggactaaggcatcaggcctggactcaaaaacaatcaacagcacacccagagggcaagatgttttttcgagcactaagtcttcagcaacctctgttcttttgagtatctggttgattgggtcttccatatttgcaagagtgcgtatggatttcgcaaggcttgctatcttttctggcttcaatgtcaatctatcaaccaaagatttctgatatccagcatcttgtgctgcagatacatcagcttcattttcagttctaattagatcctcattttgttccaaagcatctgcaatgtctaacaatattttcttgcgttcatccgatgataaattctgcagacgccttgaacattctcttgcagcaacagccatctcacgagcactaacatccttggatggctcccacagacttgcatccttatggaagagagtaccaatcttctctccttggagaactctaacaatgctctgagatgcaaatccacttgtaataacaacaggtgtgccactgttcgaagccacaaaagcagccttcactttagctgtcattcctcctctacctacacgtgacttatccccaaaagttattccactgtaatgtttatctttaatgtaggtatgaatgatctttgatcccggttcgcttggtggaccgctgtatagaccatctacatcacttagtagaacaaggagatctgctttaagttcaatagccaaaagaccagctaaactgtcattatcccagaatataccagatgaatcctcatatggagcctttctagtgctgatggcatcattttcattaaatattggtacaactttaaggtctaatagtgactcaacagtttcacagagcctctcccgaaagtttggattctcaaaatcactatctgtcacaagaagttgcgaggaggacacatcaagttgggtaaatagcatatcataaagagccatgaggccactctgaccaacagcagcgcaagcctttccatccagctccatctgtggcttttgcagatcagcaaagctgctattgacaagcttcctgtacttgagcctctgcttccccacaccaacagcacctgaggtcacaaggatcacctcgtatcctaagacattcagctcttttacctgctcacaaagacaccccaaccggcccacagccagtcgcccatcatcacccctcgtgacgactgcagtgcccaccttgatgatgacgcgtttgacgtccttcatgaaagtccgggtccggtccgcggtggccatggccgccgccaacgcttttagatcgacgccgctcttggtcctccgtctcctctccctatcagcctccgcctctcttgtccgttttccttgcgggggcagctctatcgtcacctcgtcgccgcaatcgccaggaaggcggatgagagaggagagggtttttgaagtggtgagacggactgggtgagggaacaaaaatggcaacaacctacctcagtcaggatcccgtgtcggccgg

SEQ ID NO: 18260 - DNA, 2710 bp, Zea mays
acgactcactaaggcgaattgggtacgggccccccctttttttttttgctcttttctcttgcgatcaagtaggatttaaagaaatatatgtatcactacaaaaactgacaacatatatgttcaatcagacccaaaaaaattaacaatataaccgaattctcttgtttaacctagactagacacagcctcggtacattagtgctctactactcccagcactgctttatcggggtggtgggtgtctcaccagaatgttctagataaaaatgactggataagtggacattgcagttcaccgtccctcatcgaaaagattcaccactctctgctcctgtctgacgacactatcaaacatcactggatagacacgaatcctgatgaagcacaaaaacggcctcatggcaatggaaggttcttatgggtgtatgcgatatcattgtcaccgttcaccacttgcccgctccctcgcatgatccagcgcgttgttaagagaccttcaacacccacgggcccacgagcatgtatacgccctgtgcttatgccaacctcagcacccaatccaaaacgagccccgtcagagaatcgtgtgcttgcattatgaaacacagcagcactatcaacttgacgcagaaaagtttctgctactttatcatctgtagtgacaatgcaatctgtatgtgcacttccataacaatgtatatggtcaatcgctgactgtacatcatcaacaaactcaattgtgcaggccatagaactatattcatgatggaatgaatttgcttctggaatgcacaatacttcatgtgcaacaggccccccaaaaatagcaactccttttgttttgagtgatagcagtaagtcatcaagacctggagcctttataagatctttatgaacaagcaatgtctccatagcattgcaggctgctgggtaatcaattttggcatccatcactatttgttttgccatattcatgttagctgatttgtcgatgtatacatgacagataccatcagcatgaccaagaacagggatcttagttgatgtcttgatttgtgaaaccagcttattgctgcctcttggaatgacaagatcaattacatcatgaagctttagtaaatcagcaatttcgtctctacttgtaacaaggccaataagtttttcacccacgttgctaggaatggcaccagttataaccttatgcaatactttgtttgatctcatggcttcttttccacctttcaagagaagaccattgccacttcgaatcgctaaagatgcaatctggaccaaggcatcaggcctggactcaaaaataaccaataggacacccaaaggacatgatgttttctcgagaattaaattttcagcaatctctgttcttttgagtatttggttgattgggtcttccatacgtgcaagagtgcgaatggatttcgcgagggctgatatctttcctggctttagggtcaatctatcaaccaaaaatttctcatatccagcatcttgcgctgcagctacatcggcttcattctcggtcctaattagattctcatttttctccaaagcatccgccacgtctagcaatattttattgcgctcatccgacgacaaattctgcagacgccttgaacattctcttgcagtaacagccatctcacatgcactaacatcactggatggttcccacaaactcgcgtccttatgaaagagagtaccaatcttctctccttggagaactctaatgatgctcccagatgcagatccacttgttataacaacaggtgtgccactgtttgaagccacgagagcagccttcactttagctgtcattcctcctctacctacacgtgacttatccccaaaagtaatttcgttatgatatttatctttgatgtatgtatgtatcatctttgattgaggttcactaggtggaccgctgtagaggccatccacgtcactgagtagaacaagaagatctgctttaagttctatagccaaaagaccggctaaactgtcattatcccaaaatatacccgatgaatcctcatacggagcctttctggtgctgatggcatcattttcattaaatattggtacaactttaagatctaatagtgactcaacagtttcacgaagcctctccctgaagtttggattctcaaaatcactgtctgtcacaagaagttgggaagaggatacatcaagttgagtaaatagcatatcatagagagccatgaggccactctgtccaacggcagcgcaagcctttccatccagctccgtctgtggcttttgcatatcagcaaagctgctattgacaagcttcctgtaattgagcctctgcttccccacaccaacagcacctgaggacacaatgatcacctcgtatcctagagcatttatctctttcacctgttcacaaagaacaccaaaattgcctgtggatactcgcccatcatgcctcgtgacaactgcagtgcccaccttgatgatgacgcgtttgacgtccttcatgaaaatacggctctggtctgcggtggccatgaccgccgccggggcttttagctcgacgccgctcctggttctccgtctgccctccctgttagtgttaacttcgccctctcttgtccgttttttttttcggcacctccctctctctcgtctctcgcccacgcgtccgcggacgcgtgggtcgacccgggaattc

SEQ ID NO: 18261 - DNA, 4302 bp, Zea mays
tgtcctttagagacaactactgcagttttagaatgctactaaatctttagggacacccagcaaatagtctaaggccctgtttagttcctggttactaaattttagtcacatcacatcaaaatatttagatgatagctagaagtattaaatataggggtgtttgaatgcactatagctaatagttagtggttaaaattagttgagacatccaaacatcttagctaatagttcaactattagctatttttggtaaattagttaatagtcaggtaactatttgtttgctagctaattccattaccaatttgtaaccaactaattattagttctagtgcattcaaacaccccaataatctaattacataactaattatacagataaagaataaacgtcaatacagatctattaaactaattagtatataattcacctatgcgatgttataataataatttgctaattatatattaattaggtttaatatatttatcattcaaacaccgtaactaataattcagctattaactatttttggtaaattagttaatagttaggtagctatttgttagctagctaattacactaataatttttagccaactaactattagttctagtgcattcaaacaccccatatatataataatcgtaattgacatttaagaggtgtttggtttgtaaggattaatttttaatctctccattctactttagtatctaaattactaaatacagaaacaaactctattttggtttccgcattttataatttggaggaataaaataaaataaaaattttgggaataaaaattagtacctagaagcagacacctccttaaatatccgatatcacaccatcaatggcccggttcacgtaaacagagcgcgtcaggtgggcacaattggtacaacccaacccaacgagcagcagaagccggcgccagatcccgcataaaccacccgctctacctctccacgcggccagcctgactcctccagaccagtcctcacccctgctcgccgcgaacgaagcacagctccttgcctccgtcaccgctctccgtggccggcgaacatgatgtccggcggtgggtactccgccctcgacgaccccaaggcctccggatccgtcccggtatgcaaccgcacttttttttttgccagtctccctcttgtcgcggagaacacagactcactatctctctcttgccacaccacgcaggcggccaccgggacagatccgcaggccatcaggtttgccgactccaacctccagaccttcccgccgtccgaggccaggggcaagatcgctggcgcctaccgcccgcccaccgacgccgacggtcagatctcgcggcctcagctcccgtattctccacgtttctcttcggatccggctcgctgacctggccgcggtggcctctttttttgcgcagataccttctcgtccaagggcggaggagccggaagcggtggcagaggcggcagcgcagggtcggatgatgccgcgcagggcggctggttccgcatgttctccgtggcggcgtacaagccctacttcgacgtcgacacgtctgacgttgtcgagaggatctgggagtccgtcttccccttccgcggcacatttaccgagaagacctccgagaaccccgacctgtatgctcgaatcagccccccctcagagaatacattacagctcaattttgctgcattgctgagacatgatacagcttaggtagcagtagcagacgcgatagatctttgcaagttttagttagcatactggctatcattattcatagattaaattgccttctggagttgagtgtcggtgtgtttgcattggctggaaggtgttggtacttggttatgtagtctcatgcagttatctggtctgcacactgatagtgattgctcctttgttccaaatacttagtttcttttttcatcaggatctgtttttttttgattgaatttatccttggaaaagttattattgtctctagcattgaagattgttgatatgattctttgactttgttttaaggttttaaaatggctgcaatgtcagagccctttctacaggagtctcagtagaattcatttcagcaaacagcaagcacgaactagttattagtatttacacttgctattgggttgatatactacatatccctgtgttttcttaccactataggtatttctattgttcagtttcatttggttgaattttcactgcccatttccatttggtttccaaatgaagcgtctgtggacacacttctattgatttttgtaactgtatttggttgaccgtgagatgtaatactctttgtttgaaaatggttaatgaaacataccatatctatagtttccaagatacatacttgaaatgtttttctttcattcaaacagaaacatttgggtcttctgttttggcagtatgttgaacaccagtatttcttgttggaattatttagtatgtttcacacaaagttataatatccttttgaaagcagtatgttcatgtacaatcaaattgttatttctctatgttgtgtatggcagcctgtagtgaatctacatgaaagtagaatatgcctgtgcagttgcattgaatgcttctttctgaaaaaaaacaattcgactatgaaccttttcaatctaggacattatgaactacagtttataattttgtaactaacaatggcacaatagtagtatagtacacagaacttgccgaatgtgagtcaccgggaagattttgtatttgtctgaatgattaattatttgtaatttgctactgatctctatgccttctgtttcaatttgtactctctaggtatgggccattttggacatgcaccaccctgattttcgttgctgcatctattgctacttttgtcacctacctatcccacaaatggcacaagaaggaatggaactatgatatcaacttggttacctggtctgctgggttattctatggctacgtgacatttgttcctcttcttttatatgttattctcaagtacttctcagcacctgctggtttggtgcaattgtggtgcctatatggatattctctgttcatattcattccagcatcggtaaggttcttactaaaatgcatgcacatatacttgggaatttcagctctattagtctacaattttgtgccactggtctacagctaaagttgtttaaaatttggccttttctgtgggaaatgttcactcgattctaacacctgtaaagcagcagcaaggttgagtttaaagaatttgcactgattttgtatgaaaactggaaccaattaattccaagagtcattattaccaccacttaccaatataatttgtttgctaggtacccttttactgctacatattatagttacatgattttacaaggcatatagttgtgcagtatgttagtaggcttcatgattaaacctgtttcatatggtcaaatacttttctatggatcattgtcaaaagaaaaaaaaaatgtttactatttttacttacatataaccaatatcggtcatttactgattctctattgacgaaatactactccatgccaaattatgagatgttttggcatttctaggtacataacttttattttacactatatctagatacatagtaataatgatgtatttgggaaaactaaaacgtcttataatttggaaatgagggactagtatattatctgttcaaatgatttggaatatttctacactgctttagcatttgaagttgactggaagttctttctcctttgtgttacagcttctgtctattgtgccaatagaaatattcagatgggtgattgctggtgttgctggtttcatgtctgctactttcgttgctgtaaatctccgcgcacacattgtaaattccggcgagcgatggttcctgatcgttgcagggatattcttgttgcagttggggcttgctgttttgctgaaactatatttcttcacgataactgtatagggttatttacatctaatgatcgtactagtcaagaatacacaattttccatgtggaatcacttccatgttcattgaacattgatgtaatttttccatgtatacatctttcttacacgtagaattgagaagcccctgaaattgaattacagcagccaaacaagtactgtgattgatatgggtgaagagtctgatctgtagtctattctgtgttccgctgcttgaggtgaataatgaatgagaaatcgctgtgttctccaaaaaaaaaaaaaaaaaaaagaaaaaaaaaaaaaaaaa

SEQ ID NO: 18262 - DNA, 1135 bp, Zea mays
ataaaccatctgctctaccctccttcgcgcggccggcctgattcctcacccctgctcgccgcgaagcacagctctgtcaccgcggtttgccgtggccggcgaagatgatgtccggcggtgggtactccgccctcgacgaccccaaggcctccggatccgtcccggcggccacggggacagatccgccggccatcaggttcgccgactccaacctccagaccttcccgccgtccgaggccaggggcaagatctccggcgcctaccgcccgcccaccgacgccgatgacaccttctcgtccaagggcggaggagccggaagcggtggcagaggcggcagcgccgggttggatgatgccgcgcagggcggctggttccgcatgttctccgtggcagcgtacaagccctacttcgacgttgacacctctgacgttgtcgagagaatctgggagtccgtcttccccttccgcggcacatttaccgagaagacctccgagaaccctgacctgtatgggccattttggacatgcaccaccctgattttcgttgctgcatctattgccacttttgtcacctacctatctcacaaatggcacaagaaggaatggaactatgatatcaacttggttacctggtctgctggcttattctatggctacgtaacctttgttcctcttcttctatatgttattctcaagtacttctcagctcctgctggtctagtgcaattgtggtgcctatacggatactccctgttcatcttcattccagcatcgcttctgtctattgtgccaatagaaatattcagatgggtgattgctggtgttgctggtttcatgtctgctactttcgttgctgtaaatctccgtgcgcacattgtaaactctggcgagcgatggttcctgatcgttgcagggatattcctgttgcagctggggcttgctgttttgctgaaactctatttcttcacgataactgtatagggttatttacatctgtgcttgtactagtcaggaaaacacacaattttccatgtggagtcacctccatgttcattggacatcgatgtaatttcatcgggtatacaacgtgttgagcaccaaatgaggtaaaaaaaaaaaaaaaaaaaaaagcggcc

SEQ ID NO: 18263 - DNA, 1124 bp, Zea mays
ctggccgggctgactcctccagtcctcacccctgcttgccgcgaacaaagcacagctccttgcctccgtcaccgctctccgtggccggcgaacatgatgtccggcggtgggtactccgccctcgacgaccccatcaggtttgccgactccaacctccagaccttcccgccgtccgaggccaggggcaagatcgctggcgcctaccgcccgcccaccgacgccgacgataccttctcgtccaagggcggaggagccggaagcggtggcagaggcggcagcgcagggtcggatgatgccgcgcagggcggctggttccgcatgttctccgtggcggcgtacaagccctacttcgacgtcgacacgtctgacgttgtcgagaggatctgggagtccgtcttccccttccgcggcacatttaccgagaagacctccgagaaccccgacctgtatgggccattttggacatgcaccaccctgattttcgttgctgcatctattgctacttttgtcacctacctatcccacaaatggcacaagaaggaatggaactatgatatcaacttggttacctggtctgctgggttattctatggctacgtgacatttgttcctcttcttttatatgttattctcaagtacttgtcagcacctgctggtttggtgcaattgtggtgcctatatggatattctctgttcatattcattccagcatcgcttctgtctattgtgccaatagaaatattcagatgggtgattgctggtgttgctggtttcatgtctgctactttcgttgctgtaaatctccgcgcacacattgtaaattccggcgagcgatggttcctgatcgttgcagggatattcttgttgcagttggggcttgctgttttgctgaaactatatttcttcacgataactgtatagggttatttacatctaatgatcgtactagtcaagaatacacacaattttccatgtggaatcacttccatgttcattgaacattgatgtaatctttccatgtatacatctttcttacacgtagaattgagaagcccctgaaattgaattacagcagccaaacaagtactcatgtgattgataaaaaaaaaaaaaaaaaatgaggc

SEQ ID NO: 18264 - DNA, 846 bp, Zea mays
cggccgggccgggtccccccatctctttacgcggccggcccgcctaactctcaccttgccgctgcgggacgcttgctccgccccgaagcttcccttccccgatcctccgccgcggctgtttccgtcgccggtcaagatgatgtccggcggtggctactccgccctcgacgatcccaaggcctccggatccgtcccggcggcgacggggccagatccgcagaccatcaagttcactgagtccaacctccagaccttcccaccctcagaagccaagggcaagatctctggcgcctaccgcccgcccactgactccgacgacaccttctcgtccaaggttggagggggcggcggaggcaggggtagcgatggtgggtcggacgatgccgcgcagggcggctggttccggatgttctccgtagctgcctacaagccctacttcgacgttgacacgtccgatgtcgtggagaggatctgggagtcggtcttccccttccgcggcaacttcaccgagaagacttccgacaaacccgacctgtatgggccattctggacatgcaccaccctgatttttgttgctgcttccattgccacgtttgtcacctacctttcccacaaatggcacaagaaagagtggacctatgatattaacctggttacatggtctgctggcttattctatggctatgtgacatttgttccccttgggttatatgtcattcttaagtacttctcagcacctgctggactcgtgcaattgtggtgcctgtatgggtactctttgttcatcttcattccagcctcgcttctgtcaatcgtgccaatagaaatattcagatgggttatggc

SEQ ID NO: 18265 - DNA, 3004 bp, Zea mays
  misc_feature (61)..(61): n is a, c, g, or t
  misc_feature (69)..(69): n is a, c, g, or t
  misc_feature (1064)..(1064): n is a, c, g, or t
ggcttcataattaactgacaattgcataaaaagtatataaacaaggtaccaaagtatgcancaggatanaatagtccaaaatattctttgtaattttctacatctggaaaaatatttctacaatttcatgaatttccttttgtgtttcactaattctaggaaataaacaaataaattcgcattttctctgaaaaaaaggaaaatccaaacatggtctggctggccattcgacctagcctttggccgcccaacacggtccgaccgcgggaggagagcgcgacgaggccacaacatgggcctgggccgcgaaagaggcccaagcggggccgccgcccctccccgccttgatctcgaccgtctgattgaattggacagtcctagatgctcccgttactgtagcactgcataaggaatgtaaagaataaaggcttttctttgatttttctgatttttgaagtgttttttactcaagagaggtatttggccacttggtttccaaacggtggcggagaagtacaccatagtggagaaaattttcctagagaattaaagtgtcatttaaaatctctttggtggaatacttttctaggtcatttgtcctcttgctgccaaactggcccttaagccgaaaaaaatcccggggtgtgggtgtgggctgtggggtggggttgggagtggaactctagcttttctgtttcctcccactcatgaatgatgatgggtcgactatggtataccactgttttgcgcatatcgggaagtaaccaatttgcacattatattactcatattcatccactcaaatcaatataaacctcatagatatagggctttattcggtaatttagtaaaccgcgatcagggctgaaaaaaatcagactgaagagaacttgaataacaggccccgactgaataagttcgaaatagttaggggcccagtatgacaaactagattctgaggtttgattatacaaactaaaatactttgggggcttatggtgcatttttaccagtaatacctactaggttcagggaaaaaagaactgtagtttaatgggcaattnaagaagattaaatataattgtttcctgatgctgattattagttctaattgttttccccacgttgataagattttagtttaggccccgtttggttagataagattttagtttaggctccgtttggttagagggggactaatttttagtccctaatttttagtccctttagtctttattttgtccaacgaaaagactaaaataaggactaattgactttagtctctagtctctcgtatgagtgctaaaaggggttaaagtgcaacatttacctcaattgcccttgcctagaaaactgacgtcaaacaagaaaaggaatattttggtctttatatgttgtatttaatgtatttaaaatttgtttagttcctggtagggatagtcctatgactaatggaaccaaacggggcattagaaacacagaatctataacaaggaaaccacgtgcatcttatgctactaatagctctcatcaaaagccttttagatttttcccagaatttccacctaaaataggacatataattgcggcgacaacagaggccagaatatgtaaacgtggaaagtaaattcatctgaccaaatggccagtttacacagttataaagaacacaactgggttttcacatgaacagaatctgtagagggaagttttctcacgtgccacttcctcaaaataattatgcttcttaaatccatgacatatccattaaaatgttaaccaaactaatacaaatgataaaaggattattttgaaccaaaaccaaaccatttcgccaagaagaacttattcttcccccgagaggcttcatctgaggcctttccaccacttccacgtgatgtcctttggttagttgaattagattttttaacatcttgggatgaccctgatgctgaggttgaatgtttttgctctggaggactgtcctcattaccatttatggttgaatatctgtaggtgttcttcagatactcaacaaaggagtgatcattgtgatcaagcatcaattgctgaaacaattcatgccccatatgctcagaggttccaaacaaaagcaactgcactgcatctgaatctctatttgagcacttcttggaaaggttgttcgtatctaacaggatacctgcaagcagaagtttctttatgtccaagttttgaagcaggctataagcatcctcacaataggtatgggtcagggttgtgcaaactgagcccacctcagcttttgatttcaaaatatcttgccccaccacaagcaagttaactcgctggtccattattagcccatccgtgtcaacctcgtcggcgaagagcagcgctgaggcgtcgaccccgacgtgatacaggagccaagccgcctgcctgcacctagccatcctgctccggctcatgttcaccaccggcaccgttgcctggccatcacccttgctgggaagcatccacgcgtagcatattgccgccacaatcgagctcagacttttggaggggtcggagagcacgagcttggtggacctcgacgcagggcggtcccctgccgctaggtcagcgaccatggcacgctgtcgacggaggaaggagttgaggcgggcgacaccgtcaccggatccatcggccgcgaaagcgggggcggaggaagcggaggcgtggcggcggtggcgagaatgcgtggcggagatgggcgaggtggaggtgtatgtggcgcgaccgagtggagaatcgggggtaggggcgtcgcggaagcgagacttgcgccgagggtttgggggtaaggagggggacggggagggaggcgcggaggaggcgaagggatcggagcgtggaggggacgaggcgatggacgcgcgctgcagtatctcgtcgccgatacctcctggctgccagtgcctgcaagcacacacgcgcggaatatcagtttagcgaggacgattccgacctggccggc

SEQ ID NO: 18266 - DNA, 1033 bp, Zea mays
ccggccgggaccttcgacggggtcagcaattcagcattcaccccttgataaaccgttttatacgcatagaggtcttcgtcgtgttcgtcctgcccaactgcccgctgaaaaacaaactcaccaacaaagtgacctgaaactgggagcaagcaaccgagggcgagagccatggcgaagcctcgcagcggcggcggcggcggcctcctggacttagaggggcactacgccttttacggcgcctaccacagcaaccccgtcaacgtgggcatccacgagctcttcgtgtggcccatcttcctcaccgcgctcatgctcctccacctcaccgccccctccacgcacgccgccggcatcagcgccgcggtctacgcggcctactacttcctcctcgaccgccgcgcgggcgcgctcgccgccctcctctgctacctctgctgggccgccagcggcgccctctctgcccgcctcggtttctctgttggatggaaggttgtattggtggcccagttgttctgttggattatgcaattcattggtcatggagttttcgagaagcgagcgcctgctcttcttgacaatcttgtccaggctttcctgatggcaccattctttgtgctgctagagattcttcacacatttggcgggtacgaaccgtatcctggcttccacgacaaggtgagcaagttgattgaggaagcccggaaggaatgggaggacaagaaatcaaagaaatcctcatgagatatgcgtgaattaacggctccgaactgttggggtctgcctgctcgagataacctgctgattggatgaatctattgcaaggatggttaccgaatactgatgctatttatgttgtataagatgatgtgcgctatgttgtctgatgtttttatatatattataatggtgacgaaaccgaggtaaaaaataatttatatatgtatactggtgtgattgccttgctagggcccttgtttctctatgagagggaggccttctgttgaggtgtaaaaaaaaaaaaaaaaaactcact

SEQ ID NO: 18267 - DNA, 1468 bp, Zea mays
ttcggcacgacctcgaccagaagcgcctgctcctttacagtgggttccatcctgccatgcacctccctgatcgccggcaacaccatcacgatcggtgccgcctcccccccgccccagtcgtgtcgccactcgccgccatccgctccgcaggtcacgtgaaaagcagtgcaggcgcaagggcaccgccgaggcagaaaagggcggataaactgcttgaactggaagcgaccctagtccaaaccaccgcaccgacaccgactccgagccccgccgcgccgcgctacctccgctcctctcttcgcccctgccggcgtcgaggccgaagcgaaggcgagcatgcatcacgaccccaaccccttcgacgagggcagcgccgaggacaaccccttctcaaatggaggagccggaggcggcaagcagcagtacggcttccggccgactgagcccgtcgggttcggcggcgctagcaggggcgacgccgtcgttgacgtcccgctcgagaccatgggggactctcggagcaaggtgaaggagctctcgtcgtgggaatcagatctgaagcggcgagaggcggatatcaagaggagggaagaggcgctgaagaatgctggcgtgccaatggaggagaagaactggccaccattcttccccatcatccaccatgatattgccaatgagataccagcaaatgtgcagaagttgcagtatcttgcatttgcaagctggcttggaattgtgctttgtttgtcctggaacttcgttgctgtcatagtctgctggatcaaggagggagattcaaagttgtttttccttgcaacaatctatgctttgcttggaattcctctgtcatatttgatatggtacaggccactctaccgtgcaatgaggactaacagtgctttcagttttggatggtttttcctgtgttacctgatccacattggtttttgcataattgctgccattgctccaccaattgtatttcatgggaaatcattaactggtattctggctgcgattgacactttctctgaacatgtgataattgggatcttttactttgtggggtttgcactgttttgtctggagacactgctgagcattggggttcttcagaaagtgtacatgtacttcagagggaacaagtgaagccagtcatgatggagagttacgtttgttgagaaaatttggagttacttgtggctacttgtagcacatgttcattcgatggttttgtgcatacctgtcagtacaccttgaatctataatttcttatgtcagttattggtgccgagaattgtttttttaaggtggtatgggagtataggtttgcttacggatgggtgctgtggttcttcactagctattcttgaaacgcagaagatcatgcgcccaagtcatgtttcagaattaatttactgtactcatacaaaaaaaaaaaaaaaaaaggcccctctcgagctcgtgc

SEQ ID NO: 18268 - DNA, 1615 bp, Zea mays
cctaattaatatgtctattgcatattgaatttcagtaactgttctatttgccgaaaaaactttttaaaactaaattattgaaaaaactatttgtgacaaacaatcatgttttaaaataactttacgtataaatatatattacataaatatatagagagagatgagagcctttatgtttgctttcacttaggttcctaaaatgtcaggaccggtcctgcataaggttaccaaaaatactatttcatattatggaccatattgtttatagagtggaatatgaatatgaatatgagaatgggtaaagctgcgctgaaaatgggtaaacatgatgagctgttggaactgacgtgtacaacagagaggtcgaggtggcccgaccccgaccccgaccggtggactgtggtctgtggaacaagacgtgccgacgctgtgtgagtgtggcatcaatgacgtcgtcgtctttcgtgtgtgtcatcgacgtccagcgatcaactgccaaccaactcaattgacctgagcaatttaagcacaggttgttctaaatgcagtccaagcgtggccatggccatcaagccggcgccgtccataataatcacgctcgttaacggtacaacctagctgctggtggtgctagctgtggtatcgtgctgataggaccactgtacatactgtcgggtgaaaagaaaaacagcaagctctcaagctacaagtgtacaactttgaaccatacgtacatctgtttagcaatctgcagtggcagttgggagctagctggctgcctgcctataaatgagcgacaaactgagcagctatatatatagctccgaccaccaccaccccgccaccaactcggccggtctgctagtgttggagagaagagaatacactacagtactacatggcgaagcagcagcagcagggcatggcggcagtggcgctggtagtgctggtggtgctggcgacggcggcggccgagacggcgtcggcggcttcgtgcaacgccgggcagctggcggcttgcgcgccggcgatcacggccggcgcgaggccctccgcgtcgtgctgctccaacctcaaggcgcagcaggggtgcttctgccagttcgtgaagaaccccacctacgggcgctacatcaacagccccaacgcgcgcaaggtcgtcgcctcctgcggcgtctccgtgccgcgctgctagtacgtgtacgtgtgtgcaatgtgcatgcatgtacgtgcgcacgtgggctgatcttcctgcttgtttcgtgccttgccgcgcgctatcaggtggttgtgtcacttttctgtttagtctctctacatgtgtactggtctcgtgtaccgctcctctatagtcgtgtcgtgttgtcgtgtacgggctaattaatatatatatatacgaggaataaaggatgagttcggccacttcgcaaaaaaaaaaaaaaaaaaaaactacaacatcaacaaaggttctggaaaggagccggatggaggaatgtaattcctaccaagtgtcaatgtgaacttgactatgaagccgagcaaagagagtacaattcatgcagatcgagagtctacgtacagtggactaatcaatatgaagcccatcatgaataag

SEQ ID NO: 18269 - DNA, 786 bp, Zea mays
tcgagggccggccggcattgggtacctcgaggccggccgggaactcgatcggtctgctagtgttggagagaagagaatacactacagtactacatggcgaagcagcagcagcagggcatggcggcagtggcgctggtagtgctggtggtgctggcggcgacggcggccgagacggcgtcggcggcttcgtgcaacgccgggcagctggcggcgtgcgcgccggcgatcactgccggcgcgacgccctccgcgtcgtgctgctccaacctcaaggcgcagcaggggtgcttctgccagttcgtgaagaaccccacctacgggcgctacatcaacagccccaacgcgcgcaaggtcgtcgcctcctgcggcgtctccgtgccgcgctgctagtactagtacgtgtgctgtgcatgcatgtacgtgcgcacgtgggctgatcttcctgcttgtttcgtgtcttgccgcgcgccatcaggtgtttgtgtcacttttctgtttagtctctctacatgtgtactggcctcgtgtaccgctcctctatagtcgtgtcgtgtacgggctaattaatatatatacgacgaataaaggatgagttcggccactaaaaaaaaaaaaaacgcaggctagctgctacgatatcgaaggttctggaaaggagccggatggagcaatgtaattcctaccagtgtcaatgtgaacttgactatgaagccgagccaaaaaaaaaaaaaataacccgacctccagccccacctctttgttcccctttactgaagggctaattgc

SEQ ID NO: 18270 - DNA, 623 bp, Zea mays
accgccggccgggccgggaaactcgaccggtctgctagtgttggagagaagagaatacactacactacgcatggcgaagcagcagcagggccagggcatggcggcagtggcgctggtgctgctggtgctggcggcggcggcggccgagacggcgtcggcggcttcgtgcaacgccgggcagctggcggcgtgcgcgccggcgatcactgccggcgcgacgccctccgcgtcgtgctgctccaacctcaaggcgcagcaggggtgcttctgccagttcgtgaagaaccccacctacgggcgctacatcaacagccccaacgcgcgcaaggtcgtcgcctcctgcggcgtctccgtgccgcgctgctagtactagtacgtgtgctgtgcatgcatgcatgtacgtgcgcacgtgggctgatcttcctgcttgtttcgtgtcttgccgcgcgccatcaggtgtttgtgtcacttttctgtttagtctctctacatgtgtactggcctcgtgtaccgctcctctatagtcgtgtcgtgtacgggctaattaatatatatacgacgaataataaaggatgagttcggccactaaaaaaaaaaaaaaaaaccccccttaaaatattatg

SEQ ID NO: 18271 - DNA, 2769 bp, Zea mays
gccggccgggctgggaagcagcctcgcctccgcacaattcagaaatcgtcaagtcctatcgtgctcgccgaaagaccgccgcctcgaacggctcgacacgacgaccttcgctctctccgccaccgaatccaccacaaaagccaccatatccacttgttggccggccggtcaagaagaccaaggacaagggagaaacgaggggtttagttgggcgcgcgggcgatctcttcagtaaggcgttgtgtggtggtggtgtttggacggagcggagatgtcgtcggcgatggtggagcgggcaaccagcgatatgctcatcggcccggactgggcgatgaacttggagatctgtgacatcctcaaccgcgaacccggacaagcaaaagatgtggtaaagtccctcaagaaacgcattgcacacaagaacccaaaagtccaacttcttgctctcacgttgctggagacgatgataaaaaattgtggggacgttgtgcatatggttgttgctgagagagacatacttcatgagatggtcaagatagtaaagaaaaggcatgattatcatgttaaagagaagattctcacgctgatagatacttggcaagaagtttttggtggtgcacgtgcaagatatccacaatattatgcagcatatgaggagctcttgcgtgctggagtggtatttcctcaaagattgaatggttctgtgccaatcatcactcctccacagactcagcctctccaaaactatccctcatctttacacatttcacagcaggaggaacttgaattaccaggttcagatttccctgcattaagccttacagaaattcacaacgcacgtggcatcatggatgttctttcagagatgctggatgctttagatccaggtaacagagaggtactttcctgatgcacctgtggctattgtgccatcataaaattaattatgccttataataaggaagaattgctggtaaccatcttcatcatttcatgaaattttgtttcaaaacaatctacttgcagtgcaatatttctaaattgtacttgcagtgcaagatttcaaatcaatctacttaccgtgccagatttcaggggcttagacaggatatcattgcagaccttgtggatcaatgccgttcttacaagcaaagagtagtgcagcttgtcaacagtacctcgaacgaggagttgctcaaccagggtctttctttgaatgatgatatgcagcgtgttctggcaaaacatgatgctattgatgcaggtctagcagttcgagtggagaagccgaaatctctgcagtcccaaattggaagttcttcaacaagaaagccagataccatggaagaaacaattcagaggccttcagcaagtacaactgccaccagtcagtctccctttgggattttagcacttcctgcacctccatccagtagttcaaaagcacctgcaatacctgcttctagtatcgacctacttagtggagatgattatgtcaaacccgaacctgcaaactccctagcacttgttcctgtcactgaatattcagctgcagacaagaatgtcttagcctttgccgatatgtttgaacaaaatacagccaacaatagcaaccataaccttccatactcttttctatcttcgacttcaaattctactatctctacatcacacacatatcatgcaccggtgcgacctgtattgcctcagcattcagctgcttatccaaatggggccagatccaatgccattgtaccttatgatcagcaggcccaatcgaactctacaggttcgcggaatgggcaaacagcctatggaggaaatcaccaaaagcaagcactaaattatggcacaggtgatcaaaatggagacattccaccagcaccatggggaactaagagatccactaacccatttgacgacgatcagcttggtggaatggcagtgcaaccaaaaggcatgcaaccccaaccagtgcaacccagtcagcatgggaacaaattcatgtcagcaccaccaatgccgaggggacagccaggaagaatgcagttgcaacaggtgcctggtgctcagcttggcgctctacaaccaacacaggctacactgaacatgcagtacaggggcatgcatccatcgatgcaaatgaatcatggaatgggcatgtattcccaaccaacgttcggaggatattatggaatgaaccaaacacagctttacggcgttcatatgtctggttatggatatggtcagcaatctgggggctactatattccgaatgctgcatatgcctatactagtgcaaacgaacttgcccagaggatgaatgacctttcagttcaaaacggtgatccaaatggagccgcagcaaataagcagagcagacctgaggatgcactctttggtgatctcttgagcatcgccaagatgaagcaaaacaaacctgcagctggcaaggttggcggctaagtttgagtaaagaaggtacataattttatcttaattgccagcagcagaaacctttcctgacagcgcatataattattttgccacgttctatgcaatgccagatggcttctcgatgtaagctcatttggtagaaattcatattgggaactggagattaggatgcttgtggggagcctcatagcaaatatgtctataactctactatatatgaaattcttgagttctcagtagcaatatgtattgtcataatttccctctgcaaatattaaggcagaatcagagattcctgttctccctagccat

SEQ ID NO: 18272 - DNA, 2466 bp, Zea mays
  misc_feature (27)..(27): n is a, c, g, or t
ggctagagaggccgagccgcatggtgncagggtcgcaaacacgcccttggagaccttcccctgccgcggcgaggacaccgcttgctttcacggccgacgacctaatccccttccctcccattggcagccgtcgccatgctgcgcgtccgaaatcggctcctccctctgctcggcgccgcctccccgcttccctcccccatccacatccacctccgcgtgtgccgcctcctctccacctccacctccacctctacggccaccgtccccgcacccttctcccttgagaactacctcgtcgccgcctgcggcttcgcacccgcccaagctcgcttggtgtccaagaaggcgttcaacgagttgtccagggaatccaagagatcatcggaggagcactcctgcagacgcctcatctccgcctccaacccagatgccatcctcgcgctgctgtccggcgccggcctctcccgcgccgacatcgctgccgtcgtctttgcggacccgctgatcctccgcgcttccgtgagtaaaatcgcaccccgccttgtcgctctccgcgaccgcgtcggcctgtctactccccagatcgctcgcttcctcctggtcgcctcacgcgctctccgccggtgcgacgtcgttcccaaggttgagttcttcttgtccttcctcggctcctttgatcgggtactggcggtcgcaaaggcaaacttgggcatcttcaacgcgaaccttgagaaggtaataaagcccaacatagacttgtttcgtcaacgcggcgttcgagacgtccctaagatctgtctccaccgcccacggacgctttcctttaacctcgaacgcgtgaaggaatttttgctgcgggcagaagaacttggggtgcctgccgcgtcgcccttgttcatgcaagcagtgggagtcgtcaccagttttccccctgagaaggttgctgccaaacttgacttctttaagaggactcttggttgttctgagtctgaggtttcgaatgcagtgtccaagatgccacaaatactagcattgtctgaggcgactcttcttcgcaagatcgagttcctggtcaatgagggggcgatagagccacagtatattatgcaaaggcctatcctgctcgcattcagcttggagaagcggctagtgccccggtatcgtgtcatcaaagtgctgcagggaaagggattgctgaatagcaacatgagcctttcctcattagcttctcttgcagaagaaaccttcaagtccaagttcgtcgactgccacaaggactgtgttcctggccttgcagatgcttatgctgcagcttgtgctagtattgtgccctcgacagtgtaagttaagccgtttcaaaaacaaaaacagtgtaagttaagcttctcattttgtgttttaggtggatgctcattggctgctgtccactctgcaattttgatttctgaagtatataaccactcatgatcactgattggtcatatccaaggtttaagttatggacttgtggttattgatgaaaggagctgtgtttggcttgttctggatgcttaatgcacgttttgttggtttcatcttctgcctagcacatggcctaagattatccttaacttcgttgtcttccgtggatcagtctttgatgtagagcagtatctgtaagggaatgagatgctgacagaatctaagtcttaaaactttttattactaccattttgtttactttttttttgttttaagtaggaattatcttggaactatttctacttttgtgcctttgcatgatagtagcaggcatagtgctatttataaagtttagcaactgatatggcagggttacggatcatgagctgatgtaaccactgatgccctctgttctgagctgtcgctggaatgatgtaaccaccgatgccctctgttccgagctgccgctgaaattctagatctctaaacttgtgtgatcgattgccaaattagttgatttggaagtgttgcccatctgaaccacgtcatttctactgctaattagttgcctccgcgtatgtatgctggtcctaaacttcattgttatgttgactctaaaagctgcacgagttacagccgcaatctgagaacagtttgtagctatatatatatgccatggcaaatactgatatgaatctttccacttgcaccataatatctgaatatgtacggcataaacaaggggctaatatacaagacatgaacaatagctgtctatcaacaatgtatcattaccaacagtagaagactgctcatacggaaactggcgaaaatattgatctttatatgtgaaactgtatgcggtcaactcagtcttcaatggtaaaccaagaacctaaggtgttctccctgaagatcatcctcataaaagaatagatgtaacacacaatcttcatgatgatctctgattttttctgtgcgtcaaccaatggtttgcagaaaccg

SEQ ID NO: 18273 - DNA, 2026 bp, Zea mays
gatgcgactgcattcgtgcctgaagtggaggtcgaagccgtcaaaattgtcgataagtatgcgctagggatggcaattttacccgcgggttcaggtatccgcggatatccaacccgttggattcgggtttgggttcaaaattttacccgcgggtctcacccatacccgacccgtgataaaattgggtcgggtacgggttttagcttttacccgcgggttttggcagatatccaaaattattttagttttcacttttcagcccaccagaaaccggcggaccggcccattctccatctttattcaccagaaaccctagtctcccacacgcagtcatggtctctctcacggtctcaccgtctctctcagccagtcaccaccagccgcctgaaaccaagcgccggcctccaaggctccaatccctccatggatccatctccatagttgctctgcggctgtacgcctgtaccgagcaaccgccggcgtcgaccctgccgtccaggcccgtcttgccgcggtgccgcctccgtccctgcccagctatccgaccgccagtctctacctcgttcccttctatctgccctgcaggtttctccaatctccaacactgccgaccgcggcagtctgcaatctccttggcaccgtgccaaggtttggattactgaccttgtgttttggggtccatggctatagcactaaaagagcatccgccttgggccttgccgcacgacactccatgcatgctgccatgggttgatgtgattgcttgtgggtgttgattttcctctgattgtggttgtttactctgctctgtgctgcttctgctctatagtttatatgctgctagactgctgctgcttgtagtttaggtgttcgatgaaatgcccattcaaggtaaaattctagttaacgtgcccatgcttctttgtttttttggcaattatgctgtgatgttctagcttcatgttcgtgtaatagatgctgtgggtatgagaagcggaaaacaagattagttaaccatgtgttttatttgtgtggagtgtaattatacccacgggtatccgatacctgcccgatacccgatgggtacgggcacgggtacaaaatcctacccgcgggtatagtcgcgggtaggtatgagtaatacccgcgggtattgtcgcgggtggatatttagcatacgcgatccgaacccgactcgttgccatccctagtatgcaccgcagaccgaaacattgaggagctaggttattcgtgattccaacgtcaggttgaaccgtgtatttgaactgaataatttgccttatggtcctcacccaaagggggacttacgcgataccgttgatcttcgagggaagcaagtaaagccctaggccaatgaaggcccctcaagggagaaagcttcgggtgcagctgttcaaaagaggaaattaggtacgacggatgatgagacagggctgagggctactaggcgttttgttgaggaattgatggaaacatgtgcagttcccagggaattgatgtcttcgcccaagctccaggaaacctcttcgcgaatgctaaaggttatcgggggtcgatggcttaggaatgatccgataccccaggccattggcgaggattttttacgtctcgattggctcgtgacctgagaattttttcttacagaaggaatattgttgatgttgtgttggcagtgatggagaaggatcgtcaggatgcgcagcgaaagaaacacagggcccccgttaggctggtggacccacgtcgggaaaagcaaaactggtgcgccccagcgcgaaggctgccgcatcaagaaattgtagaaaaatgctaaaaataccaaaccaattttgctagactcataatttccatagtatttattaaaaatagtttcatgatttttagtccaaataggaaattatagagcatttaaaatagccaaaatccatacttctggatttttagggaataattaataattccaaaattcaccaaactttttaggtaaactttaaataatatttag

SEQ ID NO: 18274 - DNA, 2355 bp, Zea mays
gatgaaatttggcgctatgatcagttacctgattaatgggtggatgttgctgttttttttttcagccctggtgttgtgaatactgacatgcttaattcatgctttggaagctctgccgcattatatcaaacaactgaaacatgggcacccaaggcagctacaatgatactaagcctttcactggacgataacggtgcttccttgactgtatgaagtcgtgaaattctgtgctcaactgattgctgatgggttctcttcatctcttgtagcctgatgtgtagatttttgcgagattatggtgatgtaaaatagtagtgataatgcgtgtctgcactctgatgtccctagctgctgtctgaacgttgttgtttagcattacctctatggcctattcatatatactcaaatggtgaggactgaggagtgaggacggtgccgggcgtgagagagaactatagaagcacgcgttgctttgtttcggtggtatccccacgcacggcaacgcgatccgatctgctgccttaaagacaaaatacctactgcccataattccgaaagatgaacaaggccgctcgggcgtctccaattttcgagcttcaagttagttgaattaattaattttaaatgtgctaatgaatagtataaaaagtaagagattagtatggactctagagatagtcctacatatttcatgaagcgtcctttttttaagcgcgatgttcaaagctgcttgcttgctatggtctttctcttctccatatttgtcatcttttaggactagctcggaaacccattttctatttttcaaagaaaattaattcttttttctttgagaaaatagaaattctttagaaaaatggacttcccatactagtctttagagtacttactatttactgtttgagatgacctgagagttctatgtgttaatttctaagactcctgtgttggaaatagtttagataagcttcatcgtgtaaaacttatttcatcatatgcatttttcatcaccttctcgcttatatactataataggtcagcttatttatgcctatagaattatcttgaaatctagcctaaaaagagtaaaagagggttgcaaaaagggtagcccgcaacgagtgctttgagtgttaccagcgtggtgtgaaaagccgcaggattcaagcaaccaaggagtcaaaagaaactccaagttgaagaaaagatcaaccatcaagataatgataatacaaggaagaaagtagagaataagaagattagaagaggagaaagaatagggcgcattaggaattgtcaagatgcccaagaaagtgagctagaatcaagaaaaaaaatagacgttgctgagttgctcacatcaaatgctttggatgcgaagaagtgagacttcacctcgagttgtcccaacgagcttgtggagaaggcacaagcatcatgaaggaggcaagctagaagcagtggcagactcaccgcccggccaccctgggcagctgcccaggctcctctgccgtaaatcactgatatgtttatgtaatctatgagtaaaatacaatttaggatgggtaacaactggacaaagttatattattctttcgacttttgtctagacttttgaaattttctaggtatgccactgcctagaaaaagcaaaattcgagcaagaatcaagaggctcaacaaaggtccgtgagatcaagaggctcaacaatgatcaaacgagccgaattccaatgatcccgagccgaattctattctactaatagtaattttggcatatatcaattaagctaatttggttttatacaaaaatatatttgtatactattattaaaaagatatcggaaatatttatatactatatttttactatagaggattgagacgaagagtgtcagataagttacagagtataaacaaattctactaatgcataaaattatttatcattcttcaccatatgaatttaagatagatttatatctaaactttggaaagtggtaaaatgtcaaattccaaactaaataagttactttattgagtaaattctaatttctctaaaattaagggatccaaacgtcctgtgagtgaaaattatttggttagaaaataaaaatatgcttgacgtctaagaggagatataagcatgtgttgtgcgaggcttgagaccccatgctcccaaactctaggaagcctcgacctatccagggtttggacacgccacgtgtctttgacgccccgtgacggccctagtcaatgggagactcctcacgccgtcacgcgccatgtggtcggtcgtccatgccacagttgataaggagttagtgtagtcatgagacatgtagcatgtgttcg

SEQ ID NO: 18275 - DNA, 769 bp, Zea mays
ccggccggctacctcgccacgtctttcgccgggttcttgcccgaattccccagggtccacttcgctcgcaaccttccccagccatggcgaccgcgacgcggaggctgctccccgcgctcctcaagaccctagctccagccggcgcgcgcggcctctccaccgagaaggctgttggtgcagccgccgtcgtcggcagccacaccgctaagtggatgcaggacacgagcaagaagtcgccaatggaactgatcaacgaggtacctccgatcaaggttgatggtcgcattgccgtctgtgaaggggcttctgaaggtgttggacttggccacccaatcgagtacatctgccttgatctggaggcacctaatgtgtgcaagtactgtggtctccgttatgttcaagttcaccatcactaaattgggaagatactgccgtctaccgctgcagaagctgagttgaggagtttatgtgcacacacatttgttccacaatgttctgtagtgtactttgtactatgcttgcgggcaaaatattacctttgatgatcatcctcttctcgggcgatcttttattaatcctgtcttagtatggttcatttttctacagatgaattgtgctcctttttcagaatctatacaagctgtgtgtattgaagttttactctgaataagcatggaactaactctgagggcaatttaatctcagaagttctagttttctggagaaaaaaaaaaaaaaagttgcccaatcccggcgccagctttttgtt

SEQ ID NO: 18276 - DNA, 745 bp, Zea mays
  misc_feature (2)..(3): n is a, c, g, or t
cnncggccgggaaaaaaaaaaaaaaaaaaaaaaacattgggaccctcgaggccggccgggccggggaattccccagggtccacttcgctcgcaaccttccccagccatggcgaccgcgacgcggaggctgctccccgcgctcctcaagaccctagctccagccggcgcgcgcggcctctccaccgagaaggctgttggtgcagccgccgtcgtcggcagccacaccgctaagtggatgcaggacacgagcaagaagtcgccaatggaactgatcaacgaggtacctccgatcaaggttgatggtcgcattgccgtctgtgaaggggcttctgaaggtgttggacttggccacccaattgagtacatctgccttgatctggaggcacctaatgtgtgcaagtactgtggtctccgttatgttcaagttcaccatcactaaattgggaagatactgccgtctaccgctgcagaagctgagttgaggagtttatgtgcacacacatttgttccacaatgttctgtagtgtactttgtactatgcttgcgggcaaaatattacctttgatgatcatcctcttctcgggcgatcgtttattaatcctgtcttagtatggttcatttttctacagatgaattgtgctcctttttcagaatctatacaagctgtgtgtattgaagttttactctaaataagcatggaactaacgagggcaaaaaaaaaaaaaaaaaaggccccccgggcccc

SEQ ID NO: 18277 - DNA, 543 bp, Zea mays
cattgggtcccacgtaactcttcgttaggtttctcaacagtcgcacccttccccagctagccatggcgaccgcgccgcggaggctgctccccgcgctcctcaaggccctagctccagccggcgcgcgcggcctctccaccgagaaggctgtcggcgccgccgccgtcgccgtcgtcggcagccataccgctaagtggatgcaggacacgagcaagaagtcaccaatggaactgatcaacgaggtacctccgatcaaggttgatggccgcattgccgtttgtgaagggggtaggcaccaaagctgaatcacgcaaactctatcttgcatattctcaaaccgatgatcatataatacattttatgtaaaactgactggcccctgcgcttgctgcactgtttcagctgctgaaggtgttgggcttggccagggccggtcctgacattttgggggccctaagcgaaagtctatatagaggccctatacgaaagtttgattctgctattttttcaactttaaatgatatcggaaaaaaaaaaaaaaaa

SEQ ID NO: 18278 - DNA, 823 bp, Zea mays
actccatagggcgtttgggaccctcgaggccggccggggaattccccagggtacggtccacttcgctcgcaaccttccccagccatggcgaccgcgacgcggaggctgctccccgcgctcctcaggaccctagctccagccggcgcgcgcggcctctccaccgagaaggctgttggcgcagccgccgtcgtcggcagccacaccgctaagtggatgcaggacacgagcaagaagtcgccaatggaactgatcaacgaggtacctccaatcaaggttgatggtcgcattgccgtctgtgaaggggcttctgaaggtgttggacttggccacccaatcgagtacatctgccttgatctggaggcacctaatgtgtgcaagtactgtggtctccgttatgttcaagttcaccatcactaaattgagaagataatgctgtctaccgctgcagaagctgagttgaggagtttatgtgcacacacatttgttccacaatgttctgtagcgtactttgaactatgcttgcgggcaaaatattacctttgatgatcatcctcttctcgggcgatcttttattaatcctgtcttagtatggttcatttttctacagatgaattgtgctcctttttcagaatctatacaagctgtgtgtattgaagttttactctgaataagcatggaactaactctaaggcaatttaatctcagaaagttctagttttctggagttccaaaaaaaaaaagttgcccccggccagcctatttaactttctgggaatcatgtgcttcagttccgtgcttcctttaattcagattttttcaagcc

SEQ ID NO: 18279 - DNA, 922 bp, Zea mays
gacacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggacattgggtcccccgggccggccggggaattaccccacctcgctcgcgcaagtcgtcgcacccttccccaggccccagccccagctagccatggcgaccgcgccgcggaggctgctccccgcgctcctcaaggccctagctccagccggcgcgcgcggcctctccaccgagaaggctgtcggcgccgccgccgtcgctgtcgtgggcagccacaccgctaagtggatgcaggacacgagcaagaagtcaccgatggaactgatcaacaaggtacctccgatcaaggttgatggccgcatcgccgtttgtgaaggggctgctgaaggtgttgggcttggccacccaatcgagtatatctgccttgatctggaggcacccaacgtgtgcaaatactgtggcctccgttatgttcaaattcaccatcactaaatagggaagatactggcgtttaccgctgcagaagtttggagctgaggagcttatgcatgcacacttgtttcacttagttctggtactggacttcgcactatgcttggcgtcaaaacattaactttgatgatcatcctcttttcggatgactatttaataatcatgggttaactgtgtgttgattttttttactatagatgaattgtgctcccctatcagaatctatacaagctgtatgtattgaaatcatactctgaaagtctgaatatgaaaagtatggaatttctgagggcaatttaatctcagaagttctaattttctggaaaaaaaaaaaaaaaaaaggccccccggggcc

SEQ ID NO: 18280 - DNA, 2596 bp, Zea mays
attcggctcgagcaaaaccacgcgcgccacgtggccgtggctggcccctcgccgcagcccggcacgccgcccgcccgcccgcgctagccggccatcaacctcatctgaaagaaggagtccacctgacgccgtccgcctcctcgtcaccccgtttcgcttcgcattccttcccctctctccctttattcctatcggcgctcggccaccttcccgcaccaacccacccgcccccgcattcccgggtgcctcgcttcgctttgcgcgcgattcgatccaggctttggttggaggcatggcctcgtcgcccgcgagcagctacgactgctccttcaaggtcctgcttatcggggattcggccgtcggcaagagcagcctcctcgtcagcttcgtctccgccgctcacatcgacgacgacatcgcgccaaccataggggtggattttaaaatcaaatttctcagtgtgggtgggaagaaactaaaactgacaatatgggacactgccggtcaagagaggttcaggacaattaccagctcttactacaggggtgctcatgggattattttagtttatgacgttacaaagagggagagtttcacaaatttggctgatgtgtggaccaaggaaatagagttacactcaacaaataaggaatgcatcaaaatgcttgttggaaataaagtggacaaggatgaggacagaatggtgacaaaagaagaaggtcttgcatttgcacaagaacgtggatgtctctttgtcgagagtagtgctaaaacaagagaaaacgtggaaaaatgttttgaagagcttgcattaaagattctccaggttcccagtctcttggaggaaggttcttcggttgttaagaggaacactctgactctgaaacaaaagcaggagaatgcaaaccgaagtggaggatgctgtcagtaggtcggccagttcttgttgcaagccactcgaggtatcatatatttaggtccttgtaagttgtattgggatgtagatgagttgtatctaaatgcacagcggcagagccaatgcaagtgatgggagaactaaccacttgaggttttggtgtgaattgatctgtacagaagaaaagccttctcttgtttttcctgtttcttgatgtggtaatttgtgcaagtgatgggagaaccaaaaaaaaaaaaaaaaggtgtgaattgatctctacagaagaaaaatcttctctctttttttctgtttcttgatgtggtaatttggtttgttgcttgtaacggatcctgtcagctgatcacttcattgattgtatatgtggaagtgtggtacatagttcatggcttataaagccccactgtcatgtgaagtatatgtcaatatgtacatagttcatggcttgtagagtcccgctgtcatgtgaagtatatgtcaatctggctgatccatattcagaatgtacagttggtctgagttcgagtttttaacatgttcagtccgtgcgagctgtaccattgtatgtgtctacgtggtgaactcgtgattgaaactgaagcattggttagaacaatatttttttcgtgccttagcatagtctattgtagatattttttatttagagctagtttgacaactatgttttaagtaattttcatttttcaagataaattagtttattttttctggaaaaattaagttgccaaacttgcccttaggtttgacatcacattgctctgtccctccacttgaaaagaggatttctttctaggatcacttggttacatgattcaggatagagatcctcgactcaagctcagcaattttatctttgctatcgatcattcagatttagttctcgtaccatttttttgaaaagaacggtaagagtctcagatttagttctcgcaccatttttttttaaagaacggtaagagctcttaccgccgaaatttttattagaagatataaactcagtaaaatacagctaccagagctcgagacaactgaccactccaaagaaaaaacacacagaattgtctggatgctaacagtcacagctaacaagatcatcacgtttgctctggccaactccagagtacacttattttgggagggaggaccgtccacgatagaatgcatcaatagattatctgtaggttaaactagtttaaatttgactaagtttatagtaaataatcgtcgtgttatgacaccgaaatataaacattattaaatgatgaaaaaaattatggatgagtccagaagggcctgacatctggcagccctgactgagtctcatgggaaacgtgtctctacccttccgtgttgagaacaactctccattgtcttgaatgttgcaggtgtctggcttctcaacatcttatcatgcggctgtttggttcagcttcccggcggcttctggccgccagaagcagaagctggagccaaacgcgccgcttctcgcgccgcttctccaccacgcgcttccgctggaagccgtccgcgcacttaacgcctgaagcgcccgtcacttggcttcggtttgaagccgcgcccacttccctagggttgtagcccacgcgacgctcccccgcagccgccaagccatcgcgccgc

SEQ ID NO: 18281 - DNA, 2507 bp, Zea mays
gggacctgagtgcaccgggtccatgggccgagcatgcgcgcgtttgggcagctcgaccgttcggccggtacgagtgtatgaaccgggtccagagacatgaccggaacctctcccgcccgcttccccctcccggggtctgccgcgacgccctcccattgaaaagcagagcggctgccgctctcctcctcctccttcctggacaaaatcatcagctcccgaaatccaaattgaaacagttgcaggcgattctgagctcgggttttgttccggggacggattcctgtgccggcggacgggatgtcaggccctctcgaccgatttgctaggccatgctttgaagggtttgtacataacgatgaaaggaaagagagcagatctgatgcagacaactcagaaggagataagaagactaagattgggtctttcaagaaaaaagcaattaatgcggggaacaaattcaggcattccttgagaaggagaagcaaaaaaaagaccgaaaggggggattccatcaaggacataagggacgttaaagagcttcaagatgttgagacattccgacaatgcttaattgatgaggatttgctgccaccacagcacgatgattatcacatgatgttaaggttcctaaaagcacggaaatttgaagttgagaaagctaagagtatgtggtcagacatgatcaattggaggaaggaattcggagtcgacaaaatagaggaatttgactacaccgagttagatgaagtgacagagtattacccacaattttatcatggagtagataaagagggaagacctgtctacatagaattagtaggaaaagttgatgcaaacaagctaatacaagtgacaaccctagatcggtatgtaaaataccatgtcaaagaatttgagaagtgcttccagatgaaatttccagcttgcaccattgctgctaaaaagcacatagattcgtccactactattttggatgtgcaaggcgtgggtttcaagaacttctcgaaatctgccagagaattaatcacacgattacagaagatcgacagtgataactacccagagacactgtgccggatgtatataattaatgctggccaaggcttcaagatgttatggagcacaataaaatcattcctcgatccaaaaactgcttccaagatccatgttcttgggaataagtatcaacataagttgctcgaaataattgacgagtgtgaactgccagaatttcttggtggcaaatgcaattgtattgaaggttgccaaagatctgacaaaggtccttggaaggatcccaacataataaagagagtcctcaatgacgaggcaaactacggcagacaaattgtgaccatatccagcattgatggaaaaataatacgttatgctaggccagatcacccaactagaaaagggagtgatgcatctgccgagtctggatctgaagtggaagatgtaacatctcctactgcatcaaggaacctgattacacatcctattttgacccctgttcacgaagagtcaaaattgtcgccacatggttccacatttgttgctcatgcttctattgaagaaaacattcctgttgtagacaaggttgtggatgatggatggggtactcccagaggtagtctccaagcttcttcaggttcgttgccctcgagaaacacgcacggcacattcgaaggactgagagttcaagctgtcgcatggctgacgttcttgatcacggcccttttcgccacgctctgttccgtcccgagcaagatggccagaaggatctccagccagtctagcaagcacgacgactaccgcggcgagtatcctcaagaggaggaggagcacaaggaggagttccggcctccgtctcctgccccgtcctacacggagaaggacgtgctctcgtcgatgctgagacggctcggtgagctggagggcagggtgcaggtgctcgagacgaagccgtccgagatgccgtttgagaaggaggagctgctcaacgcagccgtccgccgcgtggacgcgctggaagccgagctgatctccacgaagaaggccctttacgatgctctgatgcgacaggatgagctgctcgcgtacattgacaggcaggagctgatcaagttccgtaaaaagaagttctgcttctaagatctgaccatggagcagctggtcatgtccggagccgttcgtgtatattgttggatcgcggctagtacggtgaatgatgtaatgtgtccatctgtacaagtgtgtaacggaacggtgtaagtatagtaggaaaacaatgtgttagctgtgcggtagcacttgtgtgctagcctaaattgtaatcttgcaagtcggtgcatagctgattgcgcaccaatacgtagttatgaatggaatcgcactcgtgttcgtataaaataaaataaattagcagcgccaaatgtttaaaaaaaaaaaaaaaaaaaaaaaaaagaaaaatgaacaaaaaaacaacaaaaaataaaaaaaaaaaa

SEQ ID NO: 18282 - DNA, 2358 bp, Zea mays
ccggccgggaccgccacccattgaaaagcagagcggcacacggccccagccccccgctctcggctctcctcgtggacaaaaccaccggctcccgatatccaaattggaacaggggattctgaacttggggtttgttccggggaccgattctggcatcggcagacgggatgtcagcccccctcgaccgacttgctaggccatgttttgaagggtttgtacataacgatgaaaggaaagagagcagatctgatgcagacaactcagaaggagataagaagactaagatcggatctttcaagaaaaaagcaattaacgcggggaacaaattcaggcattccctgagaaggagaagcaaaaagaagaccgaaaggggggattccatcaaggatataagggacattaaagaacttcaagatgttgagacatttcgacaatgcttaattgacgaggatttgctgccgccacagcatgacgattatcacatgatgttaaggttcctaaaagcacggaaatttgatgttgagaaagctaagaatatgtggtcagacatgcttaaatggaggaaggaattcggggttgacaaaatagaggaatttgagtacgccgagttagatgaagttaaaaagtattacccacaattttatcatggggtagataaagagggaagacctgtctacatagaattaatagggaaagttgatgcgaacaagctagtacaagtgacaactctagatcggtatgtgaaataccatgtcaaggaatttgagaggtgcttccagatgagatttcctgcttgctccattgctgcaaaaaagcacatagattcgtcgactatctatttttgatgtggccaaggcgtgggtttcaagaacttctcaaaatctgccagggaattattcacacgattacagaagatcgacaacgataactacccagagacattgtgccagatgtatataattaatgcaggccaacgctgcgtgccgcgaggccgccccataaaatcattccttgatccaaaaactgcttccaagattcatgggttcttgggaataagtatcaacataagttgctcgaaataattgacgagtgtgaattgccagaatttcttggtggcaaatgcaagtgtattgaaggttgcgaaagatctgacaaaggtccttggaaggatcccaacataataaagagagtcctcaatggcgaggcgaactatggcaggcaaattgtgaccatatccagcactgatggaaggatagtcagttatgcttggccagtgcacccaaatagaaaaggcagtgatgcatctgccgagtctgggtctgtcagctacgtaggccccccccccactgcatcaaagaacctgattacacatcctattttgacccctgttcacgaggagtcaaaattgtcggcacatggttcttcatctgttgttcatgcttctattggagaaaacattcctgttgtggacaagattgttgatgatggatatggtagtcccagatctagtccacaagctgcttcttcaggttctttgtcccagaagaatttgcatggcacatttgaaggactcagagctcaaactatcacatggctgacattcttgatgatgaccctttttgccatgctttgttctgtcccaagcaagatggctagaaggatctccaaccaatctggtaagcatgacgactatcatgttgagtatcctcaagagcaggagtgcaaggaggagtttcgacctccatctcctgccccatcctacacagaaaatgatgtgatttcatcgatgctgagacggctgggtgagttggaggacaaggtgcaggtgcttgaaacgaagccgtctgagatgccgtttgaaaaggaagaattgctcaatgcagccgtccgccgtgtggatgcattggaagctgagctgatttccacaaagaaagccctttatgatgctttgatgcgacaggatgagctactcgcgtacattgataggcaggagctgatcaaatttcgtaaaaagaagttctgcttctaagatttgaccgtggagcagctgttcatgtccggagccgtttatgtgtatattggattgcggctaatatgtagtagaatgtaatgtgtccatctttagaagtgtgtaaagtatagtaggaaagaaaataggtgcgttgtggtgtgcgcctctcctccccgaggtgaatgtgtggtctagcacttgtgtgctaccctaaattgtaatcttggaagttggtgtatagctgattgcgtgctaatacgtagttgtaaatgaaatcgcatgtgctcgtgtttacattgaaaaactaaatatagcagcccccaaaaataaaaccggttatttggttt

SEQ ID NO: 18283 - DNA, 1799 bp, Zea mays
cattgggcgcctcctggccgccaggtcatgaccctcccccccacccccagtggcggtggcggcagacccgccgggcagctggaccgagccgatcggtccggtcccatctcagcagcccgcggcgcctgcccaccctctcagccaaaagccccctgcacccagtccatccaaacctgtgtccgcagctctcgccagccagtcgccgccacgagaggggatgtcgacggcgagcggcgtatccgctggctccgtgctccagctgccctccttgcgggtgccggccaagagatttctgcctcggagaacagccgctggtgctccggctggtaacttttttgtgaagagagatattatatataatagaagctaccaccaattcttaccattgaagcatataggaggcttgcaagcagcagtacttccagttactccaccactattagatggtgaggggaaaaagaaacaaatggctgaagagtatgggttcacacaaattggagatgaactaccagatgatattactcttaaagatgtcatggatactttacctaaagaggtatttgaaatcaatgatgtgaaggcttggacatcagttttgatatcagttacttcttatgcgctgggtttatatttcattgctaagtctccatggtatcttcttcccttggcttgggcttggacaggcacagcagtgactgggttttttgtgataggtcatgattgtgctcacaaatcattttcaaggaataagttggttgaagatgttgttggaaccttggctttcatgccattgatatatccttatgaaccgtggagatttaagcatgaccgacatcatgccaagacaaacatgttgatagaagatactgcatggcaacctgtttggcaaaaggaaattgaatcatcaccttttctaaggaaggcaattatttttggctatggccctatcaggccatggatgtctattgctcactggttgatttggcactttgatctaaaaaaattcagaccaaatgaagttccaagggttaagataagcttagcatgtgtgtttgcattcatggcgattggatggcccttgatcattctcaaatcaggactagctggatggtttaagttctggttcatgccatggatggtttatcatttttggatgagcacttttacaatggtacatcacacagctcctcatataccattcaagtcatctgaagaatggaatgctgcacaagctcaattaaacggcacagttcattgtaactatcctcaatggatagagatcctttgccatgacataaatgtgcatgtcccacaccatatttctccaagaattccaagctataaccttcgtgctgcttatgattccatcaaacagaactggggcaagtatgtcaatgaagccaactggaattggcgattgatgaagacgatactgacgagatgccatgtgtacgacaaggagagatactatgttccgttcgatgagctcgcgcctcaggagtcccaaccaatcaaattccttaggaagttcatgccagattacgcatgatgccatcatcacagctgttgactagttgagattattcagtattgtcggcacaggtggacagtcacattttcagtgattacgcatgtcccaaaattttgactggaatactccatgttacactattattcgtgcagtaggaaagcacgtagcgtaccaaaatatttatacttcaggaaatagacaaagacattggtgatgaaaaaaaaaaaaaaaatgggggcggccaaaaaaaaaaaaaaaaaaagcggcc

SEQ ID NO: 18284 - DNA, 2117 bp, Zea mays
aacgaacggaggctcccgagcccggccgagcagagcaagaagctttacagtgaacgagtgagtatgtgcggcatacttgctgtgctcgggtgcgccgacgaggccaagggcagcagcaagaggtcccgggtgctggagctgtcgcggcggctgaagcaccggggccccgactggagcggcctccggcaggtgggcgactgctacctctctcaccagcgcctcgccatcatcgacccggcctctggcgaccagcccctctacaacgaggaccagtcggtggtcgtcgccgtcaacggcgagatctacaaccacctggacctcaggagccgcctcgccggcgcaggccacagcttcaggaccggcagcgactgcgaggtcatcgcgcacctgtacgaggagcatggagaagagttcgtggacatgctggacggcgtcttctccttcgtgctgctggacactcgccatggcgaccgcgcgggcagcagcttcttcatggctgctcgcgacgccatcggtgtgacgcccctctacatcggatggggagtcgatgggtcggtgtggatttcgtcggagatgaaggccctgcacgacgagtgtgagcacttcgagatcttccctccggggcatctctactccagcaacaccggcggattcagcaggtggtacaaccctccttggtacgacgacgacgacgacgaggaggccgtcgtcaccccctccgtcccctacgacccgctggcgctaaggaaggcgttcgagaaggccgtggtgaagcggctgatgacagacgtcccgttcggcgtcctgctctccggcgggctggactcgtcgctggtggcgaccgtcgccgtgcgccacctcgcccggacagaggccgccaggcgctggggcaccaagctccactccttctgcgtgggcctggaggggtcccctgacctcaaggcggccagggaggtggcggagtacctgggcaccctgcaccatgagttccacttcactgttcaggacggcatcgacgccatcgaggacgtgatctaccacacggagacgtacgacgtcaccacgatcagggcgagcacgcccatgttcctcatgtcgcgcaagatcaagtcgctcggggtcaagatggtcatctccggcgagggctccgacgagctcttcggaggctacctctacttccacaaggcgcccaacaaggaggagttgcaccgagagacgtgtaggaaggttaaggctctgcatcagtacgactgcctgagagccaacaaggcgacatcagcttggggcctggaggctcgcgtcccgttcctggacaaggagttcatcaatgcggccatgagcatcgatcctgagtggaagatggtccagcctgatcttggaaggattgagaagtgggtgctgaggaaggcattcgacgacgaggagcagccattcctgcccaagcatatcctctacagacagaaggagcagttcagtgacggcgttgggtacagctggatcgatggcctgaaggctcatgcaacatcaaatgtgactgacaagatgctgtcaaatgcaaagttcatcttcccacacaacactccgaccaccaaggaggcctactactacaggatggtcttcgagaggttcttcccacagaaatctgctatcctgacggtacctggtgggccaagtgtggcgtgcagcacagccaaggccatcgagtgggacgcacaatggtcaggaaatctggacccctcgggaagggcggcactgggcgtccatctcgccgcctacgaacaccaacatgatcccgagcatgtcccggcggccattgcagcaggaagcggcaagaagccaaggacgattagggtggcaccgcctggcgttgccatcgagggatagacgacgacgcatatataagcttcctacttttgtttcaatgcatgcatgctatgtatctgtgtccaccggctgtctagccttatcatcatcactgtctgcaacaaattaataatcaagtggtatggggtacctacgtttaatgtaaaaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 18285 - DNA, 769 bp, Zea mays
  misc_feature (22)..(22): n is a, c, g, or t
  misc_feature (56)..(56): n is a, c, g, or t
gtcgacccagcgtcctgtcagnaagaacattcagtgacggcgtcgggtacagctgngatcgatggcctgaaggctcatgcaacatcaaatgtgactgacaagatgctgtcgaatgtaaagtttatcttcccacacaatactccgaccaccaaggaggcctactactacaggatgatcttcgagaggttcttcccacagaaatctgctatcctgacggtacctggcgggccaagtgtggcgtgcagcacaaccaaggccatcgagtgggatgcacagtggtcagggaacctggacccctcggggagggcggcgctgggtgtccatctcgccgcctacgaacaccaacatgatcccgagcatgtcccggcggccattgcagcaggaagcggcaagaagccaaggacgatcagggtggcgtcgcctggcgttgccattgagggatagacgacgatgcatatataagcttcctacttttgtttcgatgcatgcatgcatgcatgctgtgtatctgtgtccatcggctgtctagcattatcatcatcactatctgaaacaaattaatcatcaagtggtaaggggtacctacgtttaatgtatacggagtattgtattgcttgtgtgtggtatgcttaggttggccatgactaagggtacaagtattccatatcgggtgtttctatgggttgaggtgcccataaagggctctctatcccatgggcatgtttgtaatagtttttcttaaagagcttttctacaaatttggattctt

SEQ ID NO: 18286 - DNA, 1706 bp, Zea mays
aatatcgatccatggaagatgctaaatcccgtcttgaaaggaattggcaaaagctaaaaaggaggttgaagtatgaatgcacaatatatttacaatgaaaagcgactagattctctgaaaaccgcttcacaacctaaagctgacgagcttcgcagaatgcaagagctggatggcatcatatctagtgagcaagctgaactagataggctcacaaagtgttccagcaaacttaaagatcaggcttcggaacttcaacagaaagttgaaaatgctggagggaagaagctgaaggaccagaagacaaaagttggcaacatccaatctgaacttgacaaaacaagttcagaaatcaacagacacaaagttaacgtaacttcaggtgagaagttggtgaaaaggttaaccaagggcattgaggagtccaagaaagatagagaaaaactttctgctgaaacagagaagatgatgtctatgttcaaagagattgagaagaaagcgtttgttgttcaggaagagtataagaaaacacaggagatgatagacaaccataaagttgagcttgacaaaactaaggaagaatacaccaaactaaaaaaagcaatggatgaactgagagccacagaggttgacgctgagtacaaattgcaagatacaaaaaagcttgccaaggagtgggaaatgaaggtgaaaacattcaagaaaaggcttgatgaaattcagataaatgttgttaaacacatggatcaaatccaaaaggatgctgttgatcctgagaaactcaaagcgactctaggtgatgagcaactaaatgacacatatgacatgaaaagggcaatggagatggtagcattgttagaggcccagattaaagatttgaacccaaatctggattccatagcagagtaccgcacaaaggcttgcttgtacggtgagcgtgttgatgagttaaatgctaccactcaagaacgtgatgatcttaaaaagttgtacgatgggttaaggaagagaaggctggatgaattcatggctggattcaacataatatctttgaaactgaaggagatgtaccagatgattactcttggaggtgatgctgaactggaacttgttgattccttggacccattttcagaaggtgttgttttcagtgtgaggcctccaaagaaaagctggaaaaatattgccaatttatctggtggtgagaagacacttagttcgctggctttggtgtttgctcttcaccactataaacctactcctttatatgttatggatgagattgatgctgcgttggactttaagaacgtatcaattgtgggacactatgtgaaagataggaccaaagatgcgcaattcatcattataagtctgaggaacaacatgtttgaactagccgacaggttggttggtatttacaagacggacaattgcaccaagagcataacgatcaacccaggaagctttgccgagagcatgaaagtagtgtagcgtgctcaccatggatccttccgctaaatgtaacctccctagtgtcctaagcgaaactaaccactctggtgtccttcagctaaatgtaaccgttgtagtgtcctcgtggaaccgaggttcctcgggcattgtggtttgccgtgcactctataaagcactatgctatgattaagtccggcttgacaaatgggtatttccacttaggaagcgggtaggac

SEQ ID NO: 18287 - DNA, 1537 bp, Zea mays
gcgaagctcggaattcggctcgtggttagccgagagctcctctgctcctctcgtgtctggccgaacaggcagagcgaccagtctccagagcgctccccatggcgtcaggagctgcggcggcccctgtcgttcagactgtggtgctgaaggttgccatccactgccatggctgcaagaagaaggtccggaaggtgctcaggggcatcgaaggcgtgcaggacgtgacggtggacgcctcgcagcacaaggtgactgtgacgggcaccgtggacgccgacacgctcatcaagaggctgtacaagtccggcaagaagggagtgccctggcagtgtcacccgcccgccaagaacagcgagcccgcgccggaggccccgccggctccgcagcctgccggcgacggcggaaggatccctgctgctgctgctgctgtggccgcggcggacaagaagtcggaggaggcggtgaaggagccgcagggcgagagctccgaggaggagaagaagaagccggagcaggaggacggggccgcagagaagaagcagcccgaagcagagtcgtcaaaggaggtggagaaagtggaggcgaagacggacggcggtgacagcgagggagctgagacgaagcacgccaagggcgcagcagagccggcaaaggaagcccctgccgctgccggcgctgccaatgacgaggacgaggcaaagaagagcgacaaggccaaggacgccggcacggcggagcctgccgccgtgacgacggagaggtcccttcctttggcgccggcgccaaagcacgcgtacgagcatgagtaccggccgccctactacgtcgcgcccgcgcagccggtgctgagctaccacgcggcgcagcgcagctcgagcgtgtcgcacttcgcgccgcaggcgcagccggcgtactccacgcaacaggcgcacccgcatcaagcgtactactccgcgcagccgcagccggggaagcagtggtcgccgtcgtacctgtacatgccgtacccgcacgccgcggcgccggagccttactaccagcaggactactacggcccgcccgggatgcacgcgtcgcctatgcacgactcgtcatgtgagaggagagcggatcggcgcggcccgggccgccgtggccagcagcagcagcagcagcaggtagttggggggaggcggcgccgctagctaccgcaatagagaaccctctctctctctgtggttgtaagtagagtagcctgttgctggcctcttccacttagtatagaggtcaaacctctctccatgcacgacagagctttttcttcgtttccttttaatatcttttttactgtttctaatgataatgagatacgcacgcgcgtttaccctgtagtgatgttctccgagtatacgccccccgcattcttcaagaaattttgttctatgggctagcaccaatacatatacgtatatgtctagctagtagttttctctgtctagagaaaggctaatgcgtattttgtatcgccttattagtatatagtactccggcctgaccg

SEQ ID NO: 18288 - DNA, 1921 bp, Zea mays
ggccggcccattgggtacctcgaggccggccgggccataacaaagccacgttagccgagagctcctctgctcctctcgtgtctggccgaacaggcagagcgaccagtctcaagagcgctccccatggcgtcaggagatgcggcggcccctgtcgttcagactgtggtgctgaaggttgccatccactgccatggctgcaagaagaaggtccggaaggtgctcaggggcatcgaaggcgtgcaggacgtgacggtggacgcctcgcagcacaaagtgactgtgacgggcaccgtggacgccgacacgctcatcaagaggctgtacaagtccggcaagaagggagtgccctggcagtgtcacccgcccgccaagaacagcgagcccgcgccggaggccccgccggctccgcagcctgccggcgacggcggcaaggatgctgctgctgctgctgctgtggccgcggcggacaagaagtcggaggaggcggtgaaggagccgcagggcgagagctccgaggaggaggagaagaagaagaagaagccggagcaggagcaggaggacggggccgcagagaagaagcagcccgaagcagagtcgtcaaaggaggtggagaaagtggaggcgaagacggacggcggtgacagcgagggagctgagacgaagcagtccaagggcgcagcagcagagccggcaaaggaagcccctgccgctgccggcgctgccaatgacgaggacgaggcaaagaagagcgacaaggccaaggacgccggcacggcggagcctgccgctgtgacgacggagaggtcccttcctttggcgccggcgccggcgccaaagcacgcgtacgagcatgagtaccggccgccctactacgccgcgcccgcgcagccggtgctgagctaccacgcggcgcagcgcagctcgagcgtgtcgcacttcgcgccgcaggcgcagccggcgtactccacgcaacaggcgcacccgcatcaagcgtactactccgcgcagcagccacagccgcagcaggggaagcagtggtcgccgtcgtacctgtacatgccgtacccgcacgccgcggcgccggagccttactaccagcaggactactacggcccgcccgggatgcacgcgtcgcctatgcacgactcgtcgtaccgcatcttcgacgacgagaaccccaactcctgcagcgtcatgtgagaggagagcggatcggcgcggcccgggccgccgtggccagcagcagcaggtagttggggggaggcggcgccggtaccgcaatagccaatagagaaccctctctctctgtctctctctctctgtggttgtaagtagagtagcctgttgctttgctggcctcttccacttagtatagaggtcaaacctctctccatgcacgagcacgacagagctttttcttcgtttccttttaatatcttttttttactgtttctaatgataatgagatacgcacgcgcgtttacctgtagtgatgttcaccgcgtctacgccggccggctgcttcaagaaattttgtactatgggctatacggcaaatacatatacataacagactatacatgtacgactggtagacagagaaaggcaaaggcgtatttgtatctctttggtatgtactcctgaccgagaaagaagagagaagagaagcaaaggcgtgtttgcagagaatatccttcaccttctgctcgtcagttgaaacatcagtctacgtacgttcgacctgctgccattgttttttttgaaaggaacttaaaaaattgggtcctttggaccctgccgtaagctggatgagtttacaagtgaggtggctgtggtttgtttggaattcgctttctgtggcaaagtctgttgctcgctccgtcctctcatagagtagtagtatctgtgggcaaaacccatg

SEQ ID NO: 18289 - DNA, 788 bp, Zea mays
  misc_feature (609)..(609): n is a, c, g, or t
gtgcggcgccctcgagcccgccgggcctccgaagttgcaacggccagaaagccacgttagcctagccgagctcctctgctcctctcgtggccgaacaggcagagcgaccagtctccagagcgctccccatggcgtcaggagctgcggcccctgtcgttcagaccctggtgctgaaggtggccatccactgccatggctgcaagaagaaggtccggaaggtgctcaggagcgtcgaaggcgtgcagaacgtgacggtggacgcctcgcagaacaaggtgactgtggtcggcaccgtggacgccgacacgctcatccagaggttgtacaagtccggcaagaagggagagccctggcagtgccacccgcccatcaagaagagcgagcccgcgccggaggccccgccgactccgcagcctgccggtggcggcggcaaggacgccgctactgctgcggccgcggtggacaagaagccggaggagccggtgaagaagccgcagggcgacagctccgaggagaagaagaagaagccggaggaggcggcgaaggagccgcagagcgagaagaagaagccggaggaggcggcgaaggagccgcagagcgagaagaagnaagccggaggaggtggtgaaggcgccgcagagcgagaaggaggagccgcagagcgagaagaagaagccggatgaggcggccgagagctccaaggagaaggagaagaaaccagaggagccagtgaaggagccaaaggccgagagctccaaggaggaaaaaaaaaaaaaaaaggcccctaa

SEQ ID NO: 18290 - DNA, 880 bp, Zea mays
cgttagccgagagctcctctgctcctctcgtgtctggccgaacaggcagagcgaccagtctccagagcgctccccatggcgtcaggagctgcggcggcccctgtcgttcagactgtggtgctgaaggttgccatccactgccatggctgcaagaagaaggtccggaaggtgctcaggggcatcgaaggcgtgcaggacgtgacggtggacgcctcgcagcacaaggtgactgtgacgggcaccgtggacgccgacacgctcatcaagaggctgtacaagtccggcaagaagggagtgccctggcagtgtcacccgcccgccaagaacagcgagcccgcgccggaggccccgccggctccgcagcctgccggcagcagcagcagcaggtagttggggggaggcggcgccgctagctaccgcaatagagaaccctctctctctctgtggttgtaagtagagtagcctgttgctggcctcttccacttagtatagaggtcaaacctctctccatgcacgacagagctttttcttcgtttccttttaatatcttttttactgtttctaatgataatgagatacgcacgcgcgtttacctgtagtgatgttcaccgcgtctacgcccgccggctacttcaagaaattttgtactatgggctaggacaaatagatatacgtatatggctagctagtagttttctctgtctagagaaaggcaaatgcgtattttgtatctccttattagtatatattactcctgcctgaccgaaaaaaaaaaaaaaaaggcccgccgccggctactccgctcatcactgatcagtcttcgacctgccatttggtttttttaaaacaacttagaaaattgggtctttggacctgccgt

SEQ ID NO: 18291 - DNA, 1364 bp, Zea mays
gggcctcccgcccggccgggataacaaagcccgttagccgagagctcctctgctcctctcgtgtctggccgaacaggcagagcgaccagtctcaagagcgctccccatggcgtcaggagatgcggcggcccctgtcgttcagactgtggtgctgaaggttgccatccactgccatggctgcaagaagaaggtccggaaggtgctcaggggcatcgaaggcgtgcaggacgtgacggtggacgcctcgcagcacaaggtgactgtgacgggcaccgtggacgccgacacgctcatcaagaggctgtacaagtccggcaagaagggagtgccctggcagtgtcacccgcccgccaagaacagcgagcccgcgccggaggccccgccggctccgctgcctgccggcgacggcggcaaggatgctgctgctgctgtggccgcggcggacaagaagtcggaggaggcggtgaaggagccgcagggcgagagctccgaggaggagaagaagaagaagccggggcaggagcaggaggacggggccgcagagaagaagcagcccgaagcagagtcgtcaaaggaggtggagaaagtagtggaggcgaagacggacggcggtgacagcgagggagctgagacgaagcaggccaagggcgcagcagcagagccggcaaaggaagcccctgccgctgccggcgctgccaatgacgaggacgaggcaaagaagagcgacaaggccaaggacgccggcacggcggagcctgccgctgtgacgacggagaggtccctgcctttggcgccggcgccggcgccaaagcacgcgtacgagcatgagtaccggccgccctactacgccgcgcccgcgcagccggtgctgagctaccacgcggctcagcgcagctcgagcgtgtcgcacttcgcgccgcaggcgcagccggcgtactccacgcaacaggcgcacccgcatcaagcgtactactccgcgcagcagccacagccgcatccgcagccggggaagcagtggtcgccgtcgtacctgtacatgccgtacccgcacgccgcggcgccggagccttactaccagcaggactactacggcccgcccgggatgcacgcgtcgcctatgcacgactcgtcgtaccgcatcttcgacgacgagaaccccaactcctgcagcgtcatgtgagaggagagcggatcggcgcggcccgggccgccgtggccagcagcagcagcagcagcaggtagttgggggggaggcggcgccgctagctaccgcaatagagaaccctctctctctctgtggttgtaagtagagtagcctgttgctggcctcttccacttagtatagaggtcaaacctctctccat

SEQ ID NO: 18292 - DNA, 1775 bp, Zea mays
cctggccccggaaatacccggaataacaaagccacgttagccgagagctcctctgctcctctcgtgtctggccgaacaggcagagcgaccagtctccagagcgctccccatggcgtcaggagctgcggcggcccctgtcgttcagactgtggtgctgaaggttgccatccactgccatggctgcaagaagaaggtccggaaggtgctcaggggcatcgaaggcgtgcaggacgtgacggtggacgcctcgcagcacaaggtgactgtgacgggcaccgtggacgccgacacgctcatcaagaggctgtacaagtccggcaagaagggagtgccctggcagtgtcacccgcccgccaagaacagcgagcccgcgccggaggccccgccggctccgcagcctgccggcgacggcggcaaggatgctgctgctgtggccgcggcggacaagaagtcggaggaggcggtgaaggagccgcagggcgagagctccgaggaggagaagaagaagaagccggagcaggagcaggaggacggggccgcagagaagaagcagcccgaagcagagtcaaaggaggtggagaaagtggaggcgaagacggacggcggtgacagcgagggagctgagacgaagcaggccaagggcgcagcagcagagccggcaaaggaagcccctgccggcgctgccaatgacgaggacgaggcaaagaagagcgacaaggccaaggacgccggcacggcggagcctgccgccgtgacgacggagaggtccctgcctttggcgccggcgccaaagcacgcgtacgagcatgagtaccggccgccctactacgccgcgcccgcgcagccggtgctgagctaccacgcggcgcagcgcagctcgagcgtgtcgcacttcgcgccgcaggcgcagccggcgtactccacgcaacaggcgcacccgcatcaagcgtactactccgcgcagccgcagccggggaagcagtggtcgccgtcgtacctgtacatgccgtacccgcacgccgcggcgccggagccttactaccagcaggactactacggcccgcccgggatgcacgcgtcgcctatgcacgactcgtcgtaccgcatcttcgacgacgagaaccccaactcctgcagcgtcatgtgagaggagagcggatcggcgcggcccgggccgccgtggccagcagcagcagcagcagcaggtagttggggggaggcggcgccgctagctaccgcaatagagaaccctctctctctctgtggttgtaagtagagtagcctgttgctggcctcttccacttagtatagaggtcaaacctctctccatgcacgacagagctttttcttcgtttccttttaatatcttttttactgtttctaatgataatgagatacgcacgcgcgtttacctgtagtgatgttcaccgcgtctacgcccgccggctacttcaagaaattttgtactatgggctaggacaaatagatatacgtatatggctagctagtagttttctctgtctagagaaaggcaaatgcgtattttgtatctccttattagtatatattactcctgcctgaccgaacacccttccacttctacgccgcagttgaaacatcagtgatcactgatcagtcttcgacctgccatttggtttttttaaaacaacttagaaaattgggtctttggacctgccgtaagctggatgagtttacaagtgaggtgggtgtggtttgtttggaattcgctttctgtgccaaaatctgttgctcgc

SEQ ID NO: 18293 - DNA, 5421 bp, Zea mays
  misc_feature (764)..(764): n is a, c, g, or t
aatagcagaccacaatttcattggcaagtcaaaattgacgcaaactttgtcattagtctaaaaaaatagatcgagacacacacaagttttaaaaaaagagtaacaaaatcttgtcagaatcagggtccccatcaaaatatctggcatagagtcttcagactctaacccaattccagactacaaaccaaacaattccgtaaagttggttgaatgggcctctggcggctggcgcttcatggttgcttcaaccaacacctgaaacagcacaagcttcacctactttggctcttgttgttactcagactcaagtcatcacaaacggtgctgatcaacttaaaaaaactaagaagagggagaaatcacacatcataggacccaggtttcgatgactgggaatcacacatcagatatggttaaatcatatcttttgtgatatggttaaatatagaaacatttgacttggccaaatctaatgcgacatgcaaaacaatagagggtttagggtcttgctggaagcttagaatcaaacattgaatagtgactattcaattttggtctctgttttagtatatattatatatatggtagttacaccgggatgagaccatctaaaattgggagtggttccctgatgtttccgattgcctttaaaaaaacaggctcattttattttccatcaatggcaggtgtgttgccgaaatatttccactctgagtggtcagtagctcagttcaggctccatgagggggagcagtacattgttncatttggacatgagaagaataccgtgtcagttgttggtatggatggaaggtgagaacatggaatcgaacattgattttcatcaacagatataaacacaatagttgaagatatatgtttgaatctaaatatttcttcttcccccaatggttgtgcagcttctacagatgtcaatttgacccagttaatggaggagaaatgctgcagctggagtgctacagttttctaaaaccgtcagatcaaccgtagcgacacacaattatcatctatcaattgatgccctcctccccgtaccaagaactgtacagtatctttgtgcgccctcgttggccggaggtctaagctaaatatgataatattttctttgtgtatatatatatttcttgttggctctgggtgatgtatgttctgtctgtggaagggctaaaacacccatctgcagatggacgttatagaacgtgtcgttattatttatgaatggattgaataaaatagcctaacaatgtttctccaatgttatttttgccctgtttggatctcatctggtgaataaattagctgtctgctcgtacggcaactaccatgctctttgattgcgttgtctatcgggtcaggatgtcacgagcacaatgacacaaggttaggttttacagtgtgcaatattctacacaaacatacaaggttataagcctcaagtgaggagccgaaggctaagacgattgctagtttgctagtagcttaaaagagtctcttgtctggtggttaattgtgtgaaagtgaaaatgaatgctgttctactcctaccacctccttttaaactctaaaaggatgttagtgttacattcatactcttaaaaaggtgttaatgtatgccctcaagtgttctgcaggctatgccttcgctcgccttgtaatgtcgcccatctactaattttactatacagatatcagttgagaacttccgttgaatgaaaggtatcagctgagaactaaacatccaaatgatcatcatccgaattacacgaggatcagatgaatcagtctgcatgtccacatgctgaacatatctacagtaatgctacattgctacccaatgacctgtgattggtcttatggagaagaaaagagaagagaaggaagaagaagaaccgtacagcaggaaaatctctctactagaggtagctcagctcagcacgtcagcaacgattagcaaaagagatgttcaagtgtaattctacctccctgcaaaaaagccgcttttagttggcatcatcaccaaaatgaaatctcagctctactcatggtgagctctggaaggaagacgacgacgagtgtcgacgactaggactagcactgctgaaccatcgaccgtcagctccatgcgcttgctggtttctctttcacaaccatcgttctctgtatggcggttgcttactgaaccagcgcgggtatgaagatctccctccgcacttctcccgcagttgacgactccacggggacacttccctctcctgcctcctgcaagcaccttcacctcgctctcatggcctcagagcctatgcatcagtgcgtcgaattccagttccagtagatgtttgctgagcggatctttgttccttctccagtcactgatcccgtttgatcccgtttgtgtgtgccccgtttcaggttgtggtgctgagagtgtccattcactgccaaggatgcaagaagaaggtgaagaaagtgatccagagcatcagtggtacgctctgaattgcgaactttattggaacaggtctttcagtttaccagcacgtagcttcgcattgtcaaaggcccggcctgcacaagttcgtgacgcttcaaaaaatttatcggtgaagattaaatttgcatcagtgtccagtctatcacaattttatcggtgagtacatgcgaagctacgtgcatccttggcatcacaacctgaagcagggcttacttcttttttaatatactctactgtcggttccatttctgttaatcttgagacacaatggtcggaatacattattttcaattgaaaagcaaattaacagaagccgtcttcataaaacgatcgtctttgcgctaatccgtttggcagagactcaagctgtctctagcaaatatatagatcatctgtcagtggttgacatgctgcttgctgcccacctctaaaaatggattttgaccacctgtgctaatgaacgaaactggattctgtctttaaagaaagaaagaaagaaagaaagaaacccctgagactgaaacgccgctgcagcagcctgcagatctgctgctgggcagatgagacacacaaactagcaaaggctagccgtctgtggagatagcaggtgagctggagcatacatccaagtaagatattgtaggaaacgggacgttggcacgtgctctcggcccccgacgtgccagaaacagccggcgcagctgtgtggcctcatgtgcggcggcgcgcgcgcggacaaggcgcctccccgtatattaaatgccgcgcagcaggcgtcccatgttgccatgtcgtcgtcacggatcgagatcatgatccagcgagcgagcgagccagcacttcacttccattagcagttagtctcgggctcgttggccgtctttgctggggcagctacctagcagacgcatggcacacgtcgaccggccacggagccgcgccgtgctcgcggtcgccgtcgccgtcgccgccgcggcgctcctcctttttgccgcagcgggcgtcccgcgtgcggccggccagacgacgacgacagcggtggtggatctggacagctgggccgatcgcggcgcggcgtgcacgggcgcggtggaggcgtgcggcggcatcggcgcgacggccaggagggagctgggttccggcgggtacatcagctacgacgccatgagccgcgggcgcgtgccgtgctcgtaccgcggcgcgtcctactacaactgccggccgggcgcgccggccaacccttactcccgcggctgctccgccatcacccgctgcagaggctagggcagcgagcgatgaccatccccctccccctccccccggccacgcatatgatctgctctggtggttttgtgttctgtagttagctgggcttttgagaggttggttgttgatcagctgacatagagcaagctgcatcttgctctatgattttgtaattggcattggaaaaagggaacatgtgtggatcaagaactcctggtccattattatattcgtgtgcattgtctttcatgctaatcggtctgcgaacgaaattgtgaaatctgtaaatgaggaaaatggagtggaaaattgttgcagtaggatggtaagtaagaagagagattcgattcattcagatggagcctgaggtgagtggtcctgaactcctgatattgtccggttttatttttctggaatccaatcagttagcgcctttttcccggttcagatcagtcatcggagagtggagaccggagacaggaggtgttcgattttttagtgactaatttttagttccaccattttattcgattttagtctttaatttaccaaatagtgaaactaaaatctttagagtctagaatagtcaggtcaggtttcgttttgggcctctaatcaggtggggtcttcgttgcgtgttgggctgaaaaaggcgccaaaccaaagccgttccttcgctttgtactaaaccagcccaacccacgtgcagttgaaatagcctttttcagcccagctcatgtgttccacatatgggctcagatcatagtcgtggacgtgggttgggccactggcgatgccacgctgttgttgctgttgttttgaataggaaaagggatgccagggtggcactttgttgtccgctaaacgcggcagctaatcacaattcacaagcctataaaaagcttcttcgctcgagattctctagtcaagccgaacaagatccaaaactcatggcctgtacagtactgtatataatagtgtatgtagacgtatacgtatctgccttgcatgttagtgctactcttctaccgacagtgcgtgaagctcgtgcaccattattccttgtgtagaccaagcgtgaactacggcaccatgcattcagtaacaatttaataaagaagcagctgggtgtgcatcggtcgcgtgcacctcgtcagcacgccatactatcactactaataaataattttgctagacaatagatttgaattaatgtgtacaaaaataggtacatacacactacccgcaatcaagagaactaagactagagaaccatggatcataaccactagtcatgtagtacagtaaaaaagcatggatagtagtggtacgtcctcacatatgaacaatagcaatatattcacttgtgctcctcatatcggtattgttgatcaacaccaccaccataacaacatcgtcactatggtatctacacgtgtgggaaggaaaaactacgataccgatttgctaccaacatgtacatagtgagaggaaggatcgtaaccatagatagagagagaacacaacaagtcaacaactatgatgtatcttttagttctagcatgttaaccccttcctatacacaaatccttgctagtgaatttttactataaaagttcattaacattcttataaatcatgca

SEQ ID NO: 18294 - DNA, 2334 bp, Zea mays
ggcgaaaaaaaataaaaaaaattttaaaagcccatattttaaatatattatatgctaatcaaatatttcaaaaaattatgatttttcactaagacaagacaatcaaacttgaggaaaaatagtcaaaataatttataaattagtacggggagagtagattttagaacgagattctaaaaatgaggcaacaaacaaacatggcctcttgtattctccgtatggatgttctattgtggtgtggagtccaaaggtccttgtgccttttctcttatttttttttgctgtttaatgtattttttagaactgctgtggtaagtttataatttcttgcaaatatttgtatattttaaaaccatactcattttgaatgaaaaacgtgtccctcttgatagctatgaaaaaattgcccaaaaagatcagaattcagaagcgagcgtgtagaacatccctgaatcagaaaatgtttacgcccacacaatctgagccggtcacggcaacccgtacgccacgaaaggtaggcgctgccttccccgctttgcatccccgagccgaggacgaccaatggcaacaccgtgaataaccacgatctccagccccatttaccctaccccaccctgacctttatcactacatcccgcaccgccccccagcagccccgtgacacggcgcaaccctacgtccctacctaccttaccgttctgccctcgtctcgcccatggagccgcccgcctcctcgccggcaccgccaaaccctaacccagtccccgacgatcggccgctgcagcagcaggtggaagaggcgcgggcgccggagccggagccggagccggagccggagcgggagacgtcgccgacgtccctgaccacctcaatcgatcccaccccttccggcggcgaggagagcgagagcgatgactcctcgtcagtctcgtcggcgccctcctccgcctccgctcccgcggccgctgcgcccttccccacggccaaggacctcctccacatctccttcaaccaggactacggctgcttcgcggcgggcaccaagtcgggcttccgcatctacaactgcgaccccttccgcgagatcttccgccgggacctcgccgccgatggcggcggcgccgggggagggggtatcggcgtcgtcgagatgttgttccgctgcaacatactcgcgctcgtcggcggcggcgataacccccactacccgcccaacaaggtgatgatctgggacgaccaccagagccggtgcattggggagctctccttccgctcccccgtccgaggcgtccgcctccggcgcgaccgcatcatcgtggtgctcgagaacaaaatcttcgtctacaactttgcggaccttaagctcgtgcaccagatcgagacggcgcccaaccccaagggcctctgcgctgtgtcgcagcagcccgggtcaatcgtgcttgtttgccccggtgcccagaaggggcaggttagggtggaacactatggggcaaggaagaccaagtttatcaatgcacacacttcccgcgtctcgtgcttcgcgctgtcgcaggacgggaggctcattgcaactgctagcaccaagggaacacttgttagaatctacaatgcagctgaaggcaatctcttgcaggaagtaaggagaggtgctgatagagcagaaatatatagcttggctttctcgaataatttgcagtatttggctgtgtccagtgataaaggaacaatacatgtcttcaatctaaagataaatgtgggatcgactgcaaatgataaacctatacctgctccagatcctgaagtttcgcatataagcccccctctttcgttcattaagggtgtgttgccgaaatatttccactctgagtggtcagtagctcagttcaggctccatgagggggagcagtacattgttgcatttggacatgagaagaataccgtgtcagttgttggtatggatggaagcttctacagatgtcaatttgacccagttaatggaggagaaatgctgcagctggagtgctacagttttctaaaaccgtcagatcaaccgtagcgacacacaattatcatctatcaattgatgccctcctccccgtaccaagaactgtacagtatctttgtgcgccctcgttggccggaggtctaagctaaatatgataatattttctttgtgtatatatatttcttgttggctctgggtgatgtatgttctgtctgtggaagggctaaaacacccatctgcagatggacgttatagaacgtgtcgttattatttatgaatggattgaataaaatagcctaacaatgtttctccaaaaataaaaaaaaaaa

SEQ ID NO: 18295 - DNA, 3357 bp, Zea mays
ggccgcaaatttttttttgtgtcttttcgttttagcttctacttttttaaagcaaaagaaggtaggaaaagcagaaggccccggaggcgaaagaaaatagaaaaaaacataaaacgaataaaggaggagaaaaacacttgaaacgaagaattcgcgtgcctcagtgtcaattgaatgaaggcaagctaatcgggtcccaaatactgaaaggctggtgaattggatcccaaatactgaaatttctcgtccaatgttggttctccgggactcactagcttccctgtgtgacggtcgccgtacgtgagaaagcaaacgaagcaccaccgcccgcccgtgcgcgctggtttgctgctcgatcgcgcacgccaacgccatcgccggcgcctcctcgtcgacgctgtcaagggcagcgccgggtacgcgcggcggcattgcgcggaacaggttcgtgccgaccatctccaccagcgactgaggatagccagggcgggggcacagcgcacgcagtgtggccgcggcgattcgggcgggcccgcccggggcgaggcgggggcgttgtcgagcgggtgcgtgcgggggcatgcaagccggcatgcgctgaccggggcagggtcagggtggagcgggggattcgggcgggcatgcgcagggcgaggcgggggcataggcctccgaaattatccaaactaccagaattcagaaagcggcgggcgcgtagaacgtaaatatatgcgtgacggcaactcgtacgccacgaaaggtagctgacttccccgcacgagaccattacctagaacatcctaatcgaaaaaacccccagcagccgcgtgacacggtcactcgcgccacccgttctgcacctcggcccttctcatggcgacgcccgcctccgcgccggccacaccaaaccctaaccccgtctccggcgacccgccgtcgctgctgctacagcagcagcaggaggaagaggtgccagcgccggtcccggagacggcgccgacgcccctcaccacctcgatcgaccccaccccctccggcggcgaggagggcgaaagcgatgactcctcgtccgtctggtcggcgccctcctccgcgcccacccccgtcctcgcccccgcccccgcccccgcggcgccctcccccgcggccaaggacatcctccacatctccttcaaccaggactacggctgcttcgcagcgggcaccaagtcgggcttccgcatctacaactgcgaccccttccgagagatcttccgccgggacctcgccgccgagggcggagtcggcgccgggggagggggtatcggcgtcgtcgagatgctgttccgctgcaacatactcgcgctcgtcggcggcggagataacccccactacccgcccaacaaggtcatgatctgggacgatcaccagagccgctgcatcggggagctctccttccgctcccccgtccggggcgttcgtctccggcgcgagcgcatcatcgtggtgctcgagaacaaaatcttcgtctacaacttcgcggaccttaagctgttgcaccagatcgacactttgagcaaccccaagggcctctgcgccgtgtcacagcagcccgggtccattgtgcttgtttgccctggtgcccagaaggggcaggttagggtggaacactataagacaaggaagaccaagtttatcaatgcacacacttcccgcgtcgcgtgctttgcgttgtcgcaggatgggaggctcattgcgactgctagcaccaaggggactcttgttagaatctacaatgcagctgaaggcaatctcttgcaggaagtaaggagaggtgctgatagagcagaaatatatagcttggctttctcgaatgatttgcagtatttggctgtctccagtgataaaggaacaatacatgtcttcaacttaaagataaatgtgggatcaactgcaaatgacaagcctatgccttctccggatcctgaagttcctcacataaggccctctctttcattcattaagggtgtgctgccaaaatattttcactctgaatggtcagtagcccaattcaggctgcaggagggtgaacactatattgttgcatttggacatgagaagaatactgtggcagtcgttggcatggatggaagcttctacagatgccggtttgatccagtcaacggaggagaaatgctgcagctggattgctacagtttcctgaaaccgtcggatcaaccgtagtcactagtccgtagcaacgcaacatactgtcagcatcaccctcaatctattcatgcccactaccgcggtaccaggattgtacattatctttgtgtgccttcgttgactcgtgggtttagcaaaaataataatagtttatttgtaaatatatatttcttgttggctctgctgtttgttctgcggaagggctaaatcacccgtctgcagacgaacgtagtagaatgcatcgttatttatttcatgaataaaataaagtagccgaaaaaaaaaaaaaaaacgtggtgaataagttaggctagcgttgtattttttttttgcccttgccttttaggataaaatattgtcggtatgcctaactattctgtccttgtgtttgattggttggttgcgctgtgatccttataatagtaatgtttcgtcttcatgcgaatcatcatccgcatccgttttcccaagcccccaaccaccaccacacggctggcggttcgtcgcttcaccacacaggacacgtggtccgttcttttatttgtatccttggcctgaagacctcatgtccatgcccgtaacgccttgcacctacccccaccgctgctggccttgcatctcggggtgaatcgggtgattcagtatacatatactgcttcagaattctctgcggaggactagaaacgtgtctatattttacattctatacttaaatataaaaagaaaacatagcaagcatcttgccagttagtctaggatatcgctcaattacaaaaccaaatatggtccttacataacttgtacacgtagccttcttgatcagaaatcgacatggcaatgcgatttttaacacgataaacccattggcgtctccatttataacgtgcgtccgtcaaggcagcttcgtttcgggtctccttttcgggacactacaggaaaacagatctggtaatctatgcgccgatttttaacatgagaacccatcggcatctcgatttccaaggcagatttcctttctaccttccgcctcatggagatgcaatgcaacggcaatttgcgccattttattagaaattgcggtggcgcaattaaatatatcgcggctgcccctgtcgcccccgccgtccgctccttcgtcggggtacgagc

SEQ ID NO: 18296 - DNA, 1604 bp, Zea mays
  misc_feature (82)..(82): n is a, c, g, or t
cgagaaggtgcttcccttttgtactggtttcgcagtttggtgctttatatggggcgttgtagcggggggccttgggcaatantggagaagtaagcatgttacatataaaaggggcacatgcaagtaaagttattcttgttgttggaataatgactcttcattcttttggagaaggctctggtgtgggtgtttcctttgctggctcaaaagggttctctcagggtcttctagttactatagctatagcagtgcacaacataccagaaggcttagcagtaagcatggttctcgcgtctagaggggtgtccccccaaaaggcaatgatgtggagtatcattacatctttaccacagccaattgttgctgttcctgcattcctctgtgccgatgcattccagaaggtgcttcccttttgtactggtttcgcagcagggtgcatgatatggattgttatagcggaggttcttcctgacgcttttaaggaagcaactccatctcaagtagcttctgctggaacactcgctgttgctttcatggaaacattaagtacggtgcttctgggatttacagatggcaacaatgtggaagacgcatcaggcttcttagtatcacttgtgtttggactcggtccacttatcggtggaattatactcgtcacattctctcttgggttcagcatgccgcaccctcttctcaccggtgtcgcatccggcatagctttccgtctcgcggcatggagacctgtgcagctcctaatgacctcaaaaatgggtctcttcaccaccctcttcctcctcatcggaggttccctggcctaccacgccgccacatcaagcatcctccggttgttcaatcgcaaaaggtcttccgtgaacgtgatcgcgtcatcctccggcctctctctcagtgccctcacagtgcagtcccttcttgcctgtggcgccgtattccttcacgcatatgctgaagggcttgcgctcggtgtcgcggctcgcaaggcctatggcctcggccgctacatggttctcccagcctccctccacggtcttccacgtggcgctgccgcggcgagctgcgtgtatggtgccacagatagctggcgtggagcccttgccgctgccgctttgacagggctcgcagcgccgagcgccgccatcagtgcaatccttgcgaagatcgactatgatgggcttgactactggatggtcatagcgtgcggggctctgatccccagctttggccgcgtcttcaggcgctcactgcggttggacgtgcggaagagcgtcgttggcctgctggtaggtgttgccttcgcctccgtgtgcttgatgtcgactagattcatctgtctgcacactccttactgtaactcggctccagaagccgtcacataactttgttgctgccccgtgctgttgtaaaacacatgtaatactagtgtaatggcgatacaaaaggaggatgtggaagggttacgttgcgtcgaagagatctcttacggcgatacaacaaagggaaatggatgttgaacagaatttgcctttaaaaaaaaaaaaaaagagtaaaatattcccaaacattgcctgaacgatagcccattcagc

SEQ ID NO: 18297 - DNA, 2160 bp, Zea mays
gaatcgcctttgtgtcggatcagcaggctcttggctgggaaaccctgggaagaatatggaagattgttcagcagtagaccttcggattctcacataaaggcgctggctgctttgttcgggtggactgtcccggatgacccagctccggatgctgaattgcccgctatatctgggttttctccagctgatcttgtgtaagacagttttttgttggttgttgttgttctttagttttatggatccttcgaaaattctattttagaacgttaggggactcaatcagaaagctaggagagatgtggtgcgcaccatgataaatgatactagaccagacattgtttgtttgcaagaaacaaagaaagtctccatctcccgctttatgcttctatccttattaggcaatgaatttgatgaatcattggttctgtctgcggctggtacttgtggtggtatcctgttggcttggaagagctctgtgtgcaaggtttttcagacaaggattgacaatttttcagtttcagcgcaatttcagcaagaagggagatcagcgtggtggctcactggggtttacggcccccagtcagatgatctcaaacttgcatgcctgcaggagcttcagctgatccgttctgcttgcattggcccttggatgattggcggtgatttcaatcttatatatcaagcaggtgataagaacaatgataatctgaacagggcaatgatgggaaggtttaggcggctgcttaatgatctgcaattaaaggagttacctctgttgggtagaaaatatacttggtcaaatgatcgggctaaccctactctagttcgcctggatcgggtcttctgtacagcagactgggatgatgatttccctaattgtgttcttcaaagctctgcctctttaatttcagatcactgccctcttttattgggtctgaatgagctcacccaaggaaagaggagattccattttgagagtttttggaccagattggagggtttcttggaggttgttgagtgctcttggtcccaacctgtgggtgcagtttgtcccctgcaggttttcgctgcctgcctgcagagattatctaagcaattgcaggcctggagtcatataaaagtgggcaatattaatcagcaactccttatggccaaagaaattcttcacaggctcgaaattgagagggattctagaagtctgtcccccgctgaagaatggtttcgtcgtaaattaaaacatcatattttggcattggcatccttggagagaactgtagcccgtctgaggagtggtttactgtggctgaaagagggtgacgccaatacctcatattttcatcaacatgccaggtataagaagagaaaaaacttcattgggaagttgaaggtcggggacagattattgttcgagcaggaagataaaaaagaggcagtgtgggatttctataatcatcttcttgggacagttcattgcagggactctactctaaatctagatgccttccataggccggccttgaatttacttgatctagatcagaatttcagtgaggaggaggtctggaatactatcaagtccctgccatctgacaaagcccctgggcctgatggctatactgggagattctataaaaaggcttggccagttattaaaggtgatcttatgacagctattaacagattgcttcatggggatatttctaaattgcatctccttaattcagcttatgtgaccttactacctaaaaagaaggaggctttggaagttaaagattttaggccaataagtctgattcacagttttgcaaaaattataactaagctgttggccaccagacttgcgccaaggcttcctgtgctggtgtcaaaaaatcaaagtgcgtttgtgaaggggagaagcatccatgagaattttatttcagttcagcagactgcaagggctattcataggcaaaaggtgccccgtatcctgctgaaactggatattggaaaagcttttgattcggtttcttggtccttcttgtttgaaattttcaggcatttgggttttggtcctgtttggtgcagcatcatttccaaattgttgtactcttcttcaacaagagtacttgtgaatggggaacctggggagattatcaagcatcatagagggcttagaca

SEQ ID NO: 18298 - DNA, 3186 bp, Zea mays
tggggaaggcagaagaagagggggggggggccgggccgggccgggctctttacattgggtccctcgcggccggccgggaacctgtgcctcctctattctttcccttttcctcgtatccatcctccggcgtccgcccttctctcgcgcgcgccgaccgccgccgccaggtgccaggaagtcgtgggaagtcttcttcggcgacgagcacccgccaggccatatctctgcaatgggtgactacacaatccagattagcaccaagctcattgaccagcttgctcgtgatgacgagaaggtaaaacggaaagccaggaagcccaagcctaagaagaagcccaccgtccagccacatgaagagcccctggaattcccgagagaaccaaagacgacaagccttgctactgctcctgggtggcctctgcagcctccccctatgtttctgccagtgacccctgctcccccgccacccccggccacaatgccggaggtggaagccattcgttccgtcctgaaagaaagtgaggcgcttctcaagaagctggagaaccaggaaactggggcacgccaagagctcagcaagagagcaaaggagctgcacgacaaggagttcaagctaccataccagaaacccatgccctgcacccaggagagggcaggctgccttgagtgttacaagaccaatacaaaggacccgctcaagtgtgctgaagcagtcaagagatttgaggcatgtgctctcatggccatcaaaagtactgccgcaaaagctgattagtatgtagtccgtgaagctttgtgagttggggcgagctgatacgcggactctgttttttatcttttgaggcaattcaaataaccaaggattttcatgggacccactgtagatttctaatgccactgcactgggctacctgaggcagcgcaccttgagcttagcgatattgcatatgtttgttaaaattggtatatcaagttgctggtgcaaaggtttttgtctgaaatatatattgatcttgtgttggattggtatccactagctacgctgcatatttttgctgtgttctatggtgtcattattgtgctattgtcgtactcttgtgtgcatgatgcctctgtttccctattttccgtgccagcactgctattttgtatttcattcagtccatgggctgtagaattctgttccaagtggatcaatattattatcttctcttgtgctaataggaaatactgtcctgcttatctcctatgagagaaacgctagtgataactctcaagtctgagattggtgccaagcaggcaagaaatatctttaaaaagttgacattttcttttctgcaaattgaacatatatattgtttctacttttgcttgctgatccaatgaattaaacatattctagtacttcaatttttgctttagctgcacattttcttttgaaacacagaatttgtctgaagtacctatttgcacaatgcttttcattcttgtgctttgcacgttagtgatgagtgctttttagaactctggaagtctgagaatggtgctagccaggcaactaaaaaaaataggtgtttcattttttgcaactaaggatctctaagaaatcacaacttattctgcattttctttttgcagctagaacatatatctgttcagttaccttgctgacccaaagagtagaatgtattctgttactagataggatctttgcttctgcccttagtttgttttgaaacagagtttatgtctgtatactgccattgccatgtgtaaagcaggtgcaaatgtgtaaaacagagtttatattcttttgatcgaaacaaaatatatttctggtcaattgatggattaattgttcaattggaccaatgttattattatatcctcgttggctttagaaaatatgttgtcctgtttatctcccatgagataccctagtggtgcctacttttagaactctgaaagtctgagaatggtgatgaccaagcaaggtggctttttttccttaaaaaaggttctcttattattttgcaaccaaggatctctaagaagtcgacacttagtcttcctttttttgtaaatcaaacatatatatgttgcatcacatatcagcttcgccaagtggctagaagtggcgcctaggaccttagttcagctttgtttggatggataaacattagtttgttagtcttggatagagtttagatagataaacattagtttgttagatcttagataaggtttgttagtttgttaaaaggctgctatctcagctatataaatgtatcccttcaattaatgaaagatcaagcattcaattaatgaaagatcaagcaggcaattattcttgctcgtgctttttccccttcgcttattgttcacccgtgggcacgtctctcccaaccagcagccctaaccctaggatgatggctcccaagcgtcagggtcttggccctcgaccttccacccatgttacctctgtaaccctagtttcaatagttttcttcactctggctcgttgatctgtttagtagaatgtatcctggtactcagaacctttacatatatataccatgggtattcgagtgcagctcaacgagaaagatatgattagtgggttagccgagactctagactcggctgatacaacctgaggaaaccgcatgatttaaaagatttttagatggataaatattactaagatcttattatattgggagatgagatcgatatcctagcagatatagtaaaaactggcagagataattcgagatagacttagttatgatttacatcctataacctatctaaaaatacatcttataaactcgtcaccctcattggattataaaagaaggatcagggaagcctcaagatgccagattatctgatcacattgcatagcaatagacaccaacgtgtctttacctttagttcttgataacgcagcctccctaaaatttagtatcgaataatcttcgatagttagcatgctaggtagggaaaattgcactaatcaccaaagagttgatgacaactatgggtttcgcatgggagaagtcatcttcagtacactcaaattcgtcgttgattcgctcaaaaatcttaggctcactctgagtatttcgacagttttgacgctccataatcaagtacttgaaaatccaataatacacttggacg

SEQ ID NO: 18299 - DNA, 2287 bp, Zea mays
ggtaccctcgggtccgggcacgagaccattacctagaacatcctattcgaaaactttttcgaccaaccttcgtctccagactcgtccaccctataaattgtctcgccagaccattccaatccggcaactcctgctctgcctgagcctgagcgtaggcggctaccagagagaagggtaggcggcgccggcggcgggagcaatagaagagcggtaaatccaagagagatcagagcctcggagggaaacagaagcgcacagagcatggagagcccgatctcgaggactaacctgaattgcatcagcctggcggacccgaacgtccagaaatcagtggcgctcctcaagcaggcatgcctggattcaggcttcttctatgttgtggatcatgggataagccaagagttcatggatgaagtttttgcccagagcaagaagttctttgaccttcctcatagtgagaaaatgaagcttctccgagacgagaagaatagagggtacacacccatgctagatgaaattcttgatcctgaaaatcaagttaatggtgactacaaggaaggatattatattggagttgaggtacctgcagatgatccagaagcaaacaggccattttatggtccaaatcagtggccttctaaagaagtattaccaaaatggagagaagtgatggagcaatatcacagggaggcgttgagagtagcaaaatcagtcgcaaggatcatcgctctcgctctagatctagatgtggacttcttcgatagacctgaaatgcttggcgagtcaatagccacgctaaggctcctgcactacgaaggtggacaagaaacaggtaaggtgtcagatcctgcaaagggtgtttacggagcgggcgcccattcagactacggcctgataactctcctggcaaccgatgatgtagttgggctccaaatatgcaaggacaagaacgctcagcctcaactgtgggaatacgtagctccgttgaaaggcggatttatcgtcaaccttggcgacatgctcgaaaggtggagtaacggcgttttcaggtcaaccttacatcgagtggtcctagatgggcgagaacgttactcgatagcctacttcgtggaaccaagccacgactgcgtggtggagtgcctgccgacctgcaagtccgaatcaaatcctccaaagttccctccgatcacctgctccgcgtacctgtcccagcgctacaaggacactcacgcggatctgaaatcctacgacgacagcaaggcctgatcagaggactgccctctcctctctctgtctcagcgatcagtacgtacgacgtgtatcctgcaataacactgggtggagggcggcagtaccagtgtaccacagtatcagtataggtatagagagttctgttggtgccaccgtgccaccgtccatgtgttcatgtaagatgacgagaagaatcaagaacgggggccggcgttgaggtccccggccttaatctaggccttgttgttgctgtcgtgttgtgaggttcaatccccgagcttatcctttggtgctgttgagaggtccaacaaaaaaaaaaaaaaaatttgtttttggttttggtacaccaggagcaattttgttgtggattgctaaaacttttgcgaggcgcggcgtcatctcgtttcagctttatccgacggtcttggtgtgggaagcagctagacgggtttgctcagcagcgttgctttcttgcaatccctttcgtgtcaggttttctcactggcaacgcacttgaggcctttttcagttatttttaatccatatagattgtagggaattgatacggattgaaaaggattttgacttgttagggattgaaactctctcaatcctccttaatccatatggattggggtagaaccgaataagccctgagggtcgatttggtgacaagaggatcacgggatgattagaggggattgagggggaaataaactaatttcctcttgaaccccctccgatcctctcggaatcccgggtcaccaaatcagctctgagcgtgtggttgcgctcacagtcacagcagcggcaaggcagagcttgaggatgaggacgccacgaacgagcgacgttgtggctcatccgttttggatgtgtggtagattctgcacatgcggacccgacccgatgcgcacaagatgccaaatgttttggctgagagggtatttggctgtctacacatgctgatccgagggtggtacagtggtaaatctaacctagaatatcgggagccggttcctctgacgtactgcag

SEQ ID NO: 18300 - DNA, 2683 bp, Zea mays
cctcgaggccggccgggtcttggctttaacctttttcccttttgcaacctttttcgaccaaccttcgtctccagactcgtccaccctataaattgtcccgccggcccctcgccgtccggcaactcctgctctgcctgagcctgagcgtaggcggctaccagagagaagggtaggcggcgccggcggcgggagcaatagaagagcggtaaatccaagagagatcagagcctcggagggaaacagaagcgcacagagcatggagagcccgatctcgaggactaacctgaattgcatcagcctggcggacccgaacgtccagaaatcagtggcgctcctcaagcaggcatgcctggattcaggcttcttctatgttgtggatcatgggataagccaagagttcatggatgaagtttttgcccagagcaagaagttctttgaccttcctcatagtgagaaaatgaagcttctccgagacgagaagaatagagggtacacacccatgctagatgaaattcttgatcctgaaaatcaagttaatggtgactacaaggaaggatattatattggagttgaggtacctgcagatgatccagaagcaaacaggccattttatggtccaaatcagtggccttctaaagaagtattaccaaaatggagagaagtgatggagcaatatcacagggaggcgttgagagtagcaaaatcagtcgcaaggatcatcgctctcgctctagatctagatgtggacttcttcgatagacctgaaatgcttggcgagtcaatagccacgctaaggctcctgcactacgaaggtaaggtgtcagatcctgcaaagggtgtttacggagcgggcgcccattcagactacggcctgataactctcctggcaaccgatgatgtagttgggctccaaatatgcaaggacaagaacgctcagcctcaactgtgggaatacgtagctccgttgaaaggcggatttatcgtcaaccttggcgacatgctcgaaaggtggagtaacggcgttttcaggtcaaccttacatcgagtggtcctagatgggcgagaacgttactcgatagcctacttcgtggaaccaagccacgactgcgtggtggagtgcctgccgacctgcaagtccgaatcaaatcctccaaagttccctccgatcacctgctccgcgtacctcggccgcgaccacgctaacactcacgcggatctgaaatcctacgacgacagcaaggcctgatcagaggactgccctctcctctctctgtctcagcgatcagtacgtacgacgacgtgtatcctgcaataacactgggtggagggcggcagtaccagtgtgccacagtatcagtataggtatagagagttctgttggtgccaccgtgccaccgtccatgtgttcatgtaagatgacgagaagaatcaagaacgggggccggcgttgaggtccccggccttaatcgaggccttgttgttgctgtcgtgttgtgaggttcaatccccgagcttatcctttggtgctgttgagaggtccacagtccccttcgttccgttttgtttttggttttggtacaccaggagcaattttgttgtggattgctaaaacttttgcgaggcgcggcgtcatctcgtttcagctttatccgacggtcttggtgtgggaagcagctgtgcttcgttctcctagaagagacgggtgtgctcagcagcgttgctttcttgcaatccccttcgtgtcaggttttctcactggcagcgcaccccttgagcgtgtggttgcgctcacagtcacagcagcggctaggcagagcttgaggatgaggacgccacgaacgagcgacgttgtggctcatccgttttggacgtgtggtagattctgcacatgcggacccgacccgatgcgcgcgcgcacctcctcccgcgggagcggccagcagagcacccaggttgaccggtgcactggttggtggcgcgggcattcagccgctgctcctcctcctcggccggcgtacggcgtgcacgtacactgccgcacgctgggaagtgggaacccagcccagacccgtccaaaaagcgaggcaggccggaccctgtggggatggctgcgggttcaaattcgcatgattgggctgggcccaggtccctttgtattgtgtaccgctatagtcctgcccgtgctcggccggctgctagctccggtccaaatcccgtggcttatatgctaccatgccatgctcaaatcaagcacagggtggcgatcagttgcacggcggcgcatcccggcggatcgcggtgctggcctgttgttcctcctcgcctgctgcgctctttctaacaaagcggggttctggtactgtgctgtgcacccccgcgcctctatctgggtgacgtccacgcagagatccttctccttttgcgccatcatcgcggctgtgttgctttgcttggcaggacagtgggcagtggctgcccagtgcccacaggctgcccagcccagccccagccccctactgctacagcgaagcagctacgtgcttttccaacccatacaccacctgaggtagaggtacgagtacgataccatctgcctgcagcttcgttcacaagtcaaagcgagccggcggggatctgaatcggagagcagacgaaagacgagccgcttgttgcctgccccggc

SEQ ID NO: 18301 - DNA, 810 bp, Zea mays
  misc_feature (719)..(719): n is a, c, g, or t
aaccagaccttattccctcccctcccctcccctccctttctcccctgactcctgctctactggatcctccgcctccatcgcctctcgcgcctccatcgacctcggcgcctcgtccgtcctgctccacctcttcttacgccgggttaacatttgaggcatggcgaaacaccacccggacctgatcatgtgccggaagcagcccggcatcgccatcgggcggctgtgcgagaagtgcgacggcaagtgcgtcgtctgcgactcgtacgtgcggccgtgcacgctggtccgcgtctgcgacgagtgcaactacgggtcgttccaggggcggtgcgtcatctgcggcggcgtgggcatctcggacgcctactactgcaaggagtgcacgcagcaggagaaggaccgggacgggtgccccaagatcgtcaacctcggtagcgccaagaccgacctcttctacgagcgcaagaagtacgggttcaagaagaggtgacggatcagtcagttgagcatccgtgatgtgcttctcgtggttctgtgtctgagcagcgtagcgtgactgatcatatgggcacacaatgcagttgtgtaccatgtgcatgtatgtgttcagaaatttttctgttgacagattgaagctggagagtacgctcaagtttgacactgttacgtattctctttgttctaccgttcactcatctactctcctgatacaagacatnttgggcaagtttgtttggatactaaggagaacttattgcacaaatcaaacagccacaagttcatttgatttcgtggtgctgcaaaattgta

SEQ ID NO: 18302 - DNA, 3503 bp, Zea mays
  misc_feature (3485)..(3485): n is a, c, g, or t
caatctctgaagcaggtgagtgtaggtttgagtgcttactttgcactattttttgcacggtgtggtggatgtgtctagagtgtggagggtgaagttgtggcactagatgcttatattagatttttaatagagtaatatagaagtatagattaccagattacatgatatgcaaatatcgattccaaagaatatgggaagcagatattgacgatgtacgcccaggcttctagtggctcctccctccaagcagcccgcaaaacctggctccccatgcccaaggcccaaccagaccttattccctcccctcccctcccctccctttctcccctgactcctgctctactggatcctccgcctccatcgcctctcgcgcctccatcgacctcggcgcctcgtccgtcctgctccacctcttcttacgccggtacgtggctatagctcagtcgctcccacggatccatctccaggactccagccccttggctcagctcatgcattactgaacgcagttgataaaccattcgcgtgctatgctagatccctccggtgtcgccctcgagccacctaactgaaatatcgtcgtcgatgcgtgggtctgctagcagatggcgcgccggccccgcactgaccctccccctatccggagaccgccactgccgtgtcctgtctcttgtgttgatctccacttgtcgtcctgtatgggtagcaggcagcttgttgattcgactgcgcgtccagcagtagcagcttcaaacaagtacctgtgtccgtaggaaaagcaaacagttgattcaaccgtctgtttgcagacaccgccgacagccgactatttttctgggttccaacatatccaatagaagtgaacaacaacacttgggctgtttatttctatcttcgctgaagggactatatgacgctaacattggcacctcgtctagaacagattattattcttcctgtctcccttgccattaggtgtccacaatgccagtgagtacaatcgagatcggcacaaatggctgttgccagtccaatgtccgaatcaccaaatttattccaacatgttcattttagaaacgtcaagaagtatttgaacgtagctccatgggacacccttttgcatgttttttgtttgtttgtggctatagactcaattgctttaactatggtacataggaaattaggaatatatgatgaccatctccaaatcatataagatgggtttggctgtgagtagcaatgatagaggggtcctcctgtcactcatgtaggacatttgtattctttttgttcagtcaagttgctgacaaaaaagaaaagagcacctaacggtagaatgaaagaaaaacgaattcagtgatgcatatggaaagtgcttagttcccgccgaaacagaggtttcccttactacctgctatcaagttaaataaataacgaactagcaaatctctttgaatttggtatccaaccttcaaccatttctctgtcctgttttttttttctcgttcctgacaagctgtagtaacgttgctccatcgaccgtcggcgcctacgtccgtcctgctccacctcttcttacgccgggttaacatttgaggcatggcgaaacaccacccggacctgatcatgtgccggaagcagcccggcatcgccatcgggcggctgtgcgagaagtgcgacggcaagtgcgtcgtctgcgactcgtacgtgcggccgtgcacgctggtccgcgtctgcgacgagtgcaactacgggtcgttccaggggcggtgcgtcatctgcggcggcgtgggcatctcggacgcctactactgcaaggagtgcacgcagcaggagaaggaccgggacgggtgccccaagatcgtcaacctcggtagcgccaagaccgacctcttctacgagcgcaagaagtacgggttcaagaagaggtgacggatcagtcagttgagcatccgtgatgtgcttctcgtggttctgtgtctgagcagcgtagcgtgactgatcatatgggcacacaatgcagttgtgtaccatgtgcatgtatgtgttcagaaaattttctgttgacagattgaagctggagagtacgctcaagtttgacactgttacgtattctcttttttttaccgtagcaaaaaaaaaaaaaaaagatacaagacatttgggcaagtttgtttggatactaaggataacttattgcacaaatcaaacagccacaagttcatttgatttcgtggtgctgcaaaattgtatttttgaaaaaaataataatatacttactttataggaagaaaaagcctggccttccaagtcaccaccaacccaacctctgacgatcaccatcgccgctagcctccaccaccaacttcccatcgcctccccctcatctccccacactcctgacctcacctctccgaactgcagcacctcccctcccgccacccacacgtgctcccatggccgccaccgcgatctcagtccgcctccacccaaccgccgcgcgccatgtggcctccgcccgccgcgcccgcctcggggccgtccgcgcgcagtccgcgccggcggcggcggcggcggcgctgacgcaggacgacctcaagcggctggcggcggtgcgcgccgtcgagcaggtgaagagcgggatggtgctcgggctcgggacgggctccacggccgccttcgccgtcgccgagatcggcgcgctcctggccgcgggcaagctcgagaagatcgtcggcgtgcccacatccaagcgcaccttcgagcaggcgcagtcgctcggcatcccgctctccacgctcgacgacaacccgctcatcgacctcgccatcgacggtgccgacgaggttgaccctgacctcaaccttgtgaaagggcggggtggtgctcttcttcgtgagaagatggttgaggcagcatcggacaagtttattgttattgttgacgagacaaaactagttgatgggttaggaggtagtggtctagccatgccagtggaagttgtgcagttctgctggaagtacaaccttgtaagattgcaggaactgtttaaggaggaaggagtcgaggcaaagctaaggtttgaaggcgacaagccctatgttactgacaactcaaactacatcgtcgatttatacttcaagacgccaatcaaggatgcgttggcagcaggacaggaaattgcagctctggaaggagttgttgaccatgggttgttcttgaacatggcgagttcagtgatcattgctggaacggacggtgtcagtgtcaaaacgaagtgagtttttgagttgctttgttgtttgtgttgagttttacaatttaatgtacaagctattggtgtaaaagcagctgataagatgcttcaataaaggtgttcccccaatgtggggattgactatcacttattgtgggataaaaagccattttaataggttgaaacttctgttgattcataaaaaaaaaaaaaaaaatctgatgtcttngacaaaaaaaaaaaaaaa

SEQ ID NO: 18303 - DNA, 1059 bp, Zea mays
gccggcgccacccgtcccgcaggggcacactcgcccggtcgcccctgagcagcgtcgcacaccattccctgctaaaaaccctagcccatcagggcagcgaccttctagaaccgtctccaatggcgctactccgagcgctccggcgagcccttccggcgctctcctcgccggcggcggttctcccccgtcgcgccccgcacccactacctcctccgcccgctcctcgtcggttcctggacccgatcgggctccgctccttctccgccgccgccgccaccgcgtcgcaggcgccgcccatgggggccaccctgttcggcgggctcatggacacccggttcccgaagcgccggccgggcttcgccaaccgccggaagagggctagcttgcgccccaaaggtccgtactactgggtgaagtgcaagcctgacgagcccataccagttagtcagccgaaccaagggagcgtacgagggaggaaggagaagaagcggatcaagcagcgcaaggactttatcatggctgagaagaagaagcgcagagctcagtattctgctgctgttaagagaaaggaggcagaacgaacagaaaggaagatggctgctgtggcaagagagcgggcatgggcagcaaggttgatagagctaaaacagattgaggaagacgttaaagctgtaatggcataagggcctgctctggaaaatggcaaggcgtctaacctgtttctgctgctctattttctcctcctttgttcctacatagtttaaattgtcacaattctttgtgatggaatggaagaccagtaccacttctttcaacagtaatatcaaatgccggaactgtttttttaatacagactctcattagaccatgtttggagtttgtttacttttgatgtaatttagaataagtgatgcgatggtatctgtgtgcttgacatctgagatggctgttgtctgcaatatatagttttggtacacttattctataatacataatttgtactgtcagtattcaagcaactaatgcttgctagtcttttgatcaaaaaaaaaaaaaaaa

SEQ ID NO: 18304 - DNA, 2873 bp, Zea mays
  misc_feature (1530)..(1530): n is a, c, g, or t
atggtagggtcctaaataatttgtagttcaaaaatgaatagaaatagagctacttgatctgcttttgttcacagattattatcacccctaatccaatccttaaatcttatagtgtaaaatttagagctcgttatcacccctactcacacgtgacaccgtccacgatctttgatcacagattattattatcatatcatcagctacttgatctgcttttgttcatgccgaaacttcaagtcagcgttcacactacctttccgttttcttatgtcatcaagcatttaagccccctgttttagtaagtcaaccgcgaaaaggaagaaacaagacccgttcaagcaaccactctttcagatctcgcggaagacagctaaccctgtgtgctatttcgcagaaactaccggatgcaacaaccacctggagataggcagctcagggaaacctgcaaggctacaattacctgtactttggctggcatgcactgggagactctacttctaaggacctccatggattcacccccccccccccaaccccccctatataaccaacaacctctctctccatcgctcatcaaccacaatctcactcataaatcttgccaaccattgccagatctttaatcttcaccatgatctcccggggcaattctagtacgagctcagacaacggctcctccatgcagttgtaggacttcctgccaatgatggtgaggaaggtaggggtggaggggctgattcaggagctatgcaaagggttccagctgctcatggagcctaggacaggcaagatcacctgccagagcctgaagcagaatgcggccaggttcgggcttggagaactccatggtgatgagctcccggagatgatcagggaaggggatcttgacggggatggggcgctggatcagatggagttctgcattctcatggtcagattgagccctaagctgatggaagaagaggcacacatgatgtttcaatattgatgtaacttgatccttgttgcttagtacaacagaacagtgatctttaatgtcaatttggtccagctccaaaaaaaaaaaaaaaacagaaacactaatgtagtctgacaaacttactcatattatgatactaacaaaaggtgtggcgcagtggtgaaaaggcttcccactggaccaaagatcctaggttttgacgcaacctctctgcaaaataatacaggggtagagcttgacttagttatccttccctaaaccccactcatgtgggagccacccgcattgggtctgtcctttttaacagaaggtgaaaattatacaacaaagtaccatgagcacttgactacttgaggtctctagggcatctcaaagcaaaggatatatgtctgatgtttactttgtcctgttgtcagcgaatgaaattatttatcccaaacagtgtgcaaatgtccagaagaaaatcttgtgaataaccatattacaggagggttgtctcatactctcattcatactgtacctcaagtgcactgctctccatccaacctagnttgtgtggcatttcctgtactattatgaaagttgtactggagtaccacagagctcaccaatctccttctcaagaagttgcacaagattcgatccagttcgcttgtatatccaaccattagttgctgcatcccagtcaaacctagaaggcccactgcatgcatatccagatagcatttttttatatataagatatataagaataaagagcttttggttggaaatgaagtatagacgattcaatgaagagcttttggttgctgtacaagatatccaacagtgggtctatttgattggaaatgaagtatagataaatttcagaaccacatcataagacgcatagcctactggataaaccaaacgacatatcacaaatggccgctctcttctatccagaaaatgccttttttccttcccaaaaaaggaagacatgtaatcattagccattacacagtgataggttcctgaaactatatgcctatctaactcagaggtccaatacataaaatgaaacaaacaacaactgagatactaagatggtagtattaccttacaggtgaagaaagccagatttgtctgtttggtgattgcttgttcacaacatatgtccccaaatccccaagcctcaatgtcaaaacctggttctagaatgtcaaggaaaagagaaggatgcatcaataattgaatacacgaaaacaaaaacacataatagtaagaatcacatgattctccatggcatgttgcaactaaccccatagtctatgtcgaaaccatccatctgaatggagtcaccatattcctcaagtgtttcaagcaaatcatgaattgtctcatctgctaatttgtgaaattcatcctcttgcattatcgacttgtggtccaccacagatgggccgggcgcgtcactgaaggcggacagtttcgagaggcgcgttgacgagatggtcctcaaagagaacagaagagccgctggagacccgcccgacggcagcgtcgtggcagcggcggccgcgagagagcgagaggtggtagctacagggagatcggcggcccagaagagttgccgagtgcgagaccggagccgcctctcgaaggttacgcctaggagaaccttacgcgacggcgacgccatggccagcgccgacgcccgtgtgtgtgcctaggaggcccacgcagcagcctacggcagtcagagcggcggcgcagccctgctacaacggccacgggcggtggtgctggaactggaacggcgatggccccgtactgggcccgtaaaggctgcaattggatcacgtaacgagacggtaggtcggcatccactggactagagtagaagcctagcgtg

SEQ ID NO: 18305 - DNA, 1516 bp, Zea mays
tacagttgctacaaagcttatgaaggagcaaaaactcctttatctctctgctgtccctcattttgtttcttggaaaatgcagagctcgatgctttggaagccgacatggacttcgaatcagagtcagtcccatcttacctccaaccagaccaagaaccgtgaactcagcttacctgctgcaccaactggccatgcagcagtcccggcaaaccagcagcaggtagtgaaactgttgtgagagaatgacgttagatgttgcgtactttttagtgttgcttttgtttatacccaacatcatggtagttatttggtttcctttagctctgtcatgtgcgctaacaaccagttggcctattgcaacatggggccacgcttttaaattttattatctctaaaataaattagcacgtttcgaatttatcccaatgaacgtcagagaagaaaaatgtgatgaaggagaaggtaaaaaaaaaacttaggatgttctctctttatgggtgtggcagtttataaggtagaataaggtagaagacagaacacctgaattctaagttgaacgcggatggaatgagcatccacatctggccaacctaaaaaaaatcttataaacttatagttggatccatttccagttttcttgactgcagtggcatataggagtactactctctcgccgccggttccaagaacctgaactcagcttacctgctgcaccaactggccatgcagcagtcccagcaaaccagcagcaggaggatgagctaggattgcctacagtgccacaagcatccattcgtacataatcaagcagaatcacgtttcttgcagtcaacgatataaaggaagtcgtattatatatctacagctgggtgtaaaaatgctgttatgtaccgcaccacttcgattttttttgtcactccacttgtggatggtgtaaatctgattgaattgaattagttgggagttgggacataataagatcctcttgtatttgctgtatggttgtacagaaagcagcaaggccagagcagcacgtttataccgtactgtgagaaaaaatggtgatacgtggctaatgtgctaaatagctcttccttaaacatctcttctagaagagctttagttggggataagtggaatgtgttatctatcagttctaatcatcaaccaccaaaagtacaaaccatctgctctgtttttctctcatgggacgtttagatcgcttcattatgggacgtttagatcgcttcattttagaggaattgtaattcactcaataaaataacttatttagtttagaatttgatattccataactttataaagttcagatataaaactatcttaaatttatggatgcgggatggaaaatgattttatgcggtagcagaatttatttttactttgtaacttacatgacactatttgtcttactcttttataataaaattgtaatacataaatatttatgacatcttgctaataatagtatacaaatatattttacataaaaccg

SEQ ID NO: 18306 - DNA, 1253 bp, Zea mays
  misc_feature (1221)..(1233): n is a, c, g, or t
cctgccgggagaaccctgccccgggcaggccgaggagactttttaactttcacggaaatttcccctctcttggtctcttctcttgcgcgttcctcttcttcctagtcctaggctactttcttcgatcccaactccgagtcgcctgtcatctctctctaccagattagattggggatctcatctcatccgaatccttcatagtattacacaaccagcaaggccgcccgcttgccggcaacatgaagaagatcttcggcgccaagaagaacaaggatccgccgcccacaatccaggacgcaaccgacagaatcaccaagcgcggcgacaccgtcgatgaaaagatcaagaagctcgacgccgagctcgcgcgctacaaggagcagatcaagaagacgcgcccaggccccgctcaggaggccgtcaaggcacgagccatgagggtcctcaagcagcgcaggatgtacgaagggcagcgtgacatgctctacaaccaaacatataaccttgaccaagttgcttttgcggcagagggacttaaagatgctcagcaaactatgactgcgatgaaggctgccaataaagagctcaaagggatgatgaaaactgtcaagctcgaagatattgatagtatgcaagatgagatgatggatcttatggatgtgagcactgaaatacaagaaactcttggcagaagctacaacgtcccagatgacatcgatgaggaagaacttatgggggagctcgatgctttggaagccgacatggacttcgaatcagagtcagtcccatcttacctccaaccagaccaagaacctgaactcagcttacctgctgcaccaactggccatgcagcagtcccggcaaaccagcagcaggaggatgagctaggattgcctacagtgccacaagcatccattcgtacataatcaagcagaatcacgtttcttgcagtcaacgatataaaggaagtcgtattatatatctacagctgggtgtaaaaatgctgttatgtaccgcaccacttcgattttttttgtcactccacttgtggatggtgtaaatctgattgaattgaattagttgggagttgggacattttaagatccacttgtatttgctgtatggttgtacagaaagcagcaaggccagagcagcacgtttataccgtactgtgagaaaaaatggtgatacgtggctaatgtgctaaatagctcttccttnnnnnnnnnnnnnaaaaaaaaaaaaaaaaaaaa

SEQ ID NO: 18307 - DNA, 1542 bp, Zea mays
atacactactgcacgtctacccttggactgactactgaggtggcccgaacaacctttatccgattatccccccgcattatctctctcggtagttcccccgtccccctcgcgtgcgctctgtggcgacgactgctcggccgccgccgccctacgcgcaggcgcccaggtttccaccttcgccggcgacgagcgcccacaaggaaaacaatggagtggtgggctgctgatggtttgtactacttccggacctgaaaggagctttttacaatggcaccgggaagcagcattgtgactgtagtccccgagtcggactgtggagatgacgatgggctttctgaatcacttgggggtatcatgcttgacgtagactctgcaagtaaaccgtggtctacatcggcatcgctagccaatgttgcattgtcgtcgctgtgtggcttgaatgatttgctcgaatgcccagtgtgtaccaactcgatgcgcccacctatactccagtgcccaaatggccacacgatctgctctagttgcaagcacagggtagagaaccattgcccaacctgtcgccaggaactgggaaacatcaggtgcctagctctcgagaaggtggcagagcaactccagcttccgtgcaagtaccagagcacgggatgcaccgagatccacccatacaagagcaaactgaagcacgaggagctctgcaggttcaggccgtacagctgcccgtacgcaggttccgagtgcctgatcgcaggcgacgtcccgttcctggtgtcccatctcatcaacgaccataaggtggacttgcacgagggctgcacgttcaaccaccggtacgtgaagcccaacccgtacgaggtggagaatgccacgtggatgctcactgttttcaagtgtttcgggcagcacttctgcctgcacttcgaggcgttcgtgctggggatggcgccggtgtacatggcgttcctgcggttcatgggcgaggagagcgaggcgcaggggttcgggtacagcctggaggtgggcgggggcgggcggaagctgacgtggcagggcacgccgcggagcgtcagggacagccaccggaaggtgcgggacagcttcgacgggctcatcatccacaggaacatggcgctcttcttctcgggcggcggcaggcaggagctcaagctgcgggtcaccggccgcatctggagggagcaagggcaatgaaaagcacccccgcacacattccgttgactggtggttatggtggtacaccgctgtgttccattccatcccatcatccgggggcagccttctgctcagctcctcgccatgattcaagaccccattccgtgttcgtcctgtgcatttgctgtatgtacagatattttgcatacctagcctggaactagaccgtctgcagacatgattaacacgtggggaaagccccggcaaaacctgccagtctggtatgtgctcatgttaatgccttttgcaatgtccccctgcgaggctgtcacaacaggcgttatcggcaaaaaaaaaaaaaaaaaagcggcc

SEQ ID NO: 18308 - DNA, 1001 bp, Zea mays
ggactgatccacgttttcctactgtccaagggatagtacgtcgtggcttgaagattgaggcattgatcaatttatactccagcagggtgcttcaaaaaatctgaatctcatggagtgggataaactctggacaatcaacaagaagataattgatccattgtgcgcaaggcatactgctgtgctaaaagaccagtgtgtcatctttactcttacaaatggtccagagaagccatttgttcgaattttaccaaggcataagaaatttgtgggtgctggaaagaaggctacaaccttcgccaacagaatttggttagattatgctgatgcagcagccattagcaagggtgaggaagtaacccttatggattgggggaatgctatcgttaaagagatcaaggtggagagtggagtaattactgaactagttggagaattacatcttgaggggtctgtgaagacaacaaaattgaagatcacatggctagcagatatagaggagctagtccccctctcattggttgaatttgattatctcatcagcaagaaaaagctagaggaagatgatgacttcctcgagaatctcaacccttgcactcgacgagaaaacccagcccttggagatgcaaacatgatgaacctcaagcgtggagagatcatacagctcgagaggaaaggctactataggtgtgatgccccttttatcagatcgtcgaaaccggtggttctgtttgcgatcccagatggccggcagcaggccttgcttaactaggcatgatgaccacttttggcacatggaattcctgagatatcggagtcggcaatcaatattgttgcattatacactttgatactgtactgtgactgggcttactcatggtgtgccagatggccaggcctatcctgtcaacaaagcagcacagccattttgattttggtcgattatacttttaccggagcttaaaagtttcttatactttcctggcagtgcctttgctattttt

SEQ ID NO: 18309 - DNA, 2701 bp, Zea mays
  misc_feature (2674)..(2674): n is a, c, g, or t
ccggggtgtagtgctagacactgaagggttcgtccggccatccgggcaagtcaccactcactagtcaccagtaactttaccaatccgcgccggtggtaaccctgcctttggcggcggctagccggtacccagtgtgcgcactccctctatctccctcttggcgacgactgggcggccgtcgctgctgccctacgccgtcttcgggctcttcgttgtcgacgagcgccacaaggttcctaccatttttaagaaaaaagatcaatggaggcagctttgtcattctccaaggacagcccaccaatttcgataatttgtgctgcaaagattgtgggtctacccctaaccatcaatcatagcctcgctgctggctcggcacccaccctacagtttgcttctggagaatcactccatggtgtcaacccaatcatcctctacattgctagaggtgcatcaattgcctccttatctggaaagaatgatattgagtttgggcatgttgttgaatggcttgaatatgcccccaccttcctttcaggctctgaatttgaaaatgcatgcttatttgttgatggattcttggcctcccggacctttctggttggtcatggcctgacaattgctgacattgcagtttggtcaaatcttgctggaattggtcagcggtgggagagtctaaggaaatcaaagaaataccaaaatcttgttcgctggttcaacagcatagattcagaatacaaagaggcactgaacgaagttgtggctgcatttgttgggaaacgaggtattggaaaatctcctgcacctagccttaaggagaaggtacatgactcaaaggacccatcagctccagaagttgatctccctggtgcaaaagttgggaaagtctgcgttcgttttgccccagagcctagtggttacctccatattgggcatgcaaaggctgcactattgaacaaatactttgctgaaagatatcaagggcgcttaatagttcgatttgatgacacaaacccttcaaaagaaagcaatgagtttgttgagaatcttttgaaagatattgagacgttggggatcaaatatgatgctgtcacatacacatctgattatttcccaaagctaatggaaatggctgagagtttgataaagcagggtaaagcatatattgatgacacaccaaaggagcaaatgaggaaagagaggatggacggtattgagtcaaggtgcagaaataataccgtggaggaaaatctctcattatggaaagagatggttaatggaactgaaaggggcatgcagtgctgtgtacggggtaaacttgacatgcaggatcctaacaagtcactcagggatcctgtttactaccgctgtaatactgatccacaccatcgtgttggttcgaagtacaaggtctatccaacatatgactttgcgtgcccatttgttgatgcattggagggggtaacacatgctcttcgttccagtgaatatcatgacagaaatgcacaatattatcgaattcttcaagacatggggttgaggagagtggaaatttatgaattcagccgattgaatatggtttacactcttctaagcaagcgaaagcttctttggtttgtacaaaacaagaaggtcgaagattggacagacccacgttttcccactgtccaaggcatagtacgtcggggcttgaaggttgaggcattgatacagtttatactccaacagggtgcttcaaaaaatctgaatctcatggaatgggataaactctggacaatcaacaagaagataattgatccagtgtgcgcaaggcatactgctgtgctaaaagaccagcgtgtcatctttactcttacaaatggtccagaggagccatttgttcgaattttaccaagacataagaaatttgagggtgctggaaagaaggctacaacctttgccaacagaatttggctcgattatgctgatgcggcagctattagcaagggtgaggaagtaacccttatggattgggggaatgctattgttaaagagatcaaggtggagagtggagtaattactgaactagttggagaactgcatcttgaggggtctgtgaaaacaacaaaattgaagatcacatggctagcagatatagaggagctagttcccctttcattggttgaatttgattacctcatcagcaagaaaaagctagaggaagacgaggacttcctcgacaatctcaacccttgcactcgacgggaaatcccagcccttggagatgcgaacatgaggaacatcaagcgtggagaggtcatacagctcgagaggaaaggctactataggtgtgatgccccttttatcagatcgtccaaaccggtggtcctgtttgcgatcccagatggcaggcagcaggcctcgcttagctaggcatggtgaccaccttttgggcacatggaattcctgagttggcgatgagtattgttgcattgtacactttaatattgtactgtgattaggctttactcgcggtggatgtctttcaccgctagatggccagaggcatatcctgccaaccaagcagagcagccattttgattttggtctatgatacttttacctgcgcttgaatattcctatacttctctagcagggccttcgttattttgccgttagattaaaaaaaaaaaaaaanaaagaaaaaaaaaaaaaaaaagcggcc

SEQ ID NO: 18310 - DNA, 2157 bp, Zea mays
ttatgcaagattactggaagaactccatgattctgtcagagcaagcatcttttaccgtttataattttcaagtaccctgactacatagatgcctatctgaggttagcggctattgcaaaacaaagaaacaatgttcaactgagcattgaactgataggtgatgctttaaagatagacgagaggtacccaatccggaatgcccgggtcgacccacgcgtccgggagtcttgaactccagagcgatgaagcctggcttaccgcaaaggagcatttccgtaatgcaaaagaggccaccaagggagatacctactctttgcttcaattggggaactggaattactttgctgccaatcgtcctgagaaaaaagccccgaagattgaggctactcatagggagaaagccatggaactctatcagactcaagtactaaagcagcaccgcagtaatatgtttgctgcaaatggtattggaatcttatacgctgagaaggccaaatgggatgtcgctaaggagttgttcacacaggtgcatgaagctgcatcaggaagtatatttgtacacatgcctgatgtatggataaatctggctcatacatattttgctcaaggtcattttcaacaagcagttaaattgtatcaaaattgtttgcggaagttcttccacaatacagatgcaaccatcctattataccttgctcggacacactatgaggctgagcgatggcaagactgcaggaaaactttgcttagagctatacatttggctccatcaaattacttgttacggtttaatgtaggagtgtcaatgcagaaattctcagcttcaaccctgcaaaagacaaaacaaacagttgatgaggttcgcgccacagtcactgaacttcagaatgccattagagttttcagtctgttatctgttgcatcaacgtaccactcccatggttttgatgagaggaaaatagaaactcatgttgagtactgtaaacatttacttgatgctgctaaggttcatcgtgatgcagctgagcaagctgaacagcagaataagcaaaaaatggaagttgctcgtcagattgctttggcagaggaagctcgccgaagggcagaagagcagagaaaatttcagttagaaaggaggagggaagaggatgaactcaagcaagtaaaacaacaggaggaacacttccagcgtgtgaaggaacaatggaaaacatccagcaacacccctggcaagagaaaagatagatctaagactgaagatgaagaggtgggaaataaaaagcggaggaggaagggaattaggaggaaggatcaaaaaacaaagatgcagtatggggaagaggaagatgagtacaaagatgaaccagaagcagatgatgactatgcagacctggcgaggtataatggcgctgacaattcagagagagccccagatcaccttcttgcggctgctggccttgacgattctgatgccgaagatgacatgggtcatcctcaatctgcaatagaacggaagagacgagcttggtcagaatctgaagacgatgagccagtgaagaagccagcagcacaacctagcccgggcgctgatggtttgagtgaatgaaagaaaccgagatgatgttcttgcagtgaagattaacatgcatgggtctttgctttaggttagcatggtgttgaattggggagattcagaacttcactatacatagctgatagtcaaggactatgtatataccttgttgccaatcttgtttatcgcattagattatggagttgtttaatctgctggtttctgcaatataacatggaatccagtcctattagatggtgacttgtaggtgttttagttgggatgcaaagttttgcacgtcaagtttcagcagttagatttcccaatggacgtatcatgaattaatgatatcacattggccgatatatgtagagaaatgttgaactcgctcgtcctctcagcaagaggacataaaactaagccaaaacaacaaacttaagagaaatgttgaacgggctagttatctcagcaagaggacataaaactaagcaaaaagaacgagcttaggacttgtttgaatgtacttgtatctatcgtaatccattatatctaccttaagactgtttccattatatctatctttt

SEQ ID NO: 18311 - DNA, 1489 bp, Zea mays
gtatatctagtgaattaataataatccaaagaaaaggctgagaggctgtaaagagtgttgaaggacgctcggttccttcaggtgcggcggcgaccttgtctaggattttacccgtggaacgtggcgaccacttccgacgggccactcgccgccgctcgcccgccctgctcttcaccccttctcccgggaccgggacaagcgatctcccgtccccgtagtccgcaggagagagatttttttctcggttgcaatgaagagttatccgtgggcgggggcccgccctcttgccgtcgtgcagctcctcctcttcctcgcccacctcgtcgaccgcggcggtgctgccggtggaggcagcaagggcagctcggtgtacccggcggctgtcgtctacccgcatcactcccgccagatctcctgcaaacccagggtgttcctgtatcagcacttcctcagcgacgacgaggctaaccacctgatctccctcgcgagagcggagctcaagaggtcagcggtcgccgataatatgtctggcaagagcacgctcagtgaggtccgcaccagctccggcaccttcctcaggaagggccaggatcctattgttgagggtatagaggacaaaattgctgcatggacattccttccaaaagagaatggtgaagatatccaagtcctaagatataagcatggggagaagtatgaaccacactatgattacttcactgacaatgttaacactgtccgtggtggtcatcgctacgctactgttcttttgtacttaactgatgtaccagaaggaggggaaacggttttccccttggctgaggagcccgatgatgctaaagatgcaaccttgtcagaatgtgctcagaaaggcattgcagtgagaccacggaaaggtgacgccctccttttcttcaaccttaacccagacggcaccaccgactcggtgagcctccatggtggttgcccggtcataaaaggcgagaaatggtcggctacgaagtggatccgtgtggcctcgttcgataaggtccatcacccacagggcaactgcaccgacgagaacgagagctgcgcgaaatgggcggccctaggggagtgcataaagaacccagagtacatggtgggaaccacagcgttgcctggttactgtcggaggagctgcaatgtgtgctagggtcaggacgtgagagtactagtatttgttagtgcataccacttgtatccatagtctgttgttggtctcctacatctcgcataaaagaaatactcctatgctataggttatgccgatggaggtgcatttagaataagcctagtatttgatctattgatttattagattgcttggttctgctagctcataatttgtaccggaaccttagaagatctttgattcgttgtcatctgtaacattttctcgatatatatatggtgtgcatttctggtcatccaaaaaaaaaaaaaaaaaaaagggggggcccggtac

SEQ ID NO: 18312 - DNA, 1283 bp, Zea mays
ggccgggccgggaatggaaccgtacctccagtggttagggatacagctcatggagctcggcggtaccgcaatgtcgctgctgctgctgctcgtgctcgccgcgtcgccattgcagcaggccagggcggttggcggcggcaggccgcgggtgccggccatcctggtgttcggcgactccatcgtggacacgggcaacaacaacgccgtcctcacgctcaccaagtccaacttcaggccatacggcaaggacctcaacggcggcgtacccaccggacgcttctccaacggccggattccgacggacttcgtagcttcacggctcggcttgaaagatctggttccggcgtatctcggcaccgacctcagcgacgacgacctctgcacgggcgtcagcttcgcgtctgggggcaccggctacgacccgctcacctccactctcgtggaggagctcaacatgttcgcggagtacaaggagaggctcgcaggggtcgtcggagacgaggccgccgccgcaggaatcgtggccgaaagcctgttccttgtctgcgccgggtcggacgacatcgccaacaactactacctcgcccccgtcagacctctgcagtacgacatctcggcgtacgtggatttccttgtggagcaggcctgcgacttcattaggcaactgtaccagcaaggggccaggaggatcgcggtcctggggatgccgccggtcgggtgcgtgccctcgcagcggaccctcgccggcggcctagccagggactgcgaccccgctcgcaaccacgcggcgcagctgtacaactccaggctgaaggaggaggtagtgctgctccagaaggagctggcgtgccagagaatcggctacgtggatatctacgacgtcctgcaggacatgatcacgaacccctgcaaatacggcttcgaggtctccacgagaggatgctgcggcaccggggacttggaggtgtcgctcctgtgcaaccagctgacggcgccgacgtgccctgacgaccggaaatacgtcttctgggacagcttccatcccaccgagaaagcatacgagatcatcgtggactacctgttcccgagatacatagagaacctgctataattacttctgctttaccgtcgcttctttaattcgatcgtttctagttgttgtcaagtttagacatgccgtctttgtttcccaatttaagcttttgctttaaaactcaagacttttcaaggaaatgaaatgacacctgctagcttgttgcaagctgttaaaaaaaaaaaaaaaa

SEQ ID NO: 18313 - DNA, 1312 bp, Zea mays
  misc_feature (740)..(740): n is a, c, g, or t
ggtaccctcggagtcgcccgagaatggaaccgtacctccagtggttagggatacagctcatggagctcggcggtaccgcaatgtcgctgctgctgctgctgctcgtgctcgccgcgtcgccattgcagcaggccagggcggttggcggcggcaggccgcgggtgccggccatcctggtgttcggcgactccatcgtggacacgggcaacaacaacgccgtcctcacgctcaccaagtccaacttcaggccatacggcaaggacctcaacggcggcgtccccaccggacgcttctccaacggcaggattccgacggacttcgtagcttcacggctcggcttgaaagatctggttccggcgtatctcggcaccgacctcagcgacgacgacctctgcacgggcgtcagcttcgcgtctgggggcaccggctacgacccgctcacctccactctcgtggcagttctgccgatgcaggaggagctcaacatgttcgcggagtacaaggagaggctcgcaggggtcgtcggagacgaggccgccgccgcaggaatcgtggccgaaagcctgttccttgtctgcgccgggtcggacgacatcgccaacaactactacctcgcccccgtcagacctctgcagtacgacatctccgcgtacgtggatttccttgcggagcaggcctgcgacttcatcaggcaactgtaccagcaaggggccaggaggatcgcggtcctggggatgccnccggtcgggtgcgtgccctcgcagcggaccctcgccggcggcctggccagggactgcgaccccgctcgcaaccacgcggcgcagctgtacaactccaggctgaaggaggaggtcgtgctgctccgcacggggctggcgtgccagagaatcggctacgtggatatctacgacgtcctgcaggacatgatcacgaacccctgcaaatacggcttcgaggtctccacgagaggatgctgcggcaccggggacttggaggtgtcgctcctgtgcaaccagctcacggcgccgacgtgccctgacgaccggaaatacgtcttctgggacagcttccatcccaccgagaaagcatacgagatcatcgtggactacctgttcccgagatacatagagaacctgctataatcacttctgctttaccgtcgcttctttaattcaagtttagacatgccgtctttgtttcccaatttaagcttttgctttaaaactcaagacttttcaaggaagtgacacctgctagcttgttgcaagctgtaaagattgattggttttgtttacttgttccgtgcgcgagc

SEQ ID NO: 18314 - DNA, 1633 bp, Zea mays
cctcgaggccggccgggacacattagtgctgttctgattcccaattgcctgggtccctcgggcccgccgggaaacgacgatacccccacgtctccaaaccctaaggcggccccaaattgttatcccaaaccctagacctaaacggctccatgctgtgagaccaccaacagtgtccatggctctggacgccccggtggagcgacgggacgaggtacagatcgcgatggggaacggaaacggcgtggcgccgtctcaaccgtcgcggccagccggtcggccaacggctgctgcggcggcagcgccatacgcggacaggcggctgcggctgaacccaaatgcggatcacaagccggaagactacagcgacgtgcgcggcgagtacgcgccggccgtgtacagcgcactcgagcggcatctcccacccagcctcatcgatgccgaccgcgatgtcaagctacacttcatgcgggacattctcgcgcgctactggccgcagggcgagcgtaacaaggtgcaaaggcacagagaatataggcagaggatactccacctttacaagcctcttcatgaagaattatacaatatgcatccttcagtgttcttcttaccaacattccttgaagcagttaggagcaatacagaagaatgctttagaagtattatgactgagccaattcctggtgtttattcgtttgctatgttgcagcctactttctgtgagatgttattggaggaggtagagaactttgaaaaatgggtccatgctatgaaatttaagataatgaggcctaatacaatgaacaagtatggtgctgtccttgatgattttggcctggaagctatgctgaaccagttcatggaacagttcatagctccaatttctaaagttctttatcctgaggttggtggaggaacattggactcccatcacgcttttattgttgaatatgggaaagacagggatgttgaactaggttttcatgttgatgattcagaagttacattaaatgtttgccttggaaaacaattctctggtggtgaattatactttcgaggtattcggtgtgagaatcatgtgaattcagagacacaacatgaggaaatgtatgactacacacatattcctggttgggctgtactccaccatggtcgacacaggcatggtgctcgagctacttcatctggtctcagaataaatctgcttttgtggtgccggagagagatgaagaaataccagaaggattttccgagctggtgtggtgaatgccagcgcgaaaagagggaaaggcagagtcagtgtgttaaagcaacgaagatggcctttctcaggggttctggaggtgcagcgatttaatttgtacgtaggtcatttatgttatatactgttttgcgtcatactgaacttcatcgtttaggacttgacaggggcattgtatcgatggccagctttgtgctagtgcgtttattggtgcgatcccagttgtatgtaaatgtaaacattgaccaaatgcagccgaaagaaatgtaatagcgggtcataaactgctatgaatttggatacttttgttgccaaaattgataaattggaacgccaatagcttggcgtgattattgatcaaaaaaaaaaaaaaaa

SEQ ID NO: 18315 - DNA, 1623 bp, Zea mays
  misc_feature (799)..(799): n is a, c, g, or t
ccggccgggaacagagtgctgttctgtattcccaaattgccaccctgttctgcgtactcgtcgaaacgacgataaccacacgtctcgaaaccctaaggctgccccaaattgttatcccaaaccctagacctaaacggctccatgctgtgagaccaccaacagtgtccatggctctggacgccccggtggagcgacgggacgaggtacagatcgcgatggggaacggaaacggcgtggcgccgtctcaaccgtcgcggccagccggtcggccaacggctgctgcggcggcagcgccatacgcggacaggcggctgcggctgaacccaaatgcggatcacaagccggaagactacagcgacgtgcgcggcgagtacgcgccggccgtgtacagcgcactcgagcggcatctcccacccagcctcatcgatgccgaccgcgatgtcaagctacacttcatgcgggacattctcgcgcgctactggccgcagggcgagcgtaacaaggtgcaaaggcacagagaatataggcagaggatactccacctttacaagcctcttcatgaagaattatacaatatgcatccttcagtgttcttcttaccaacattccttgaagcagttaggagcaatacagaagaatgctttagaagtattatgactgagccaattcctggtgtttattcgtttgctatgttgcagcctactttctgtgagatgttattggaggaggtagagaactttgaaaaatgggtccatgctatgaaatttaagataatgagggcctaataccaatgaacaangtatggtgctgtccttgatgattttggcctggaagctatgctgaaccagttcatggaacagttcatagctccaatttctaaagttctttatcctgaggttggtggaggaacattggactcccatcacgcttttattgttgaatatgggaaagacagggatgttgaactaggttttcatgttgatgattcagaagttacattaaatgtttgccttggaaaacaattctttggtggtgaattatactttcgaggtattcggtgtgagaatcatgtgaattcagagacacaacatgaggaaatgtatgactacacacatattcctggttgggctgtactccaccatggtcgacacaggcatggtgctcgagctacttcatctggtctcagaataaatctgcttttgtggtgccggagctctgtgttcagagagatgaagaaataccagaaggattttccgagctggtgtggtgaatgccagcgcgaaaagagggaaaggcagagtcagtgtgttaaagcaacgaagatggcctttctcaggggttctggaggtgcagcgatttaatttgtcgtaggtcatttatgttatatactgttttgcgtcatactgaacttcatcgtttaggacttgacaggggcattgtatcgatggccagctttgtgctagtgcgtttattggtgcgatcccagttgtatgtaaatgtaaacattgaccaaatgcagccgaaagaaatgtaatagcgggtcataaactgctatgaatttggataaaaatccccccacccctgggggggcccggcgcccatagcttggcgtgattattgatt

SEQ ID NO: 18316 - DNA, 883 bp, Zea mays
taggccgggggcatcgatcggtaaggctcagctcagctcagctagcatatcgtcgtccctgcattatttgagtttctctcgtgctctagctactagcatcctcgacatcgatggcttctggtgccgccgccccggttaagatgtccactgcagtgactgcctgcatcctgctggcggtcctgctgcccatggcgcccaagctagtaatgggtgacgtttgttccgaccgttgtggtaccctttgcgaaacctttgctgatgggttctgcacgggcaacgccaacgaccccgggctttgttcaacggcatttgaggagccatgcaagcccacgcttgtcacagggtgtaccgctgaatgcaattcattctgcactacaggcggattcgttccttgcgctgcttagcttgatgagattgcatgcatgcgcagcgcattcataataagtattactgtttgcggcagaataaaggtgagtgcaagagcaaccagcaggcctcttccccacgcatacacacactgcagcgtgagctgagggaggaagcatgcaataagcttccacgatgatctacgtactatcccacatttccttactatattttcctttgtttaattcacagtcaagattgtgccgttcagaggccagcatacatgggcttattgtacttctccatatgcatatggaaacgtgtagtgtgccaattctctgtatggtctttcagtgtctactagtagacatatatatgtcattgtcatgtaatctcctctcgcgggcttactaccatcagcacagctgagggaagttgtattgaaataaaatcatattaaaaacccgcagtgctctatgtttttgcacatcagtagttaggctttatatggggcgta

SEQ ID NO: 18317 - DNA, 2468 bp, Zea mays
cgacctgcaggtaccgcgtcgtcggtgctactaggagtctaatgagagcagcaactttgcacttgcctatactatccgtttgacgaaatacattagtaaagaggtgtttttaaaaataaacaataattatataaaaaatagtgcaaagtgagcactcgaaccccgcatcgtcggtgctactgggagtctgatgagagccgcagctttgcacttacctatactatccgtttgacgaaatgcattagtcaagaggtgttttagaaataaacaataattatataaaaaatagtgcaaagcaagcagtcgaactccgtgtcgtcggtgctagtgggtgtctgacgaaatgagagcagcagcattgcacttgcctatactatccgtttgacgaaatgcattagtcaagaggtgttttagaaaaaataaacaataattacataaaaaaatagtgcaaagcgagcactcgaaccccacgtcgtcggtgctactgggagtctgatgagagcagcagctttgcacttgcctatactatctgtttgatgaaatgcattagtcaagaggtgttttacaaaataaacaataattatataaaaaatagtgcaaagagaacactcgaaccccgcatcgtcggtgctagtgggagtctgatgagagagcagctgctttgcacttgcctatactatctgtttgataaaatgcattagtcaagaggtgttttagaaataaacaataattacataaaaaatagtgcaaagcgagcagtcgaactccgcgtcgtcggtgctagtgggagtctgacgaaatgagagcagcagctttgcacttgcctatactatccgtttgacgaaatgcattagtcaagaggtgttttagaaaaaaaataaacaataattatataaaaaaatagtgcaaagcgagcactcgaaccccgcatcgtcggtcggtgctagtgggagtcggatgagagagcagtagctttgcacttgactatactatccgtttgacgaaatacattagtcaagaggtgttttagaaaataaacaataattatattaaaaaatagtgcaaagcgagcactcgaaccccgcatcgtcggtgctagtagtgggagtctgatgagagtagcagacttgactatactatcggtttgatcttggcctagctagttacacatacggtcggatgcgccgatgtgtgcagcaagaggccggcggcgtcggtggtggcagcgtccactatcgtttgacgaaatgcagccttgcttgtcagcaattaacataatggtaagctcacgtgtggatgtgtggtttggatgttaagtgatatgttataaaaaagcttatgcaagttgatactgaaacctctcgttaaaataatgggtctccagggtattgaactctattaatattacttggtcaattaatgcttaacatgcatgcttaatggaatcacacatatgatcatatcgagtagctcagtgatatgcttttcttccagctgggctagcgtgtgcgtgtgtggtagtgctgcaggcctgcgctattaatatactctgggatatgcactttgctgcctataaattggctgcgcctcgaggccggccgggccggcatcgatcgggtaaggctcagctcagctagcatatttgagtttctctcgtgctctagctactagcaacctcgacatcaatggcttctggtgccgccgccccggttaagatgtccactgcagtgactgcctgcatcctgctggcggtcctgctgcccatggcgcccaagctagtaatgggtgattgttccggcagttgtgttaccctttgcgacacctttgctgatgggttctgcacgggcaacgccgaccccgccatttgtccaccggaagtgcaggagctatgccatcccacggttttcacagggtgtatcactgaatgcaatacactctgcgctacaagcggattcgctccttgcgctgcttgatgagaaagtatcgtttgcggcagaataaaggtgagtgcaagagcaaccagcaggcctcttccccatgcatacgcacactgcagcgcgacctgagggaggaagcatgcaataagcttccacgatgatctacctactatatcccacatttccttactatattttcctttgtttaattcagtcaagattgtgtcgttcagagtccagagcatgcatggggtgcgtacgtattactagtattattgtacttctccatatgcatatggaaaagtgcactgtgctagcttgtgtacgtgtgccttttctgtgcatgcatgtgtggtctttcagtgtctactctagctattagtaggcatatgtcattgtcatgtaatcgatctctcgcggccgggcttactaccatcagcacagctgagggaatttctattgaaataaaatcatattaaaaacaaaaaaaaaaaaaaaaaagccccctagggccaaaaagcccctagggcc

SEQ ID NO: 18318 - DNA, 478 bp, Zea mays
cggccggccccccgcccaggtacgcgggggcatcatcgatcggtacggctcagctagcgcatatccctcccagctggtcgtgctctagctagctaacaagcaaccatcaatggcttccggtgccgccgccccagttaagatgtccaccgcagtgactgcttgcatcctgctggcggtcctgctgcccatggcgcccaagctagtaatgggtgattgttccgacagttgtcctgacctttgcggcgagtttgctaagcagttctgcacgacaaaccccaaccccatcacttgtccaccgggcacggagagcacatgcgagcccgtggttaaagaagggtgtgtcactgaatgcaagacagtctgcgctacaggcgcatacattggttgcgctccgtcttctccttgatgagaatgcatgcccatggcgctcgatcatgcttctctttgggtacctcggccgcgaccacgctacacgcta

SEQ ID NO: 18319 - DNA, 848 bp, Zea mays
cccgcgagtcgggcggaagcggcatcgatcggtaataaggctcagctcagctagcatatcgtcgtccctgcatttgagttcctctcgtgctctagctaatagcaacctcgacatcaatggcttctggtgccgccgccccggttaagatgtccactgcagtgactgcctgcatcctgctggcggtcctgctgcccatggcgcccaagctagtaatgggtgattgttccggcagttgtgttaccctttgcgacacctttgctgatgggttctgcacgggcaacgccgaccccgccatttgtccaccggaagtgcaggagctatgccatcccacggttttcacagggtgtatcactgaatgcaatacactctgcgctacaagcggattcgctccttgcgctgcttgatgagaaagtatcgtttgcggcagaataaaggtgagtgcaagagcaaccagcaggcctcttccccatgcatacgcacactgcagcgcgagctgagggaggaagcatgcaataagcttccacgatgatctacctactatatatcccacatttccttactatattttcctttgtttaattcagtcaagattgtgtcgttcagaggccagcatgcatggggtgcgtacgtattattactagtattattgtatgcatatggaaaagtgcactgtgctagcttgtgtacgtgtgccaattctgtgcatgcatgtgtggtctttcagtgtctactctagctagtaggcatatgtcattgtcatgtaatctctcgctgagggaatttgtattgaaataaatcatattaaaaacaatatatttcgttcaaatacccaaaaaaaaaggccctag

SEQ ID NO: 18320 - DNA, 2001 bp, Zea mays
cccctgttcccagaggcggcagggtgggcgaccagtctcctccgcacgcttcccaccgagctcacacactgcacactcccacactcccactcccacctgtaggttcacgggaggcgaggaccctgccccccctgcattcttcccgtatcgcggaccgatcctcgccgcgggaggcgagcggagcggggcgtttctgcgggggagaagcgcgtccctgcaatttctgagagaggggaggcggcgagtggaaaagagcaggcgttgctatcctatcttgctgacacagcggcggtgtggcgaggcgcatggcgagggcgcgcggtggcgccgcgtggtgggtgctggcagcggcgtgggtgctgtgggcggctgcggctgcggcggaggcggaggccaggtcgccgtcggcgaggagggtgcaccggcacctcaagcgcctcaacaagccggccgtcaagagcatcgagagtccagatggagacatcatcgactgcgtgcatatctcccaccagccagcgtttgatcatcctctcctcaagaaccacacaatacagtttaggccggcgtaccaccctgaaggtctatacgatgataccaagagcagcataggctcaaacaatgctggcgagaggccgatgctccagatgtggcatcgaaatggcaggtgccccgagggcacggttccaatcaggagaaccaagaaggacgacctgcttcgagctagctccgtgaggcggtatggcaggaagcggcacactgctccgaacccactgtctgttgatcccaacatgctcagcgagggtggccaccaacacgccattgcgtacgtccagggcgacaagtactatggtgcaaaggccaccattaatgtgtgggagcccaagattcagcaggctaacgaatttagcctgtcccagctctggatcttggggggttcatttggggaggatctcaacagcatagaggctggctggcaggttagccctgacctctatggagacaacaacaccaggctgttcacatattggactagtgatgcataccaagccacaggttgctacaacatgttgtgctctggtttcattcagataaacagcgaggttgccatgggggctagtatcttccccatctcgaactacgcgggctcccaatatgatattagcatcctgatctggaaggaccccaaggaaggaaactggtggatgcagtttggcaaggaatacgtcctgggctactggccgtccttcctcttctcctacctcgcggacagcgcgtcgatgatcgaatggggcggggaggtggtgaactcggagcccgacggcacgcacacatcgacccagatgggcagcgggcacttcccggaggaagggttcagcaaggcgagctacttcaagaacgttcaggtggtggacagcagcaaccagctcagcgcccccaagggcgtaggcaccttcaccgagcagtccaactgctacgacgtgcagaacggtaacaatggggactggggcacctacttctactacggcggccctggcaagaactcgaactgcccgtgactggtgcttctaatgtgtagtgtgaagtgccgtcaccactagcaaaatgtaacccaagcgttcaggttcgcttatacagcgtcaatctgcatctccttgttcagtcctagctaggtagtgtgtaacatgtgcatgtgctctctagactctaatgttttcttcttcttttcattgtattttcttcttgtgccatgtaaagtttctgaagagaaggagcatggcttgaggctgcggtgggtggttgggctggtcggtggtgacctctactgatttttgcgaagtctgcttattggtcaccttcgccagttattttgaaagtgtgctatagcttgtttgatgatgaatgatagtaatgctgtaatggtattgagcttagtggttattattgcatccagttaaaccacccccggcggggtgttaaaaattcagaaattgttgataagct

SEQ ID NO: 18321 - DNA, 3444 bp, Zea mays
cgagagacacgaatgcctcctcgagcgggagccatggcggcggcggcggcgagggcaagggcggcgctgctgccctcctccccctccccatcgccgctgttccgcctcccgcgccgcttcctttcactcaccgcgactcgctaccctctctactacgacctcatcgtgcatcgccccgcggaccccaatccccccaaatcctccgccgccggggccgaccggcagccgcagccagcccccgaagagcagacgctcgaccgcgcaaagcgccggtacctccgcaagcgccgcagccgcctactccccgaccctgacgccaccaccaccactaagccctcctccttgtcgtcggagttcgtcgagctcaggccggaggtggtggacttcccgcgcctgcacgcgcgcgaggaggcgctctacttccacgacaccttcgcaatgccgtgggagaaggacaagcactaccgcatgctctaccgcctcgagaagaagtacttcccccaccagtcgctcgacaacgcgttcgtctccgccgacgccgccccggcctccgacgccgacagggggctcgtattctttgacgacgagaagaaggaaaacgagggagaggagcgggcggtcagtgacaagggcgccaacaaaggggaggtgctggagaggaaggtggaggatttcttcaggtctctcaagaagggtcccggccaagtcgacaccaaagccaagagaccgggaacggagccgcagcagcaggtgaagcgcgaagtgcggagggaggaggagcggccgcagccgtacctcgtcactaggaccacggagctgccgccgaggtgggacggccctgctgggaccgtcgtgctcatcgacaagcccaaaggatggacttcgtttactgtctgtggaaagttacggcgcttggtgaaagtacaaaaggttggacatgctggaactctggacccaatggcaactggattgttgattgtttgtgtaggaaaagcaaccaaaatagttgacagctaccaaggaatggttaagggctatagcggtgttttccgacttggagaagccacatcaacctgggatgcagattcaccaattatccagagggaaccatgggaacacatcaaagatgaaaatattagaaaggcagcagcatcattcatgggtgagatatggcaagttcctccaatgttttctgccattaaggttggcggtgaaaagatgtatgacaaagcaaggaagggtgaaacagtagagctttcaccaagacgtatatcgatataccaatttgatattgagcgcagtttggaagacagacagaatttgatatttcgagttacttgctcaaaaggaacatacattcggtccctatgtgcggacttgggtaaagcacttggaagctgtgctcatttaactgccttgcggagagactcgataggtgaatactcggtcaatgatgcttggaacttcgatgagcttgaagaacaaatcaccaaggggtatttatgagcatgccagtgagccgagctaggttatatgcggcttgcaaccagtggcatccatgctgccatgtcagtcccaaagctgtcaacgtgggcttcagcgaagagttgcaaatccagttcagttcatcctcaaccttttgtcatatagaggaacacgaagctccgttagttgtatgtgtgttgtgggtttcaattgatctcagtattgaatcgattttggcagtattgatgtataccattgttggtcaggtcttttgattgccttgccatgtaattttgctgggagcatattaaatttataatctaaagactgtgttaaaagtagcgaaatttataatctaatgacgaacacaagctggcgttaagtccccccctttttcttctctcgtccctcgacgctcctcagagcatgaacagtgctaccatctgaatcatccctttatctaatattgcttgtaatgttattcatctgaatcattcctttatctatgtacttatagatggtatcaaatatgagagtctgatcttaagaacatgacgaatgattcatatacccacagccatttgagaaaatccactgtcgaaagggagtatttgtttgcttctttgcatagaagatactacgtcctctatttcaaattaaatttcgtttttgttttttaataggatcatataataattaatgtatgtgtttgtatatgtgtttggatccatcatcatccattcgagctcaaatgggacggggggcagtaataagttactcatgcggagggaaagggttagaaatttaatttacgtatatattttggtgttctgggctcttacatcaaagaaaaatatataatttaagatcttaaactgactccttgttgtgtaaattttagtttttgtataggtaacttttatgcaatgtcatcaaagcctgtggtcgtttgtaattttgttgtctttctaatttttgccagctagaagctgatttgttctctgcaatttttgcccgtccagtctctctgatttggttattattgcaatttgttctctgttattataatttttgccagccaaaaactgattcatcgcacttggcgccttcactgcaaagtccatgaatttttttcgtcatgcgctttccatcatttccaattggcaaatgagtatcctcaaattgctacctttttccatgcatatataaatacatactaaggttaccaaattagccctaaatcttgagtgtatacaaactagactttttagatgggaaaagatctagatgaaaagacgactttttccgttagggctagtttgtaaactcaaatctcatctaggattaaaaaagaaatgaactaatttcttcttcaatcctcttcaatctcggaggggagttgagtttccaaacttgccattaggagttgctgatttaacacatgttcaatgtcacgaaaattgacttcttatgagtatgtccactccagatttccagtgtatctaaagttatattggagtttggctctctaccatttgttcttctcttctgcacgatttccgagaaaaagcactgcaggttaaggctgtgatcaaaccaatctttggagctggagcatttgcgcaactgttgtgatgcttacaaagtttcatatgagataaaaagtgttggacatggagcggataacgttttaaactgacaacaataagctcgttgtttcaaattcaggcgtgggcatggaaagcgacaaccctcgacgacatgtaaagctagctccaatgacacaaatgcccctccttgtgtcccccgaccggtgtccgaatagggtgttggccactccaacggcgtcccctgttgtgcccccatgcgagcgggaggatgactgatgtatcaaattcaggcgtgggcatgggaagcgacgccccacgacgacgtgtaaggcttgctcctattggcgcc

SEQ ID NO: 18322 - DNA, 2270 bp, Zea mays
cggaaaaaaaagggttgcactaggccggccggagctgaaggcgctaaactactactacacacacacacacacacacacatcctacgcatcttctcgcagccatctttgtggaagcaaggcgggcaacatcgtgtggctagccagcaagagggagagaaacaagcacaagtatggcctcaaaacctggccctctgagtcgctggccatggcaagatcttggaaactacaagtacgcgctggtggctccatgggcggtgcgcagcacgtacaggttcgtgaggagcgggagcggggagcgggacctgctcgccttcgccgtgctgccggtgctcctcctccgcctcctctacagccagctctggatcaccgtgtcccgccaccagacggcccggagcaggcacaggatcgtcaacaagagcctcgacttcgagcaggtcgacagggagaggaactgggacgaccagatcctgctgacggcgctgctcttctacgcggtgaacgcggcggtgccggtggcgcagtcggtgccgtggtgggactcgagggggctgctggtggcggcgctcctccacgtgggtcccgtggagttcctctactactggctccaccgcgcgctgcaccaccactacctctacgcccggtaccactcgcaccaccacgcctccatcgtcaccgagcccatcacatcggtgatccatccgttcgcggaggagctggtgtacttcaccctgttcgccatcccgctgctcaccatggtgggcaccggcaccgcctccgtggccgtggccaacggctacctcgcctacatcgacttcatgaactacctcggccactgcaacttcgagctcgtccccaggctgctcttcgacgtcttccctcccctcaagtacctcatgtacacgccatcgttccactcgctgcaccacacgcagttccgcagcaactactcgctcttcatgccgctctacgaccacctgtacggcacggcggacaagtcaagcgacgacctgtacgagcgcgcgctgcagggccgcgccggggaggacgcgcccgacgtcgtccacctcacgcacctcaccacgccggcctccctcctccgcctccgcctcggcttcgcgtccctcgccgccgcgccggcgccgcccgcgtcccgctacggcgccggcagcagcagcagcagcagcagcagcctggcggcggtggcgtgcccgctggccgcgctcctcggctggacccggaccgccttcaggtccgaggccaacaggctccacaagctcaagctcgagacgtgggtcgttccaagatacacctctcagtacctgtccaagcaaggcctgtacgcagtggggcgtgtggtggagaaggcggtggcggacgcggaggcgagtggcgcgagagtactcacgctgggtctactgaaccaggcaaacgagctgaacaaaaacggcgagctgtacgtcatcaggaagcccagcatgaggaccaagatcgtcgacgggacaagcctggccgccgccgccgtgctccacatgatccctgagggcaccgacgaggtgctcctcctgggagacgccggcggcaataagatggcgggcgtgctggcttcggcgctctgcgaacgcgagattcaggttcacgtggtcgacaaggacctgtacgagtccgtgaagcagcagctgcgcccagagacgcacgagcatctcctccacctcgctgagtggtggagtcacagcgccaagacgaccaaggtatggctcgtcggcgacaggctgacgggcgaggagcagaggagggcgcagggcggcgcccacttcgttccctactcgcagttccctcctggcgccgtcgtccgcgccgactgcgtctaccacagcaccccggcgctggtggtgccggacgccttcgaggacctccacgcatgcgagaactggctgccgcggagggtgatgagcgcgtggcgcgcggcgggcatcgtgcacgcgctcgaaggctgggacgcgcacgagtgcggcgccagggtcaccggcgtcgacaaggcctggcgcgccgcgctcgcccacggcttccgcccctacgaccgctatggcgccaactaatacgtgaagtgaccattacgaacgacgacgactacgaagcgtacctgtgcatggaatgatgagtagcatctatctatgaagacgaggaaaaaaacacttctttgtttatcgttcaagatgcaaaaagaaaaacaaagattcgtctttgacagttcaaaaaaaaaaaaaaaaaaa

SEQ ID NO: 18323 - DNA, 1048 bp, Zea mays
attgggacctcgagccggccgggagtacgcccaaaggcccatcaaccgagagccttcgtcttccttctctcatcctttgctcctcttcaaacgctcgagaaagagagagagactaaatcctccctcgaaaccctagcatagccactgccttcccgcacgctaggaaggggaagatatgggcgccgaggaggacgccgctgcacgccgcgagcgtctccgcgccctccgtgccgccaaggacctcctctccacccccgacggcgccccaaccccttccaccgacggagaacaccaaaatggcaaccatgagatggcagaagagccagaattaccaggtcatcaggatgcacctggtgaggctgctaaagaggatggtagccccactgaggaggccgaagaggttgaagatgatggtgagcttccagccatgaagttcagaaactaccttccccatgatgaacaacttcgaggaggcaagctggctccagtgtctcttcccaagtttgaagacccaattagtgccgaaactgcagagccaaaggaagtggagaacctttttggaaacatagcaccaaagaatccaaattgggatctgaaacgtgatgtgcagaagagaattgataaactggaaaggcgcacgcagaaagcgttggctgagattgcattggaacagcagagggagaaggaagccttggaggaatctcaagattgaccgacctgtataagtgaccagtgactcatgctggttggtccctcgagcagacgtcattatcttatttagataatgtaatgtactttgggatgctctgtgtatctaccatcttgggatgtactgaattgagtttgggacgtgtatctacctaccatcttgtattgtcagctcaaggatgtagcaaactagtagcaacttcaaaaaatgagatgtagcagtcctgttctgttagacggacctggtcaaactaccgtactaaatacaaacaaagcacaccttcatgctgtgttggactcggtattctcaggcaatggacgaataatgacttctttggtg

SEQ ID NO: 18324 - DNA, 967 bp, Zea mays
aaaaaaaatgtagagagggcaaggcagcaggagcgaagcttgctagctcaccgagcgccgcacactaggtgatgacggcgacctcctcccacgagacctcaaatcacggctggacaacggcggggcaaacgtcgctgtggctcagctggcgctgctctgggcctctggcggtccggctcggcgggcagcggctcagtccgcggctgcagcagtgctctgctggtgttgctctgggcctccggcggcggcggtccggctcggcaggcagtggctcgggcctcctgcctccaggcaactaggcgagcagcgctgcgccgctgcgtgctgcagcctgcagcggcggtggtccggggctcgggtcgtcggggcgtccccgtgtggggtcgtggccggtggcccggtacaccggtgggtgcctgtgcctgggtcttggcgggggtggctcctcctgtcctccacggctggcggcctggcggcggctggtttagggtagacgcggacgcgggagtgggcacggggacagagcttcacgcgcgcgcgatgggcctattccttgttactgggctgcgactgggctgcaccccggtcgtaaatccgcccctggcgcaggagcaggggaccgctcggcactggggcagtgcgtgttctgccgccgaggaggagggcccgtgtgctcgcttcgtgctctcgcgagcctgccgccatgaaccgcggtttggaggtggagaggaggcgccttctcatgtccgggctcgtgtcttctttcacaatcgtgctcccgatttcaggtagtgttcacgggcctccgctcctaatgattcgttgttaacgcagttcgccagttcagggtcttctgaatggtagagctagcattttttactctctgttaatgtccacaaactgaatttgtcaggcgtgtcagttctatgaatatatatgcgttatgtgctcaaaaaaaaaaaaaaaa

SEQ ID NO: 18325 - DNA, 1798 bp, Zea mays
tcttgttctagatcgcgagcggccgcgcgcgagctctcccccaggagcttgtaccccacaccactaggcactagtccactacctaacgctacctgccttttcaccgcgtcgtgcgccaccgccacgttgagctcgcgtccgtcccagatccgccgtgctcctccatcgctcgcgcaagatgaagatcacggtgcgggggtcggagatggtgtacccggcggcggagacgccgcgccgccggctctggaactcggggcccgacctggtggtgccgcggttccacacgcccagcgtctacttcttccgccgcgaggacgcggacgggaacgacctggcgggcgcggacgggagcttcttcgacggggcgcggatgcggcgcgcgctggccgaggcgctcgtgcccttctacccgatggccggccggctggcgcgcgacgaggacggccgcgtcgagatcgactgcaacgcgggcggggtgctgttccaggaggcggacgcgcccgacgccaccatcgactacttcggcgacttcgcgcccaccatggagctcaagcgcctcatccccaccgtcgacttcacggacgacatctcctccttcccgctgctcgtgctccaggtgacccacttcaagtgcggtggcgtggctatcggcgttggcatgcagcaccacgtagccgacggcttctccggcctgcacttcatcaactcgtgggcggacctctgccgcggcgtcccgatcgccgtcatgcccttcattgaccgctcgctcctccgcgcgcgcgatccgccgaccccggcctacccgcacatcgagtaccagccggcgcccgccatgctatcctctgagccgccacaggcggccctcacgtccaagccggcgacgccgcccacagccgtggctatcttcaagctctcccgcgccgagctcgtccgcctccgttcgcaggtccccgcgcgcgagggcgcgccgcggttcagcacgtacgctgtgctggcggcgcacgtgtggcggtgcgcgtccctggcgcgcggcctgccggccgaccagcccaccaagctgtactgcgccacggacgggcggcagcggctgcagccgccgcttccggagggctacttcggcaacgtgatcttcacggcgacgccgctggccaacgccggcacggtgacggccggggtggcagagggcgcgtccgtgatccaggccgcgttggaccggatggacgacgggtactgccggtcagcgctggactacctggagctgcagccggacctgtcggcgctggtccgcggggcgcacacgttccggtgccccaacctggggctcaccagctgggtgcgcctgcccatccacgacgcggacttcgggtgggggcggcccgtgttcatgggccccggcggcatcgcctacgaggggctcgcgttcgtgctccccagcgccaaccgcgacggcagcctgtccgtggccatctcgctgcaggcggagcacatggagaagttccggaagctcatctacgacttctgatctccaactcctccccacaagtcatcagtaccagtacgcgcaacacaaagaagcaagagaccgttgggagtaggttgcagcaatattctttgatttcacacatagttcctgcacacttttccgttcctgcctgccccctttgggcagggcgcataccttttgtgccgaattatttacgagcccctgcaattgtatgatgaatgaacaatgaatgatacagattaataagattaattaacttaaaaaaaaaaaaaaaaaaaaaaaatccgagggggg

SEQ ID NO: 18326 - DNA, 1283 bp, Zea mays
gccggccgggggacatggagatccttttgctctcacgcaagacgcaacaaaaggtttggatagaacactctgcttccccgtccttcggtctagcccgagtggacgtaggaagggacgaggggtcttgacgccggcgagccatggcgggggctctcctctcctctccgcacactctcccgagccccacatctcagtccccgttccgccccaggagcaggggaccactccacgctggggcagcgcgtgttctgccaccgaggaggagggcctttgtgctcgcttcgtgctctcgcgagcctgccgctaggaaccgcgggttggaggtggagaggaggcgccttctcatgtccgggctcgtgtcttctttcgcaatcatgctccccatttcagaagcatatgctgtcatggagactgatgaagacgtgaagatgaacacacaaattgatgagatcaatgcatactcttttctttacccggtggaactgccagggaagaaatttgccttcaaatgggtagagtccagaaaaccagagcgatattcctctgcagcgccactatcgcctgatgcaaggcaacgtatcgtatcagagcgagttgacatgatacacaatgttgtcatctcggtctcgattgggccaccgaattcacgttttttgccttcaaaagacaagagctcgtgggatccaaaagatgttgctgattgcattttatctgatagatctaccatgaaggtgacaactggccagcgcatgacagagagttctgtccttgacgcacacgttgcagaggttgatggagaaccatactggtattatgagtatcttgttcggaaatcaccaacaaaatctgcaccagaaccaaatttgtttcggcacaatgtagcctgcactgctgagcgtgatgggtacctgtactcactgaatgcttccactcttagcaaacagtgggaatctatggggccctttctacaaaagaccgtggcatcctttcgccttctccccggtacagaaaactatgttcctccctacaaggatccttggagattttggtgaatggagattcttcttgtagtcatcatttttatcccttcagatgactttatagcttcaggttttagaccatatttttcacgtcagatgtttagtgagtgtctgtcctttcagcttgacagataaaattcagagacccagtttggtatcagtttcgcccatcgtgttcgttctgattaataacagtcccagactaaaagagtgtttgaaagcactagaatttttttctcgaac

SEQ ID NO: 18327 - DNA, 2409 bp, Zea mays
  misc_feature (2353)..(2357): n is a, c, g, or t
  misc_feature (2359)..(2363): n is a, c, g, or t
gccggccgggtgcggacctccaggccggcccggacaccagagtagggagacgcaggacgcacagagcgacagaggagggagacctcgcccggtcgctccaccctcgcccacatcacttcgtctctctggtcgcatcccaccccacacccctcctctcccatctccgctcgatctcccattcttcctcgtctccgccgccgtctgccccacctccaaccaacgcccaacgatcagtattccagaagcttccccggcaaccttcgtccccgtcccggatccggggcgcccctgatgcggtgcccgcgcggcgcgatcgcgtgacggacggccgccatggatcccccaggccgcggcgaccaaggcgaggcgccgcagccgctggagtggcggttcgctcaggtcttcggcgaacgtgccgcgggcgaagacgtccaggaagttgacatcatatctgcaattgaatttgacaaatctggtgaccatcttgccactggggataaaggaggacgtgtggttttatttgaaaggacagatgttcgggataatgccagccagagagaactggagagacaagatgttccagttactagacacccagagttccgctacaaaactgaatttcagagtcatgaacctgagtttgactacctcaaaagtttggaaatagaggaaaaggtcaacaggatcaagtggtgccagacagccaacaatgctctctcccttttgtctacaaatgataaaacaataaaatactggaaggttcaagagaagaaagtaaaacgatttgcagtcatgaatttggacagttcccaaagtgcaggaagtagtaccactgctattgcaagtaccagtagttctaaggcacctcttccaaatggtggatgctctgatatgcttggttgcctgaataatgatctcacatttcctcctggaggctacccatcactgcgtttgccagttgttaccagtctagaagcaaaccctgttgctagatgtcgacgtgtatttgctcatgctcacgattaccatataaattctatttcaaataatagtgatggtgagacattcatatcagcagatgatctccgaataaatttatggaacttggaaataaacagccagagctttaacattgttgatgtgaagcctacaaacatggaagatctaacagaggtgattacatgtgcggagttccatccatcccattgtaatacactggcctatagtagttcaaagggttctatccgacttattgatctgcgtcaatcagcactgtgtgacaaccattcaaaaatatttgaggaacatgaagcacctggatcaagatccttctttacagaaattattgcatcaatttctgatataaagttttcaaggaatggcaaatatattcttagccgtgattatatgacgctcaagctatgggatctaaacatgaattcaggccctgtttcaaccttccaagtccatgaacatttaagacctaagctctgtgatctgtacgagaatgactcaattttcgacaagtttgagtgctgtcttagtggggatggacttcgtgttgcaactggttcttatggtaatatatttcgtgttttcggtcgtcctccgggaagcatagaggcaacaactttggaagcaagtaggaacccaatgaggcgtcagattgcaaatccagcaaggcccacacggacactaacttcttttgcccgtggtgttcggagaggtggagaaaatcaaggcgttgatgctaatgggaattcactcgacttctcaacgaagctgctccacctcgcatggcacccgaccgagaattctattgcatgtgctgctgcaaatagcttgtatatgtattatgcgtagagaatgccctacagaaaatttgttttttttgtggcttgctctcggcgaaggcccagggcccttcaactgcaaccagagagatggtgcaggacattgttgtcagttcaccccttggggccagaagccgctgatgtccacaagatcaccaatgctgtgctaacagactgcgccctgttgattctttagtacatgtgtaaattataattctaaacatgggaagttttgatccaaatattcaatcgtggcagttgtattgggagtcggtggaagggacatatcgaagataaaattctgtattggatttgcaggacatgcattgcaatggtgtagtatgactggcaatccttatcatgtaataccacctagacagggataatgttgtttaatgtcagaaaatgatagatatttcccagttaaaaaaaaaaaaaaacaaaaaaaaaattctattagttgtactgttaaaataaggcagcaccgttataattgtgcnnnnncnnnnnctgaatgccttttgtacactgaggttttcgcaagaaaggaattcac

SEQ ID NO: 18328 - DNA, 1280 bp, Zea mays
aaaagaatacaaaactagaaaaagggcagaaactgggaatacgtttgagtgggcccaaagttagcataggaactataggtaccttcctttccggcccaaccgtaagtaactgggaagcctggccccccgggatattgaagtccattctgttggcatcgcccgatctcccttgaaccctttcgcccacaccacagcaccgctgccgaaggtgggaaagaaggcggcggcggaggcaccggcaccggcaccgcctaggaaaggaaaccgaggaaactacagccatggtggtacggatccgtctggcgcggttcgggtgccggaatcggcccttctaccgggtgatggccgccgatagccgctcccctcgagacggcaagcacctcgaggtcctcggctactataacccgctcccagggaaggatggaggcaagaggatgggcctgaaattcgaccgggtgaagtattggctgtcagttggggcacagccatcagatcctgtgcagagtattctctttcgtgccggacttctgccaccacctccattgctagctatggcacggaagggtgggccacgtgataggcgccccattcatccaatgactgggcgccctctggatctcgagggtgtcgcaattattgataattccaatgctcctgaaggcgatactgaagtgcctacagatgaggtggctcaataagccttttgtattagcatagcatatgtagcggtgctgcaaaagaaaacttgtttgatgtgcttgtggcaagactttgggtactcgtacaatgtggcaaacttttaaacaggtaactttcatccatttctcttcttaaaaatatgtcagttcccgctgtttgttcttaaaaaaaatggtgctgtgtgcatcagtagcttttgttctgcagcaccatcaatttgtggtatctagtattctctgcacttgcctgataaggtttgtctgtgaaatggaatatgcgtgataagttgggccttgatgaattcttcgtgatcactttgtaggtgttggcttaaattgagactattagggtgtgtttggttagacgtataagaagggatggaagtggacggtcatattttctatagtgttttaatgagtcatgtggggtcgaggtgaacaccatgctcatcctattttaacctcaaaccatacacatccttagtatgtgtattgctctcgtataaaacgatggtatgcatgatgaggtgactttgaagataggcgagatgctctacctagtatgcactaacagtttctgca

SEQ ID NO: 18329 - DNA, 1358 bp, Zea mays
cccaatcgcccgccgtcctctcctctcctccccggccccttcactccaccaacgaaccccacgcaggcagcagcacgcgcaagccgcaaggcaaggcacaaacactaggggccgggcatggcgacgcgggcggacgtggagaagggcgggccggcgaggaaggagcccggcaaggtgccgtcgccgctgtacccgcagcacgagggggagcgggagtgggtgccctggctcgtccccgtcatcttcgtcgccagcatcaccgtcttcgtcgtcaccatgtacgccaacaactgccccgcgcgcgacaccaacaagtgcgtcgcccgcttcctcggccgcttctccttccagccgctgcgacagaacccgctcttcgggccctcctccgccacgctcaccaagatgggggccctggtgtgggagaaggtggtgcaccgccaccagggctggcgcctcctctccagcatgtggctccacgccggcgtcatccacctggtcgccaacatgctctgcctcctcttcatcggcatgcgcctcgaacagcagttcggatacgtgaggatcggcgcgatctacgtgctctccggcgtgggcggcgccgtgctgtcgtcgctggtcgtccggaaccgcgtcaccgtgggggcctccggggcgctcttgggcctgctgggcgccatgctctcggagctgctcaccaactggaccatctacaccaacaaggcggcggccgtggccacgctcctgtccgtggccgccgtcaacctggtgctcggcgtcctgccccacgtcgacaacctggcgcacctcggcggcttcctcgcgggcttcctactcggcttcgtcgtgctcatgcgcccccacttgggctggatggagcgctacggactccccgccggcgcgccctgcaccgccaggaagtacctcgcgtaccagtggaccctcctcgccgtcgccatcatcatcctcctagtcggattcgcggccggcatggcgatgctcttccgcggcgccaacgccaacgacagctgccactggtgtcactacctcagctgcgtgcccaccgccagatggaactgcaccaactgatgatccatgcatagcggcagcagcacgagttggagttgccacccattttcatcttccgatccgtatagtctcgttactgtagatagcttctttgtcattcattcagatctcaacacacacgtcggtctcctgttcatttgattcattcttttacataatgatgcaatgcaattattgagatttcgaatctaaaaaaaaaaaaaaaaaaaaaaaaaaaaaaaaaaaaaaaaaaaaaataaaaaaaaaaaaaaaaaaaaaaaaaaaaaaaaaaa

SEQ ID NO: 18330 - DNA, 2230 bp, Zea mays
gggacctcgagccggccgggaaaaaaaagatccatgcttccattgacgccacgaccacgctacatataactggcggctccgcggccccgcccccgaccctcgtcctcgtcctcgcgcagcctctgcttccatataactcgctcactgctcgcgcgcctcggtgggtgcaaacgcgcacagggacagaaacagagacagagccagccatgtcgaccaccaccctgcagctggttccgtggccgccggagccggcgcgcgccgccgtgcttcttgttgcggcggtcgtctgcctgtgggtgcttctgtcacgcaggcgggccgccggagggagcaaggacaaggagcgggcggcccggctcccgcccggcagcttcgggtggccgctggtgggcgagacgctggacttcgtgtcctgcgcctactcctcccgcccggaggccttcgtcgacaagcgccgcctgctgcacgggagcgcggtgttccggtcgcacctgttcggctcggcgacggtggtgacgtcggacgcggaggtgagccggttcgtgctgcacagcgacgcgcgcgccttcgtgccctggtacccgcggtcgctgacggagctcatgggcgagtcctccatcctgctcatcaacggcagcctgcagcggcgcgtgcacggcctcgtcggcgccttcttcaagtcgccgcagctcaaggcgcaggtcaccgccgacatgcagcgccgcctcgcgcccgcgctcgccgcctggaaggttcggtgcgcctccgcgccgccgctccgcatccaggaccacgccaagacgatcgtgttcgagatcctggtgaggggtctgatcgggctggaggcaggcccggagatgcagcagctcaagcaccagttccaggaattcattgtcggcctcatgtccctccccatcaagctgccggggactaggctctacaggtccctccaggccaagaagaggatggccacgctgatacaggggatcatacaggagaagaggcggcggcggagggccgcccttgaggatggcggagagggcgagggcgaggccggtcccccgcgcgacgtcatcgacgtgctcataagcggcggcgacgagctcaccgacgagctcatatccgacaacatgatcgacctgatgatccccgccgaggactctgtgcccgtgctcatcacgctcgccgtcaagtatctcagcgagtgcccgcttgctctgcaacaacttgaggaggagaacatgcagctgaagaggcggaaaaccgacgtgggagagaccttgcagtggacggactacatgtcactgtcgttcacacaacatgtgataacggagacactgcggatggggaatatcatcaacgggatcatgcgcaaagcggtgcgggacgtggaggtgaaggggcacctcatccccaagggctggtgcgtgttcgtgtacttccggtcggtccacctcgacgacaagcgctacgacgagccctacaggttcaacccgtggaggtggaaggagaaggacacgagcaccatgggcttcaccccttttggcggtgggcagaggctgtgcccaggcctggatctggccaggctggaagcttccatctttctccatcacctggtgaccagcttcaggtgggtggcggaggaggaccacatcgtcaacttcccaaccgtgcggctcaagcgaggcatgcccgtcaggctcaccagcaaagactagctagctagtcactacgacctgcttgtgcatgccatgcatgcagatttcagtcacgtcatatgcaatatatattggaccctggaggttgcacgtgtacagaagagaggatgcaggagctagcagatgatcggaggtatttaggcagactgaaattgaatcgaccgcgaagagtagcacactactataccacgagtatgatctgtagtagtagtaataagaggaatataatatcattagtgtggtagtatttacttattatactactctctcttttcgtttttatttatcgtgttttagtttaaaaatgaactagcgaggttagtcaataggcgtgcatgcatggcccatcatggtcatggatatataggccttgatggttatactagtataagcagtagtgttatgtcacaagggattactgggatctgggatgatgatccacaatcccatctaaaacgaaaagagttaataaagattgttaagtttactgctgggagcctgggactttgact

SEQ ID NO: 18331 - DNA, 3840 bp, Zea mays
gagggggctgcgtaggggttgcgctgcggttagtctgagggtgcgcagctaggacagctgcaggcagccgcacgtgtgtcgacgccctccccccttgcactgcgcacgcctcagtcagtggatgtgcatgtccggctttgtgtatggcgatggcagcaggatagagtagcagtagtctactcctagcctgtttgatcgtgtcggctttgcttccatcagattcatcagaccagatgggtgacatgctctgtgccgggtccgtccgctgcacgagcacgcgtgctatgcagcagctgggaacgggagaataataaaatagtaggcgtctcgcaggattgacgctggctagctttgaccgtatgtctgacgacgacgacgtccaaggctcccagcactccagcagggtatggccgccccccggcccggcacccagccaatgctctcttgccctcttgctgccactttaaaattcgctggtgatgtactcctcctcctacttgactggtcagcggataaacatcgtcagcttcgaccctgcatgttagaaaaaaaaaacgagaaaagagagagagaaatgcttgaccattttgccgtgcatgcatgcatccaccatggatggcaatggcaatggtaatgggcatcgatgagttgatccccctctgcatgctacgtactgatgcttgctgctgctgctgcttgtcgcatcacctggtgacagcttcaggtgggtggcgggggaggaccacatcgtcaacttcccaaccgtgcggctcaagcgaggcatgcccgtcaggctcaccagcaaagactagctagctagtcactacgacctgcttgtgcatgccatgcatgcagatttcagtcacgtcatatgcaatatatattggaccctggaggttgcacgtgtacagaagagaggatgcaggagctagcagatgatcggaggtatttaggcagactgaaattgaatcgaccgcgaagagtagcacactactataccacgagtatgatctgtagtacgtagtaataataagaggaatataatatcattagtgtggtagtatttacttattatactactctctcttttcggttttatttaccgtgttttagtttaaaaatgaactagcgaggttaggcaataggcgtgcatgcatggcccatcatggtcatggatatataggccttgatggttatactagtataagcagtagtgctatgtcacaagggattactgggatctgggatgatgatccacaatcccatctaaaacgaaaagagttaataaagattgttaagtttaccgctgggggcctgggactttgactactactgaaaaatgtttgtcttctcgtattgcatgctgctgtgttgtttgagggcagagagtatagtatatgctgcagaacgtgacgcacagcgtatacacggaggtattagcaaagcgtgagataaggggctggatatataggaaggcaagctgattagagaccgcctaaaataagccctacgtatcgctatcggcttggaaaatcaaatctttttttcacgtttaaactaaatatataaaaaatgctaaaatttttaatagtagagttattttgagatgtggaatatttaaaccgggatttcttatattgttatattagttagatttgaaaaaggaagtactatgtatgtgcacatgtccatggagaggtgaagagatgatgtgatagaaattgatatggatggaacggattgtcggagagtgacggaggcaatccagcccagcctttgcctttgttgcgtgatcctgccttcctgctcctccatgcatcatgctgaagctgaaaaggaagaataggaagaagaaaaaatgctgtccctctacctccacctccacgcggctggtggaaaagggtaaatgcagttgatcccttttgggacgctttcagccttttcattgaatgaagaagaacagatgagcgcagacaaggcccccagtaaactcaggttgcctgccattaccagcagcggccaatcaatccacccgctctcgcgtgtgtcaagatcctctcatggttacgcctcatatataccaaccaaccattagcatacacccacgcagatcatcccctaccaaccgggtcggttccttcggtttctgagaacacattagttcactaatgatggtgatatcgtttaaccactttcacccatgctcgattagctttggttgagtgtgtatgctatgctatgctatgcaatgccccccatgtgcctttatatatgcgtgtgttctcatgctattggaaccttcttgcttcgttctcctctcaggccaggcctctcgccaagacgattgctgctcacgccctttcggcaaagggcaaataaaacccaacgcgaatacgcacgcagtgtctgcctggcccggtcccgctggcccccgccctgcagggccccccctgcatccccagcgcgagcgacaccagcttttgggaacaccgacacagggcagagcgcatgcatgcccgcaccgccgcacgcttgggtggcctcatggtccagccacatgtgggcgtgcccgcccccttgctctgtcctgccggtctgccctgcaccaaagctgcacgcaacgaaaaaaaaaaaaaaaaaaaaatccttcaatggaaaacgctaggctctcatttccggcagcagttcggctcaaaacatggctccaggaagacatcagaaatggaggggcctcaaacatggcatgagtcgtgggcagatacagtacccaacagatcgcacgcaggcacaggatacgggaggtagcagccagcagacaacacaatcaaacagtacacagcattcaaggcctcatctaacagcttagctaggggtggtaatagatcgcgatccaaatgtttcttcacaatcctttgagaccttacttaattttagtttttaaaaatggatagaaatatagtccgaacctaatccgacccttatattccatagtgtaaatttagagatcgttacaacctctacttcccacatgtagtcctttcagaacaataacatcttcagaactaaacacatctctttcttacccatctacgaaaaaaaaatcaactcgcttgattttaccagacagttatgggaacaagcttagtaaaggctttccttctatatcaagagcaatgtaaacaaatggtataatctaaacaacagatgatgatgatgataagatcttcacgcaatcatgcaggtaatttctaaaatccagaagctattgatacagacaaaatccagttttcagcttagcgttgcagatagctccgattgacagatgtattcgatacgggacagcagcgatgaccacaaccccatcttctgccagatccttgcttaccacatgctataacagagctattgatttcagactgcgatttttcagggatgaacattgaattatgctgcattgaagtaaaaaaaaatgactaagcgaaagaggtagatatgggacagggtctgtccttctgaagttcccagtccccagctgacaaggacatttcttatatcttctgaagaactcgagtcagtaataatagtatgatagtagatgcgtgtcaaaagaatcctatgctgggcagacagcaaatgacacagcctgtatagcagtccagcaggaagcatgttcatgaaccattaccaccacatatttcatggagaccccccaaaaaaatcttcagaatatctacctagaagatgtggccataacacacccttccttgatataccacatcctataactagaagttaccttactaccctaacatcaataatggtgtgcattatctgccagct

SEQ ID NO: 18332 - DNA, 2671 bp, Zea mays
gacctaacggatgtcaatgaaattgtaggtgtagggtactggaaatctggaataggaaccgttggaacagtaaatctgtaaatgtcagttccattctctttttattcggtaatgataatgatatttgagttgtgtcaatgtgtgcacgtcccagaaagactctcagtatcaatggtgagaatttttctttgcaaggtacatcatgcaaattattaaaaacattgcaaacaacaacaaaaaaatcatcaagctgcgaatggtctaaccctggacaatggacatagcagttaataaagttgagacaagtgagtagaaatatttcagttattcaagacatgttaaacgtaagatcatataaagtaactaaaaatatcgcctcttagatgaaacagttagtatgcttcattcaaggaataagaacaaaagaataccctcagtttcttatgctgtgcaagaacctgtggaggaacgcccgccggcccggggctgagcggtcttgtaatgcagaataagtgggtgttctgtgaacctgtaataatagagcatcccgtcctccgcccccgccttcccttcccacgccgcccgtgccgccccagatcggcaaatccgcccgcatctaccccgcgcgcgtcccggatggccacttcttcctccgcccgccccggggttccgtagcatgggccactctctctcctcgcattccaaatccaccctctcctccccgccgcgccgcagcaggtcgctctcgccgatgagtccgccgccgctgcggctgaccgcgccgatgcagatcgctgcggaggacagcggcagtgacagttcctcctcgtttgcgccgcccgcccgggactacacccaggacctgcccgacgagatcctcgcgctcgtcttcgcgtcgctctcgcccaccgaccgcaacgcctgctccctcgcctgctcgcgctggatggaggtcgacgccaccacgcgccaccgcctctccctcgacgcccgcgccgcgctgggcaacgctgcccccgcgctgttcgcgcggttcacggccgtcacgaagctggcgctccgctgggcgcgcgggtcgggcgcggacagcctctccgactacggcgctgcggcggtggccaccgcgctgccctcggggcgcctctccaggctcaagctccgcggcctaaggcagctgtccgacgccggtctagcctcgctcgctgctgccgcgccagcgatccgcaagctctccgttgcgtcctgcaccttcggacccaaggcattcgtcgccgtgctccagtcctgccccctcctcgaggacctctccgtcaagcgcctcaggggcctaccagacacggccggtgccaccacttccattgctgaggacatcaaatttccaccggcttcgtccctgcgttctgtttgcctcaaggatctatatagcgctctatgctttgtgccgcttgtggcatcctcaccagaactccgctcgctcaagatactgcggtgctccggcgcctgggacctgccattggaggtcatcactgcacgtgctcctggacttgttgagcttcacctcgagaaactacaggtcggcgaccgtgggcttgctgcgctttctgcctgtgccaatctggaggtcctgttccttgtcaagacccctgagtgcactgattcgggcatcatcagtgttgccgagaagtgccacagactacgcaagctgcatgttgatgggtggcgcacaaaccggattggggattttggactcatggctgtggcacgaggatgtccaaatctgcaggagctcgttttgataggggtcaaccccaccgtgctgagcctccggatgcttggcgagcactgtcggacactggaacgacttgcactttgtgggtgtgaaactgtgggggatgctgagatcatttgcttggctgagcgctgggctgcgctcaagaagctctgcatcaaggggtgcccagtatcagatcgtgggatggaagcactgaatggtggttgtcctagtttagtcaaggtgaagctgaagagatgccgtggagtgtcatacgagtgcattgagaacctgaaggttactagggggggatcattttccatcagcttggatattgtgttggagcatgatgctaggagtgctagtgaaaatggtgcccaggagaacggacaagcacaaattactgcgctgactgatcaaatggcaggcatggaccttccagtcaatgctgctggcgcacaatcatcgactcatacaattaccaggatgaggagcgtcgtgtcagcactccggcgtaggtttggcaatcctccgccaccgtgatttgtgattgaaattaatgaactgtttttacagctttccattttctaatgaaacattcatgttgcctaagacttccattatttctggtcagtgcaagataaccgcctatggatgcttctgcatgtagtttttattaatccacatcagtctttcctgtgctctagaaccaaaatttactcctgttgctttgtttaccataactgtgtttccatatgcatctaaattaatcatctgttttttggggggttttgctgcttggtgttaagaaattgggtgctacagtccctatataaaccattatcctggaaagttggttagttgtagatggtggacgaacccattgaaatatacgcacac

SEQ ID NO: 18333 - DNA, 2872 bp, Zea mays
cgagtactcgccggggcgggatggcacggccctgccatgccaacgccatccccgccggccgccgcatcaccacctacacccacctgaagaacgccgtccccataaactctctcgggctcgatactttccccatctcccatcccatccagccatcctccgctttcccttcccctcgccgccccccaccccccagatcggcaaatccgcccgcacctaccccgcgcgcgtcgcgcgtcccggatggccatcgtctcctccgcccgactcgtggttccgtagcatgggccactccccctcttccctttccaaatccggcccctcctctccaccgcgccgcagcaggtcgttctcccccatggcgccgccgcagcagctgcggctgaccgcgccgttgcaggtcgctgcggggggcagcggcagcgactcgtcctcctcgttcgtgccccccgctcgggactacacccaagacctgcccgacgagatcctcgcgctggtattcgcgtcgctctcgcccaccgaccgcaacgcctgctccctcacctgctcccgatggatggaggtcgacgccaccacgcgccaccggctctccctcgacgcccgcgccgcgctgggcaacgcggccaccgcgctgttctcgcggttcacggctgtcacgaagctcgcgctccgctgcgcgcgcgactcaggattggacagcctctccgaccacggcgctgcggcgctggccgccgcgcttccctcggagcgcctcgccaggctcaagctccgcggtctaaggaagctctccgacgccgggctagcctccctcgctgccggcgcgccagcgatccgcaagctctctattgcgtcctgcaccttcggacccagggcattcgtcgccgtgctccagtcgtgccccctcctcgaggacctctccgtcaagcgcctccgcagcgtagcagacacgtccggtgccgccagttccattgctgaggagatcaagtttccaccggctttgtccctgcgttcggtttgcgtcaaggatctatataacgctctgtgctttgtgccgcttgtggcgtcctcaccgaacctccgctccctcaagatactgcggtgctccggcgcctgggacctgccattggaggtcatcgctgcacgtgctcctggccttgttgagcttcaccttgagaagctacaggttggcgaccgtgggcttgcggcgctttccgcctgtgccaatctggaagttctgttccttgtcaagacccctgagtgcactgattcaggcatcatcagtgttgccgagaagtgccacaaactccgcaaactgcatgtggatgggtggcgcacaaacaggattggagatttcggactcatggctgtggcacgaggatgtccagatctgcaggagctcgttttgataggggtcaaccccaccgtgctgagccttcggatgcttggtgagcactgccggttgctggaacggctggcactttgtgggtgtgaaactgtgggggatgctgagatcatttgcttggctgagcgatgggctgcgctcaagaagctctgcatcaagggttgccccgtgtcagatcgtgggatggaagcactaaatggggggtgccccggtttagtcaaggtgaagctgaagagatgtcgtggagtgtcatacgagtgcattgagaacctgaaggttactaggggggagtcattttccatcagcttggatgttgtattggagcatgatgccgggagcactagtgaaaatggtgcacaagagaatggacaggcacaaattacagagctggccggtcaaatgacaggcatggacctcctcaccaatgccgctggcacacaatcatcgattcataccattaacaggatgaggagtgtcatgtcagcgatccggcgtaggtttggcaatcctctgccaccatgatgtgagatggaaactaatgaactgttatttacatcctttatctaatcacacattcatgtttccctaagcttatttcattgcaatgtctggtccgtgcaagataaccacctatgggtgtttcttcatgatgcttttattgggctaatcccatcagcattagtttcacccatgctctataactgaaatttactcgtgttgctttgcttaccacagtagacatgttcccatcgtatctaaattaatcatttttttattttttgtttttggtttcactgcttgtggttgagatattatcctgggacatataggtatggttagttgtagatggtggacggaaccattgaaatgtatgcacactggtaatagtgtagtgttgcttctgtgttaggtttgaaggaaacatatgtttgactgtatctagtttagtgtcgcacgttatcctaatgaaatgatgtactacattatcttggatagagtgattcctcgaaccaaactcactatgatcactcatagttttcaaacacgagtgataccaaaacaccgttcaagcattcgggggtctggccgcttctctcccaatggacaagagtacttgggacccgatctatttcttcattaggcttgtgtttttttattggtcaaaggtttggttctggtgtcatcaacaaggtggtgttgatactttagaacaaggtctctccagtctcactacctagacaaatttggtgtgtccgatcttgatcttcacatttcagtagttggtatgcttgtaagaggatgcagttggttggcttttgatgtggcgatttcgacctcgacctcttcttttgatatgttctacaccctattttgatggtgaatgactgtaatcatgtgttctttggaggccttgtgttttttttttgcggtcttttaaagccgtatttagtgaagatatttgtgggtggtcct

SEQ ID NO: 18334 - DNA, 2280 bp, Zea mays
ctcgaggccggccgggccgggctgttctgctacttccgacccggcgcggcccgcccggccccctcccactccactccgcgttttcaaaaatcaaaaccccagccggaacagcgaaaccccttccaccatagcccgtaggaaacggagcagcggttgcggtttctctctccgtcgctctcaccgctcgccgccggctccgtatccggtccgcaaggcgggcctggcgtcaaggtcctccgctccgtccccttcactcgcgaccggagtcccctcttcgttggttcgccaatctacttcgtcggcccacccctttccccccgatcgatctctccttctcgctaagcgaactatcttgacctccctccctcgtgcgagattagccagtagaaagttccccgcttttcatccaggcacacttccaccacctcgctttgctgcttcactgcttgcttctgttgggcggagtgctaagaggacggcacgggagtcaagattcctcctccttaacctgccctttcgtgttgccgttgttggtggtttggtttgtgattgcggtggcgctggagttgcggtgtgtgtgaagcgagggatccgagattcttgtggattctgttctacttttcgattgctgctgatcctctctcccgtgcgacggcacaagcggcggtgtggggagagcatccgccgttgcccggccttggagggccccggtccgtctatggaacttgccgccccggtgccacgccccggcccggaactgaagtgctcagcaaggcgcttcttgcctgccactctcacgctgctggtgcctactgtggcagtcccctgtttggttcctgctcctcactgaccggctacggggctgcgataatggtgcctcagatggtgctgctcctttgctgctgccttctggcgttcccgccacatggtccgttagtcgttgaggcttttgtaggcggttatggagtaaactatgggagaatagcaaacaacatcccttcccctgacaaagtggtggagctcctgaggagagcaaagataaggaatgttaagatatacgactctgaccacagcgttctcgatgcgttcaaagggtctgggatcaatctggtcatcgcaatccccaatgagctcgtcaaggatatggctgcaaacacgagccgttcaatggactggctaaatcaaaatgtgcagccttatctccctcagacgcgcatcgttgggatcactgtgggaaatgaggtgctcggaggccaagatcaaagcttgtatcagccacttgttgatgctgtgaagaatgtgtatgatgggctcaagaggctccacttggagagaaaaattgagcttttcacacctcattcggaagctgtttttgctacttcttatccaccctccgcatgtgtgttcaaggaggaactcatgccatacatgaaacctcttctcgacttctttgcaatgattggctcacctttctatgtcaacgcatacccctttttggcttacataagtgatcctgaacatatcgatatcaattatgctctctttaaacccaacaaaggaataattgatccaaataatagcctgcactatgacaatatgtttgatgctcaggtagatgcagcttatgctgctctacatgctgctggttatgataacatggaggttcgtgtggcagagactggttgggcttctagtggggatcaaaatgaagcaggagcttcatctgagaatgcaaggacgtacaatttcaatcttcgtaaacggctatttctgaggaccggaactcctctgaagccaaagagaccagtcaaagcgtatatatttgcattgtttaatgagaatcagaagcctggagctggctctgagaggcattatgggctgttccttcctgatgggaggatttcatatgacatcggtgtctcaggtctactaccttcatctgcatcctcatccgtgctgtccattaagaatgttcaagctgggggttggattttacagcattgggctacagttcttttatgttgttttcattttttgggggccatagtgacttgaggacggcataacacatccgtagtaaagggtgcaattgagcaagttagaatgttgctattgggaaattcacaatgaaaatccaaataatagtaccgctgcaataatctcttctcctgaggctgtcctgctttgctgcttaaaaccgtactcagttattgttctaaaaaatgattcatacctgctgaaaaaaaaaaaaaaataaaaaaaaaaaaaaaaaaagcggcc

SEQ ID NO: 18335 - DNA, 2261 bp, Zea mays
  misc_feature (84)..(84): n is a, c, g, or t
  misc_feature (89)..(89): n is a, c, g, or t
  misc_feature (143)..(144): n is a, c, g, or t
  misc_feature (160)..(161): n is a, c, g, or t
  misc_feature (214)..(214): n is a, c, g, or t
  misc_feature (2164)..(2165): n is a, c, g, or t
ccctttggcgcccccccgggggttttcccggttttttgcgtgccggggtttgttttttcttgtgggggtttgttgggtgcgctnccccnttttccccccccggggcccggctggtgtccccggggttccggccctggctgggnnttgggccccccctctnnggggcccaagccccggggggttccccccgcgggttggcgcgccgctcccgggncttggtggttccccccgggtcttcctggcttttgggggggggtgggtgggggagtctggtgctccccccccccccccccccccattttttgggggccatagtgacttgaggacggtgtacacatccatagtaaagggtacaatcgagcaagttagaatgatgttattgggaagttcacaatgaaaatccaaataatagtaccgctgcaataatctcttctcctgaggctgtcctgctttgctgcttaaaaccgtattcagttattgttctaaaaaaatgattcatacctactgaaaaccgttctcactctatctaattccttctatttttttcttttttctaaatgaaccctcacccagcattcaccatacgcagtttattttagcagttgatatactatatcaaactaagaaccatgtgaagatagttctctatcatagcaacctctagcatcgtagggatctattttccatttttaacaatcaggttaatagcttgagcttgggtgccttaaatgctcactatttttcatatggggtgatgtgcatcaagcggacggtctggcaagattgacaaatcattgtgctttctcccccggtaagaattgcatcttgacacatcagcttcaaagcagatgctgaccgaaagaattagcattcttttttgggatgtttagaagtcctatcatgtgatctgttcaaaagggagtcttaaaaagaaacagttccaaaacctcaaataatatacatatagatatcaaaaggttgtataatgttgttgccttgtttgctgagtggttctattgattaattaaagctctagcatattgttaaggtttcgacctgagtttgttccatgattttagtggaacgactcaatttcttattgatgggataacaggcagctgttgatcaaatcgaaccctggcgaagttgtgaagcctggtgaggaatccgattcattgtgttcagggctgcttgcggtttgaatttgacagtatttgtgtttgtgccagtgatcagccggctacactaccacctgaaccggttgcattgcatagactcttccgagtttaacaagtaggtgttggtagttcgtcaggggcgtttagcttttgccaatgggggatttggctgcattttgttaccttttggtatatgtactgattatattatttattggtctataagaccactggggtactaaactatattgctgattgttaagataagatctgtgatgatttttgccaagtgagcacctgatcttttttatgcaatcaatttcaggtgtgtgtagacaacctattttttagttgatatagatggtgctgatttgttagttaaagctattgtctttgatggtcacacttttattggaaatctgcaattccttttatgttgtaacaaaatttaatatctaaaaatgttgttggtgtcttggtggtaccgtgtcagttgtcaacagtccaattccattctcatggctttgattctgacgtatgattatgattattttaaatttgtgcagattcattcaaggcaatcaacgatgaaggcatgcccatgtatcagaggcccttcatgaagggcaagctgtacatccacttctcggtggagttcccggactcattgagcccggagcagtggaatgccctggaggatgttctcccacccaagccagtatcacagtacactgacatagagctggacgagtgcgaggagacaatgccctacgacgtgaacatcgaagaggagatgcggaggcagcagcagcaccaggaggcctacgacgaggatgatgatgtgccaggcggtgggcagagggtgcagtgcgcccagcagtaggcagcttacgtcaaatttgctgtttcgctttgggcgactattgagtttacccgcttgtattggtctgatgatacttcggttacaagagtgcagtattactaannaaaaaaaaaaaaaaaaaaaaaaaaaaaaaaaaaaaaaaaaaaaaaaaaaaaaaaaaagggaaaaaaaaaaaaaaaactcgggggggggcccggtac

SEQ ID NO: 18336 - DNA, 2257 bp, Zea mays
tgcagtccgaaccggagtcctgcatatgatttgcctgccattaaggtcttctaattacagcacagcacagcaagcagcacgcaccacgcaagtcaaggaaacagttttttttttttttttggcgaggccggtcactttaccggactgtgtcagtgctcatcagctcaacagggtatagtgtgcgacgcgctaggcgctacgaaacaaaggcgaggccggccctcgcgccccggagaagtgccaaaactggcatccgggttggatctgcatgccggccggaggagcagcgaagcatcatcagctgctgctgggacgcttggtttgtcttggcagcaagaagacgagctgccagtgattgggcgccacgggcacacggtgggtccgcccaggaaggcgccgcgccaacagcctccctagtccctcccacgcctcgcgccaggctgtggccgtacgcgtggtggggtgtgcgtgtgcctccgggccccggcctccgcctcctccccgaccccgacgacgtgttcgctcggtctcgtgcccgggcaggcagggacgcctgatccccggctcatgctcccatcgcagcctaaagtactgtcgtctcacagcagacgcaagctgtctccgtagagtttctgtgattggatcccagatcttctgctcatctcctgttgcggtggaacggagcggcaccaggcacagccacccgtatcgcacgcaccgccacccgtatcgccgtgctgcagggacacccaccccggtgtcggtgtgtacgggcgcacggcgcgacgcgtcatcactcgcccgtgccgctgtcgagcggcaccaggcccgggcgcccgtgcaagcctctcggccatggctgccgtccgtccgggacctggcgtctctgccgcgcttcaactcctccggcttcgcgcgttcgtgtgcgtcatccaatccaacagccggaccggacggacgacggctgtggcgggcgcaggtcagtcgtcatttcagcagagatctgggcgcacttgctgggatcctgacaggttgtattcccgaccgacaggaagcccagggcgcgggcaggacaggtggggtttcgggaccatgacgagctcgctggtccatcgtcggacccagagcgggctcttgccgatgacgatgatcatgagcagcgacagcgacaccacaggccacagcattgggcagcatccgtcgagccaatcattgctgctctcctgctagactcactcctgattggaccatactgtttctgctgttgggcttaaggcaaaaccatcccagatttttaaaaaaaccgtcaagcctccatcccgtggatttatatagcctcaccaaatcaatatgtccatattaattaatcaagctaaaccaactactacttcgccttcccaacaacacaaaccaaccaaagcacagctgcgacacccctactacaagcgtgagccaacacccaacccaactacgcgcctaatattatgtctcccacaaacagcaagcacaggcagagatgcccacccacccaagccggtaaatgctgcctagtataagcactctagactccactaataaggccatgcacctcttgggccacaaaaccaactggggacgaagacgagcccagaggcaccagaaacgcaaaaaggccagtcgaactattagccgccactgtgcagcgcaggcgtcacaaccgcaaatggtcagcttagcctctggttctggtgatcgtgatgctccccttgcccccctcggtgtggatcttcgtcttgtggaccacaggcttccccgagatggccgaggcctggagcgagctgggctcctcgtcgctcttgtgccggatcttgtacggcgggggcgcgtggagcttctcgtttatgtcgctcagggtgacgtcgccgcggatgctgctcggcttgatgagctcgaaagggaaggccacggatgtccttgccttctttgccccgatgatgctcttgccagctttcagcggtgtaggtctagcctgtgcacgattgttgttgactacgatagactgttgactaggcgaagcattctgatgcgcagacgtatcaacatctttttccgtggcagcagcagggctattcatttcttctgccggaaaaccaggctcggtgtcttgtgagcaatcgactagccattcttctggcagttcatcagtcccgtcagagttcagtaaacagttggtacctgaaaaatccatctcctgaagactttccagtcgtgccgaatc

SEQ ID NO: 18337 - DNA, 3941 bp, Zea mays
tgttgtttaaaaatcggaggtgcattttagtttttggatgcacagacccaagacttactgcccccccgccgtctccgcgcgcctccctgtccccgctccgccgcgcgcctccctgtccgcgcgcctccgcgcaccgtcgccggcccccgatccgccgccgcggaggtcaggggcctaggtctcattggacgatgaggcgggaccggaggggggaaggaacatgagcaccggagggggagaaggaacatgggcgagcgactcacgacgacggctctcggaaggctgggagggatagcgtgggggagagaagttcgaggggagaggggtgcacacctgtggtatgggtatggccatggctggaggtttcacgtccgttgaaagccaagtttcgcgtccgcgtgagtcagaccagagaggacgagcgtgtggccatcggtagcacacgtgtcgcgcgacgaatagcgagtacgccgccaaacgcggacaggcgtctaaaaggggatcaggttttaataacttagattagattgcatagacatatttatttagactgggttgtaacacctaaattttaatatgagagttaagtaggaaggtcttcaagtttttttatgtgtgaattagttttatattttcagattattttatgccagtctattgtatatttttaataaaatatataaaataaaatatttttgtacctctttttttgtaagacgctgatttaaggtaccgttgtagtggaaaatgctataatcaaatgcagagtgagcagtattgtctagtgaaatgataggctgccatatccgtgggcttgccctccacgggatgggccggaaaacaagacgggtcagcccgcgaaatgcgaagggccggaaacaaaaggggccgagatgatcatgcctgcaaactgcaccatgcatgtttccgttatcgttagatcagacggtgagaagaataattctgatagttcagtttcaacttccagctaagaaaaatgagaagtggggtacaatcatacagggctcctatgagcctcagctaaacaaaagatgctccggttagttggatgcagaagcaggagttcttctgaatcttatcttggttctggttggtcaacctaacaaccactctgaaatactgtactaatacggaaatacacacacattgcgtagatactataccattttattgcaacgtacggtagcatacgtacttgaacgatcaatgacatccccaaaaagaaaatctagcaaacaacagagttttggtgctgggtagctcgaaatcgaattcgtctacgagaggttcagtttcactgattccggagtgtcgcatcggccactcacatcctcgtctaggatatgaagcggaagcaagctagacgatggtgatcgacggcaagctcgatcgatccgtcagaagatgtcgaggatctcctggatgaagccgttgcagagcgggcagttgccgcggctgacccagagctcgcgggagcagaggcggcagaaggtgtggccgcaggggatgaaggccgcgcccttgtgccgcaccatgcacacgcagcacacgtgcaccatctcctcctcccggccctcgccgtcgtcctcgtcgtcgtcgccctcgcctttcttgcgcgcgccgccaccgccgccgctctcctcctcgtcctcgtcgtcgtcccactggctgtccgtctgctccagcagcgccatcagcgacatctgcgccgcgggcgcctcctccttctcatcctcctcgtcgccctcgtcgtcgtcgtcctcgccctcgtcgtcctcttcctcttcctcgcccccgtcgtcggcgtcggcgtcgtggcgtcgctcgtcgacgtcgcggaagtcgtacgtcgcggggcgcctggagctggagcgggacgaggcggggccgaggcgggtggacgcgacgcgcgagaacgtgggcgtcgcgcggagtgacggcgcgcgcagcgagggcgcgcgggagaaggtgcgggagaacgccgccgccgcctcgccggggttgtagttgtacctgttgctgagattgccgctgttggtcggggcgtgcgccgcggccgcgccgggcttaggcggcgtctgccaggcgcccgccgcgcgccggagccggaggcggtcccgcagcggcttccagccgctcgtcctgccggcgcggggtccctgcgcgtccacggccgaggggctatcgccgtcgtggaggatcccgccgacgtcggcgtcgtgggggatcttgaggaagtcgcggatggccgggtcgggcgtggacgacagctgctcggacagcgtcatggtccgccgcatctccggccgcccgccgtccatctctctgggccgccgcagcaggtaggtgcgtgcgtgcctggctggctggcgtcggggttggaggtcgggtcgtgataaggtggcggcagatgcggggcggtggcgtcttatgggcgggttggatcccgcgcggggaagggggaggagaggcgttggacacggggcagcttggagcgggtctcgcgggctttttaaactgctggcgtaggagtatacaattaccgcaacgtgcggacagttgggcccaaactcccgaggttacaatgcatgcgtaatcaccggccttcctatttatgtttctgggtggattctttctttatagtaggagggagtttcacgtcccatgctctttcaattttagagccatgctatttgtagcacgcaattttaggtgccgaaaaatgagaattttttttgtttccatggtgtccatatacaaacataagaaacgattaaaaatattagcgagctatcaatagtacttgattgccttgttttgttttttatctctgtcggcatagttttgctagtgcttggtcttcttaaaaaaaatggtaaaactaggggggaaacatatgttctgctggtttcagcttctaagtaaaaatcacttttggtttcaccggtttcgctttcagaagccattacacgcttggtaggtagcgttgattaatccaatcgagaagcctaaataaatgccctctggcctctgctttagcagttatgtacggccatgtcatgtatctcgcgtacatcaaccgctcgctttgtgattctgattttcctttcccccatcttaacacttgtgctgttgcagttaactttttcttgttgctacgagcctacgacgcctgtcgaagttttggtccattttgaaagaacgaaaaaaaaacagtggaaattgtgaggaggatcttggtccaccccctccttccctctccgcccctgtttgtgaacactgcctctacaagtagcatcatcaacaaagtagtagcacgatgcacctgcgcttgaaccctgttctccacacgcttcgcctcgtactcgtacccgtagctagcgatcgtggcatagttttggactttttgcaggacctctgttctcatgcgtggtgcatgtggatgacggtaccaaaaaaaaagagtaaatacattcctttaataaaatgaaattggctgcttgatcggtttctgcgtggtgcctgcgtgcaagcaacggtacgtcagcgggtgcatgtcccgttctttgctgtttaccaggccactaaacattggtgactgcgtgattactctagggctctaggcctaatccatctaagtcactaacaataggaatctagaatagtacgtactccctcggtatgaaaataaaattcgttttgcctttctatagaattcatacattaactcgcgtacatgttcgtctatattcgttaagagctaaaacgaatattattttagaacgaccgagagggagtacttaggaacgtttggtgtgcctgtctgactgttgaagcttcccgttcctcgtccatcaggacattatggcaccggtccagcttggtgtttggttggaggacgaggaggacgacgacttctc

SEQ ID NO: 18338 - DNA, 1668 bp, Zea mays
atcttttcttttctttcttcgtcgctactagcgacatacgagcgccaccttatcggttcccctctctggccctcccggcctcactcaccagcatcggctcttcagtcttcaccatggccgccgcccacctcctcgccgctttgtcctcctccaccgccttgcgccctcctctccgcctccgttctccacagcatccaccacatatccgcttcaactgtactgggaggcggccgttcccggtggtacgcgcggctgagaccgacgccaaaaacgcgaaggcgaacgccaaggccccgaataaggcacccgcggcggatggctccagtttcaaccagctgctcggtatcaagggtgctaagcaagagagcgacatatggaagatccgtcttcaacttactaagccggtgacatggcctccgcttgtttggggagttctctgtggagcagctgcctctggaaatttccactggacagttgaagatgtcgcaaaatctattgtatgcatgataatgtctggtccatgccttacaggatacacacagccaaacattcttgcttgtagacacttaatgactggtatgatcgagacattgatgcaattaatgagccttatcggcctattccatcaggtgctatatcagaaaacgaggtaataacccagatctgggtgctattgctaggagggcttggattgggtgctttgttagatgtgtgggcaggacatgattttcctattgtgttttatcttgctgtgggtggctccttactttcttacatatattcagcaccacctctcaagctcaagcagaatggatggattgggaacttcgctctgggtgcgagttacatcagcttgccctggtgggctggccaggcgttatttggaactcttacaccagatatcattgtcttgactactttgtacagcatagctgggctagggattgctattgtaaatgatttcaagagtattgaaggggataggactctggggcttcagtcacttcctgttgcttttgggatggaaactgcaaaatggatttgtgttggagcaattgatatcactcaattatctgttgcaggttacctattgagcaccggtaagctgtattatgccctggtgttgcttgggctaacaattcctcaggtgttctttcagttccagtacttcctgaaggaccctgtgaagtatgatgtcaaatatcaggcaagcgcacaaccattcttcgtactgggcctactggtgacagcactggcaaccagccattaatgaaggcaaacttaaacagaacgagcaaccgttctgataccgaagaggcacgtctggtgaccattaataagctagctgcttgtgtgcagggtaggaagagaacgtctttttacttgtagaacacagatcgattttgtaagggttatgtggtgggaggaaaagttagcaatagcactggatgttgttgtagtaggatctgtagttgcacggtaagatcgttacttcgccattgttagcggttgaactggcaatgctttgaacaaacagttttgtgtatcggccgtattgttgtatgatcaaccctggaagtttgtacaacctccgttctgagtatttgcacctcgttctcgagtatttgtatttaaaaaaaaaaaaaaaaaagaaaaaaaaaaaaaaaa

SEQ ID NO: 18339 - DNA, 1641 bp, Zea mays
  misc_feature (1620)..(1621): n is a, c, g, or t
  misc_feature (1625)..(1625): n is a, c, g, or t
  misc_feature (1629)..(1630): n is a, c, g, or t
cccgatcttttcttttctttcgtcgcccgggcccgcgacatacgagcgccaccttatcggttcccctctctggccctcccggcctcactcaccagcatcggctcttcagtcttcaccatggccgccgcccacctcctcgccgctttgtcctcctccaccgccttgcgccctcctctccgcctccgttctccacagcatccaccacatatccgcttcaactgtactgggaggcggccgttcccggtggtacgcgcggctgagaccgacgccaaaaacgcgaaggcgaacgccaaggccccgaataaggcacccgcggcggatggctccagtttcaaccagctgctcggtatcaagggtgctaagcaagagagcgacatatggaagatccgtcttcaacttactaagccggtgacatggcctccgcttgtttggggagttctctgtggagcagctgcctctggaaatttccactggacagttgaagatgtcgcaaaatctattgtatgcatgataatgtctggtccatgccttacaggatacacacagacacttaatgactggtatgatcgagacattgatgcaattaatgagccttatcggcctattccatcaggtgctatatcagaaaacgaggtaataacccagatctgggtgctattgctaggagggcttggattgggtgctttgttagatgtgtgggcaggacatgattttcctattgtgttttatcttgctgtgggtggctccttactttcttacatatattcagcaccacctctcaagctcaagcagaatggatggattgggaacttcgctctgggtgcgagttacatcagcttgccctggtgggctggccaggcgttatttggaactcttacaccagatatcattgtcttgactactttgtacagcatagctgggctagggattgctattgtaaatgatttcaagagtattgaaggggataggactctggggcttcagtcacttcctgttgcttttgggatggaaactgcaaaatggatttgtgttggagcaattgatatcactcaattatctgttgcaggttacctattgagcaccggtaagctgtattatgccctggtgttgcttgggctaacaattcctcaggtgttctttcagttccagtacttcctgaaggaccctgtgaagtatgatgtcaaatatcaggcaagcgcacaaccattcttcgtactgggcctactggtgacagcactggcaaccagccattaatgaaggcaaacttaaacagaacgagcaaccgttctgataccgaagaggcacgtctggtgaccattaataagctagctgcttgtgtgcagggtaggaagagaacgtctttttacttgtagaacacagatcgattttgtaagggttatgtggtgggaggaaaagttagcaatagcactggatgttgttgtagtaggatctgtagttgcacggtaagatcgttacttcgccattgttagcggttgaactggcaatgctttgaacaaacagttttgtgtatcggccgtattgttgtatgatcaaccctggaagattgtacaacctccgttctgagtatttgcacctcaaaaaaaaaaaaaaaaaaaaaannaaangaannaaaaaaaaaaa

SEQ ID NO: 18340 - DNA, 2486 bp, Zea mays
  misc_feature (2430)..(2430): n is a, c, g, or t
ggatatagagaaagaatcgcacaaggagaaaagacacttgacataactatttttatcccatggttcggtcaagtaatacttgcctactccacgttgtggcgtcctaatggatgagggttgcactcaaccccttttaagtgatccaaagatcaacttgaatacaacgattctatttatctcaacaatatcctgtttgtgaggaatctccacactttggagtctctcacgccttacacaaatgatctcaagtaaacacaagagtaagggggaataacaacacacacaagagcgagagttgcagcaacaacacgcacgcaagacaagaacgagcacacggagttacagctcagaaaagtactcaaatctctaacacgatgaaccaaatgcgtgtatgtgtagtctcgacgtcttagaatgttcaatgagtgtgtactgctccatgcgcctaggggttccttttatagccccaaggtagctaggagctgttggagctctatttggaaggccattgttgccttctgtccgtggggtccggtgcaccatcggacagtgaacagtgtgcgatttccttccttttctggcgaagccggccgttgtagccaccagtccccgtagcacaccggatagtccggtgcgacctggtgaccgttggtaatgtccacgtgtcgcccgctgaccgcgcgattgaccgttagagtgggcgcggctgacacaccggacagtccgatgcacaccggatagttcggtggattataaccgtagctcctctaacttttttcgagagcaaccagttcgccgcgcacgcagcttgggcaccaaacagtccggtgtaccgcaggctccatgactaggttgttttttagagttttcagagcaacaaaagaggtactccaaaaaattatattgcagctccaaaaactccataaaattacaactctggagttagagtgattgtcatgctctggatagctccccattagagttttactctggacacatgtcaaacaccccctaaatctagccgaacagaagatccattgcaagaaaaggtcgcttcaaccatgcttgatttatatctacaaactcacgaattagtcttcaggagtacggaatccgcgcaaattcgtgcgagatcgaggaaattaaatcattgaacaaaactgggccgtgcgagcaacgtatttgggctggcccggtggaggcccggtgcgaacaaccaatgcctgaaagctgaatatccctgatcccgaagccccagccgccatctctctctctctctctctctctctcttcatcgccgcagtgcgcgctcctacaacccatcgctcaccaccacctgctcctccagcggcggcgtccagggtgaacccgaatccccaacaccatggcggggggcaagatccagaagaagcgccacggcgcggcgggaggcgcccggctgcagggcggtatcccgttcgagaagtccaaggggcagcacatcctgcggaacccggcgctggtggactccatcgtcgccaaggccggtctcaagcccaccgacaccgtcctggagatcgggccgggcacaggaaacctcaccaagcgcctcctcgaggctggtgtcaaggccgtcgtcgccgtcgagctcgacccgcgcatggtgctcgagctcaaccggcggttccaggggcacccgctctcctcgcgcctcaaggttatccaaggagatgtcctcaaatgtgatctcccatactttgatatttgtgtggcaaacatcccgtaccagatctcatctccccttataccatcctctcccagaacctagttacctggttgtagaataaattaattgattccctgaagttcgctcttcgattgttgtttgcaagttttttcaagatttttttttgttttcgattttggttaacttgatgtcttgtcgactgcaaatggagctcatttgtaatgagctgaatggtgtggtggagctggaaaactcaggtttagaatctttatgtttgaaggagttgattaatgggactttcctctcccccgttgtgattcctgttattggtagcactgttgttgaacaggccataattttaggatctttgtttgctggtactgatggtgaagaggctgtaactttaggaccttaatttgcggtatactacgtgaagacatttggttcactgtcaactacttctgaagtgttgtacatgtaacttacaatgcatcatagatagccttcatgagctaaactggtgaactagtaaaacgttcaggatattgactttagtgcctcatttttggagtttttaggagctgatgaatgagtaattatgtcaggatgttctatccagtgtaccattggcatttgtggtacatgtacatgaagagcgagtgagttaggtttgtcagaaatgagttcaccttttcatgaagatnccctgatgtgcttattgttggcgattttttaattggtgctactcatgcacgagaaa

SEQ ID NO: 18341 - DNA, 3590 bp, Zea mays
  misc_feature (1516)..(1516): n is a, c, g, or t
cattgggtacctcgaggccgggccgccatctcgctctctctctctctctctctcttcatcgccgcagtgcgcgctcctacaacccatcgctcaccaccacctgctcctccagcggcggcgtccagggtgaacccgaatccccaacaccatggcggggggcaagatccagaagaagcgccacggcgcggcgggaggcgcccggctgcagggcggtatcccgttcgagaagtccaaggggcagcacatcctgcggaacccggcgctggtggactccatcgtcgccaaggccggtctcaagcccaccgacaccgtcctggagatcgggccgggcacaggaaacctcaccaagcgcctcctcgaggctggtgtcaaggccgtcgtcgccgtcgagctcgacccgcgcatggtgctcgagctcaaccggcggttccaggggcacccgctctcctcgcgcctcaaggttatccaaggagatgtcctcaaatgtgatctcccatactttgatatttgtgtggcaaacatcccgtaccagatctcatctccccttactttcaagcttctgtcacaccgtccaatctttaggtgtgctgtgattatgtttcaacgtgaatttgccatgagacttgtggcacaaccgggagatagcctctactgtcgtctctccgtgaatgtgcagctcctgtcacgagtgtcgcatctcctgaaggtggggaggaacaactttaggcctccacccaaagttgattcatcagttgtgcgaatagagcccaggaagcccctccctcctgtcagcttcaaggagtgggatgggcttgtgaggatttgtttcaaccggaagaacaagaccctgggctccctctttaaacagaaacgtgttctggaattgctagagaagaactacaagactatgcagtctctccaaactgtgcaagatgcagaaatgggtgaggagaagatgtccgcagacgatgtcgcgttgctggctaatatggttgaagatatgagcatggagactggctatgataaggaagatgatgaaatggaaatggatgatgcagacatggctggagatggtgctgcaagctttaaagaaaagattatgggtatattgcagcagggcgattttgcagaaaagagaggttccaagctgagccaagttgatttcttatacctgctgtccctcttcaacaaagctggtatacatttctcgtgattggtggtccagcttctcttcagtagtagtctgtttctttctgttttatttgtcgtgctgttaatgtacttattagttactgaaaaaacctctaagcttgtgctcgtagaaattttttacaggctccgtcctagtttgagctgcaacgaaagaaaattctacttgttattgcctgtgcttcttagtccccgtgctagtaccgatttgccacaaatgtcattcgatatgcagcggcaagggcaacagaacgttcggatccacgtgagtacttgtcaccagcgtatagaaatgttggtgtagtgntccaagtggatgccttgagtatccatgcgtgttaagtatattgatactgatttataaaaatacggaaaagttgtgctaattattgaggaactaagtttgctcattgatctacaaaaatacgagaaagttatacaaattattgaggaattaagttgatcagccttactatgaaactacggagaagagttatgcagcataaggaggaagtgttatcaagcgtgaggactaaggagtaaggaataaagtggatagatttttttaagaaataacgataatttctaaatcaattagtttcatgtccaaaagctcaatcatgaaaggtatttttaataatacaagtgatggataatatatggagcaaaaaagaatctacatatggtttttttattgacttgaagaatgtttatgataaaacaccaaagaatattatatgatgggtgtcgaacaaacataaagttttagtaaagtacattggaacaaaaaataacatatataacaacgttaagactagtgttcaaacatgtgttaagacctagcgggcatcgagtctcataatggctctttatggattttatggtgcagttatttcttcgagatatcccgatgtcaagttatacagtgttaagcatctgctctcgtcagatctatgggaggtccttgggatgtagggcctcaagagcgatggtcccagtagatgggtcccgtgtagctttctatagcgggatttttttggatgtgtctttatggtagacgagggtatgacctttctggaatattgacaatgggcataaaaatgagtctgaaacgatgatatatatgatagactaaatgtaccatcaattgaagaaaaacttgttggatattggatgagatagtttgaacatgttgaatagagacctctagacgcactagtgtgtagtggggtcctaagccgcaatagcaatgagaagagagaccaagaaagactaaagttaacataaaaaggaacaataaaaggaggcttaaatgatggaatataacaaaattttaaccttaaataagagttcataaaaataactattcatatatctaaactttgaagtatgatttttgttcagttttaattccaatttactctaatttgcttacaactaaaaggttgttgttgttgcttgtttcacactaaaccattcttaacacatgaattgttaaacaccttcgaatatatgtttaagcaaaaacttgggatcatgcaaatggaatatgcattgcccattgttttctaaggccatactcagtagagcgtgcatatagctgtgcaaaacactattttgcatcgtaaattgtattgtttatagagtaaagtttgaatagagagtgcgataaagggtgatataggaaggtcgctaaagttggccttagaggaaggtgttagctccctctacttttctacaatcatagaacgttaagccttttataaaggaaacgacgagccggaaagctcaacacaatcgcacccttcttgaccaactagcgccaccgtagccatcacgttgtgccaccctagcccatcacgtctttaggttatctacactcatattactctaaattagtactttaaaaatattctatcctcgtcagcaagattctttaccctatatcaactacaatacattatatcaaatttttagacctacaactgcttactttatttctctctctcctgtagcaacatgaggaccagattgagtatatatgtcgtacaacactagatctgaggttccattcattctactccattataaagtatggtatagagtatgtcattggatgtgttttttactctacactaggatagtgtagggcgagcagttggccactacagacaaccttaagtcatgaatgcaaacgtgtctagcttgtgcattaaaccccacgaatttagctacataaagtgaagaatgacttctattatcttatatctctagcccttccaaacttccatggtaccaatttgtagcagggccaagagctcaggttgtccacacacggggacttgaaaagctaccgtaaaggataggataggacatagagt

SEQ ID NO: 18342 - DNA, 1206 bp, Zea mays
ctgcctgcagtcaaaaaaccgccaaggactgctgctgtccttcccacagaccacgagacttattccaacagggcaaaagtcgggggcggggcagggtggaggatcaagattgcatggtgaagaatcggtgctgcctcgcgtgtggtatgttgaggcttggaaatgacggcgtaccgcggtcttcctccttgtgtgccggtgtgtgggtgtagacatcgtcgagttccttcggccatgtgcggcccatcttggagagtcggagctgctcgtcccttgtgttgagctcgacaatgatgactctggatcctctggctttcgctggctggaatacttactttggttaactccaccttctcggctatgccaatctttgctatgtgtactctcaagttgttggctactatgattaagaacatcgatcaaattcgaaggagatgtctctggagagggagtggtgaggctgctcatggcattcctctcatcgcttgggataaggtcacttgtccgaagaacgaaggtggtctgagagtgcttaatccgagaatgaatgtggcccttctgatgaaatttgttcacaagttttacaacagactggacattcccagggtccatctggtgcgggactcctattattcttcgggtcggatcccccactgctctcctgagaaagggcccttctggtggagagatgttacacagttactcccctacttcagaggatatgccatgcctcgtgtgggtgatgggggcattatcctcttttggcaggatgtttggaacaatcacgcccccatgacggctttcccctgcctctattccttagcaaaaaaaaataaggaatccacaatgctggcattcatcagcaatgtctttggaagataattttcacactcctctgtcatgcaggctcaggaatacattatcttttcatatatgatcgaatgctggaagctagggaagagacggataaatggatttacccttaggaaacaacaagttcatctcctcgaaattctataatatcatctttgcatccatcaatcctctcgcgattttttttatggatttggtctcatctttcggctgactgcctgactgcgtaacccaaacgctgtattaggattcccatcttttgcatatccttattggagttaacctaatgttggttaataaagttatgcgacaacttgtcacctttatctgcag

SEQ ID NO: 18343 - DNA, 2254 bp, Zea mays
ttgggtacctcgaggccggccgggaagaacaaaggagccgccaagacggcaaggcgccaaggcgaccggacaggcctaggcgaagcgggcgcagctcctgccggtggtgggtagtggccctagcaataaacatcttgcccaaccggctctcgctacgcgcctacgcttcgtcaacaccggaaccgcccccaccccgccccgagcgccaattgcaccgccgctcccggccaaaccggccaagtcaacggcgcatccacttctccttaccatcccggaggtaatcttgcgccgattcggtgccgatttgcgccatccgcgaccggaggctccgccgggtcttgtgttcttgcggggcgggggctcaggacaacctggcctctgcttgattggattcggggcgttcggcgcctccagctcgcgatctttcctgccggtttcgtcgaccgctggtcaacctggccggtcggtcccgggggctcttcacctccgtgctgcctgccaccgtcgctttagtcaagtctcggccaagattttagctatctccggtcaaaaggctttaccgattcttggattggtggcttcttgggggcgagaagccggttcctgtttcgtctcttgtgctccagcatgttctgtagcacaccggttccccatctccagtgaaggtgttcgtgtgctcttggttttgtgcctcccggaatcgttcccggaaagctacttttggccgctgcggcgatggcgtcgagcaccagcgagatggccgaggggaaggagaagctgaagaggtccggcagcttgggaagcaacgatacgtatgtgcgtgcagacaagattgatcttacgagcctcgacatccagctggagaaccagctcaccaagacctggggcaaagccaatctcaaatcccaggggccaaaggaggagtgggagatcgaccttgcaaagctggagatccgctatgtcatcgctcaggggacgtatggcacggtctaccggggcacctacgatggacaggacgtcgcagtgaagcttttggattggggagaagatggttttgccacagaggctgaaactgctgctttacgaacatcatttaagacggaggttgctgtttggcataagctcagccaccctaatgttacaaagtttgttggtgcatctatggggaccacagaccttaagattccatcaaacaattccaatggtgctgcacgtacaaatttgccagcaagagcatgttgtgttgtggtagagtatcttgctggaggaactttgaagcaatatttgataaagaatagccgacggaagcttgcttataaagttgtggtccagcttgcattggatttggccagaggattgagctatctgcactccagaaagattgtacatcgggatgtgaaaagcgaaaacatgctgcttactccacagagaaaccttaagattgccgatttcggtgttgctcgtgttgaggctcagaatccaaaggacatgactggtgcaacaggcacacttggttatatggctccagaggttcttgatggtaagccatacaacaggaagtgtgatgtttatagttttggcatttgtttatgggaaatctattgctgtgacatgccttacccagacctaagttttgccgatgtctcatctgccgttgttcaccagaatttgcgcccagacattcctcgctgctgcccaagcgcatttgcgaatgttatgcggaaatgctgggatgcaaaccctgataaacgccctgatatggatgaagtggtgcagcttttagaggctctggacacgagcaaaggcggtggcatgatacctgatggccaatcatcaggatgcttatgcttcacaaaggctcgtggtccatagatacttttcatggtactcccttcccttggcaacactttccccgtgtaaatgactgggccacagcatgcttctctttgcacgacctgtgcagtcgtcgcttacagttctccatagctgccttgcgatcattgcgtgtcaacctgtagctctcatacgatttttgctgtcctctgtcgacaatcttttcatatactagtgtgctgctgtaattgtggttctaaaagagatttggcatacgcgttacactcttgaaactgctgtatgatcagtataaatctttactctgattattatttccatttgtgctaagaattgagtacaagaatggcctgaaataaattcgtgtttagctgatccaaaaaaaaaaaaaaaaaaaaaaaaa

SEQ ID NO: 18344 - DNA, 1829 bp, Zea mays
ataaatgcgcccgcaaatgccgccagtccgctctctctcgctgcgcctccgcccccaaatctgcgcaaaggtctcccactcaaattcctcgcggcgaccgatatggttgggagcgtgggcaacgggctggccgatctgggtgcaagagccgtctccatgaacggggcggggaaggcgctgcgtcctaccgaggcggcggcggccgccgccgccgcggagacgctcccgatggagctggatccgtcggaggccttagttgccgctgcggtggaggcgaagggcgaggaggctgccaacgggaggagggagttcgtgatggggaggaacgtacacacctcctgcttcgccgtgaaggagcccgacgcggacgacgaggaaaccggcgagcgggaggcaaccatggctagcgttctcgcgctctaccgccgctcgctcgtcgaacgcaccaagcaccacctcggttacccatacaatctggactttgattatggtgcactgacccagctgcagcacttctcaattaacaaccttggtgatcccttcatcgagagcaactatggtgtccattcccggcagtttgaggttggagtgctggattggtttgctcgcctctgggagttagaaaaggacgagtactggggatatattactaactgtggtacagaaggaaatctgcatgggattcttgttgggagggaggtgttccctgatggaatattgtatgcttctcgtgagtcccattattcagtattcaaagcagcaagaatgtacagaatggattgtgtcaaagttgacacccttatgtctggggaaatagattgtgctgatttccagagaaagttattgcagaaccgagacaaacctgccatcattaatgttaacattggaacaactgtgaagggggcagttgatgatctagacttggttatcaaaacccttgaggaaaacggctttaaagatcggttttatattcattgtgatggtgccctttttggattgatgataccatttgttaagaaggcacctcaagtgacatttaaaaagcctattgggagtgtcagcgtctctgggcacaagtttgtcggatgccccatgccatgtggtgtccagataacaaggttggagcacataaatgccctttctagcaatgtggagtatctggcgtcaagggatgcaacaatcatgggaagcaggaatggccatgcccctatcttcctctggtacaccctcaacaggaagggctacagaggctttcagaaagaagtccaaaagtgcttgagaaacgcacactacctaaaagatcgcctcaaggaagcaggaatcggagcgatgcttaacgagctcagtagcacagtcgtgtttgaaaggccaaaggatgaagaatttgtccgaaggtggcagctggcttgtgaagggaatatagctcacgttgtggtgatgcccagtgtcaacattgacaagctagactatttcctgaatgagttagtggacaaacgggcgacttggtaccaggacgggataagccagccaccctgcattgccagagacgtaggtgttgagaactgtctctgtggccttcacaagtagcgagccttttgctttgcaagtgggttcactcttgagtcgagttaaaaagtgttatgttgtactgtgttcattcttgagttgagttaaaaagtgttatgttgtactgtgttcatgcgttctgcttctgtgtttctccacagtgtagcttatttgttgccatgggaataaaattccttctattaaattgattgatggaagttgcatcacggttggctttatccttccaaaatcccctcctcgcc

SEQ ID NO: 18345 - DNA, 1962 bp, Zea mays
cattgggtacctcgaggccggccgggagcaagagtgggcacctccgcgcccgcccccctgcttcctgcttttcgtcctcacctcccttcccccactctcttctctccccgcggcccgtgactcatccacccacagtccactcgccactccccccggaacggcggcggcggcgacggcggaggagtaacgcaagatggcgaggaaacctctcgactacgaggagctgaacgagaacgtcaagagggtgcagtacgcggtgcgcggggagctgtacctccgcgcctccgagctgcagaaggagggcaagaagatcatcttcaccaacgtcggcaacccgcacgccctcggccagaaaccgctcaccttcccgcgccaggtggtggcgctgtgccaggctccgttcctcctcgacgatccccacgtcggcctcatgttcccggcggacgccatcgctagggccaagcactatctcgccatggcgcccggcggtctaggtgcgtacagtgactcccgcggcatcccgggaatcaggaaggaagttgccgacttcatccacaagcgtgatggatatcccagtgatccggaactcatctacctcacagacggtgccagcaaaggtgtgatgcagatcctgaacaccatcattagaaacgagatggatgggatcttggtccctgttcctcagtacccactttattccgccaccatttccctctatggtggttctctggtcccgtactacttggaagaagaggctaactggagcctcgactttgtgaatatccggcaaacagtggcggaggcacggtccaagggaatctctgttcgagcgatggtgatgataaatccaggaaatcccactggccaatgccttagtgaagcgaatataaaggaacttctgcaattttgctaccatgaaaacttagttctgctagcagatgaagtgtatcaacagaacatttatcaagatgaacggccatttataagcgcaagaaaggttatgttcgacatgggtccaccaataagcagtgagcttcaggttgtttctttccacactgtgtcgaaagggtactggggagagtgcggacaacgtggtggatacttcgaaatgacaaatcttcctcccaagacagtagatgagatctacaaggttgcatcgatagcactgagtccaaacgttcctgggcaaatttttatgggagtaatggttaaccctcctaaacctggagatatctcgtacctgaagttcgctgctgaaagcaagtccatccatgaatctttgaggaggagagcacgcatgatgacagatggtttcaacagttgccgaaacgtcgtgtgcaatttcactgaaggagctatgtactctttcccccaaatacgtctgccaccgagagctattgaggcggcaagaagagccggcaaatcagcggacgtcttctactgcctcaagctcctggaggcgacaggaatctccactgttccgggctctggttttgggcaaaaggaaggggtgttccaccttcggaccactatccttccagcggaggaagacttccctgccatcatgtcgagcttcaagaagttcaacgactcgttcatggagcagtacgagggctactccaggctgtgagcaggaagagaaacaagagtttacagatctgaagaagagattattgattggaagcttattagttattgtaactcccttgaaaagcaggttgtgcggggattattgtttattgaataaaaagtccgccatttgattctactgccataccagtatatataattgtgaattggcttgtacttgctgctggtggggagaggtggaaatagctagccctccttgaccgcgcgcgataagaatgtcgcctcttgttctggagattattggagagttgaatagttcataatcagcctacctacaatatattgcagaaaaagtactgatcagtcccggcc

SEQ ID NO: 18346 - DNA, 1908 bp, Zea mays
attttatccaccgcagggccaccgagcgaggcgataacccaaccagtatcagccagctcgcagtccctccgccaccaattttttttctcattccccgccccccgtccgccgccgctgaaacaatctgcacccccacgcacaagcacgaagcagtcagcagtggagtacaaatcctcgcctgcttcctggttttcgtccccattctctccccgccactccagcggaacggcggcgagggagtgagtgacggcagcgaggcaagatggcgaggaggaggccgatggactacgaggagctgaacgagaaagtcaagaaggcgcagtacgcggtgcgcggggagctgtacctccgcgcctccgagctccagaaggagggcaagaagatcatcttcaccaacgtcggcaacccgcacgccctcggccagaagccgctcaccttcccgcgccaggtggtggcgctgtgccaggctccgttcctcctcgatgaccccaatgtcggcctcatgttcccgcccgatgccatcgtgcgggccaagcgctatctcgccatggcgccgggaggtctaggtgcgtacagtgatgcccgtggtatccccggaatcaggaaggaagttgctgacttcatccacaagcgtgatggatatccgagtgacccagaactcatttacctgacagacggcgccagcaaaggtgtgatgcaaatgctgaatgccatcattagaaacgagagggatgggatcttggttcctgttcctcagtacccactttattctgctatcatttccctctttggtgggtctctggtcccatactacttggaagaagaggctaactggaaccttgactttgcaaacatccgacaagcagtggccgaggcacgttcgaagggaatcactgttcgagcgacggtgattataaatccaggaaatcccactggccagtgccttagtgaagcaaatataagggaacttgtgcgatattgctaccatgaaaacttagttctgcttgcagacgaagtgtatcagcagaacgtttatcaagatgagcgcccatttataagcgcaagaaaggttatgttcgacatgggtccgccaataagcagggaggttcagcttgtttctttccacactgtgtccaaagggtactggggagagtgtggacaacgtggtggatacttcgaaatgacaaatcttcctccaaagacagtagatgagatctacaaggttgcatcaatagtactgagtccgaatgttcccgggcaaatctttatgggagtgatggttaaccctcctaaacctggagatatctcatacccgaagttcactgccgaaagcaagtccatcctcgaatctttgaggaggagagcgcgcatgatgacagacggtttcaacagctgccgaaatgtggtgtgcaatttcacagaaggagctatgtactctttcccccaaatacagctgccagcaagagccatcgaggcggcaaagagagccggcaaagcagcagacgttttctactgcctcaagctcctggaggcaacggggatttccactgttccgggatctggttttgggcagaaggaaggggtgttccaccttcggacaactatccttccagccgaggaagacttccctaccatcatgtcgagcttcaagaagttcaacgactcattcatggagcaatacgagggctactccaggatgtgatgtcaacatgaaaagaagcgaccgcgccaccattttgcttctactgcccatactagtagaacagtgatcggtgcactatgtgatatttgctgctgctgctgaactgcggccttttctcactcaacactctgcttagtctgctatgtatgtgttgcctgttctgaaagagtaaagaagcgaccgataatgtaaaaaaaaaaaaaaag

SEQ ID NO: 18347 - DNA, 882 bp, Zea mays
agcagtctccacagggccctcggggccggccctcacctgctcccctgcttcctgcttttcgtcctcacctcccttctctccccgcggcccgtgactcatccacccagtccactcgccactccccccggaacggcggcggcggcgacggcggaggagtaacgcaagatggcgaggaaacctctcgactacgaggagctgaacgagaacgtcaagagggtgcagtacgcggtgcgcggggagctgtacctccgcgcctccgagctgcagaaggagggcaagaagatcatcttcaccaacgtcggcaacccgcacgccctcggccagaaaccgctcaccttcccgcgccaggtggtggcgctgtgccaggctccgttcctcctcgacgatccccacgtcggcctcatgttcccggcggacgccatcgctagggccaaacactatctcgccatggcgcccggcggtctaggtgcgtacagtgactcccgcggcatcccgggaatcaggaaggaagttgccgacttcatccacaagcgtgatggatatcccagtgatccggaactcatctacctcacagacggtgccagcaaaggtgtgatgcagatcctgaacaccatcattagaaacgagatggatgggatcttggtccctgttcctcagtacccactttattccgccaccatttcccctctatggtggttctctggtcccgtactacttggaagaagaggctaactggagcctcgactttgtgaatatccggcaaacagtggcggaggcacggtccaagggaatctctgttcgagcgatggtgatgataaatccaggaaatcccactggccaatgccttagtgaagcgatataagggacttctgcattttgcta

SEQ ID NO: 18348 - DNA, 2154 bp, Zea mays
cgcacactgttttagcgacgaaatcatgtgtgcattagcggatatggttctggctaatattagtcgaatcacgcagattaaaataccgaagctgaaatccattggattcggtatgttatttctcgcctcggtctcaaattagattttcgtggctcgtgtcgtaataattcagactacagatgaattattaagtttcgaatcaaatcaactatgtttaggcatcgggtaaatttttatccgatttcgactaaactagtatggtctcagaataatgtatccgatatctagttcgtttccgtgttgcccgaaacagtcacgaaaattatctgattttaggagtattcaccaaatcaaatcctatctaatttttcttttatgcctgatattgttttgggccaatttatttgtatctcttttaaaccttagtcctattatccacttacttttaagtctccattaacgaaaatgggggaaatccctttattacttcaacccatgtcacgcttcaagccttgtcttccatcgacattatcttcagccaccacacagcaggtcacgtaaatctccttctcacgtctcttgctcccttgttcttatctcaagccatcgtaatatcctagattccagtacacgtgccagctcgggaattctctctgcattctatcacaacacgtcatcagccatgcagatcaagttcttgataagttttagtgttcgcctctgtgtacataaatgcaccatgcgcataagctcagctcgccggtcgagctccctgcttccatggccctcggcttctccagctgccggtgcttgccctctgccatggccgcgccggattgaagcccctgccatggcacttcgcttcctctgcgacgttctcctccctctaatctttctgctcgccggcagtaatatccagtcgcgccctgggtttgcccgaagctatgcgcgcccggtcgatctccctgctccagcgctgcgcccgactccagccagctctgctcctctttctctctgctcggcgtccttcctctgcccgctgagtccctccatcgcctggccgcgcccagcttctttgctccgtgcgcgcgcctgctcctatgcggcgcggaacttcctctgcgtccaggtccctcagctcgcgtccatgccgcggcgtcctggtccctacttgaccgtgtcactctgcgctcgcgtcgctgtctggttccgagcgcctgggtcttctttcccctgcgctcggtcatagtcgctgcgagccgtgaaactccctgtgtcgagctcggatccctgcgcagcggagcttttcccctagccaagatcgtcattgcgcgcagattttctttgctgctcgccgcgctcgattcgtcgtgcgctgggcgctgtccggcgccggtattcgccgaccccgcctcaccatgggtgtgtgtcatcaatctcgccctgttctgtccactcgatgtcgcgtgcttctgtgtcgtttgctacgcttggcacatccgtgtcattcgtgttcgacatgtccccggcacggttgtttgcagctgctcggataaacttctctgtttcggcgtgttcgccatcgaccgcccccggtgctcgacgaatggctggaacccggaattcgtcgtcgtttctcatccgcgatctcgtcaacctctgctcgacaagtgttcgatgaagggcctgagccaagtgttgttgctacttccacgaatttctcatcgaattggtaatagtactctagctcgctactcctactaatcaattaattcgatgaatatattggatgaatattacccgcgacgttagaatcagatacttgtgatgtgctgtagtaattatctgtatttcattgtatatgtttgatgttaggttatttctctacgggataggatattgtatttcgatatttaatctcgtctggtatgtagacttgttaggtgttcgagaaaatgtctgaattagaaatcgttgttgttatcaggtgttgagtcaaatatggtcccaatgagctgtgccgtttttactgctattagaattgatgaatggttcgattaaatatattatcacgatgattctcttatttatagcacacatgcgcggtagcgatctgtgttacttagcgctagtttgtttcctttgtgtgtttgc

SEQ ID NO: 18349 - DNA, 1333 bp, Zea mays
cgacttcttctcaattataagctagcgctttggttctgggaagaaaaatctcaccgttgtttgatcctctcgcgagctcgactttctgctgtagtccgggttgtcttcagccgctcatcatccggggcaggaagcttcctgcgggttcgtcgcccgcccgcccgtcgaggtccggcgccctgcacccacgatcggattctcctagaaacaaatatctgccatcagctgtaggatttcttctaccgcctcctccttatccagtatacgtcagctccccggacgctcatctctccccgtgattatctcaagccgccgctggcagcttggaactcctctctgcttccttagctgctcgcctaggtccggcgtgctccagctcctgctcggccgccgtttcccctgctcgccgcggtgctccatttctaccctctgccggcgtccttcctgctcgccccagcacagcggtttcctgttcggcgcccagccatccctctgttttcctccctcgccatgccgcgcagttctccggctcgccggcgttttacccctgcgcgcgcgctcagctcggcgttcccttccccagctccaatcttctctgccgagcccctccgtggtcgcgtcccggccaacctccggctcggatcggtcttcagctctccctgcgcccgttctccttcgtcctggccccttcctgcgcgcgcaaatatattttccccagccgattctgctgtttgctcccgtgcgcgtctgtaacaccctgaatttagggtataaatttttttctttgatatccatcaaattcaggtattaccctctcttgtccttgcttttctttttattttcctaaatattgtagagttattttgttatgtatataggcgtaagcctagtaaacaaaaccctaaaggtaataatgattattgcattatgccagaatacatctatttttgtacgatgatttgttttggtgtgcatctatttaaactcgcagagcgtggttgaacttgaattcaaaacttaaaacaatattcaaatagagaaaagggagaaaaataaaaagagaaaataaacccaataccccctcccatgctccccacccaggcctgccccgccggcccgttcggcctcgtgcggcccagtgctcgagctgagcaccgcacgctctagccagggagccacccagcgccgccgcctgcgtgtgggccccactcaccaggtcgccccatctcctattcatcttctccaaaccgccttcccccacccatctcgcccacttcgccgttcggccagcgccctggcgcgcgagcagaaccgctcgcccagccgcgttgcg

SEQ ID NO: 18350 - DNA, 1011 bp, Zea mays
  misc_feature (923)..(923): n is a, c, g, or t
  misc_feature (948)..(948): n is a, c, g, or t
  misc_feature (951)..(951): n is a, c, g, or t
aagatttttttcgatgccgctgtctttttctactcccagccgaaatctccttctccctggtcatttcctcgcgttgcatcctgcttcctgttctgcgcgccggtcgtctctttcccatggcgctaggtcttgttcggtgctcctctctgccagccggttctctctccctcaagctcaccgtggagcgctccctgctcctccgctgtctgctcaccccggcttctcgcctcatccatcgccgagcgcccagcccgctctccttcgctcctccctgaagctttcatccatggcagccggcgctcgacggctcgcgctcaagctcctcccctgcgctcgccggcaacctgcatcttctccggctcgccggcgttttacccctgtgcgcgcgctcagctcggcgttcccttccccagctccaatcttctctgccgagcccctccgtggtcgcgtcccggccaagctccggctcggatcggtcttcagctctccctgcgcgcgttctccttcgtcctggccccttcctgcgcgcgcaaaaatatttttcccagccgattctgctgtttgcttccctgcgcgtcgtgctcctctgctctctgtcggcgcgcgctgtgctcgacgtcctcctatggcgctcgatgctcctctgttggccgcgccgtggagcctgcgcgctcggtcctgcccatttcgccgtgttctgtttttctccccgtagcgctcaacgccttggaacccgcatagctctgttcgtctcgtcattaccgtgctactgcctccggtgtggagcgatttgcgtgtgtcgatgaagcaagcgaagtcccgcaacgtccgctaggtgctcgacgaatggctggaacccggaattcgtcgtcgtttctcatccgcgatctcgtcaacctctgctcgacaagtgttcgatgaanggtctgagccaagtgttgttgctgnttncacgaatttctaatcgaattggtacgttaattaatcgcgtgatgcggaagacgagccaag

SEQ ID NO: 18351 - DNA, 1650 bp, Zea mays
aggaattcggcacgagccccattccaaacatcaccgggggccccctggcccgccggcgccttcctgagatccccaaaaccccgacgccgcgctctcccacctggcacccgagaatactcgcgctcgcgcactcgacattcctcgccccccacgccggttcaccctgcgcgcacgcgctcagcatctcgcaatcccccgggcggaggcgtatgtcctgcgccgtggcgatgccgatcgacttgctccacgctccagctccgtgggaggaggaggtgaaggcggttgaggaggacgaggaggaggtggagggagtaggatgcggcggaggggccgtggtggtggtcgcggcggacgcggaggcggagggtcacccctacgacttccacgtgtccgggccgcgcaacctgccgccgcccaactggaaggagataatcagatcgagctggaaggatccaaattacaaaaggatggtaatggcctgcttcattcaagcagtctacctgcttgaactggacagacaggacaagaaaggcgaagaggatggccttgctccaaaatggtggagacccttcaagtacaaggtcactcagacattggtggatgagagagatggttccatctatggcgccatgctggagtgggatcgttcttctgccttgtgtgactttatcctcatgagaccaagcggggcaccgagggctgtgttagctctcagaggaaccctcctgcagaagccaactatgaagagagatctgcaggatgaccttcgcttcttggtatgggagagcctcaaaggttcagtgagatttgttggtgctttagcagcgctaaaatcagcagttgagaagtttggcagcgccaatgtttgtgttgccgggcactccttgggagctggctttgcactccaagtctgcaaggagcttgccaaacatggagtttttgtggagtgtcatcttttcaatccaccttctgtttcactggccatgggtgtaaggaccatgagtgagaaggccagctacctgtggaagaaagtcaaaggaagtctgccattgaaggaagacacaacaccaccacttgagactgctaaggctgatgcaagtgacaagaagagattgcgcgccgagaagaaatgggtgccacatttatatgtcaacaacagtgattacatctgctgccactacaacgctccatcctgctcgtccacaacaacagatggtgcttccaacgaacagcagcaacaacaacgcaaggctagtgaaattgccggtgatgtggtcgcaaagctctttgtgacatcaaaagggccacagaaattccttgaggcgcatgggctacagcagtggtggtcagatggcatggagctgcagctggctctctatgacagcaagctcataaacaggcagctgaaatccatctacgcaacaacaacagaaatgccatctcctgccaagtcctagacacggcttaagccgctgttgcatcggtcattagaaatactctttctaaccagtgtgtgttcctttatcaactgagaatgttttattactccagtgatgccccaaaacagtcgaataatttgattaaagggatagtgtgtgaacagtttcgacaaaacaacattgtatttcaactctaaaaaaaaaaaaaaaa

SEQ ID NO: 18352 - DNA, 1655 bp, Zea mays
cgccgagtgcagctacaagtactcttacggccttgccagtgatccgcaccactacacacaaggctaccgaggagcgagacgttcacgctcggcactgacgacgctgccgtgccaggcatcgtcctcggctgcaccaacatgtcggagggcgggtacggctcgggctctggcctcgtcggcctcggccgcgggctgctgtccctcgtatcgcagctcgaggttagcgccatctcctactgcctcgatcaccatgcagtgataccgcaaagacaagtcctctccttttcggctccggcgccggcggtgcccagtcgacgccgctccttccggcatccacctactacagcgtgaaacgtgctcgggggtgcctcttgcaccagtcgagcgcacagtttccattttattactaagaagcgttttggttgatggcttaataagcactcgtgcagctgtgtgctgtccagtgcggaagcccactaactagctagccggtttgcaactaatcaagtgagcactcactagccaataagccaaagtggagacaacactacccatactcgagtcgagtgctgtagcacgatacatgtaatcagtgagcgccaggtggtcacacccttccgtccttcgatcagtgtcaggagcactatataagaagcaccagccgtgtcggcgggggaagcagcagcatccttaccagcacacagtggagctagctagctagtagagaggtcaatcaccaatggcgaggcagctcgttgtgcttgctctgcttttcgtgatcgccggtgtggcgcatggcgcgggggagtgcgggagagcctccgccgacagggtggcgctaaggatggcgccatgcatctcggctgccgacgacccgcagtccacgccgaccagcagctgctgctccgctgtgcacaccatcgggcagagccccagctgcctgtgcgccgtcatgctgtccggcaccgccagggctgccgggatcaagccggaggtcgccattaccatccccaagcgctgcaacatggccgaccgccccgtcggctacaagtgcggagattacacgctgccctagctgatgaagacgtcgtcaacgagaccgtgcgagtgaaccagtgcatgaacgaatgccattatgccatgcaactatgttgcgttgcgttagctgatgaagacgtcgtcaatcgagatccgctgcgagtgaaccagtgcatgaacgaatgccattatgccatgcaactatgttgcgttgcgttgttggaataataatcgaatccgctagaataaatatgtacgtgcacgacggcctcttgcttgtatcactggactttgcttgtgtgttatacgtcaaatatgttccgtttctctcatataagaaaattatgcaatgcttgttattaacctaattcattgcacactacaccatgacactatcaaggcagatttttagtatcgccatctcctaccaatataatggcacactcgctctctgacaggacgactcaatcttcggagcgaaacatatcatggagaccttgtgccgaaggtccgaaaaacaactttcgaaggctcgttattgaaaatgacaaaaataaatacttcaggatagataaatgtataattgtggtccacctgacagtgagaaggtgagactg

SEQ ID NO: 18353 - DNA, 968 bp, Zea mays
  misc_feature (749)..(750): n is a, c, g, or t
  misc_feature (756)..(756): n is a, c, g, or t
ttgggaccctcgaggccggccgggctgcaggaattcgtccttaccagcacacagtggagctagctagctagtagagaggtcaatcaccaatggcgaggcagctcgttgtgcttgctctgcttttcgtgatcgccggtgtggcgcatggcgcgggggagtgcgggagagcctccgccgacagggtggcgctaaggatggcgccatgcatctcggctgccgacgacccgcagtccacgccgaccagcagctgctgctccgctgtgcacaccatcgggcagagccccagctgcctgtgcgccgtcatgctgtccggcaccgccagggctgccgggatcaagccggaggtcgccattaccatccccaagcgctgcaacatggccgaccgccccgtcggctacaagtgcggagattacacgctgccctagctgatgaagacgtcgtcaacgagaccgtgcgagtgaaccagtgcatgaacgaatgccattatgccatgcaactatgttgcgttgcgttgttggaataataatcgaatccgctagaataaatatgtacgtgcacgacggcctcttgcttgtatcactggactttgcttgtgtgttatacgtcaaatatgttccgtttctctcatataagaaaattatgcaatgcttgttattaacctaattcattgcaaaaaaaaaaaaaaaaaaaaccctgggggggggggcgccgggaccccattcccccctttaggagcgatttaaaacaanntccccntttataatacaccggccgtttcccgttctccacccgcccgcccaacaccctatttatgttttaccactgccacttatgcaccgcgactattggtctccgcgtcgggtacctcgtatgttccccgacattatcgttccgcccgttatatcgtgacgaattctctcatttttccccgcccgcattatttttgttaacccacacaggtaataacg

SEQ ID NO: 18354 - DNA, 753 bp, Zea mays
ctcgaggccggccgggaataaattcagaactggttggaacaaaaaaaaaaaagcagcaggcagcagcatccttaccagcacacagtggagctagctagctagtagaggtcaatcaccaaaatggcgaggcagctcgttgtgcttgctctgcttttcgtgatcgccggtgtggcgcatggcgcgggggagtgcgggagagcctccgccgacagggtggcgctaaggatggcgccatgcatctcggctgccgacgacccgcagtccacgccgaccagcagctgctgctccgctgtgcacaccatcgggcagagccccagctgcctgtgcgccgtcatgctgtccggcaccgccagggctgccgggatcaagccggaggtcgccattaccatccccaagcgctgcaacatggccgaccgccccgtcggctacaagtgcggagattacacgctgccctagctgatgaagacgtcgtcaacgagaccgtgcgagtcaagtgcatgaacgaatgccattatgccatgcaactatgttgtgttgcgttgttggaataataatcgaatccgctagaataaatatgtacgtgcacgacggcctcttgcttgtatcactggactttgcttgtgtgttgtacgtcaaatatgttccgtttctctcatataagaaaaatctgcaatgcttgttattaaacaaaaaaaaaaaaaacataaccccccggcccccaaacataaccagtgataagtagataaagcttga

SEQ ID NO: 18355 - DNA, 2577 bp, Zea mays
ctctagtgcccggcaaattgcgaggttatctgctatagtctcctttttcggtgtattgtaggggaccacatactgagcgcacagcgcgcgcagcatgcgtccggcaggcagttgtgcctggaattgccggcactgcgtgccaacctataatcagagcccggggcgcgacggagttgtggtatgtgcgcgttagtgacctagacgctaaccaaaggaaacaaagctccctcgaccactcgcctttgcattgccaaacgaccgaccggcctggacccggagcgggaccagccagcagcagatgggccggtatgattaggaaaagcctcgtgccggtgcctcaggcgacccctccatgtgcacgcaccaccacgctgtcgatgcatgctatcccccggcccttttcgccgctgcattgcccttttgacgcggaccccatgccaccacgcacggcggctacaggcgcgcgcgccaccaccagccaccagatctcggcgttataaaacgccccgcgagcccgcgccgccccgctcttaggcaaacaaaccagccacccctgctctctgctcactcaccttccttactactgctcactagtcactacacaccaaccaaaggaaggcccctcgcacctcttctgtggttgtcgtcgtttgcctttccgtccgttagccaagccatgggcaactgcctcaacacggcctccaagcggagtcaccggggcatgcttttgccggaggaggaagagagcctctcggagataagaaggataagccagctgcttcgggaggaggaggaggacggctacgaggtggtgggtatgcactccgtctccgagcagctggtgcaggaggtggtggccgtggctccgggggtgacggcgcccgcagagggcctcaaggtgaagatcgtgctgacgcgcggcgagctggagtggctcatggcgcagctcaagagcggcgagcagcgcctcgaggacgtgctccagcacatgcaggctgctaagggagctggcggcggcggtggctccttcgctggcgacaacaaggccggctggcggccgcgcctcgagagcatcctcgagagctcggagacccaaagctgataccggcctgagcatgtcctcgctggaccggctccttgaattcagatcttgtccatgcctgtaggtttgtcgcttgctttcttgatgtttggtctggatcggtggagatggaggccgtcgatggatcggagtcagggagaggcttaaattcttgttgtgtttttttaacaagggactggccttgttacaactctgctactaggctggagcctggagggagggacgatgatccatcagatgggctatgttactctgtagatcatcgagatgttaattaggtctcttgtgcagtgcagctcagccaattagcatcttctttcactttttgcctttttgcgctgttacttagatcattatctttcgtaaatagcggtgcgaatgagatggcatctgaagccctctgtgtctgtaataatctcctctgactaggtcctgaatctgattgattcttcctaagtaggaggagcaccctgctcgctagctgtcaagacttgggagagtgctttcacttgggtttggaaccgtgagtaacgttctaatgaagatgaatttggtgtgctcgtgctcgaatctgctgttgtgacgatcaagttgtggccattgctgtgacgtagtagcaaattttcttggcaattatccccctctgctatctgctccacacaaagacgtagtaaccaacaaaaaatttttgtcgcctggcctgtgacctgacccccgtgctgtggttgtggaagaaacgagagatttgcatgcagttcgtagcatatataggtcggtctccgttacctgagtttttaattccatcgagtttaccaacacgtatcccgaggacgaggatatagttaggcaggtcaaatttttgcatacagtacaggcgtaattggttactgtctactgtgtccctgcaaaaggattggtgatagaccatggttaacgtccgggaaagcgggacggaacggttgggaggatgtgatgttacggtggtctcgtcttcgtctcactggctgcgctttttcaaccgcgacaacgacgcttcttccctccctctcctggccccagtctcactaacctctgcctctgactaatccacggcgtcgttgccttcccatggcgagcccaacaaccaagcaaaacgaccacgaacgtcaccgtcgccggcgtcccggtcccggtcccgcccggtacgtgtagactcggccgtcgccatagccgccgccagcagcggtcggtcggcagtgcagtaacgtacgctccttctcctacgcacaccataccgcaatcctttatcctggagacctggaccgagcacgtgagggaaagcggttttcttacaagatccaggaagaatttggctgaccccctccgcatgtcgagtccaaatttttagtgctcccctggattttgctgcccacaattcaggggctcctgttccaacgtttgacatggatgtgtttattttttctgtgaaactgtgg

SEQ ID NO: 18356 - DNA, 4446 bp, Zea mays
cattgaggattgtcatggtaaatcaatttaaatacattaaccaaacagtcaataacatatataaataatcgcacgttcctctagtgctcatgtaagacataatgttttctccttttgagcttgccttttttcatcaagtttacaactcttttccacctatgacagtatcttagaagcccatcattaccatccagtatccctccttcccttatgctaaatttttctcatccatattaagctaaatttttctcatccatattaagctaaattcttctatgatgagaaaaatgtattcaataaattcttctatattagctaaatttatcttgaagatttgagagcaagagaatagcctacttcactctccgttttctcatccatattaagctaaaattttcttctataagagcaagagccactaaatgttatatttttctaatattagaagaaaaatgtattcaatagattttgtaaatgacttttcaaatttagtggctctctatccctccaccttcgctctatatttttgaatagcctacttcactctctgttcagtctgtagatttactgaatctattggattaaactacttttttataaaatctattttagagaatagctaaatcagtaaatttacttaatctttttagctaatattttggagttgctcttacagagtagtagagatttaacattaaggtatgtagtaatttgatacttctagaactaaatttcatgaaagtggcaaaggataaaaaaacagagcactcaaacttttataataacgcacgaaaaaatctcaaaaaacaccctatctagttttacaatatcacaactctaccgtttgcatctttttcttgttggaaaagaccttatccacgctaccgatcaacttcaaaagatttcttctgcagtttctcaagtcgagaagctagtgggggacgacgccaccgagagggaacgcgacacgagatcgccatcgccatggggggaggagtcatgcgcaccgccgcgaaggtcagcatcgccgggggcgcggcggcggcgaaaagcggccggttccgcaacgccgctccggtcttcgccacggcccccgccgccgcgggttccgaagcggcgccgcttgtctccgtctcgagtggcgaggtgccccccgccgcggcgcagtgggcggcgtcctgggagctggacgactgggagtttgcggactggagggacgacgccgcggcggcggcggcggtagtggagagggaggcaacggcggccgccgccaagcccaggctggtcttcgcgccgccgtcgagggaggaggccgaggaggccacgaccgagctcagggacgccgtagagaggtgaatgttcttgtctttcccacgagatcccctttctcacttaccctctggaatttgtcgaattggatgtaaaggaaagatttttgttttaggtgacaattgattgggattttgattttcgttagctagactgctggtgcttctctttacgatctatttatcccgacatgtttggctgaattgattctttttatgggattttggaagcatctgattagccttttataggattatattaggtgctgggattcgatttcccaattgatgataagaaccctaggccccacagcgcaatagatttattgcaaaggagaatctgatgtttgttattcagttcactcaaattgtctagttgatgcagtctagtgcatgctaagaaagcttcctacccacttagttcccagatacatgtttggtccatgtgtgtctatatagcatactaaagtatgaaagcgtgatgctttgaggcacctgcacttctccatacatgtgtattgatgccctcaacaacgctctgattgtctgattgctttacaatttgttgcatctgcacaggatatacttatcttcgcatttagttcatgcatattgaccctatcctcacaagataatttgttacagggcttatttcaacgagtcgccagttgaggttgttaaggaacaagataaagagtttaataaactggcaactgatgccatgattccttctatgcctggacatgtggttcaagcttggacgttgctgaaatcaagcacggaggctcaggtttgtgcaatggcctatgtaaacatatcatttgagggaaattaattatttgtcaccctagtcactggcggagccacccccaggcaacgtagggcggctgccgaggcttgttggcaaagcgcaaagaaagtatttctttgtattgtagaggaatattatatctttttagataaatatttgtgcacaatgagaatcacttgggctcctaaaagtttctggctccgacattaaccctaatagatgcccactttaggggggagaatcattcatcagatacatcgacctttgtacaatgctacctagtttattgaattttgttagggtgataatgttttgccttgccaataattataatcccagaagaaactctttgattatgtttggttgatgctcctgtttgatttgcattaatgagttccgtgagcagtctttccttttcagttttcagtcacgcggttctacatatgtactccctttattcaaaattataagactgtctgacttttctagatacatagcttttgctatgtatttgtatcacatagtttatcttagttgatgatcatatagcgatacatcaatggatcacttagattaatttgttctgatatcatctgctatgtttctcactggaactgtttgttttggctcttgatctctagagtgttgtcgcctcccttgcatcagatagaaatgtctgggatgcagtattgaagaacgagaaggttatggagttttataagactcaccagacaagtacctcatgagactttagacagttaaacttatcgtattcatcgtctctaccaacttgtttgaccattgttgatgtcctctgctatgacacagctctagttcagacatcccctaacgaagccgtcacagtagagttgccggggaagctggaagatgctgcctctgaaaacacatccagcggcgaactccccgctggctcaggcccgagtttctccgatttcgtggacaatgcgaagaagacagtgatggacgtggtccataacataaccgacttcttcaaggacttgttcgacgactcagccaagacccagactggggcaggcccttcagcagctgagaagggcccttctacggcagatatggctgtcggcggatccttcatggctctggccatagcggtcatcctagttgttatgttcaagagggcatgatatagccatgagtatcttctgggatccacggtgctttaaatctgtcgaaaattactcgtctatcgtttggtcaagaactcctgactgtaatgtaatgtacagcttgtgtccttgtccttggaaacagcacactaaaaggctatctatgatatacaacggtgtgtatcttggtttctcaacctctgatgtgcagacatgacaagagcgtgcaacgcgttttgatgacgtctcctagtattcctaggtcatgaaacgtcaataaatgttcttgcatgtgcaaaaaaagcaaaccatccagctagcaaggggattccttctcgtggatcattccgtgattctttgtcactaaatcagtccttaggaaatgtttgaaagaaagttttttcacagttttaaaaaataacatagtattctcaaatgctacaatattatatacagaaattatttgacaatctagctaaaatatctgttttcaaaagttaagtattgcagatattatagttattttaaagtattctaaacttaggtctaaaccttacttttttttaaactgtagtattttaaattatgttattattatgactaacgtatattgtagtatttgaaaaacttcattgcagggaaactgaacttcttcgttgttgatctgtatcaccattgaccattgtagcgggtcatgctatcttttatctgaaattataaggccattataagcccatgctccaaattgctacgtatacatcaaaatatattgcacataagatgggattacaacataaagtgttgcgtctgttactttgtaatttgagacctataagggacatgaaacgtaaacacacaagagcaccaagaaaaaagaatcaatgttcagaggaccatcagaatattgagattccatcaggtatcaaggatagcaactaaaaagtgggttagatgaatatcatataataatgcacacctcctagtttagttgtatctctactactctataatctctattactctataagacactaacgtgggtgcccacaactatacgccatgtcgccatgcctccgcccccgcacatcgcactgccccgtcctcccaccggtcgttcacgatgcggaaatctcgcccgcccgcgagatctccacgtccc

SEQ ID NO: 18357 - DNA, 1228 bp, Zea mays
ctcccacacaaataggacggagaagtcgggaacaagctaaggggaacggcgccaccgagaggaacgcgaggtcgccatcaccatggggggaggagtcatgcgcaccgccgcgaaggtgggcatcgccaggggcgccgcggcggtggcagcggcgaaaggcggccggttccgccacgccgcgccggccttcgccacggcccccgccgccacgggttccgatgcggcgccgcttgtctccgcctccggtggcgaggtgccccccgccgcggcgcagtgggcggcgtcctgggagctggacgattgggaattcgcagactgcggggacgttgccccggcggctgtggtggcggagagggaggcgacggcagcggccgcgaagcccaggctggtcttcgcgccgccgtcgagggaggaggccgaggaggctacgactgagctcagggacgccataggcagggcttatttcaacgagtcaccagttgaggttgttaaggaacaagataaagagtttaataaactggcaactgatgccataattccttctatgcctggacatgtggttcaagcttttacattgctgaaatcaagcacagaggctcagagtgttgtcgcctcccttgcatcagatagaaatgtctgggatgcagtattgaagaatgagaaggttatggaattttataagactcaccagacaactccagttcagacattccctgaggaagcagccacagcagagtcgcctgggaagtttgaagatgccacctctgaaaatgcatccaacagcgaactccccacgggctcaggcgcaagtttcgcagatttcgtggacaatgcgaagaagaaagtgatggatgtggtccacaatataaccgactttttcagggacttgttcaatgactcagccgaggcccagaccggagcaggcccttcagctgagaagggcttttctgcaacagagatggctgtgggaggatccttcatggctctgaccatagcggtcatcctagttgttctgttcaagagggcatgatagctcaagagtcatgggtaccttctgggacccatcgtgctttaaatctgtcgaaaattactcgtctgtcgtatggtcaataattccgaatgcaatgtatagcttgtccgtttctttggaaacagtacaataaaggatttatctagagtatgctcctcaaaaaaaaaaaaaaaaaacctcgagggggggccccggacc

SEQ ID NO: 18358 - DNA, 1257 bp, Zea mays
  misc_feature (1246)..(1246): n is a, c, g, or t
accgatcaacttcaaaagatttcttctgcagtttctcaagtcgagaagctagtgggggacgacgccaccgagagggaacgcgacacgagatcgccatcgccatggggggaggagtcatgcgcaccgccgcgaaggtcagcatcgccgggggcgcggcggcggcgaaaagcggccggttccgcaacgccgctccggtcttcgccacggcccccgccgccgcgggttccgaagcggcgccgcttgtctccgtctcgagtggcgaggtgccccccgccgcggcgcagtgggcggcgtcctgggagctggacgactgggagtttgcggactggagggacgacgccgcggcggcggcggcggtagtggagagggaggcaacggcggccgccgccaagcccaggctggtcttcgcgccgccgtcgagggaggaggccgaggaggccacgaccgagctcagggacgccgtagagagggcttatttcaacgagtcgccagttgaggttgttaaggaacaagataaagagtttaataaactggcaactgatgccatgattccttctatgcctggacatgtggttcaagcttttacgttgctgaaatcaagcacggaggctcagagtgttgtcgcctcccttgcatcagatagaaatgtctgggatgcagtattgaagaacgagaaggttatggagttttataagactcaccagacaactctagttcagacatcccctaacgaagccgtcacagtagagttgccggggaagctggaagatgctgcctctgaaaacacatccagcggcgaactccccgctggctcaggcccgagtttctccgatttcgtggacaatgcgaagaagacagtgatggacgtggtccataacataaccgacttcttcaaggacttgttcgacgactcagccaagacccagactggggcaggcccttcagcagctgagaagggcccttctacggcagatatggctgtcggcggatccttcatggctctggccatagcggtcatcctagttgttatgttcaagagggcatgatatagccatgagtatcttctgggatccacggtgctttaaatctgtcgaaaattactcgtctatcgtttggtcaagaactcctgactgtaatgtaatgtacagcttgtgtccttgtccttggaaacagtacactaaaaggctatctatgatatacaacggtgtgtatcttggtttctcaaaaaaaaaaaaaaaacccgcgnccgcgggtttt

SEQ ID NO: 18359 - DNA, 811 bp, Zea mays
actcctatgggccattgggtccccccgggccggcccgggaccccccccgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgccccgtccctcgccggcagcgcgggaggacgggtgactttcatggggtccattcaggctgatggcttctgttttcttctgctgttgagctactggagtcatgttactttggtcgttggttttgtacccagacagcaagaaactgtccagcttattgtcttgttcctcgcgtcttgtcataagtaacttcaaacaaaggagtgcatgcattgtgattaaaaacgttttcagcaaaaaaaaaaaaaaaaaactcgagactagtgctctacctcgtgcaaaagcggccaaagcttatcgataccgtccaacctcgcagtggggccccgttaacccaattccgccctaaaggtgaagtcgaattaccgcgccgctcccctggcccgtcgtttttacaacgtgcgtgaatctgggaaaaaaccctggg

SEQ ID NO: 18360 - DNA, 1013 bp, Zea mays
ggtaccctcgggttcggccgggaaaagaagcggcaggaatggcgtaagccggcccgccttttgtatctgcccgaaccggtatgcgtgggatgtgggagggaggaggacgaagacagacgcgctccgccgtctctgccttgtgggccttacgtgggcctcatggcttaaaatgccatgccccagcaactacacgagtcaacacaggcccggcccggcccggcccggcccaagaacccccatctctcgattcctccaacaaattcccctttcccttactccccatccccacccacccacgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgccccgtccctcgccggcagcgcgggaggacgggtgactttcatggggtccattcaggctgatggcttctgttttcttctgctgttgagctactggagtcatgttactttggtcgttggttttgtacccagacagcaagaaactgtccagcttattgtcttgttcctcgcgtcttgtcataagtaacttcaaacaaaggagtgcatgcattgtgattaaaaacgttttcagcaattgagtacgaatattctctttttttttgtaaaaaaaaaaaaaaaaaccagtcatatttgctgcattgctggaccaaaaaaaaaaaaaaaaaggcccctaccgccaaaaaaaactcgagactatctctctctctctcctcgtgc

SEQ ID NO: 18361 - DNA, 1138 bp, Zea mays
gccggggacacgctggagtaacaggcatgccgaacggtggcggcaagaggtggctgctgctgctgccgctgtcgcggtgggttctcctcctcggcagcctccagctcccggcggtcggcggcagcggccatgtcgtcacgcgcatgcgcgggttcgacgggccacttccgttctacctcgaaaccgggtagtaaactgcttccgtgcttgactgcaaaccgcccaagttttaattttcttctcaccggcaccgccggtgcggcggcttcgtattgcgatgcaggtacgtggaggtggacgagcagcaaggtgtgcagctcttctactacttcgtgcgctcggagcgcgacccctacgaggacccgctgctgctgtggctgtccggcggcccaggctgctccggcatctccggccttgcctacgagataggacccttaaaatttgatgcccgagggcaaggtgaatttcccactcttctctaccgaccggagacatggaccaaggtgagcaacatcatatttgtggactcgccggtggggactgggttctcgtacgccaagtccgaggaagggctcgagaccggcgacaccaagcaagtgaggcagctaggcatttttctcaggaagtggctccaagaccatccccggttcgtgatgaatcctctttatattgcgggagattcatacagtggtctcatcattcctactcttgcattagaaattgacagaagcatagaactcggtgaaaagatattttctggtctcaagggggtacattgctggcaacccgttgactggcggacagtttgatacagacagccaaattccatactttcatgccatgggacttgtatccgatgaactttacaagaatgctagggagaactgtggtggaaagtatagtgctccactgaatgctgtatgtgcagaggctgtccaagctatcaacaatgtaaataatccttagatatctgatacaatgtgtgtaacatagagctcattacatggaaatcatattgatcatgtgtgacatcattggatataactcaaaagcagtcttgttatatacaattttagttatgctttctgcaaacgtagtatttacaaatagttatgttcaaaattacatgttagagagg

SEQ ID NO: 18362 - DNA, 684 bp, Zea mays
tagcgtggtcgcggccgcagtacattgctggcaacccgctgactggcggacagtttgatacggacagccaaattccatactttcatgccatgggacttgtatccgatgaactttacaagaatgctagggagaactgtggtggaaagtatagtgctccactgaatgctgtatgtgcagaggctgtccaagctatcaacaattgcacacgggatatcaataagcaatacatcttggatcctgcttgcccggatgatgatctgttgagccccaagactgtagcagagacagatggaacgagcaggttgatgctagagtctgcagattttctacttggttccaaatgtgcagctaagttccaaagatcatatcctttaactaattcaatccccttgtccctacactgttaagtccttgactgcttatctgacctacactttcctttggccgcaggaagctttatacattctatcctacgcttgggggaatgatgatacagttcaggagagcctcggtatccgcaaggggacaattggagcatggaaacgatacagccatgcattgccttacaattatgatatcgagagtgcagtggattaccattcaaggctagccacaaaaggatacagggcgctgatatacagcggcgaccacgatgctgttgtacctgcccgggcagccgctcgg

SEQ ID NO: 18363 - DNA, 1775 bp, Zea mays
ggcttgccccggccggtatagggaccggagtggcatttgaccgctgaagtcaacaggcatgccgaacggtggcggcaagaggtggctgctgctgctgccgctgtcgcggtgggttctcctcctcggcagcctccagctcccggcggtcggcggcagcggccatgtcgtcacgcgcatgcgcgggttcgacgggccacttccgttctacctcgaaaccgggtacgtggaggtggacgagcagcaaggtgtgcagctcttctactacttcgtgcgctcggagcgcgacccctacgaggacccgctgctgctgtggctgtccggcggcccaggctgctccggcatctccggccttgcctacgagataggacccttaaaatttgatgcccgagggcaaggtgaatttcccactcttctctaccgaccggagacatggaccaaggtgagcaacatcatatttgtggactcgccggtggggactgggttctcgtacgccaagtccgaggaagggctcgagaccggcgacaccaagcaagtgaagcagctagtcattttcctcaggaagtggctccaagaccatccccggttcgtgatgaatcctctttatattgctggagattcatacagtggtctcatcattcctactcttgcattagaaattgacagaagcatagaactcggtgaaaagatattttccggtctcaaggggtacattgctggcaacccgttgactggcggacagtttgatacagacagccaaattccatactttcatgccatgggacttgtatccgatgaactttacaagtgcacacgggatatcaataagcaatacatcttggatcctgcttgcccggatgatgatctgttgagccccaagactgtagcagagacagatggaacgagcaggttgatgctagagtctgcagattttctacttggttccaaatgtgcagaagctttatacattctatcctacgcttgggggaatgatgatacagttcaggagagcctcggtatccgcaaggggacaattggagcatggaaacgatacagccatgcattgccttacaattatgatatccagagtgtagtggattaccattcaaggctagccacaaaaggatacagggcgctgatatacagagcggcgaccacgatgctgttgtaccccatgttggcacacaagcatggattagatacctcaacttgacaatcgttgatgattggcgaccatggtacgttggaggccaagttgctggattcacaaggagttatgcgagcggcctaacatttgccaccgtgaagggtgctggacatgttgcgccgttgtataagaccttggaatgccaaaaaatgtttataacatggatttcagggaatcctctttgatgcaagtctgatagaatgacccatcggttatctgagtgggcgtcagccgtcaggaatcctctttgaagggtcagttgcttgggtttctttggtgtcaactggttcaaatccttgatcgatatggttgatcgtaatatttttggaacttatttcaagatttattaacggtattgttctcttaagacctgcctgttgattctgttcatataggtgaacgtgcatatgttgttgctatatgcatacatggggacatggggtgtaggggtgcttgtgcgttcgtacaaaaaataaagtgccaatttggattaaaaaaaaaaaaaaaaaacaggtgtatgtgcagttgcgtgtaaaaattctttgcataaaacaattataacttgcttcct

SEQ ID NO: 18364 - DNA, 1838 bp, Zea mays
  misc_feature (9)..(9): n is a, c, g, or t
ccggccggnggaggatagggaccggagtggcatttgaccagctggagtcaacaggcatgccgaacggtggcggcaagaggtggctgctgctgctgccgctgtcgcggtgggttctcctcctcggcagcctccagctcccggcggccggcggccacgtcgtcacgcgcatgcgcgggttcgacgggccacttccgttctacctcgaaaccgggtacgtggaggtggacgagcagcaaggtgtgcagctcttctactacttcgtgcgctcggagcgcgacccctacgaggacccgctgctgctgtggctgtccggcggcccaggctgctccggcatctccggccttgcctacgagataggacccttaaaatttgatgcccgagggcaaggtgaatttcccactcttctctaccgaccggagacatggaccaaggtgagcaacatcatatttgtggactcgccggtggggactgggttctcgtacgccaagtccgaggaagggctcgagaccggcgacaccaagcaagtgaagcagctagtcatttttctcaggaagtggctccaagaccatccccggttcgtgatgaatcctctttatattgctggagattcatacagtggtctcatcattcctactcttgcattagaaattgacagaagcatagaactcggtgaaaagatagcgtggtcgcggccgaggtacattgctggcaacccgctgactggcggacagtttgatacggacagccaaattccatactttcatgccatgggacttgtatccgatgaactttacaagaatgctagggagaactgtggtggaaagtatagtgctccactgaatgctgtatgtgcagaggctgtccaagctatcaacaattgcacacgggatatcaataagcaatacatcttggatcctgcttgcccggatgatgatctgttgagccccaagactgtagcagagacagatggaacgagcaggttgatgctagagtctgcagattttctacttgattccaaatgtgcagaagctttatacattctatcctacgcttgggggaatgatgatacagttcaggagagcctcggtatccgcaaggggacaattggagcatggaaacgatacagccatgcattgccttacaattatgatatccagagtgcagtggattaccattcaaggctagccacaaaaggatacagggcgctgatatacagcggcgaccacgatgcggttgtaccccatgttggcacacaagcatgcattagatacctcaacttgacaatcgttgatgattggcgaccatggtacgttggagaccaagttgctggattcacaaggagttatgcgagcggcctaacatttgccactgtgaagggtgctggacatgttgcgccgttgtataagaccttggaatgccaaaaaatgtttataacatggatttcagggaatcctctttgatgcaagtctaatagaatgacccatcggtcatctgagtgggcgtcaggaatcctctttgaagggtcagttgcttgggtttctttggtgtcaactggttcaaatccttgatcgatatggttgatcgtaatatttttggaacttatttcaagatttaacggtattgttctcttaagacctgcctgttgattctgttcatataggtgaacgtgcatatgttgtatgctatatgcatacatggggacatggggtgtatgggtgcttgtgcgttcgtacaaaaaataaagtgccaatttggattacttgtttggtccccatgcaggtgtatatgcagttgcgtgtaaaaattctttgcataaaacaattataacttgcttccta

SEQ ID NO: 18365 - DNA, 1196 bp, Zea mays
  misc_feature (1176)..(1176): n is a, c, g, or t
ccgcgtccctcgaggccggcggggacaacgttacaaggacgcatcgaggagactacctacggccatggcgaggagaaggcttctcgcgctcgcctcccggctctacgggaggcctcaggcgacgcagccgtggcggcgacccccgccccggtttctctcctcagctgcgtccggcaccctcgatcacctgaagtcgccgcctttcgcgcgtccggctgcccggaaccccgcctcctatccatgggatcgattcggaggagggcagaagaggaccatgttcatccagacacagtcgaccccgaacccgcagtcactcatgttctatcctggaaagccagttatggagattgggagctctgatttccctaatgctcggactgcgatgacatcccctttggctaagtcgctttttgctattgatggagtaaccagggtattctttggatctgattttgtaactgttacaaaatcagaagaaacttcctgggattgcctcaaacctgaggtttttgctgcaataatggacttctactcatctgggcaaccactttttctggactcaaatgctgcagcttctatggacacagcaattcacgaggatgattctgaaatagttgccatgataaaagaattattggagactcgtattcgaccagctgttcaagatgacggcggtgacattgaataccgaggattcgacccagaaacaggaacagttaagcttaaaatgcaaggtgcctgcagcggctgtccaagttcgtcagtcacattgaagtctgggatagaaaacatgcttatgcactatgtgcctgaggtgaaaggagtagaacaggagttcgatggtgatgaggaagctgaagggcctggtggtgaggaagctgaagtggctcgagagatcgagagagtttttacaggttttgagggtcaacacagcctgatgttatagcaacttcgcacgtacggtattgccgatcctgatgtatgcaggaggcaggcttagatagcagaggcgtcaatagtctgaaataacatccgttgcactagtatccgaataaagtgacagtgaattgattttttattttcattgaaaaaaaaaaaaaaaaaaaaaaaaaaaaaaaaaaaaaaaaaaaaaaaaaaaaaaaaaaaaaaaaaaaaaaaaaaaaaaaaaaaaaaaangggggcggccgttttaaagg

SEQ ID NO: 18366 - DNA, 1233 bp, Zea mays
aggagagcacaacgttacaaggacgcatcgaggagactacctacggccatggcgaggagaaggcttctcgcgctcgcctcccggctctacgggaggcctcaggcgacgcagccgtggcggcgacccccgccccggtttctctcctcagctgcgtccggcaccctcgatcacctgaagtcgccgcctttcgcgcgtccggctgcccggaaccccgcctcctatccatgggatcgattcggaggagggcagaagaggaccatgttcatccagacacagtcgaccccgaacccgcagtcactcatgttctatcctggaaagccagttatggagattgggagctctgatttccctaatgctcggactgcgatgacatcccctttggctaagtcgctttgtccctttttgctattgatggagtaaccagggtattctttggatctgattttgtaactgttacaaaatcagaagaaacttcctgggattgcctcaaacctgaggtttttgctgcaataatggacttctactcatctgggcaaccactttttctggactcaaatgctgcagcttctatggacacagcaattcacgaggatgattctgaaatagttgccatgataaaagaattattggagactcgtattcgaccagctgttcaagatgacggcggtgacattgaataccgaggattcgacccagaaacaggaacagttaagcttaaaatgcaaggtgcctgcagcggctgtccaagttcgtcagtcacattgaagtctgggatagaaaacatgcttatgcactatgtgcctgaggtgaaaggagtagaacaggagttcgatggtgatgaggaagctgaagtggctggatagatcgagagagtttttacaggttttgagggtcaacacagcctgatgttatagcaacttcgcacgtacggtattgccgatcctgatgtatgcaggaggcaggcttagatagcagaggcgtcaatagtctgaaataacatccgttgcactagtatccgaataaagtgacagtgaattgattttttattttcattaaatttctgtgtatatgtgagttaaacacggcaatgagcagtaaaaacccgtgtacctgcggatactggacccgatggtgcggacatgggcgtcatcttgtgcccaccggcatgggtacagaattgtacccaacaggacgaaggtagacggtaaaaaaatagcaaacccgtatccattt

SEQ ID NO: 18367 - DNA, 959 bp, Zea mays
  misc_feature (881)..(881): n is a, c, g, or t
  misc_feature (907)..(907): n is a, c, g, or t
  misc_feature (914)..(914): n is a, c, g, or t
ccggccggggttctcccgctacctccgagcccctcggccctcaggctctgaccttaaatgggatctgccgcacctcctgctctctatctctctctctgcaacgactgggttaccgacgcagccgccctcagccaggtgcgcgcgtcttctttgggcccttcgctggtgacgagcgcccactaggatcgaggcgtggtgatggtcgttgggtacttccatttggtgataatctgtgtgggaggtggaattcatggacgttgttaccgggcccaagtttaatcctagcaatttcagggtttctggtgcctgctcattctgaatggcagaccttacggacatcggttgctgcagttgctttagctttttaaggaagcccagtgtacctgtacgtcaacatcaggatgctgatggcatgttatctgaagatttactgaagcgtcaatcagctgaagatcctgatggaagtttctacactggggatgatcctgatgtaagcttttataacggggatgatcttgatagaagcttctacaatggagatgatcctgatagaagcttttacgatagagatgatactgattatattgagggaagcgatgatggaccaccaaggaagagttctgaagatattgtacagttaagaactcgacagcaacgttgcatgtagagaaatctcagttaaagagactaaaaaagtatttcgctcagaggatgaaaatggtaataagatggtcaatcaatatgtccacttgggaaagattggttctggaagctacggaaaagtggttctgtacagaaacattaaagatgggaagttgtatgccatcaaggttctgaataagccttacatgatgaaagtacgtgttgtacgcaccagaaantgccattgaccagatgttcttccggnaggtgtncctaatgaaaatgctgaatcaccctaaccatttgtcaatcctggt

SEQ ID NO: 18368 - DNA, 880 bp, Zea mays
ttgggtccctcgaggccggccgggaagctctcggcccttaggctctgaccttaaatgggatctgccgcacctcctgctctctatctctctctctgcaacgactgggttaccgacgcagccgccctcagccaggtgcgcgcgtcttctttgggcccttcgctggtgacgagcgcccactaggatcgaggcgtggtgatggtcgttgggtacttccatttggtgataatctgtgtgggaggtggaattcatggacgttgttaccgggcccaagtttaatcctagcaatttcaggttggctgtgtgctgatgctctttgtgtttaagtacttccacctggtgttaatctttttgggagtggaatctctgagacctctgaggtgtgcctttctggcatcaagtttaactgcaacgatcagagggtttctggtgcctgctcattctgaatggcagaccttacggacatcggttgctgcagttgttttagctttttaaggaagcccagtgtacctgtacgtcaacatcaggatgctgatggcatgttatctgaagatttactgaagcgtcaatcagctgaagatcctgatggaagtttctacactggggatgatcctgatgtaagcttttataacggggatgatcttgatagaagcttctacaatggagatgatcctgatagaagcttttacgatagagatgatactgattatattgagggaagcgatgatggaccaccaaggaagagttctgaagatattgtacagttaagaactcaaaatggctttgcatgtagagaaatctcagttaaagagactaaaaaagtatttcgctcagaggatgaaaatggtaataagatggtcaatcaatatgtccactttgggaa

SEQ ID NO: 18369 - DNA, 788 bp, Zea mays
ctcgaattcgttgctgtcgacactgttcaccatagcagccatcactttaccatcattaagctgccatgttttgatatcagcagcattgcgacgatcatccgcaagtatgggtgccgcatcagtcaaatgaaagagtaatccatgtcctctgagtgcagtctcaacacagaaagcccactccggataattttgtccatcaagagtgatattgaccacaatagcatttgtcgtcatattgaattcaatgaaaaacaggaagaacaggagaccggaaaccaagcaaaccagaggaaccgcagctgacagcagcccgggttggacgagttgacgaaggtcctggtcgcgaaagccgagttggacagtctgcccacaatggcagccaccggcgcagatggcgacgaggcagggcgcagtagacggtgacgtagatccggatccgcagaagcgtgcagcaagcagacggcagccgggcgcagcactgctggggacgacggctgaggacggcaaccgggcgcagcactggcgagggacagagccgggcgcagatggaagacagagctgggcgcagcactggcgggcgcggcctgacgcagcagacacggcgaacagcggcggacagcgcaggcgggagaagatccgccctggcgagatccgcccctggcggctgacagcacaggcgggctggcggcgggagatgccgccctggcggaggaccagcgcaggcgggagaagatccgcccctggcggctgacagcacaggcgggctggcggcagggagatgccgccct

SEQ ID NO: 18370 - DNA, 6270 bp, Zea mays
cttgattaggcgagatgagagataagaacccccctcgggtactgtagcatatatataggcatatggaccttatgggccttaacagaagcttgttacagtcttttactcaagtaaatgcactcgaacgcttcaaagtaagtgtgttttttatggtgaattcttcgggactatcaaatttgatatattgtcatattggtgttttactgatatattagtactgtgatacttatgcgtttgcaatgtaggatgatgatgatatgctttggagatctcctggcactcctgttttcactgccccggagtgctgtcaaggtacaactagcttttgatatttaggttataaatgctgcacataaaactggtccatagaaccacaaattaacaaaaaatggaatagatcagaatttttctgccgttaatttaaattaccattctttggctgctcggtatagactttcaaaatatggtgaagtatctcgtcctttaactgcaggttcagcctaccatggtagagcatctgatacatgggcagttggtgtaactttatattgtatggtctctgggcactatccatttctgggggatacattgcaggaaacttatgataaggtgcgaagaaatgttcctttccttttgcttgaattactctgcgtgaaactgactcgggtggttactccaaaatagattgccaatgatcctgtggaattacctggcgacgtgaatccccaacttgccgatttgctcctaaggcttctctgcaaaggtgcctttttggtcgttatctcaccccctccttatgattctgatggcctgaagttttgttaggtcctcagttaacgcatgtccttaccatgtccctctttccatgtgcttgatttgcagatccaggagatcgcatcacactgcgtgctgcggctgagcatccttgggtcgctggggatgaggggccagtccctgaattcatctgtagatgtgggtttggccgcaggaagaggaatgatgtccgggaagaagttcaataacaaagcatcctcggatggtctaataggtctagcgtagataattgatgatcggcaaagcgaagccctgacgatgagttcgttgttccgtgttccctgtttctaatacgcgctcgactgaacatatttctttttggtacagaatatatactgcgtaaccctatgccagtaaggcaacgtttgtcacagtttcacgttgtcaaacgcagcttaacgggtgatgtttttttttatgatccgagaggaatggataagtgaatttttttttttgaaaaaaggtgtatctttacggatggtctacgggtgaagcttccatttcatataaggagccattggtgaagctgttttactgaacggtttttataacagctcaaattctcgcttaactttcgtcgagttaatcgagtacttttcctgaggataatccaacacatttcttgttcttgaggataatccaacacaattcctgaggataatccaagtgtccaagacccccccaatttgcccggcaaccactgaatttatatgtgactgtgaagtccgcctgcagataagcgcggagagctttttgagaggctcagaacaaatgacgaagggcaattcctcgcttaacttccgtcgagtttccatcataacaaacgcaaacggcgtcatgttgggcgttcagacctcgaccaagacaagttcgacgtggcactgccaccaatccaaccggtaccattccaagccagcggctagcctcgatcgacgaacggtcgctgtacggctccgcgcctcatcatcagcccaatccgttgatgagtcgcaccagccagtggtccagtgtggcaaatgcgtggcgcacacctcttgccttgttgtacccgtcgtagctgtctccccatgtcggcgagaagaaaaccgatgcccttgccgctgatacccttgccgttgacagaaaaaattcttctcttgcgcgcatgcgagcgttgcacgctgcacagttatttacagaaatggtctgagctagtatccggcgccggagacgatccatccgatcgcagctgacttcacgcaacacagaaacgctaaactgacaacgccagtttcaaactgctactgatctgatacacgcaacctcgtcggctcgaaactaaaaaataaaaaaaatgaaaatacgactgcgtgaccccgccggagaagacagcaagtactagacactagaaagttgccccctgccgcgaaccttgggccttcgcgtttcaggcggccccggtaaagggtggaaaaaataggaaagaagggattcgtggtagtctcttgggccacctgtcgcactctgacctgttgtactccgtacctcccaaacttgtcgcgactcgagacatcctaatcctaggatatttctaaacatgaacggagatttcccgtacgaaggaggaggacggggtgggtggatttgggtgtggttcgctgctggtcctccgtgtggagtcttgtcttggcccgccgaccgcgacgtgcgcgcaacaggtggcggcctggcggggggattgatggggcgcccagatatttccgtacgagcaggaaggaaaaacgtaccgccactgatgattcagcgctgggcgagtggctgatgaatagctatttgtacgcagatgcctctctggtattcctatcctagctagcagcactacaccactagttcgtgaaaacgtactacttgcttgtcggtagtggtacgtgccgtgaagtcacctgcgtacacaagtgagtgacggttaaaccaggtggttcctctgaaaacaagtagcaaatctaacaattagatttacgttgtcttctgtccggagatatatttatttttaaacaacatttgaattctggaagtagacgtagaactgagagagtagtacactagtaataccagcttcgctgatctgtcgcttgatccagctcagcattacacaccagaatttccacaccgatagtggatgtgcacgcgcacccggaagtagtccaacatttggtcctggacgaaagttggactgggagatgcacgcgcacccggtgcaggtcgtactgggagagtgcaacggggacaggatccacaccacacgatcgtgcaataacggggttagttgcacatctgtatccacatgtggccaacacgaaacgtgttcgataaatctgtggcaggcctgctccacaaatactatacagttttggatagaaagatagattatagcctgtgcgtagctctcctgttgcttgatctcaggttcgcggcaatctgctggtaggcagagcgtgccgtgcgtgtaccatgattttttcacagccgaactgattgatacaagggcgctggtgcgagctcgccgtcgctcagcagtaacgccggaagaagttatttggaaggaaaaaagccaacaaagcgacatgcagctaaaatggagcaaaggaaccatggatggaccacgcaccgtccgagccacaccagccattaccattacgatttacgaacaaacgccgcctggccacgacgagagctcggcaaatccaagccactgtggccaagggatgtcgatttttccactcgcgcatggcccaaagcggtgcaggtctataaaacatgggtccccccctccgtgctccgggtccgggctcactcctgcgcgcttccgttgcgattgcgactttgcaccattaacactccctgcgtgcggtgcgtctgcttagggaggggaaggacagactctcaacgaaggagagaccttcccgcagtttctctctctcttgcaatcctcctcgccatgctaaggaggtcccgccacggcggggtccgtctcggccggaatctgctcggcctgtggcggcgggcgctctgcggccggcgccggcgccggggaggctactgccgcctgcagcagcagcagcagcccacctgcgccggcagcggctgcacgcccgggcgcggcgctaccgcgaggaagctcgcgccggtgctgcggtggggccggtcgctggcgcggcgcctgcggctcgggtggagggccgccggcggcgggcaccggatgctgccggacggcgacggcgagcccgcggtgagcacgcccaaggggcaggtggccgtgtacgtcggcggcgagggcgaggcgtcgcagtcgctgcggtacgtggtgcccgtggtgtacttcaaccaccccacgttcggcgagctgctgagggaggccgaggaggagttcgggttccagcacccgggcgtcatcagcatcccctgccccgccgcgcggttcgagcgggccgcggccctcgccgccgcggccaagaagggcttcggcaggtggtaggcaggcaggcggggcgcgcggtagtcgttgattagggagggagagacgccgcacgacgacggaggccccctgaccgccgccggccggtggcggaggcggatgatggtgtatatgcatgcatgtgcgctttgcttcagaaacgtacggggctgcctggcctaggcctagctgattttgttctctggattcttggtcctggtgcatccatccggttacttgtttcgtccatgtctactgcttcttgtcttcggattcaccctcagaccactggaaggattcacccaactgttgcttgctggacgtgtgtgctgaattcaccacgtttgccaattccgctagtagtagtgtgtacgtattacgggagcaaatgctctgtgtgtccctctccctctcttgacttaactgcaaacttctcatcaggtcgagactcgcgagcacgtccggcacgggccaccgcctgatctctccagtttcgtcccatgccctaccatttgtgctaccatgcgccacaatccgatgcccggaaaggcgtgccatccagattcagcgtcctcgaacggtgcgccaaccactgcacgaaccgtacacgcacgccttcatcatccgtacccccatgctaggaccgatcgagtcggctgttggttggagcacgccgtttgcgccgcgcagcgcctttgcacgcagcacgccagcgcgccggcctcgctactagctaggcaccacttgccgttctcgctaggaggctggcgtggtgactgactgacgaggtccggcgagcacagtgcaccgcgcgccctggcccctggcagcagcccgagatttcccggcgcctgacgctgtccagcggcggctactgtgcgctgccagatttctacagcaacaatcatgggatcgtacgcggaggccgctgtccgttcacggggcaaacgcgccgctgatggctcgcagtcgcagtcgcaggcgcaggcgcaggcgcaggaccaggggaggcagcggcctggccctggcgctctccctcgcggctcgggcgcacaggcaaggcagatacatcccggcgggctgcaggcggcagcaaagaaagggcggcgcgcgcggtcacagttccggcgtgggggctgcacggacgcaatcatgcggccgcgcaccaccgcgacacgcaagagcaggccagccgccaaccggagagagatagtagaagatagaggtgtatcccccgcgacatctcccccagcttttgccgagaaaagttgtgatcgccgtttcgggccggaggaccacgagcatatcgccgtccacaaacgcccggctcaccggatcttcgtcccaacaaaacagaaaaccatatcctgctactgctatgaagtgtattaggcgaaactagaaaaatctgccgtccttcttttccgaaaagggagattacgttgtgtttgtagggcgtacggttccatcgctcccctctacaccgtctccgtctgttatgctttagagcatcttcaaacaaagtaatttataaaaaatgctttataatttaaaaaattagtatattttataaaatttaagacaccaacaaaacattctgcttcaatagtaaaatcttaaatctagattatatgacacctcactacaatgtactctctccatccacaatatttttaggtttattttaagtcaattactattaacttaaaccggttatatcggatgtttcataagattttataatataaaaataaaattactaaatttatcaatacttgaactactataatatataattattttagtttaaaataatttaatttatatatattgttcgtcaaagcgaaaatagtttgacttagaacaaataaaaaacgactaaatcatgtggaccgatgaagtagtacatttgaggcacttgagatggtgcccttataattttg

SEQ ID NO: 18371 - DNA, 2607 bp, Zea mays
  misc_feature (682)..(682): n is a, c, g, or t
atctctctctcgcaacgactgggttaccgacgcagccgccctcagccaggtgcgcgcgtcttctttgggcccttcgctggtgacgagcgcccactaggttggctgtgtgctgatgctatttgtgtttaagtacttccacctggtgttaatcttttgggagtggaatctctgagacctctgaggtgtgcctttctggcatcaagtttaactgcaacgatcagagggtttctggtgcctgctcattctgaatggcagaccttacggacatcggttgctgcagttgctttagctttttaaggaagcccagtgtacctgtacgtcaacatcaggatgctgatggcatgttatctgaagatttactgaagcgtcaatcagctgaagatcctgatggaagtttctacactggggatgatcctgatgtaagcttttataacggggatgatcttgatagaagcttctacaatggagatgatcctgatagaagcttttacgatagagatgatactgattatattgagggaagcgatgatggaccaccaaggaagagttctgaagatattgtacagttaagaactcaaaatggctttgcatgtagagaaatctcagttaaagagactaaaaaagtatttcgctcagaggatgaaaatggtaataagatggtcaatcaatatgtccacttggngaaagattggttctgggagctacggaaaaagtggttctgtacagaaacattaaaggatgggaagttgtatgccatcaaggttctgaataagccttacatgatgaaagtacgtgttgtacgcacagaaactgccatgacagatgttcttcgggaggtgtccataatgaaaatgctgaatcaccctaacattgtcaatcttgttgaagtgattgatgacccaaacatagataaattctacatggttcttgactatgttgaaggaaaaatggtttgcgataatggtttagaagaaggtactgcaagaaattatttgcgagacataatatctggtcttatgtatcttcactctcataatgttattcatggtgatatcaaaccagacaatctcttggttaccagtgccggcaatgtgaagattggggatttcagtgttagccaggtttttgaggatgatgatgatatgctttggagatctcctggcactcctgttttcactgccccggagtgctgtcaaggttcagcctaccatggtcgggcctctgatacatgggcagttggtgtaactttatattgtatggtttctgggcattatccatttcttggggatacattgcaggaaacttatgataagattgccaatgatcctgtgcaaatacctggagacatgaacccccaacttgctgatttgctcctaaggcttctctgcaaagatccaggggatcgcatcacgctgcaggctgcggctgagcatccttgggttgctggtgatgagggtccagtccctgaattcatctgtagatgtgggtttggccgcaggaagaggaatgatgtccgcgaagaagtacaataacaaagcatcctcggatagtccacaggtctagtgtagataattgataaaggttggcaaaacgtagccctgacgatgagtttgtttttgtttgtttgtttgtttgtttgttgtttcgtgtccccaatttccaacgagtgttgggcgctcgactgaacatgtttcttttagtaagagaatctcgagtgtaaccctaatgacagtaaaacccaccgtctgccccccccaattttttgttgccctatataggacatacatacatacggtcacaaaccaccaaggtgccgtaaacctgcactgccattcagatagtgtgagaagttgcgtttctaaaatgccgtgtgcattgtttggatgtcggagagcataccattttgcatccttgacgttcaatctgtaaattctactgttctaatatcgtgtactgtgcgccgctatatatacttgtcgagtacggtggattcgcgttgtagctgaagggagctcattagctacacctgcacgccctgatttttgttggactgttcagacagcgaccaaggttcatgtggcatgtggcagtgccaccaactcaactggatcgttcaaagtcatctgctagctaagccccgaccgatggttgggtgagcgtaccgaagtgccttgcgtggatgtggtgggagcacggtcgccgtacggctatatggttctccgtcagctagcaagattgagtggcactagcagtggtccagtgcggcgatgcggctttgctttgcacacagtccctgtcctggtctaggcttgacttgtggcgggccttgttgtgcgtgggttgccatttgccactgatcagcttcctggctttctcactacgattttgtgtgtgtgtgcgtgtgtgttgatggttacaggagaggggaaaaaaaaggaaaaatcaatggcaaaactgtgtatggccgtccggtttttgagctgggtgcagctgaagctctgggacgtcagtgtcagtggatcggtgcggccgccaacctctgggatgtatgattggacaggacgagaggacgatcatacggggtacggccccgtttaacggctgcag

SEQ ID NO: 18372 - DNA, 4181 bp, Zea mays
aaacaacatgagagtcatcattgttagtacaagtatcggcaacaggatcatcagcaggactggctgtgggattagagcgaggacgacgaatgtaagtctgagtaacaggtggtttggaagagtaagactgagatgatgtggaagtggaaggtggtgtgatgggaataagaacatcgggtgtagaaacagtaggtggtaatgctgatgaagtttcagaaatgggaggaaggctcatgaaggcggtagactctgtggaatgaaaagaagaatgagtggaagagttgtaaaagaagggtcggttttcattaaagctcacatctcgagaaatacgcatgcgacgagaagatgaatcataacaccgatagcctttatgttcagggctgtatccaagaaaaacacactcaacagattgagcagtcaacttagtacgttcacgaggtgataatagtacataacacgtacatccaaaaactcgaaggtggtcatatcgtggaggagttccaaaaagaacttcaccaggtgttttgccagagagtttggatgacggttgtctattgatgaggtaaaccgcagtagaaactgcttcaccccaaaaatgtgaagggacaaaagaagatatcaacaaagtgcgagcagtttctataatgtgacgatgtttgcgttcagccacaccgttctgtgcatgagcaccagggcaagaaagctgagcaagagtaccctctgaagtcaaaaactggcgaaaattatcagataaatattcaccaccagaatcagaacgaaaggttttaatatgagtggaaaattgagtgtgaatcatgcgagcaaaggttttataaatagaaatcagctcagagcggcgtttcatgaaataaatccaagtgtttcgtgtatgatttgcaataaaaatgacatagtatttatatccaccttttgacacaaaaggtgcaggaccccaaatatcagagtgaaccaaatcaaagggttcaacagaatgagaattactagtaaaatatggaagttgtatttgttttccaagatgacaacccttacaatgaaaatcagactcaaccgaagtatgacctaagcaacctgactttattagagtagacaatctagatccacacaaatgacctagacgatgatgccactgggcaaaagacgcaacagaagcaagggtagctgaaagcacatgcgctggagatgtagccaaggaaggaagccgcaaagagtccaagatgtagaggcgaggagcagctctacggcgacggccagtcccaatcacttcccctgtgcgaaggtcctgtacaaaacaagatgagtcatcaaatccgacaaagcaattatgatccgtaatttggcctactgaaagaagatccatagatagctcagggacaaagaaaatattaggtactgtaaagtgtggatctgaaagagaacccttatgagtaatgtggcatacagtaccatcagctgtctgcactgaagcaccatctgtgacaggtgtagtagaagccaactttgactgatcagatgtgacatgaaaggaagctcctgaatcaagtacccaggccgactctgaagtacaggcggacgaagtggcagcaacagcaactgagcctctattagatggtcctggaccacgaccacgagcagcacgtcgtgcacggaaatcagtcaacttatcagggaacttgacaaagcaaagctcagatcgatgattggtcttgccacaatgatcacaaggcttaaaaatattcttaggtttctgggcagcagccaacacactgtgaggattaccaccagtagaggacagagaatgaagacgagtctcttcagcaagtaaatcagacaacgccttagccattgtgagagtgtcagaaccctgaagtaaacgagcacggagagaatcaaactcggccccgacccccctaacaaatctgtaagtgaagaacttctcaataaacttatgagctggacacgtgatcaggcgagatgacaggctggcaccattgatgtcaaagcactcatcaggcgatcaaaggctgagtagtactcatcaatgctcatatcattttgctcaataacatgtgtctgctgcatgagagtgtgtaatagagcaccactgtcctgaacaaaacgctccttcaaatgagaccagatggctttagcagttttgaatttagacaaactcataatcatagatggtttgacgctgttcaccatagcagccatcactttaccatcattaagctgccatgttttgatatcagcagcattgcgacgatcatcagcaagaacaggtgccgcatcggtcaaatggaagagtaatccatgtcctcggagtgcagtctcaacacagaaagcccactccggataattttgaccatcaagagtgatatttaccacaatagcatttgtcgccatattgaattgaatcaaaaatcagggagaacaggagacctgagaccaaacaaaccagagcaacccgacttggacgagttgacgggagtcctgggcgcggaagccgagttgaacagtggctggcgggagcagcaacgtcgcagatccgcagccctgtccgcaacggcgacggttggtgcagatttccggcgggagcagcggatccacggccctgcgcgcaacggcggctggcgggaatccgcagaacttgtcccagcggcggaacggcgcaggcagaaatagaaatccgcccttggcggcagatcgatgtagcgggcggcgctctgcccctggcagcaggaggcgcgctgcccctggggaggacggcgctctgcccctggcaaagaacccccggcagaaggcgcgctaccactggctgacggagggagggagatccgcccctggctgacggcggattgatgaagaaggcgggccaaggtccctggcggcggactgcgcggccgagatccttggcggcggacggtgaagtgagagaggaagatccgcccctggctgacgacggatcgatgaagaaggctgcgcggccgagctggcggctgcacggccgagatccctggcggcggacggcaggccgagatcgatctggtccctggcggcaggatgaaggaagggggtggccgcggcggcagagggaagggggtggccacgacggcaggccggagagctggtcgcgatggcagcacagcgacggcgcgatagcgccaaaaatttggatcagaatcgggtttagatgtaaaccctaaccctaacctgctctgttaccatgtgactaaccttgattaggcgagatgagagataagaacccccctcgggtactgtagcatatatataggcatatggaccttatgggccttaacagaagcttgttacagtcttttactcaagtaaatgcactcgaacgcttcaaagatgatgatgatatgctttggagatctcctggcactcctgttttcactgccccggagtgctgtcaaggttcagcctaccatggtagagcatctgatacatgggcagttggtgtcactttatattgtatggtctctgggcactatccatttctgggggatacattgcaggaaacttatgataagattgccaatgatcctgtggaaatacctgggcgacgtgaatccccaacttgccgatttgctcctaaggcttctctgcaaagatccaggagatcgcatcacactgcgtgctgcggctgagcatccttgggtcgctggggatgaggggccagtccctgaattcatctgtagatgtgggtttggccgcaggaagaggaatgatgtccgggaagaagttcaataacaaagcatcctcggatggtctaataggtctagcgtagataattgatgatcggcaaagcgaagccctgacgatgagttcgttgttccgtgttccctgtttctaatacgcgctcgactgaacatatttctttttggtacagaatatatactgcgtaaccctatgccagtaaggcaacgtttgtcacagtttcacgttgtcaaacgcagctttacgggtgatgttttttttttatgatccgagaggaatggataagtggattttttttttttgttttgaaaggtgggcgcttctttacggatggtctacgggtgaagcttccatttcatataaggagccattggtgaagctgttttactgaacggtttttataacagctcaaattctcgctt

SEQ ID NO: 18373 - DNA, 6630 bp, Zea mays
  misc_feature (1586)..(1586): n is a, c, g, or t
  misc_feature (3694)..(3694): n is a, c, g, or t
  misc_feature (3807)..(3807): n is a, c, g, or t
  misc_feature (4068)..(4068): n is a, c, g, or t
tgcctaattagtagtctggataaccttcattaattgctcgttttgtcaaccaaactaaactttctaattcatgtagttaaattttcatatcatacatgagaacaaagcgttccattatataatataactactgcacatgccaagtctatgaatcatattttcacatcacactgctcttagtaccattacaataaatatatagaagtcgtgaatcatacctttattttttgttattagtaactttggatgggaagtttgttggtgcacttttatttcattggaagcttgaagcgtgcatctatcattgttgtatttcccatcctaaaatcctcctgtttcacacagatcctggaagcaagagaaggactactgcaaagttcaccgacaaagcacaagctgttatcagaaagcaggaatactacagaacctgaagagagtgagttgtcaccggcaagcatccaaaacaagcatggagtatctgaagcgccgtcattccaagaactaacttctgaccctgtgcctaatgttgaggctgacaagcatcctatctcaagtactgaggcagaaatagttgacaagtctgtaattcaagaagagttggtgatgaaaactgaggccaagagtttacccactgaggaatctaaccctgaccctgcggatgatgatgatgaaaaagaagtagatgattggctacaggatgtcgactctgtgcccagcaaaactggcaacaatactgcagttggggaggaggaagatgtatccttcagtgatctagaggatgactgaggggctgttattgagccaaccagctatcagtttactgttagacggtagcttcatgaagtgaagaacacttgctctgtggctttaccacttcactgcctggttcttccgattgcagtagcagaatcacgtaacaatgtccctcggtgtgtcccaattccatgttgtatctaagcagtcaccgttttctctgtacataaagttccagatgcggctgtgcattcatgctatatcgttgtccttacgagctgctttttgaaacacgagattctgaatgtaatatattagaatcatctataagctgtcggatatcatgtatctcttacatgttgatataaacagagaaaaaatttttttcagggaacatgatacatcatcatacatgtaatctcaaggatgaactctgcatgctaaagcttatgaggcgttgagcaggatctggtgcactcacgctccacagtctctacagtaacagtaattacagtatcactagatgtagtagtaaacaaagcgctcatacgcgttgcggtgatgaagcattagcaaatgttcgagttcgtacgtttttttcataacgctatagaacctgttgcctgcgttacaggaaatttcattttcacaacgaaaagaaaacactgttccgaataggtaaggcaaacgctctgtttttccccatgacagcgcgatacaagcctttaatcgttggtccttaagctctgcttttcccaatcacagctcgatacaagccaaacgcttgaaactctgaataatgcagatgagaaggataaaaacagtacttgtcntctagcattcacaaaccgtaggcattcgaagtttactgctggtgcactcatgcaatccttttatccacaagtgagagttcaagaaaagaacaaatcggtctcagtaattcagtatccattcgtagcaattgcccaaatcacatggatcccaacagtatccccctttgaaggtaaactgtcaagtaagcaaaataacccatctaaccactgatgatttttcttacaaaagaattagaacccccaagccttttacagcccacagtcccaagccatattatatctacaatccacaattccacattttcaccgtttcaagtatccccgatgaaactatataacccttcttaatccggaatcaaatcttctttggatcatgtaccacgcttgcctttacctgaagtgcctcttttggtcgcattgccccccactcgcagcaaaatagatacccaattactctcccttgtaccgcatcactcgacttgctcaccgattagatcgagcccaacaaccaagaacgacaccccttggaacagaaggaagtagaaatgtatcccttgcaccgatagcaggctccgagcagcggctgttaggagaaggaaggagagtgccagctccttcctgtatatcctattgtgtttcttccttttggagtcccttttgagactggaagactcctttgtaagtgactcaaggttgggtgcagaccctaccctttgctgtttaggctgcttctcgacaagggcgatgaggtcgccctcggaagaacggcctgatttcttggtgacaacccactcgtaggcgctcccgagctggaacaggccagaaaccatggcgttgaatttggttactgacatggtattctcaaacaggagataggggacaatgaacgggaacgatttgggggctgggaggatgttcagcaaggacatggttgccggaatgtagcacacgacccaggcagggagctcggcttcaggaatgaacattgtcatgggaagaatgatacagaaaagggtgaaggaatagaagggcaaaataagcttgcgaaggagaaagaaaaggaatatgaggttgaacttcttccaaaatccaatctgcagaaaaagggaagaaaggttagccccagcataaaaaaaaggtccaaattttttgaaacgaaaacatgttaacctattgttgaacatataatcatacagagcaactatatttgtttttctacgaatggtataaaggatatataaaaatcgagttccacggaacaaacaaaacataaacatcggtaagtgcttgaaatatcactagttagctttgtattttgatattattttctttgatacaagtgtgtcgcccaagcgcacagttagtttgcacattttgttctacccaagctttagactgtgtctagcatgttacacccaaaacagtgttttgcactgtaggctgcattgttcgcagagtgaagtttgaaatagaaaatagaatgggagataggatgggtaatctactagagatagtcttagttatagcctataggaaacatttaaccaataaaatcactgctacattaaaaataagagcagacaatacataagtaatgaggctcaaaagaagagagagatgccataaatgataaaccagcatatgtcaaattgcgatttcatttctcaaaaaaaaaaggcaacaaacgtaactggcactggcatgtgaaataatgtacccaatatggcaacataaacgtattcaaggtttcaagcaggacctcaaaattgtgagcaatcatagtatgaatagtagaagatttgaagacacataactacataggtgacattctgtctctagaaatctatttcacagtccgtcatgctaaattatcaaattgaatgggcagccaaatacattcccaacaggaagaaaaggatggatggtcttaaatcatgcacaaaaagagatcacaacaatttgaaaatattcaaattttgaaaatatgtatgcaaggaaagctccacaccttcgatttgataatatccacaaagcatagtctaaataactgcattggaccagaatgccatcggtgttgctgttttcgatatgcctcatatgactctggnaattcacactggcactgaaaggataatcatgcaacacagcttcatttgtaatcagaagtctcgacacaatataatataacgataaagtaaaatgttatatatgcaagtacctnaacatcgttaaggaacagaaacttccagcccttgaggtgtgctcggacagcaatatccatgtcctccactgttgtcctctccatccacccacctgaatcctcaagtgcctttattctccacactccagccgttccgttgaatccaaagaaattgaggaagatcccattaacctgctgctccacctcaaagtggaagcacaggtttatgttttgcagcctagttaacaagttctcatccttgttcacaaaagaccaccttgnctgaactagcccaacatcctcatttccctagaaacccctcgcacaatgagtcagacaattgaattcagatggtctcatcactagatgaaaatgcaagcaaaagatgcgtgccaaaccttgaaatggggcacagttcgcttcaggaagtctggctggggttgaaaatcagcgtcaaagataacaacaaactcataatctttcacatagctgcagttcatggctgacttgagatttccagccttgtagccatcacgaattacccggtgtcggtacaatatgcgaacgccttcacgttgccacctctccacctcctctttaataagcgctgaagtggcagcatcatcagagtcgtctagcacctgcaccaagaagttgggccgtggccagtccagaccgcaaacagcaccaatagattgctggtacacctgcacacatataaaccaaaggaatgagacattctgttagagttcaaaataaatgcacaatccccgcttcaagattgttaaaaaattctacacttggtctttcctgaagtagtaatttagtaaaaaagaacaaacctaatgttggagggttccacatgaatgaggtctatctaggaaaagaataaaccgaagcgagtctccccacaaatgcgtagatgctgtaattttgtaagatgtaaaaaagatgctgacatcataactatttgtttcagtggtttcctccaaacctacgatcagttcattgtatggtggtcctctttatgctcatgagaattttcatgtgtttgggaggccaaggtgcaaaacaagagagacgagtgtgttctagaattccgtccaccggtcccccaaccggcgagcagctttatttttctttgaccaatggccacagatttcaatttcagaatcgatttaacccaccaacactttcagaagaaaaacctcaccaaaatgtcgatagtaactactactagtaagtattactggtgctttccggagttgttggcagaaactgaaaccgtcccatacccatttgtatgcatcactccgatcctcagatgatacctgaactagagccaccttgtttttccgctagtggcactacagccaaggtttcccccaatctaaaactaccctatcgaccatctgtttcagcttgaaaaccgaatctttcgatctctgcaaccaccaatgcggctagggcactcaaggcccaatccccaaatgcgaccttgaacacatcccaacagaggaatcgaaaacttcgtttgcctttttgtttccagctcacctccttctcgttgcacatcggaatctgcacgagcaccatggggaactccccggtgccggcctcgacgtcgtctggccctttgccagcagcattgggaactggcttgatgcccctgagcttgatccagaggcagccgaggcagaggataaggcggtcggcgctctggaccaagaagagcaggacgcacgcgttcgccaggaactgcagccccgccgcgaggtactggaggcggacgcgcacccaggacgcgtacccggcggcgaagagaccctcgacggcgagcaggtcggggacgtcgacggcgaggaggtgccagccctggaggtgcgcggcgacgtcggcggcgaggaggagcatggagaggacgagagaggcgcggaggaagccgtagagcctggtgcgcagtgcggggctctccccgtgcggcgcggcgccggcgccggcgccggcgtcggcgtcggcgtcggtccgccccgccgccacccgcctccgcgcggccgcggcgacggacagcgcggcggaggcggcgcccgtgagcttccccgcggcgcggtgcgccttgagcagaagcacccacgtgatctggcgagcgttcttgccgcggccggccttccccctcgccgcctctggctcccggacggcccagtccgggctctccatcttcaccaccaccgacgtgccgccgccgccgccgccaccccgcgcctcccggccccaccactgcggcattggcacctcgccgcggaacccaagcctaggcggcgccgcttcttggctttggcttccccctcccccggagcacagcccctccctcagctcatcaacgagaccacccgtgagcgccgaggcgaacgacggagacacgctcacacaaggaggagaaggggggggggggccaaagattaatgcgagctgggagcctgggacaagggagggaaatgctggtgaggtaggaggaggaggccgtccggacaggtccccacggaagcgggagcgcgcgcgcacgagcagaggccagagttagagcggcaggtagcagagctaggaagaagctcactgctcagtgctcaccacgtcgcggcggcgatccaatccgctcgggctcggactcggacaagtccaacctttatgaggccccatgattaccgcgaccaccacaccacctcctaataataaacagctactcctagaacatactagataggagaggcggcctttaccggctttacgccggtcggcagggctaatcagcacggtcaattaactaatccgccatagaaggagatt

SEQ ID NO: 18374 - DNA, 1756 bp, Zea mays
cctcgaggccggccggggccccccggccccgccccgctactattctactccactctacctaccgccccacgctccagtgctcgcccgccctccagaccgcacgcacgcacggcacgagctcgccgcgatgtcatggttcgctcgctccatcgctgccacactttcatctgcccactctgacgacgatgaatccgagcccgcctccggcgacaacagcccgccgcgcgcctccgaccccaccagcgccgagaccggtgagtccgatgagcagccggacaccccgagccgcggcgttaagggcgacatctcggagctgaccgagtccctcacccgccggttctggggcgttgcctccttcctcgcgccaccgccaactgaaggagagactgaagaggaggaggaggagacagccgccgccgcggaggtgcctcagtccccacggatcgacgggatccggagtgacctggcggagatcgggggcagggtgaagaccggcatctcgatgctgtcgaacgccggcgcggtggcggagatctccaggttcgcgtcatcgttcctgccattcggtcccggggatcagggggaggaggaagagggcgaggcggtcggtgtgaccgaggaggtagtggtgttcgtcggtaacatctcaaagcatccgaagacatggctcgatttccccttgtttgttgatgaccgacacgcagatgattttgaactatcagatgaacagtatggacatgcagttgctatagagcggcttgtaccaagcctatcatacctcaggactgagctttgctctaccaatatgagtgaagcgtgcttctggaagatatattttgtgcttctccattcgaaactcagcaagcaagatgctgaaattctttcaacaccacaaatcctggaagcaagagaaggactactgcaaagttcaccgacaaagcacaagctgttatcagaaagcaggaatactacagaacctgaagagagtgagttgtcaccgtcaagcatccaaaacaagcacggagtatctgaagcgccgtcattccaagaactaacttctgaccctgtgccgaatgttgaggctgacaagcatcctatctcaagtactgaggcagaaatagttgacaagtctgtaattcaagaagagttggtgatgaaaactgaggccaagagtttacccactgaggaatctaaccctgaccctgcggatgatgatgatgaaaaagaagtagatgattggctacaggatgtcgactctgtgcccagcaaaactggcaacaatactgcagttggggaggaggaagatgtatccttcagtgatctagaggatgactgaggggctgttattgtgccaaccagctatcagtttactgttagacggtagcttcatgaagtgaagaacacttgctctgtggctttaccacttcactgcctggttcttccgattgcagtagcagaatcacgtaacaatgtccctcggtgtgtcccaattccatgttgtatctaagcagtcaccgttttctctgtacataaagttccagatgcggctgtgcattcatgctatatcgttgtccttacgagctgctttttgaaacacgagattctgaatgtaatatattagaatcatctataagctgtcggatatcatgtatctcttacatgttgataccttcagagttccttttttttccagtgaacatgatacatcataaaaaaaaaaaaaaaaaaactcgagactagttctctctcctcgtgc

SEQ ID NO: 18375 - DNA, 4392 bp, Zea mays
aaacctcctgcataaggaaaaccgccgcggaaagaacgagtaggaggatagaaaaccataaatcgaaagtgaaaaggaaaccagccaccgaagcgagccaagggtttttgagtaatccgacgcgagcacgcacgctgcctgtacttcggctcgtcggtctagtccctccgcagtccgcccacgccccccgtctccctcctccccacgccccgcaaaccaagcgacgacgcggcccacgccatgagctgatgaacattgggccagtcgctgctccagtcctctgctcttccttccgcccacgccagcgccaacgccagcgcctcggggccgtgcgggggctagggtttggattcgtgggtggagtccgaggctagatccagcaggaggaggggaggggaggggaagggttgtgggtccagccggcggggatggccgccaccgccggggcgtcggacgacggcggtagcgtgggcggcggcgggggcggcgagcggatgaagctgctgtgcagcctgggcgggcgcatcctcccgcgcccgggggacggcacgctgcggtatgcaggcggggacacccggatcgtgtccgtgccgcgcggggtatcgctgccggacctcctcgggcggctcgccgacgcgtacggcggcgccactggcccgcacttcgccgtcaagtaccagctccctgacgaagggctcgacgcgctcatctccgtgtcctcgccggaggatctcgacaacatggtcgaggagtacgacaagctcagcggcgccagcccgaagctgagggtgttcatcttccccatcctggatgcggcgggcggcagcggcgccgcaggcggggaggacttggagaccgggaactttgactcgggccttcggtatctggaggccgtgaacggcattgtgcgcaaggacagcatcgcgagcctctcctccacgcagtgctctgacggggggctcccccctccggcgccatcaggtggcggcggccctggatctccagctgcgctctcccccacatccactagctcaaatgatgctgcgagatcgaacatcactggagccggggcggcgcctccgccccttgttgacgtcttcagtaatgctgctcctgctcctgtacatgtgaagccacaggagattggtgctgaagggagggctccccaggcgaatccacatccacatccagaggcagctacaaacacccatccggaggcagcgaggtacaggcaaccactatcgcagctgccaccactgcctcctgtgttcatgaacgatcacagagatgccattcagggtctgaatcagcagctgccaggtaacggagcaagattcgacgactgccacatgtgcttgaaggcattgcctcacgcccactctgatccagtggtcaatgagtatggcaatgaggtgcatggaggggctgctccagagcctgggcctgtgtttatgagcctgcggcctgaagatgtggcaaggatgatgataccggagaggggtgttcagccacccatgggggcttacggatatacgcatatgcatccagtgcctcaggagaggatgtatgtgcccaagatggaaggggttacaaactcagtattcattgatccaactggcttgcatcagcatgtgtatgtgcagcagcagcagcagcagcagcaaatgccgccacaacagttgccatctacctatgggtttagccatattcctgtgatttctagcgagaaggacagagtagtttctccaagttctgcccacaatgatgttgcaaactctcatcatcaatttatgcagcagtcgcagcagcagttaccttctggccatgggatgcctcagtatccagtgaagcctactagtcccagtaacccgcttgctggtgaaggtagtgtaagtggcaattcaaggcataatgaggatggacaggtgtatcgtgacaatatgcctccggttgcacctgtggctgtgccaacatacatggcaaatgtggacaggatgatggattcactccgtatgagccccagcgaagtttctggccctactgaacaaaggaaacatgcaatgtctcctgacagtggcttaccccagaatgcagtgccagattactctcaggggcatccagagaatagtatcagtacctggccagatacacgagcaaatgatgttcatccaagcaacaccaatactttttttgatgttagtgaaccaaaggtattgcttcaaactgaatctgcgccaccaccttctgttgccagctcttatctgcataatgtccagcatgttaatatgagtcatatgccacatatggtgagcattgggggaccctattctagctatgttgttgctacagtcggacctggtggattgcctcaatcaacttatggtattgatatgatctatccaaatgccactgttaatccagtgactgagagaagagatgtcccgcctgaagtttatcacaaggaagctccacatgaagtcgtagctcctccaaacacagttcagttgccgacagcagcattggcaaaccatgctacaaatgtggatcaagcagctgcacatgcactgccaccaagacctaagagggtagcaagcagagagaacatcagcccaaaggatccgcacccacacaactctttgttgaactgcaaagggccagatctgaatattccagctgaggatgtttctctccagaaacagtcagatcacaaaggtgatgacatctctaacccagatttactgagtatggatgatgggttagctacatctaaagctcagtcatctgagcctcaacctcctctggtaaatgaaggagttggggcaattaccaatagagtagaaggtgaagtccaccccaacgaggtttccaagagcaggccagcagattggatttcaggattcccaccctcccgtggacgtctgcagaggattcacaacaatgaccttgaagagctccaagagcttggttctggaacttttggaactgtctatcatggtaaatggagaggcactgatgttgcaataaaaagaatcaatgatagatgttttgctgggaaaccatctgagcaagaaaagatgcggtatgacttctggaatgaagcatctaaacttgctgatctgcaccacccaaatgttgtcgcgttttatggtgttgttcttgatggacctgggggatccattgccacagttacagaatatatggtcaatggttcacttaggacagctttgctaaagaatgccaaaaccctcgatcgacgcaagagattaattattgccatggatacagcctttggaatggaatacttgcatagcaaaaacattgtgcactttgacttgaaaagtgacaatttgcttgttaatttaagggaccctcagcgtccaatatgcaaggttggtgatcttgggctttcaaaagtgaagtgtcagaccctcatctctggaggtgtccgaggaacacttccatggatggccccagaacttctgaatggtagcagcagcttggtctcagaaaaggttgatgtattctcttttgggattgttctctgggaactgctaacaggagaagagccatatgcagatttacattatggtgttataataggtggcattgtgagcaacactctacggccgccagtgcccgactcctgcgaccccgagtggaggtcactgatggagcaatgctggtcaacagaaccatctgagcggccaaacttcacagaggttgcgaataggctgcgctccatggcggcatcccagaaggtacaacaacactaagggaccatcggcacgcagaagttgtaccagggcagcagtcagtcaaacttgcaggttacatccatgggccgccaattcacgccatccgccatatatgcctaggatctgttcataacccttcatttgttcgtatattgtaatcaaaagttacccgccgtgtgtctacaacgtgtcgtcgcaatggacgcagcaggtgcctgcctattcattcattcataccgttttggtcgtcgagaggtgcgttcaataagttactagtccagtgtccgttataggggagtccggtagtgtccgttataggggagtccggtattattattattattgtttcatcttcttcttcgccctttctctgggtaataattgggttacttggaaactgttgatcagtgggtcagttagaatgtgaactggttgttgctgggtaagtatgtggtttgttggtatattgagtctggggacagagagtgaggtcctgatctgcttgtaacagtacctgctttggttttgtgattgctatatactgaaacccaaatccctctgttgctattctaaattctgagttgtttggtgcacaaaaaaaaaaaaaaagtcgacgcgaaaaaaaaaaaaaaaaaaa

SEQ ID NO: 18376 - DNA, 1795 bp, Zea mays
ccattaaatcccgctgcttccgccaccggctaccctcgcggcctcgcccgtggccacctcctttcctctttccatttccgttcctccgctcccgatccctaaaccctacctaccccaaacccgcggcggcggcggcgcgactgttgggtttccttggtcatgggctgcttcctctcctgcttccggggcggctccaacccgtcgggcgatctccgcgacccgctcgtgagggagagccgcatcggggacgcctttgtcaacgacgagaagaagcttgatgaagcgactggaaagctggatgtcgaggcggctactgaccacggagtcgacgacgagcttcggagagaggcaaattatctcaaatcatgtggcacaatatcacagaccccaccggaaattctagattcaatcccaatcaactcagaagatgctaacgagtgcggcgatacaccgaccaacgtgcagcagacgaaacatgtagtggtagttgaagagaactcatctgaactgctcaactccgatgatcacgatgtactacataagcaggacactgactgaagggaggactctgcaggacgggatcagagactcaaccatccttagaagaagttaagccttcgtgccaccagaacgtggtgagagaccaaagcaccgactccagtgactcgccctatccaacccctctggtgctcaggggtgacatccagactcctggcaccgtatacgccgccgctcacaaggaggcttggaagcctgggaagcgcgcgagggcgttcatctaccctgtcctgcgccccatcgagaacaagatgcagtggatggaactgaaagccgccgagtctcctactgtgctatcacccaaccctccaaaaagaaggaacctgagcgcagcaggttccggcgacaaggctcaccagccgcctacacgttcagcgttcgccggatcttcagagcacggatccttcccaaatacttacagccgtgcagcgcaggacggagtgatgtcgcccgatgaacccaagtgccagaacggcttggaacagcaggacggacgcgaagagctatcgacgcgaagttctggacgcgggaagcgtggtgtcgcaagcctgtctcattggctgaagccatcgtcatcgtccgcggatgacggcagccccgacgacggcagcagcaattttgttggaacggaggaggagaagacacggtgtggggcgaacgtctctgatgtgcccttctttcctgcgttcgggttggactgggagggggagaccgacaagcctactcctgtgctgcccaaggcgtgggacggcaacggcatcccgaacaccacaaccaaatacaaggaggaccagaaggtaagctggcacgcgacgccgttcgaggagaggctgctgaaggttctgtctgacgagaagcctcggcatgaaaggaggatcagcgggaagcttatccacctcgacgaaaacgccgagtagaggggccttttgcgccgtcctctgcatcaagaaccgtctaaagaatggtccaggtggtggtggccgccagcccaccatatgaactccgtttttcagccgcatgtcacctgtagatagagtttctttcgctgagttatgctctgcactctgcagtgctgcgtggaatgttacaagcatatgtgatgacgtgtcaataaaaggacaaacatgccagtctcatagtctggtttcatgagaaacatgaacatcctcatatattaaaaaaaaaaaaaaaaaaaaaaaaaaaaaaaaaaaaaaaaaaagaaaaaaaaaaaaaaaag

SEQ ID NO: 18377 - DNA, 1175 bp, Zea mays
ctcgaggccggccgggagaacgtttcaacggatagtaaaaagttccaagaaactcgagaccacaccaaagactactcacaggtctcacttgaagctctaacagcaagccatggcaggacgagtagcggacaaagacccagagctgaaggtgctcggcgtgtggtcgagcccgttcgttatcagggcccgcgtcgcgctaaacctcaagggcctggcctaccgatacgtggaggacaacctggacagcaagagcgagctcctcctcgcctccaaccccgtgcacgggaaggtgccggtgctcctccacgacggcaggcccgtctgcgagtcccgggtcatcgtggagtatatcgacgaggccttcccggccagcggcccctgcctcctccccgccgacccgtaccgccgcgcggtcgaccgcttctgggcctcctacgtcgacgacaagctctttcccacctggatacccgtctacaacggcaggacgagcgaggacagggtcgcggcggcgaggcaggtcgtggccgtgctggagaagtttgagcgggcgttcgatgagtgctccgggggcaaggcgttcttcggcggggacgctgctggcctcgtggacgtcgtgctaggcggcttcctcgggtggctgcgcgcgtctgaggtgatgtgtggcgtgagggtcatcgaccccgccaagacgccgctgctggcggcgtgggcggaccggttcgccgcgctcgacggcgtcagggaggtgatacctgacgtgcagaggctgctggagtataacaagattaggcgagctcgtcgtgggctgccgtaggtgctgggccttgggccatctatctgccaccatgtgatcagtcaactctaagcaggagactttgacaaggttgaagttagtttatgacggtggccaatctaattaggatgctcatgctttaagctaggagtgccattagttttcctgttgaaaggcatgtttggttcctctttcctactgaaagagtttgtaatataatctatgatgctttgagtttgagaaaagaactatgaataaaacatggatatcttccgatatttcagttcaaaaacaatggaatgcttttgttctaaaaaaaaaaaaaaaaaacaaaaaaaaaaaaaaaaaaaaaaaaaaaaaaaaaaaaaaaaaaaaaaaaaaa

SEQ ID NO: 18378 - DNA, 686 bp, Zea mays
ggagatcaggactcaatttgagcgtgcctcacaatcagctagtgaggtatccaagatgcttgaggtcggaaagatgccttactaccagaagagttcaggtttcaaagtctctgcaatgatggtctgtggtataccgacaatggaggaggagtttctgcgttttgaagaggacaaggcgatgggatccggcaacctctcctctacgctacagaagttgtacatgtgggagaagaagcttcttgaggaagttaagacagaggagaggatgcgggtactgtatgacagaaaacgtgaggagctgaaaatgttagatgagaaaggtgcagaagctcataagcttgaggccactgagctttacatcaggaaactatcaactaagattagcatagccatccaggttgtaaacactatttcagaaaagattagtaagttgagggatgaagagttgtggccacaaacatgtgagctcattcaagggttgatgaggatgtggagcgttatgctagaatgccatcagatacaattgcatgccatatcccaagctagatacatagactccatgatagacactgcaaagttcggtgatgatcatatggacttgatcaagcggttagagcttcagctattggattggattgcttgttttgctgcatgggttagcgctcaaaagaattatgtcaaaactt

SEQ ID NO: 18379 - DNA, 988 bp, Zea mays
ttgggtccctcgaggccggccggggcccgatagctgacctagcgagctgatcggctctactcccttctcttgttcctttcttctctccgggctcacctaccggatcatcctccatggccaccctcgccttgccgccgaccaccaaggctgccggccaggacgccacccaggaaagcctagcagagaatcctgccaaggacgccgcagatccgggcagcatggagtccgagtgggttcttctcggaaaatcggacatcgtcccggccgatgtggccgccgccgccgccgcggggcaccaccacctcaacttctcgccgctgccgatgatccctatctgggtgcagatggttctcgggggcgtggtttacacggctgtgccgttctacaagagggtgctgaaggtcgaaggtgaaacgttggccaatgtagaaactgcagtggaggtcgtggagcatgtcgccgaggtgacggagaagttggctgcagatgcggccagttccctgccagagaacggatccctgcacaaggttgccgtggaggtggagtgcgttgctgaagcggtggataaggatgcacatgaggttgaagcagtcatcgataaggttgaggaggtgagcgagaagatcgatgctacagtggaaccggtcatcgaagagcttgagaaggacctgataccgaaccccagatcctctagtggatcagatgcccagaaatgacagttcatgtaaattgggagggaaagctggcgtgtgcgtgtccctggctgtctgtaaatttgtaaatctctcttcgttgtttcctaatgccctatgcgtgtaaactgtaaatacaactaagatacctcatgaactgcaacgacgccacggaatagtaagacgtggtacatgattgtgtcaaaaaaaaaaaaaaaatgtgcgtgctcgaatcctgtacatctgattgtcaaaagtactggcaacatttaccaagaatggtttacttgcaaacc

SEQ ID NO: 18380 - DNA, 1049 bp, Zea mays
gagttattgctctgacactatcattactaatttaatgcgagcccggccgggcccggacggaacctatagctgacctagcgagctgatcggctctactcccttctctcgttcctttcttctctctgggctcacctaccggatcatcctccatggccaccctcgccttgccgccgaccaccaaagctgccggccaggacgccacccaggaaaaaagcctagcagagaatcctgccaaggacgccgcagatccgggcggcatggagtccgagtgggttcttctcggaaaatcggacatcgtcccggcagatgtggctgccgccgccgccgccgcggggcaccaccgcctcaacttctcgccgctgccgatgatccctatctgggtgcagatggttctcgggggcgtggtttacacggctgtgccgttctacaagagggtgctgaaggtcgaaggtgaaacgttggccaatgtagaaactgcagtggaggtcgtggagcatgtcgccgaggtgacggagaagttggctgcagatgcggccagttccctgccagagaacggatccctgcacaaggttgccgtggaggtggagtgcgttgctgaagcggtggataaggatgcacataaggttgaagcagtcatcgataaggttgaagaggtgagcgagaagatcgatgctacagtggaaccggtcatcgaagagcttgagaaggacctgataccgaaccccagatcctctagtggatcagatgcccagaaatgacagttcatgtaaattgggagggaaagctggcgtgtccctggctgtctgtaaatttgtaagtctctcttcgttgtttcctaatgcccgtatgcgtgtaaactgtaaatacaactaagatacctcatgaactgcaacgacgccacggaatagtaagacgtggtacatgattgtgtcaaaaaaaaaaaaaaaaaaaaaaaaaaaaaaagggaggacgaataaaaaagatccaaacttaacataaacatgcatgcaaaagaaataaactcttctataatggggggcggccctttt

SEQ ID NO: 18381 - DNA, 3278 bp, Zea mays
  misc_feature (555)..(555): n is a, c, g, or t
ggaaaattgtgaacacctacaataggtacataattagtagtagaaattagttttatagttagattatatttaatactataatgatcatttaaacatcccaaacatcccctgcaactcgagttatttttctgacactatcatcactaatttaatgctagcgtaggcaatgaagcacggaacctatagctgacctagcgagctgatcggctctactcccttctcttgttcctttcttctctccgggctcacctaccggatcatcctccatggccaccctcgccttgccgccgaccaccaaggctgccggccaggacgccacccaggaaagcctagcagagtatgttttgttctgtttagcggtttcttcgcaagaaccaatctacaaagtttcgtgtccaaagtcgaataatggttccttgttttttttctcttcctcctaatgcaacgggatcaggaatcctgccaaggacgccgcagatccgggcagcatggagtccgagtacgtgtccccgactccccgaattaggaatctgtggtttgtttttctgctgtttnggacaacgactcctgaatttcgtctgacgcggtttgttccgatgagcaggtgggttcttctcggaaaatcggacatcgtcccggccgatgtggccgccgccgccgccgcggggcaccaccacctcaacttctcgccgctgccgatgatccctatctggtgagccatttgctatttgtgggcttctctagttattatgcaactggtaggaagtgggacggggcagtaattccgcaattggctgtatatcattttttatttattaagcttcaaaaccaaagcgcaacaatcttcatgttcttcgctcagggtgcagatggttctcgggggcgtggtttacacggctgtgccgttctacaagagggtgctgaaggtcgaaggtatgtttggtcacatccctacgtctgtttactgcaaggagcagatggtgactaggggccatcggagcatagttcacaggatcgttgcctgatcagtcacagtcaatctatatatacatgacaagatgagctagacaaattgctgctcacggcctattgcaacgattggattactatgtcaggtgaaacgttggccaatgtagaaactgcagtggaggtcgtggagcatgtcgccgaggtgacggagaagttggctgcagatgcggccagttccctgccacagaacggatccctgcacaaggttgccgtggcggtggcgtgcgttgctgaagcggtggataaggatgcacatgaggttgaagcagtcatcgataaggtttgctatgccttgtccatgttcttactcgaaattgaatatttcaatatgttatggatatgccgtcgcaattagtcattgagattcttttgtgtgcattaattgagtaattgacggttatcggtgaaatgaaaatatgcaaggaaaaaaaactggccactcttccttttttacttttagggctagtttggaaacttaatctccccaccacaccacacacacgcacaatcccagggaatacatgaggggatttaagtttccaaactagttcttaaggtagggaaatgctgaccactttaagttcagacaagggattgctaactgtttcgcccaagaaaccaatgacagattcaatcttttctggcagcccacatattaagatttcagtaacttggggctggggataaagcatgtgcacatttctctggtaaaaagggaatgtctctaatttcttgcaaaacatgttctctcttcccccaccaagtgagaaattgtcctgtgcctgcttaacattctaggtgaacatttagtatgcttcagcagctccaacttgagacccaagtttacagaggcatctgcattgcggctagcgaagtagacaaactacttttcttcaataacgctaaagacggtagcatgtctacaaatcctagttccatgggttttatgaaagaaagcaaatctcttctaatgccccctcctcaccggttgcgctgggcgctaaggttgaggaggtgagcgagaagatcgatgctacagtggaaccggtcatcgaagagcttgagaaggacctgataccgaaccccagatcctctagtggatcagatgcccagaaatgacagttcatgtaaattgggagggaaagctggcgtgtccctggctgtctgtaaatttgtaagtctctcttcgttgtttcctaatgcccgtatgcgtgtaaactgtaaatacaactaagatacctcatgaactgcaacgacgccacggaatagtaagacgtggtacatgattgtgtcattgtgtgtgtgtggctgtgcgtgctcgaatctgtacatctgattgtcaaaagtactggcaacatttaccaagaatggtttacttgcgtgaggtgtttgcatgcagatggaatggttcattgtgagtctcatcatcagacgtgccctttgaacactcggtcagcggctcagcgcaatgtctcgatccatgcggccataaattgaacactcgctttggcatcagttcccttaacccacttcattgtttagctcaagataactctagccccgtgtaccatttctgctccggatgacctcgcggtctccgtccatgaaattgtctgtggaaagcagctgctaatgctactgcagtagtgatcgtgcgaaggattcgctttgccagcgagccgcacgctcgcgcaaaattaaaaaggaaaagaagaggagagaaatactacaagtagtacgaaccaatcgagcagtttccctgttcgaatttcaaactttggaagctactcctacgttgtcagtaagtacacaagtcctgagtccggcactccatccaggcacacactcctttgtgtttgctatctcgttgttggtgttggagttcaacaattaaggccaggattatgatggtggccaaacagattgtctctggtggccgagctcgtagcgcaaaattaccgcggccaggacgttcaccgtgggcgacggccagggctggatgagcggcatcgactacaccgactggaccagcggcaagacgttcgcagtcggagacaaactacgtgagtaggcactgatacgttaaatgaggtgtttggtttaaggaatcactacatccaaattgagatgttgttcattcctcaaatttggtgggatgaccacattcctcatattagtactaactaactaactataaggaatgaggtggtgataaatcaactccttccattccataaaccaaacaaaaa

SEQ ID NO: 18382 - DNA, 1631 bp, Zea mays
cctcgaggcccgcaaaaaaacaaacccggctctctcacttgcttcaaggccgacgggctatctcactgatagtgataggaacagaacccgtgcatatttcagtcgtcgctcgcggagccgtggcgcatcgcgactcaggcactcaccgaccgcggatatggccccgccgccatggcctctccttgcgacttccctcctcctcatcctattccaccactcgcctcgcgccgcggtggcgtttccgccgtctctgggcgacggcctcctgggcgccgcccgcgcgccgggtttcgcggcttggctgcgcggcttgcggcgccgcatccacgagcgccccgagctcgccttccaggagcaccgcaccagcgagctcgtccgcgacgagctcgacgcgatcggggtgccgtacgcgtggcccgtcgcgcagacgggcgtcgtggcgaccatcgccggcggcagcgatggccccgtcgtcgcgctccgagccgacatggacgcgctacccttgcaggaattggtagactgggaacacaagagcaaggagaatggaaagatgcatgcttgtggacatgatgctcacacaacgatgcttcttggggcagctaaattgcttcatgctcggaaggatgatctgaagggtaccgtgaagcttgtcttccagccaggagaagaaggctacggcggcgcttaccatgttctcagagaaggtgtcctggatgacgtgtctgccattttcggcttgcatgtggatccaggacttcctgtaggcaccgtttcgtccaggccagggccgtttctagcagcagcaggtagatttctggtgacggtcactggaaaaggcggacatgctgcagggccacaggatgctgtggatcccattgttgcggcatcctctgccatcgtcagccttcagcttcttgttgcccgcgaaattgatcccctccaggctgcagtggtctcggtcacgttcatgaaaggaggtgatgcttacaacgtcattccagagtcagcatccttcggcgggaccttcaggagcttgacaacagaaggcttttcgtatctcatgaagaggatcaaagagatcatagaaggtcatgccgccgtccaccgctgcaccgccgccgtcgacttcatgcaggagaagctccgcccgtacccagccaccgtgaacgacgaagggatgtaccgtcacgccagagaagtggcagaggccatgcttgggcaggacaaggtgagtgtaggcgcgcagatgatgggcgccgaggatttctccttctacgcggagaagtttgcaggggcgttcttcatgatcggagtccgcaacaagagcatggaggaggcaatgcatcctctccactccccgtacttcgtgatagatgaggacgtgctgcctgtaggagctgccttccactctgcagtagcgatggagtacctgaacaaatactcaacgacccggcaaactgagctgctgcgcattgagctgtgatagattattgcttgtaataagggttaccaggccgaggtcatgttgcacaaaagaaagtctgcattgtgcccatggaataaatacagtttctccttacaaaaaaaaaaaaaaaaaaaagcccgtattgtgaaaaaaaaaaaaaaaa

SEQ ID NO: 18383 - DNA, 2357 bp, Zea mays
gcatctcaaacctctcttgcaatctataaatgatagtacaagataaagcagtgaagattatttaagtgtatattatgatgtcagaaatcagcactcatttacacatgctgggaacttactcgacatgtttctctcatcctttctattagttcaggggtcttaatctacagaggcacaaataaaacattaatcatcatactacctatgttctcgaatatttgtcgccggctagttcatttttgaactaaaacgccacaaataaaaaagaatggagggagtatatttcttcatggaacatttgtgatactcaaaaacctctgaaggattttacctctactcttttctgcaagtcactatctggttctatcttgggaattccctaagaagtattgcaatgtcaggaagattgaaagagaatattgctcgagatatcaattcaagtagtaatgacgagacaacactgcatgcgcactgtgaaggaaaagacacttaaaacaacaggaacctacatcaagcgcccaatcaggcttctcaatttcatctggcaccacacgcatctttgatatcggatatggtctcaatggactgaaagacatgatcattcaataaatatgagaaaggtactatccaaatagttcattcctcccaccctaaattattagcaaagaatacagatacattttcttcagaatttccaatttgtaaatattctattttgggtgaatggaaggaaatgttaacaccatgtttacagcatgcacaaagccacactattgctcaaatatactgaaactctcaaatgtgcaatcaatgcaaaagaaagtgttccatgcattcacagtgcataaccaagtgtccaagtaaaaaaaaacctattgactatccaaaaggcgttggttcactgcagatatatgttaggtttgctatcgatagttagctttttcatagcttgtttgctgctctaaatcttttgcatggttttggcagggttatccttagtgttccacataggttgtgtcatatcaacatttatttcaaaaggtaggaagtcaaccagctgaaatcaatacaaattcggattatttgaatttgagttgtcactaccatttttttacggtggctcatgctggatttcaggcctagcctacccaaatttgcttgggattagaaactagaaagtttggtcaacatttaataatgtccccaaaaattccagaggcaaatgaaattctacatatgttgaacaacagatcgaaaaaaggaattgtggatgtggtaacagtattttaccctgtccattcaaaacgaggaagttgcaatgcacgtccccgcccttttctcaaacaatatttccaaccttccggagactgctgggatgccagtgcaccaggctttgggtgaacagattttgcagtatgtaatctatcccccagctgaccatgcttccatcgtagctttgcctttgcagttgcagccttccttgcgtgtcttaatttgttcccttgcagcctacattattgtaatcccagatgttgctctgataatagcatgatctcctcttttgctgccactgtcaggtggtctcggtcacgttcatgaaaggaggtgatgcttacaacgtcattccagagtcagcatccttcggcgggaccttcaggagcttgacaacagaaggcttttcgtatctcatgaagaggatcaaagaggtaaccgtaccgatgaaggaagcactcatatctatttctccaccaatgtgttgtgcagtggatcagtccagatttaaaacagcatacaaaaatgatatatttatatacctctaatcgaagatcatagaaggtcatgccgccgtccaccgctgcaccgccgccgtcgacttcatgcaggagaagctccgcccgtacccagccaccgtgaacgacgaagggatgtaccgtcacgccagagaagtggcagaggccatgcttgggcaggacaaggtgagtgtaggcgcccagatgatgggcgccgaggatttctccttctacgcggagaagtttgcaggggcgttcttcatgatcggagtccgcaacaagagcatggaggaggcgatgcatcctctccactccccgtacttcgtgatagatgaggacgtgctgcctgtaggagctgccttccactctgcagtagcgatggagtacctgaacaaatactcaacgacccggcaaactgagctgctgcgcattgagctgtgatagattattgcgcttgtaataagggttacgaggccgaggtcatgttgcacaaaagaaagtttgcattgtgcccatagaataaatacagtttctccttgccaaaaaaaaaaaaaaaaacccgcggcc

SEQ ID NO: 18384 - DNA, 1331 bp, Zea mays
  misc_feature (1326)..(1326): n is a, c, g, or t
gcacgagaccattacctagggcatcctaatcgcaaaaccacatcgtcatcgtgcgtgtaggagtgtcctccagatccagagccggcgcgccgcccctgcctctcctggcctctccgccctccgagcgcgcgccgacgccgcccctagcgccgcccgtagctctagcgtcgacgccctgccgacgcccagaaagcgtcccggccttcactagctggaagtcccgagtctcgagtggaggcggatccaaagccaaagccaaagccaacaaccgccgctgggacgcgagggatcgattcggagatggcgtcaactagctccgccggggacgtgggagactcagggtcaaaaggtgcggttgcagataaaacacttactgcttctgcaaacactagtagctcacatcaagaatctcatgatgttgatgcaaaatcacgtgtggaggacatttggaagaaaatgaacagtggttttcctaataagatgcccaaacctgcaatgacaaagctcagtacaacagaaaaacaaaagaaaaataaaccaacaaataattggatgactgttctaggcctttcaccaagcaaggcacatagtgtcgatcaaggatccaaaaatgggctacaacagacacaacatgaaatgagcgaggatgctaaaaaacttgcagccaaggcccttgcagctgccaaaaatgctgctgctgtggcatctggacgagggaaagtggagatcactgaggtaagggactttgctgggaaggacatcgaaatcaagaaactggttgatgctaattcaaaggaggcaatcgagaaggccagggcaggtggtgccgccccatcagctgtcgataacatcctagagcaaatacggaagaagcagaagctgagcgtcctggacaagacgaagaaagactggggagagtacaaggaagagaaccggggcttgggggaagagctggacgcctacaagaagagctcgaaccagtaccttgacaagcaatcatttctgcagcgaaccgattaccgcgagtttgagcgcgagcgggatgcccggctgtcaatgatggccaagcggaggacagatacgcgggaggactgaaatgtttccctgtaactccgttgtagacattctttcgagataatggtagacactaaattgtcaatgccttccagccccgttaaatcttcttttttagaattataatgtgctgattgtaatttacaaagatgcaccgtgcatgtgcgtaaattgcatctggtggttttggcaaacatttctgagctgcataaaatgcagtcatgattggatatttctgaaaccgggaaactntgacg

SEQ ID NO: 18385 - DNA, 744 bp, Zea mays
ccggccgggctcgtaacttttgtgccccagttcgtttatcctctcctctctctttctctgtcttgctgcggcgacacctccgcttccgccggccgagtccggagcggagccgaagcaacaaccgccggggaggcgagggattgattcggagatggcgtcaactagctctataggcgacgtgggagcctcaggtaaaaaaaatggaaagggagatgacaagttagttggtgcgctccttgtgggatttgcgcgtccaattccaccttgagtgcagggatcttcctctctgtaatttgtaacatgtatgtgtgtgctgggtatcgcagtcctgtacggctcctgataagattactgttcgttacttgctttcccttgtacagtggctgcattaggattagataatgcatatggtcaaaccttgccattagattgttaacagcgtacctacagtttgtcctgccatggatgtgaaagtactccttttcatgcttcagctccgccgctccgggacaaagaggattgttgataggacaagtctgcagttttacctcttcagatacgatgactaatttatgcaaggcgcttaattaggatgagataacagcctgaaatgcataaacaggctcctgggtttgtgggatgcattgcaagatggttatgttggaacatgcagttcattttttgttttgtccctcgagaacatgtttgtaaggatataaataaccttttagcaaaagggaaaaa

SEQ ID NO: 18386 - DNA, 802 bp, Zea mays
  misc_feature (759)..(759): n is a, c, g, or t
tgggcctgctgggccctcccccacccatggcgttggagctcaacaaaggtgcaaccgctctccggacctggattggccttcgttggccctgggtacctcggccggcgccctccccgccgcacagcctccacagcccgaaaccctcgccgccgatcggtttcggagaagagaagcaaatcaagatgtttctcggctcgctcccgcggcgcccgagcaaggaggctgcttacaagcagctgcggtcgcacatcatcatcatggcctcctgcgccgccgtcatccgcgccaccccttacatcctccatttcctcgcccgcgacggcgacatccaggaactcaagctagatctgtaggcccgtccgttgcttccccacctccagaggtgctacaaaggcaaccgttagttcgagcccactgcaaggtactatggagttagtggctatagtgcctgcttaagtttttttgttgttccaagtttagtgacaaactgacaatggtgtagcaactggcttgtgctgcgacaagtatttcgtttttgcctatctgtatggtctagtctttgtttgcactggtggatttgcagagatgttatcattcaacaatgttctgtggtcagtcgcaaaaaaaaaaaaaacaaaaaaaaaaaacaaactctcctcgggccccgcccccctcgaccactccgacgcccacagcgcctccggcgagctccacctctccaccggcggcagcgaggggcgaggggggctaatactgtangcggaggaggaaccgagccgatggggcagcagtcgctgatcta

SEQ ID NO: 18387 - DNA, 2152 bp, Zea mays
tgtagcatccgcacagcgggattgcggtgtggggggcgggtggtagggcggttcgtggcgttcgcggatggagttgcgggtgggcggtatggcggggtgtttcgacggcgagatttccggcgtgaggcaggcgaaggcgggcgcagtgtttttggaggtcaggggcgggggcggtctacactctgcgcttaattgttagtagagatagagattgctgctgttgctgattttatcgtcgtgtcatcgtcattttcgttattttattgggtccctgatttgtgttattgttatgacgttttctagaaggccaatcgggccaattttacggcgaacgacggtaagcaaccggtcaacccgtttgggtcggaggcccattcgtctccgaaatccagagtgggacctgagcgtaaatagaacccgagcccctctccgcctccctccccgccgcacagcctccacagcccgaaaccctcgccgccgatcggtttcggagaagagaagcaaatcaagatgtttctcggctcgctcccgcggcgcccgagcaaggaggctgcttacaagcagctgcggtcgcacatcatcatcatggcctcctgcgccgccgtcatccgcgccaccccttacatcctccatttcctcgcccgcgacggcgacatccaggaactcaagctagatctgtaggcccgtccgttgcttccccacctccagaggtgctacaaaggcaaccgttagttcgagcccactgcaaggtactatggagttagtggctatagtgcctgcttaagtttctttgttgttcgcagcgattttgtgttgtattcacgatagatgagccgcggtcggtcatagctcattacatgttctggtggaatgatctgttgacttgaacttggttagattcaccgtgttttgttggattaatcaatgcggcaataggtcatcatagtttaaattctgcggttccaagaagagttgaccggctgaactgctggattcggtgttttagttcactggtgggtttcattaagttggtggtcttgttgaactgtctgttggtattgtattatttaatgtttattactcctctgcttgaattgttaaggcactcctaatgaagaaactagggtagtttttatgtgtatttattatccagtcagataagcattttgctgatgcggcaaagattttttttgaggagagaggagaaaatagagaaaccgtttctacatcaagaaacatagtcttcacgcgcatcaagggcacaaggaatgatccgttctactatgggcatggtgacatcgtttctattggccttactcaaatcatgggctcctgtgacctccctccctttctggttagattgccgctgccaaaatccccttccccactcatgctggtattgtgtccgtccatgccttttctccttgcttctggatctggtgctgccgcaactgatgcagctgatgtgccaacacagtccgctgtgcacggagtcacccttccaatgctggtcttccttgcagctcaaattgtctccatctgatcagtgaacaagctctgcctatccccagccacttaccagatcagctcctgcctgacctagctgcaccaaaattccatcggtgtcatgattccaatttctgtgcaaggatgaattgaccagcaaatgatagagtagagcaagttgaaagatcatagaagcgtactttgggtacagatgaatcactggtattctggcggccggtgctcctagatgcatgttttttccgtcgctagtggtcttaaatctaaatggtatggttccaatatgcatgctttggctaggatgtgttctgcacctctcctaagttgtgactctagtctagagtagctctgctacttgttcgatttggttactggagaaactgtttcccgttcagtttatgaacgacccacaattgttgtaaccaaatttttatggtatatttatgttttatctgcacaaaattaaagctttgcttctcccctaataatttttctttgaacaattgaacaaacatgaagctcctttgcactgaatttttcatatccacaatggtcaagtctaaactcttcctttaatattatgatctgataacatgatggctgcaggtcgtctctagaggtaacccgg

SEQ ID NO: 18388 - DNA, 861 bp, Zea mays
gccggccgggtccgaaccatttgggtcggaggcccactcggcgccgaaatccacggggggcacctgagcggtaaatagaacccgagcccctctccgcctccctccccgccgcacagcctccacagcccgaaaccctcgccgccgatcggtttcggagaagagaagcaaatcaagatgtttctcggctcgctcccgcggcgcccgagcaaggaggctgcgtacaagcagctgcggtcgcacatcatcatcatggcctcctgcgccgccgtcatccgcgccaccccttacatcctccatttcctcgcccgcgacggcgacatccaggaactcaagctcgatctgtaggcccgtccgttgcttccccacctccagaggtgctacaaaggcaaccgttagttcgaggccactgcaaggtactatggagttagtggctacagtgcctgcttaagtttttttgttgttccaagtttagtgacaaactgacaatggtgtagcaactggcttgtgctgcgaccagtatttcgtttttgcctatctgtatggtctagtctttgtttgcactggtggatttgcagagatgttatcattcaacaatgttctgtggtcagttgcaattgtccttatgctctgtgaataatgcttggactgccgactgtgtatgatttggtttcggcttgaaaaaaaaaaaaaaaaaaaaggccaaaaattcctcgcttccccgcggccgcccccaactacccccagcctcggaaggaaccttccagaagcgcaagactctaaggccgtcaccttcccattcttcctcgccgcgggggtcgcctgagatcacataaacaagggtgaaagctgttgctgggcttg

SEQ ID NO: 18389 - DNA, 996 bp, Zea mays
cattgggtacctcgaggccggccgggagccggccggccgggacaggccgagcagaggcagaggcagcgggagttcctctcatggaggcgtccttgctcgtggctcccaagccttccatgcccaggaccatcttctccgccaggcgagccggtcggagttggaggtgcctcgtcgtcgctgccaccatcaagcaacaactcggcacacggtcagaaagtgtggacgtcgatgcgccggtcgagcacctagcgccgccttcgaaggcgacgacgggagctcgcggcggcctgctcgccgccgtggcgacgacaacgagcagctgcacggcagtgttaccgtgtcacgccttatcaggcgccggagcggtggaatcgggaccgtggtggtggacgtcgccgctggacaccctgtaccgcgcggcggcggtgctgggcgacctggacccggcgacggcgcgggcggtggcgggcgtggcggggccggtgctgtcggcgttcggcttcctgttcatcctgcggatcgtcatgtcgtggtacccgaggctccccgtgacggagttcccgtacgtagtggcgtacgcgcccacggagccgttcctcgccgtcacgcgcagggtcatcccgccgctcggcggcgtcgatgtcacgcccgtcgtctggttcggcctcgtcagcttcgccagcgagatcctcgtcgggccacagggcctgctcgttctcctctcgcagcagcgctagcgaccactgcgtttctgcttccattccttcgatgaacaaattagtagtcatttttacaagggcacacttcgtgccatatccatttgattttaagatgattttaggttgtcttcagctatcgtgcccttaattatatattggtacgctattcctatatatttcgcatgcctaaattttagaagaaaataattattgtaccaccaattagtataaataatttatcattttatggcttaaaaaaaaaaaaaaaaggccccta

SEQ ID NO: 18390 - DNA, 920 bp, Zea mays
cattgcctccctcgaggccggccgggagcttctatccaacgaaccaaggccgagcagaggcagaggcagaggcagttcctctcatggaggcgtccttgctcgtggctcccaagccttccatgcccaggaccatcttctccgccaggcgagccggtcggagttggaggtgcctcgtcgtcgctgccaccatcaagcaacaactcggcacacggtcagaaagtgtggacgtcgatgcgccggtcgagcacctagcgccgccttcgaaggcgacgacgggagctcgcggcggcctgctcgccgccgtggcgacgacaacgagcagctgcacggcagtgttaccgtgtcacgccttatcaggcgccggagcggtggaatcgggaccgtggtggtggacgtcgccgctggacaccctgtaccgcgcggcggcggtgctgggcgacctggacccggcgacggcgcgggcggtggcgggcgtggcggggccggtgctgtcggcgttcggcttcctgttcatcctgcggatcgtcatgtcgtggtacccgaggctccccgtgacggagttcccgtacgtggtggcgtacgcgcccacggagccgttcctcgccgtcacgcgcagggtcatcccgccgctcggcggcgtcgatgtcacgcccgtcgtctggttcggcctcgtcagcttcgccagcgagatcctcgtcgggccacagggcctgctcgttctcctctcgcagcagcgctagcgaccactgcgtttctgcttccattccttcgatgaacaaattagtagtcatttttacaagggcacacttcgtgccatatccatttgattttaagatgattttaggttgtcttcaaaaaaaaaaaaaaaaaaaaaaaaaaaactagttctagatcgcgggcggccgccgactagtagcctc

SEQ ID NO: 18391 - DNA, 1389 bp, Zea mays
  misc_feature (18)..(18): n is a, c, g, or t
  misc_feature (29)..(30): n is a, c, g, or t
  misc_feature (33)..(33): n is a, c, g, or t
ggagatgatacaggcganattcgttgcannagnagtatggtgatatagggagagattgctgacgtagtggccgaaattccgttgcgaccctcgccaagacagtctcagtcatccacttcccctctgcaccttgaacgtcctccgcagaggcagctccccaactgttagaatggacgacacggaagccgccaagaacacggccaccaccggccccactttcgcctcccctctcttctctttctccaacctcggcggtgcttccttcggctctggctttggcttcaaatccagcgctcctctgccgcctgccatcgaggtccagctctgcgaggaatcacccgttccggcagctaggttggagccagtcgtggtcgatgactccttgacgatctacaagggcagagtgagtacatctgacgtgtttggtgtcaaagactctgatttggtccctggaaaatatgaaggtgggttgaagctgtgggaaggttcattagacttggtgaaagccctgaattctgatatcaaagaagataaatttcatctggaaggcaaacgcgtattggagcttggatgtggacatggcctccctggcatttttgcgggtctcaagggtgctgacctgattcatttccaagatttcaatgccgaggtgcttaggtgcttgactataccaaatgtaaaagtcaatcttttcaaggattcaccagaaggaacatgtacatgtccgattgttggtttctttgctggtgattggagtgaaatggataagctactactttgcggggatgctgagcaagacaaaacagccagtggtgatacagaaggtaaaatgtgtaatggttatgatatcatcctgatggctgagactgtttacgcggtatcttgtcttccaaatctctacaggctcatcaagaagtgcttgcgctaccctgggggtgtggtttacatggcagggaagaagcattactttggagtaggtggtggcacaaggcagtttctgcgcttggttgaaaaagacggtgccatgcatcctgagcggctcaatgatgttgctgatggatcatccaatgttagggaggtttggaaattctcattcaaatagattagcactgcccctgcgattgtcgggagaactggaaacatgtactggactccatattgggtgagagggaggtcttataggacttcctggttctgttaatctacctgtgactgtttcaaaaagctgatctttctcttttggagcactgctttgctcttgtagactaaaaaaaatcgcttttacctctggtttctgtttgttaaacttgtttagcctttcatatgaaacgatgaattctccatgatattatcacaaaaactctcaaattaccctcccgacgcggccgc

SEQ ID NO: 18392 - DNA, 1430 bp, Zea mays
catgatctgatggtcaaaggctaacattcgggtacatgtaaaaaagatggggagaagtgattttttttacgagtagagatttcttcgggacagatggtagataccgttgttgggcccagcaaaggttgagtttattctcctccaaaacagcgccagagattgggccgtaagacaagagcgggccacgaaaggaaaccacggcccacgggtggtaaccacgtccacgcctttccgccaaaagcaaaacccagagcgcatgcgcatccagattcctgtcttcttcaacagagagcaaccgcggccgctacctccgccacagcccacagctccctcgcactgtatctgcatgcaacaacacgctctgcagcacgtctaccccgtgaccctctcggcatctccagtgtccagagctacaacagatggccgtcagttatgtccgcggtgatgttgtgcacgaaacaccgaagcaaaagaaaaaagagaacgacgacgtcgtcgccgacccagacgccgcataaaggaaagctttctccgcacaagaaaccaaaccgtgacgcagcacagccatggggaagcagctctgcgacatgcaccgctcgcgccgccgcgcccgcatcgtcgccgccgccctcctctccgccttcgccgccgccgccgccgcgctcacggtgtacctcgtcttccgtccgctgaagccgcaggcctccgtggtgcgcgtcgccgtgtaccgcatggccacggccgccgggaactcctcggaggggcgggccccgccgccgtacacgctcgcggcgagcgcgcggttcacggcgctgctgcacaacccgagcgaccgcgccgtggtgttctacgacggcctcttcgcctacgtgacgtaccgcggggagatggtggcgccccccgcgccgctgcccggggtggcccagggccgcggcgccgacgtggcgctgtcgccgcatttcggccttcgcggcgcggtgcccgtgccggtgtcggcagacgcggcacaagcgctggagggagactgcgcggcgggccgcgtggagctacgcctcgtcgtcatgggccgggtcaagtacatgagcgggccattcaggaccggatggcgcgggctatacctgcgctgcgatgtcaccgtcggcctcggggtggacgccaccgcgggcgacgacggagccggggacgtgccactgctcgagtaccccaagtgctccgtcgacgcttgagttgatccttgatcggcgcaatgcatgagcgctcagatgatcagattttcagaattctggtggagaataaggaattgggaaaagcatttttctgtgtccacgcatgctgattcatacatttatacgagccgtttagtttttgtcgccttactgttccctaactcgtcaaattcgatacgctttataaaatttcaagaacaaaaa

SEQ ID NO: 18393 - DNA, 1734 bp, Zea mays
tcggtacccctggagttggaaaaactgaactcacaaaagcactagcagcgagttattttggatctgtgggttatgccttccttcttgcatcattctcgcgttctgaaaagacatgttgcatggatcatgtcttgaaaaagttatttattcgatttgcaggaatcagctatgattaggttagatatgagcgaatatatggagaggcatgctgtgagcaagcttataggctctcctccggggtacatgggatttggtgaaggtggaactttgactgaagcagtccggagaacaccattcactgtagtcttgcttgatgaaatagagaaagctcatccagatattttcaacattcttctccaagtatttgaagatggacacctgacagactcacaagtacttcctgacatccgccattatattttttgtgcagatcttttcagaacttagagggttatactagccaaatcatgcacctaaggggttatactaaccactcaccaagatggttgatatacttttactgttttctaccttgctaatgcctttggtgaaatgaatttgccgactctaaagatagaaatagatttatctaagttatttaacacaagcagcttgtttccgatgggccttctctctggggaccgatagcgatgctcatcattgaacttttgcattaactacagggacgcagagtttccttcaaaaatacgttgattgtcatgacatcaaatgttggttcaacatcaatctcaagcggaaggaggagtataggtttctcaacacaaagggatacagaggagaccacctatgctgcgatgaaatcacttgtgatggaagagctgaaggcattttttcggcctgaattgctcaatagattggatgaagtggttgtattccaccctcttgaaaagacccaggtctgtggttacttttactgttctgttctgtcgttattatgtggttttgaatatcgtatcactcattcatgaaagataggagcaaaaaatgttagcttgatacaatccacttgcacctagaataaatgtgcagttgtgcactatttttttccatatgtagttcaaacgagacatttgtactcccgacattttgcagatgatggctattctcaacctaattctacaagaagtcaagagtagacttctagcccttgggattggcctagaggtatcagaatcaatgaagatcctgatttctcagcaagggtatgacagaagctatggggcacggccacttcgaagagccgttactcagctggttgaggatgttatcagtgaagcaattctctttggacagttcaagcctggtgacacgatattgatgggcactgatgccacagggaagccttgcttgagccgactcaatgatcagaccgtccaattgtccgacactgctccaacaatatgaacatcccagcaccctgtgtatatagttgcagattacacatttattctgtacatagaatccccatctcagcgtggacataatcttccagatgttggtttgtctccacaacattataatgtaaatcttatccttaaatccaattgtacatatttttattattaatgttagaccgtgttgcgtgtataggcctgaggtctagttcatgtgtagtgtatatattgtactctttttaatatttagctattctcatttatcatggtatgagactagctccaataaagatctctaaagagtcttgtcccctgtatt

SEQ ID NO: 18394 - DNA, 1583 bp, Zea mays
cctcgaggccggccgggcatttaaaaggaagaaggaagaacatgctccattctctccaagtcaccagacgaatattggcaagagattagagctgttcagagtacacatgaagtggcactggctaacaggttgaagtattctcttgatgagaatgacaaagatgatggtgttaatattgaagtcataggggacaacaagattgcttcgccatcgatgcctccaacttcagtcgatgaacctattctggttggttcagaggaaattgcaagagttacatcattgtggtcagggataccagtccagaagttgactgcagatgaaacaaaacttctagttggactagatgatgaacttagaaagcgtgtcataggtcaagacgatgctgttgtggccatatctagagctgtgaagcgatctcgtgttggcctgaatgatcctgacagacctattgcaacactactattctgtggtccaactggagttggaaaaactgaactcacaaaagcactagcagcgagttattttggatctgaatcagctatgattaggttagatatgagcgaatatatggagaggcatgctgtgagcaagcttataggctctcctccggggtacatgggatttggtgaaggtggaactttgactgaagcagtccggagaacaccattcactgtagtcttgcttgatgaaatagagaaagctcatccagatattttcaacattcttctccaagtatttgaagatggacacctgacagactcacaaggacgcagagtttccttcaaaaatacgttgattgtcatgacatcaaatgttggttcaacatcaatctcaagcggaaggaggagtataggtttctcaacacaaagggatacagaggagaccacctatgctgcgatgaaatcacttgtgatggaagagctgaaggcattttttcggcctgaattgctcaatagattggatgaagtggttgtattccaccctcttgaaaagacccagatgatggctattctcaacctaattctacaagaagtcaagagtagacttctagcccttgggattggcctagaggtatcagaatcaatgaagatcctgatttctcagcaagggtatgacaaaagctatggggcacggccacttcgaagagccgttactcagctggttgaggatgttatcagtgaagcaattctctttggacagttcaagcctggtgacacgatattgatgggcactgatgccacagggaagccttgcttgagccgactcaatgatcagaccgtccaattgtccgacactgctccaacaatatgaacatcccagcaccctgtgtatatagttgcagattacacatttattctgtacatagaatccccatctcagcgtggacataatctcccagatgttggtttgtctccacaacattataatgtaaatcttatccttaaatccaattgtacatatttttattattaatgttagaccgtgttgcgtctataggcctgaggtctagttcatgtgtagtgtatatattgtactctttttaatatttagctattttcattttcaaaaaaaaaaaaaaaaaa

SEQ ID NO: 18395 - DNA, 1203 bp, Zea mays
  misc_feature (13)..(13): n is a, c, g, or t
  misc_feature (16)..(16): n is a, c, g, or t
gggtacccctcgnggnccggccgggagaaggtcgtgggttccccgattagccaatcgaataccgttgcagctgcaggttctcgccgactccccttctccttcgacctccgccgctcgccgccgtttcccgtccgcggcggcgcctcctcccctcccactcctactcgttgtcgatctcgtctcgggtaccatggcaagatcactctccaccgccctcgtgaggggacttatgagatcgtcccgtgcatcgacatcagctgctgtgtcacgaccagctatccagcagtttatgaactattcatcaggtcttagtggcactcctaatgcaaatggggactcagtgacaacacgagtagctgctgatcacgacacccatcaagattttcagccaacaagtaaaagttcagatatgtctttcagtgacattgttgctcaggatgtgaaggagcaccctgttgtcatctatatgaagggttatcctgatgctcctaggtgtggtttcagtgcattagcagtgaaggtcctccagcaatatggtgtccccatcagtgctagagatattctttcagatctaaagctcaaagagagtgttaaagcatacagtaactggcctacgtttccacaaatatttatcaaaggagagttcgttgggggatctgatatcatactcaccatgcaccagaagggtgaactgaaggaactgcttggcgatattgcacaaaaagccgaacaaagtggttcttcatgaaacaagcatcagtatttgtgatgcaaacttcccggactggatgttccttctcagaagattttaggtgatcttgcattgttgccctgtggcttcggatttgaatacgttctctgttttgttctgttctgttcttgccagttgtgatggaagatccactcaaggccgaattgcaggagtaaccaaagttctagttctcgataaataaatgccaatgctcgacactattcttttatgcatctagctgcctgccttagcttaagcttgggtgctttaagttgcttttaaactgaacggtgctgttgaaacatgtaattagtatgtgacatgcttatacgctctatgttttgttcttttttgacatcaactctgtttgcagttctactcaaatagatgtactgctttgttccaccaaaaaaaaaaaaaaaaaaaaaaactagagggggggcccggtaccc

SEQ ID NO: 18396 - DNA, 3589 bp, Zea mays
gtcaagttaaatagctagtctgttgaagacctattttgctattaaatagataaaatttagcttgataaactatttagctagtatctggatctggatatgctagtattcctactctagtaaacaataaggataaaaataatgataaggtaatgacgtcgcggctaccgggagccgtccgatcgacgtttaagcggctcagattgttgggtggttaagcacgactccttggcgtacggtacggacgaggccccctccccattctatctcattcccaattcctcatctgcttcgcttccccccaaatcgaatcctcatcgctccgtctatggcgactctaaccatgcagccgatcggtcccacccctgctccggctgcgcagcaagacccaaggcgagtgctcttcttgctgtttccctttgctagatttggcaaccaagctgggttttgttcgagtgcatcgttttatttttgtgattttctggtgtcgatcgatgcagcaagggagagaatcctcctaccgtggatggtaccgatctgggtgacatcgactcggggtaattgcttcctctcgccttctaatgtccgtttactttaaaacacctagctgggtagcgcatggtttgttcatgtgcttgtgctgctgcgcagctgggttatcctcaagaactcggatgtcgtttccgcggatttggcagccgccgccgtctgtggcggtcagcgtctaggctcttctacgattcctagctggtacggattttatacatacatcaacaacaagcgtgccgcttttggtgtgaactgaaccgcaaccaacgctcttctttttttttcccctcccagggcacggtgggttctcggaggtgtggtttacacgctcgtgccgttctacaacagagttaggcatctcgaaggtacacaacaagaacttattactgtttctttccatggtcaactgtgaagaaataacattctagttcacaatatgacttgaatatactcatatcatcaagtgatgagtttggagattcttattgctatggccagacgagacggtgggattcgtggagaatgctgtggaggttgtggagcatttagctgaagtaacagagaagctagctgcgaatgtggctaagcaacttcctgaagatgggtctctgcagaaagcagtggaagaggttgaacacattgctgaggtagtggatgatgatgcggagaaggttgaagcagtcactgaaaaggtttgcttttcttctcttatattcttcttgtttgatatcgtgtcattgcaaatcgtgaattgagcacaagaaaatattgtgcttgctttctgagaatctgatgtatgccaagctgctagctggtatctgtatgcacatatattttttgtctattcaactcctgaaacaaaaaaagagagaccattttagtcatttcttttggagagcaaaactagttacctatcttctgttgcacttgggagtctacggcactgggacaatgtgtattgacaactggtcttggtagtttcttttggagaccatataacactctctaccaatgtaaaagacttgctttgaaggggaggttagtttagttgtttcttgtgaggaactgagatcagtaatcatttgcaggtagtgttctgcacagaaatgttgtacaacacttgaaattgcttgcttggtgctgcatgagtgtcacttcagacatatttttttgacaccataagttgatggcaacttctgtaaggaatcggagaaaaacataggtctgcaaaccgcaaggcatgcgtcggattttgttaagaaaacttcatatgatgatgttttctgcatcatttggaagtagcataaaccgagcttgaaacatttcactcctgacgttgggtctctgcagaaagcagtggaagaggttgaacacattgctgaggtagtggatgatgatgcggagaaggttgaagcagtcactgaaaagatcgacaaggtcagtgatgagattgatgctgctgtggagccggtcatcgcggagcttgaaaaggaactcgatcagagcacaacctcagacgatggagttgacacaaagaattgatcaactgcatgttaggtgtgctcttcattgtacatagcgtgtgtactgttgtttttcttctctctctcctctttggagaaactgcttgtacatatgtatgtatggaccatgaagattattggtactgtatcaagtcactatccataaataaatacacgttggcctgtgaaaaaaaatatactagctcgcagagctgtgaattattgattcgcattcgtttctatgtaaattgttgccctcccgttttgtctttttgtatcacaaaaacaattgtcacccaaacgttcggcaacacgggcagacacttggcgaggtcgatggccgtggagctagctgcctgggaatgggataggatattttcccgtggcgggataaagcccaacgagcccgcgttacggatatcttcgccatccgttgcctcgcgagctcgccgccatggcattggctctccccctcgcccgcctcgtccccgcctgccagtgccagccttggccccacctgcgctttcggaagcgccacgtctccttcgccgctcacgccagttctcgcgccgccttcgctgcctgcgcggcggcccctgccctccaggtccaggcgccggaggcggaggcggaggcggagacggtcgagcaagtgggcccgaagacacgcctcgtcgcgcagaacatcccgtgggactgcacggccgacgaaatgcgcgcgctcttcgagagccacggctccgtcgtcggcgtcgaggtaagcgtctgcttcccttcccttagtaacggactaactgcaatcctgttagacagtggatgctaacaaaattattggctgccatccagaatgaagagctaatgtagtttaatataatgatgcaaaccagaattctgctactatctgggaatattattgtctggttgctgcaaactccattgtattgtgtgtagagagattaattactagtaaagtgctcttccctttgctagctatatattttttaaagaacaacaacatatgggctaatcttatatggttacctagtttgtatttgggtcctgtgaatctgtgctcagtagtgtgcagggtaggtgttgatcaaagattgaactcaacaacaaggaatctgaattatgctgcgaatatgtctgaaatcactttgttcagcatgctgaaactcaggccctcctgttcagaggagaatgctttgtgttaattagatagatagattgcgatgccacgtgtttccacctttcgcttaggataataacttttttcatggttatccaattcatgatgggggtatctatctgtttttcttttgtctagaattatgtacagaagaaaatagtgacagcattagtgattatttttttgttccttgatttcctagctttcaatgtacagcgccaataaaaacagagggttggcgtttgtaaccatgggttcagaagaggaggctcttgcagctctcacccatctcaattcaactataagttacttttaattgaacaaagcg

SEQ ID NO: 18397 - DNA, 953 bp, Zea mays
  misc_feature (949)..(951): n is a, c, g, or t
  misc_feature (953)..(953): n is a, c, g, or t
acgactccttggcccacgcggtgcgcgaggccccctcccgattctatctcattcccaattcctcatctgcttcgcttccccccaaatcgaatcctcatcgctccgtctatggcgactctaaccatgcagccgatcggtcccacccctgctccggctgcgcagcaagacccaagcaagggagagaatcctcctaccgtggatggtaccgatctgggtgacatcgactcgggctgggttatcctcaagaactcggatgtcgtttccgcggatttggcagccgccgccgtctgtggcggtcagcgtctaggctcttctacgattcctagctgggcacggtgggttctcggaggtgtggtttacacgctcgtgccgttctacaacagagttaggcatctcgaagacgagacggtgggattcgtggagaatgctgtggaggttgtggagcatttagctgaagtaacagagaagctagctgcgaatgtggctaagcaacttcctgaagatgggtctctgcagaaagcagtggaagaggttgaacacattgctgaggtagtggatgatgatgcggagaaggttgaagcagtcactgaaaagatcgacaaggtcagtgatgagattgatgctgctgtggagccggtcatcgcggagcttgaaaaggaactcgatcagagcacaacctcagacgatggagttgacacaaagaattgatcaactgcatgttaggtgtgctcttcattgtacatagcgtgtgtactgttgtttttcttctctctctcctctttggagaaactgcttgtacatatgtatgtatggaccatgaagattattggtactgtatcaagtcactatccataaataaatacacgttggcctgtgaaaaaaaatatactagctcgcagagctgtgaattaaaaaaaaaaaaaaaaaatgaggcaaaaaaaaaaaaaannnan

SEQ ID NO: 18398 - DNA, 1004 bp, Zea mays
tgtcggccagctcccagacaagtccaagaacccaggggaaccctatcctatagcagttgaagtccaatagtataggtctccgggtagtggtcggcctcgccagcgagctgagcaacgtgaagaagccgtcggccatggtctcgtacgtgctcagcagctacgtcgccaaactcgcgggagggatagagaaggtgaccgaggcgcgccggcccaaccggccgctcaagtcgcgggacgacgcgtggcagttccacgacaggatgcagaggttcctgaagaaggcggacgacgagatcatccgggtgcagtgccaggagagcgtggcgctgtcgctggtgaaggagatcaccgagtacttccacggcgactccgccaaggaggaggcgcaccctttccggatcttcatggtcgtgagggacttcctggcggtgctggaccaggtctgcaaggaggtgggcaggatcaacgagcgcaccatcgccagctccgcgcgccacttcccggtgcccgtgaacccgatgatgccgcagctgttcccgcggctgcacgcgttgagagccgggttctccgacgacgagagctcagccgcttcggtgtcgtcgccatgaccgatcgatcgctggtagtcgttgttagtctgccaacatgattttttgttcgcgcggaccgtcggtggtagaagaacaccgcgccaggcggtagagggggattcgagtggtagcgggctgtccctttttttttcccttcttcttcttcttcttctcaccttttgtacctgtagattatatagaatgtacaatgttttttttttgttgttgttgcaaatatttatttttatatataagaagggatacaaatctagatcagaagaggaaataagcagttcgtatgtgaatgtatgcagcttttcagtctgtacatccatccatctcatagaatgacagaagagtgaagctaacaattcctcaaaaaataaaaaataaaaaacagaagaaattctgcag

SEQ ID NO: 18399 - DNA, 1987 bp, Zea mays
ccggccgggaaacccgttcgcccagcaccgtccctaccgacgagcacacacccgccacggccacctccggctgcagtggccgccgccaccacctcctccgccaccgccgccgccggtgggctactgggagagccgtgtccgcaagcccgacacgtccaaagaaacccgttcgccggcactgtcgccgccaagcttcaggagcgtccctgcgcccaccgacgcgttcccaagccggcggcccctcggcgccggccggggcgacaagtccgaggacacgacgccacggccgaagctgaagccgctgcactgggacaaggtccgggccagctccgaccgcgtcatggtgtgggatcagctcaagtccagctcattccaggtgaacgaggagatgatcgagacgctgttcatttgcaatccagccaatgcgccggccaaggaggcgactaggaggcccgtgctgccgacgcccaaggccgagaacaaggtgctagatccgaagaaggcgcagaacattgccatcttgctgcgcgcgctgaatgttaccaaggaagaggtcagcgacgcgctctgtgaaggtaacacggagaactttggagcggatttactggagaccttgctgaagatggctcccaccaaggaagaggagattaaactgagagaattcaaagaggagtcttctccagttaagcttaacccagctgagaagttcctcaaggcagtgctcgatgtgccttttgccttcaagagagtggatgcgatgctttacatagcgaacttcgatgcagaggtcaattacctcaagaagtcgttcgagacccttgaggctgcttgtgatgagctgagaagcagcaggctatttcttaagctactggaagcggttctgaagaccggcaacaggatgaatgttggcacaaaccgtggggacgcacacgcgttcaagctcgacactctgctcaagctggtggatgtcaaaggcaccgatgggcacacgacccttctgcacttcgtggtacaggagatgatccggacggagggcgcccgtgtgtccgccagcacccagacaactccaagaacccaggcgaaccctctacgagaggagctggagtgcaagaggctaggtctccgggtagtgggcggcctcgccggcgagctgggcaacgtgaagaaggcggcggccatggactcggacgtgctcagcagctacgtcgccaaactcgcgggagggatagagaaaggtgaccgagggtgctgcggctgaacgaggagctcaaggcgcgggacgacgcgtggcagttccacgacaggatgcagaggttcctgaagaaggcggacgacgagatcatccgggtgcagtgccaggagagcgtggcgctgtcgctggtgaaggagatcaccgagtacttccacggcgactccgccaaggaggaggcgcaccctttccggatcttcatggtcgtgagggacttcctggcggtgctggagcaggtctgcaaggaggtgggcaggatcaacgagcgcaccatcgccagctccgcgcgccacttcccggtgcccgtgaacccgatgatgccgcagctgttcccgcggctgcacgcgctgagagccgggttctccgacgacgagagctcagccgcttcggtgtcgtcgccatgaccgatcgatcgctggtagttgttgttgttagtctgccaacatgattttttgttcgcgcggaccgtcggtggtagaagaacaccgcgccaggcgcgcggcagagggggattcgagtggtagcgggctgtcccttttttttcttcttcttcttctcaccttttgtaccctgtagattatatagaatgtacaatgttttttgttgttgttgttgcaaatatttatttttatatataagaagggataccaatctagatcagaagaggaaattagcagttcgtatatgaatgtatgcagcttttcagtctgtacatccatccatcttatataacgacag

SEQ ID NO: 18400 - DNA, 967 bp, Zea mays
  misc_feature (936)..(936): n is a, c, g, or t
  misc_feature (941)..(941): n is a, c, g, or t
aaacagttaccacgcctttcgctttttcttttgcccgccggccccccgtcccctctgagcgagagagagagagtgcgtgcgaatgcggagttactcggggactggtacgagcggagcaggggtgggcggtgggggaagcgagtggaagattgggagccaagagcacggagagtgccccgggatcttcacctcccatcattcgagtgtggagtttgtcctacttccgggagttgcttcgcttggtggcgcccagaattagtctggaagcagggtggagtgctgtctgcgcagaaatctgctcaccgggtgccaggaaacaggtggctgtagagaattgcttggggattcgtcaagaaacgacccagtaggtggttgtgcacttgttatgctgagactgaatggaggctgtagacaagattgctgagcccaaagacccttttgtgctcactgcccagaaggttcagagctcggagccaccgatacctataaaggcgtcatgtgaagggaatgactcccaacagcaagaagagacggatttgccagatgatggcgaagagagcttccggagcatggattcctctgatgaaggtgtccggagctccttctctggggctagtcaccctccagagcctattgacatggatatcatgaagacagtctatgttgcaatcgacgagaagtccgagccaccggttagtttagtgcgaggagtctcggtgaaggggcctttcatagatgacctctcgatccgtgttacaggcgcaaaggcaaatctggtggtaggtgcaggcggtgctgagggtatggctgaagagaggaaggtatctgcttctgcagtggcatcagtcaccacagcaaggtcgtctcaggctacctctttgcctcaggactcggaggagaaggagtgcgtctgggacgcttcgctccctcgagtgncatgntagcccttatagtagtattgacagca

SEQ ID NO: 18401 - DNA, 2668 bp, Zea mays
gcacgagaccattacctagaacatcctaatcgaaaaacgagaggagagagagagagagagagagtgcgtgcgaatgcggagttactcggggactggtacgagcggagcaggggtgggcggtgggggaagcgagtggaagattgggagccaagagcacggagagtgccccgggatcttcacctcccatcattcgagggtggagtgctgtctgcgcagaaatctgctcaccgggtgccaggaaacaggtagctgtagagaattgcttggggattcgtcaagaaacgacccagtaggtggttgtgcacttgttatgctgagactgaatggaggctgtagacaagattgctgagcccaaagacccttttgtgctcactgcccagaaggttcagagctcggagccaccgatacctataaaggcgtcatgtgaagggaatgactcccaacagcaagaagagacggatttgccagatgatggcgaagagagcttccggagcatggattcctctgatgaaggtgtccggagctccttctctggggctagtcaccctccagagcctattgacatggatatcatgaagacagtctatgttgcaatcgacgagaagtccgagccaccggttagtttagtgcgaggagtctcggtgaaggggcctttcatagatgacctctcgatccgtgttacaggcgcaaaggcaaatctggtggtaggtgcaggcggtgctgaaggtatggctgaagagaggaaggtatctgcttctgcagtggcatcagtcaccacagcaaggtcgtctcaggctacctctttgcctcaggactcggaggagaaggagtgcgtctgggacgcttcactccctccgagtggcaatgttagccctcacagtagtattgacagcatgggtgtggtcactgctatgagcaccctcaacagctgcacgagcacatataaaagcgagaccatagctggtgaagcaatgctcaatgtggagaggaactgtgagagtgtaaagggtgttcgaggtgacttactagaaagtgcaaaaaccagcatgagtcgagcaagtgatagcagtgttgttagtgatgacagcagctggagccacatcactggaggtgccagcaagcctcacaaggggaatgatcctagatggaaggcaattcatgctgtacgaactcgtgatagcgtgcttggaatgagccattttagactactaaagcgtcttggttgtggtgacattggcagtgtttacctctcagaattaagtggaactcggtgctactttgcaatgaaggtaatggacaaggcatccttggcaagtaggaaaaagttaaatagggctcaaactgaaagggagattctacagcttcttgaccacccattcctcccaacgttgtatacacattttgaaaccgacaggttctcttgtttggtgatggaattctgtccaggtggtgatctgcatactttgcgacagagacaaccaggaaagcatttctctgagtatgctgcaaggttttatgccgcagaagtacttctagctctggagtatctacacatgttgggagtggtctatagagatctgaagcctgaaaatgttcttgtgcgcgatgatgggcacataatgctttcagactttgacctctcgctgagatgtgcagtctcacctacactcatcagaacatcagctttcgattctgatcccagaagagcaggtggttctttctgtgtacagcctgcttgcatagaacctacttcagcttgtatccagcctgcgtgcttcctccccaaattcttcggacagaagagcaagaagaagactcgaaaggcaaggtctgagttgggacataacgccggcaccctgcccgagcttgttgccgagccaacatcagctcggtcgatgtcatttgtcgggacccatgaatacttggcccctgaaatcatcaaaggcgaagggcacggaagcgctgtcgactggtggaccttcggcatcttcctgcatgagctgctgtacggcaagaccccgttcaaggggtcagggaaccgcgccaccctgttcaacgtggtaggccagcaactgaaatttccggagtcgccgtccacaagctactcgagcagagacctcatccgtgggctcttggtcaaggagccgcagagccgcctgggcgtgaagcggggagcgacagagataaagcagcatgccttcttcgagggtgtgaactgggctctcatccggtgcagcactcctcccgaggtcccgaggcctgttgaggccgagctgcctgtgaagtatggggtggcggaggcgatcgggagcaacagcaagcgggtagtcggagcagacgtgaagtcggccggaaaatacctggactttgagttcttttaagagcagtgcgtgcccagtggcagctattgtttgcgtactgtccgtgtatggtcggttttgatgtttgtgtgattcgatatggtgatttgtgcctcgccgtcgatgcacaattgtcaggtttgaatcgaccaaaattaggtaggtgtgtgttgccatttgcctgctttggcacatttcgagtttatgtatggaactatgtatagagtatgcattgcaatttgcagcaaacctgaaaagcagctaagaaggccctttcctcctaaaaaaaaaaaaaaaaaaactcgtgc

SEQ ID NO: 18402 - DNA, 1894 bp, Zea mays
  misc_feature (15)..(15): n is a, c, g, or t
  misc_feature (21)..(21): n is a, c, g, or t
  misc_feature (30)..(30): n is a, c, g, or t
  misc_feature (35)..(35): n is a, c, g, or t
ggagctccccgcggngggggncgctttttnctaanggatcccccgggctgaggggttacagagagagctcactatccccccccccccccccccagtctcggtgaaggggcctttcatagatgacctctcgatccgtgttacaggcgcaaaggcaaatctggtggtaggtgcaggcggtgctgaaggtatggctgaagagaggaaggtatctgcttctgcagtggcatcagtcaccacagcaaggtcgtctcaggctacctctttgcctcaggactcggaggagaaggagtgcgtctgggacgcttcgctccctccgagtggcaatgttagccctcatagtagtattgacagcatgggtgtggtcactgctatgagcaccctcaacagctgcacgagcacatataaaagcgagaccatagctggtgaagcaatgctcaatgttgagaggaactgtgagagtgtaaagggtgttcgaggcgacttactagaaagtgcaaaaactagcatgagtcgagcaagtgatagcagtgttgttagtgatgacagcagctggagccacatcactggaggtgccagcaagcctcacaaggggaatgatcctagatggaaggcaattcatgctgtacgaactcgtgatagcgtgcttggaatgagccattttagactactaaagcgtcttggttgtggtgatattggcagtgtttacctctcagaattaagtggaactcggtgctactttgcaatgaaggtaatggacaaggcatccttggcaagtaggaaaaagttaaatagggctcaaactgaaagggagattctacagcttcttgaccacccattcctcccaacgttgtatacacattttgaaaccgacaggttctcttgtttggtgatggaattctgtccaggtggtgatctgcatactttgcgacagagacaaccaggaaagcatttctctgagtatgctgcaaggtaatctatattgaacactattatacttcataggatgcaacttgtttggcacattcactgttgtttcagaggtaacagcagccttcttcggaggtgtgctcgaagatatgatcgtttccagtacatctagcacattggccattctctttctcttcggagttgcggctggcactttttcattttttgctgccccaataattgctgtaggactcaaaacttctgatgttttggagccctcagttgcttcttttacctcttcaattttttctgtggacggcgcttcggctttctcttttgtttctgacaacaaaatgtttgattgttctgattctatctttggtggcacttcggcagtttctgcgatctctggcaacaaggctggctcgattggtttttcagcttcggtggctgaagaagttttcccggtaaactccggcaccgaagctggttcaatataacgcggctgatgcgtaagaacctttatctttttccttttcggttctggttcgctaggagcagctgcgactacacactagggtaggcgcttgtgaacccagcacacggacacagcacttgcacagtgtagccttgtagtgtaggccgtatctatattattaattctcaagaaatgctctagaaaaaaaaaaacacagtaatcatggccggttcattatatatcacatgttcacgtgtgtgggctagacgggcaacagccaacatgagagacgataagatctactacagtaacaagctggaagcaggcaagcttgcacgaatccacgagaccgcgcgccacccaggaggccaggacggacgggatccgtcgagggccgggctgtgctgcggactagacatgaacgcgcgcccatgcatgcacaaactgtgcacacgcatgcctgatgcatagcggcgtcgcacatcgcag

SEQ ID NO: 18403 - DNA, 2080 bp, Zea mays
  misc_feature (1807)..(1807): n is a, c, g, or t
cgctggaagaaaccaaaaaataacagaactcggatcaaattggaacactacgcaatcaaaccaaaccaggaatcgaaccggcgggacacacgactgggagaacagcgcgaagaagtggttggctagcgtgaacagcggctggaacttggtgctggaggcggtgccagcagggtacgaagcgagctcctctaaatgggggctgctctgacctgagaaagcctgttgtctgaaaaaacatagtggatgtctgtttcttcgagaaaagcataacgagacgattcacattttttttttttttttgtaatacccatcttttttttttttttgatctgatttacacgggtgattttattgctatggcggtaactttgcatatttgatttgatttacacaggtgggtactgcttgcttcgtcgttcttttttatttgtcaaatttttgaaatgaactatcaaatgacaaatatttgagaacggaagcaagtactccgtaataaataaataaataaataaaaagaagcgccaccgcttgcgctttgcttgttgcagcaacaagaagcagacagatgcagcagcaaaaactaaaaagggagtggttggttggtgcgtgcaagctacgttacgctaacccaattcaattcatgctgcgcagctgcagctgagcaccatgtttcgtggcggatctggggctggggccggagccggagcggcgccgcttgtcggtggtggtggtggtcggcggcggacaggggcggaagaggcgctccagctcgtcgaggcggatgctgataacagggacggggcccgcctcagcaagctgctgatccgccgcttggaagaggcgcttcctgcacatgggcggcggcggcggcggcttccggggcgcgggcgggcacgtggtgggctccctcaggtagcagatcccgctgcccgtcggcgtcctgcagcagtagtcgtcgccggcgaacacgagcggctgcgtggcgcaggacggcgagaaggccggcgcttccgcgggcctgtacaactccggggacgccgacatgctgtaatcctaatcctgatcctggtgggttcaaattcaatcgatcgacagtagtggctgtgtatagggcaggtgaggctagagggggagagctgagcagaagagcgaggtgctgatggtggtatgtataccaaccaagcactaaggaggtaggcgtggaccgtggggtgggggagaagacgaggacgaagacgaagaccaagacgcgtgccgcgtgcgatggaaggaagggaagggaacccggccggccgcgcgctgcgctgattttaatatagctagcgctttggaccccaactcctgctgtcggaaggaaccaccattaccgaaaggtactttccttcttcttcttcttctttttttcttggaaaagagcaataattgacgccgccgacaaaattaggggcagctgatcgaattctcctcctccttccaccactccactctgcatctcctggtcccggttcccggaagggtcagccagcgacggaacgaagcctcctatggacagagacgtgtgtgacgcgttcggcggcacacccgactctctgacttttcatcgcatccgcgtcggtccttcttatcctcacatccttttacgtctgtggtctccaatttcagacgtaacagttagattccaatgcagatgtataaatagatataccatctggttggccttgactgatatcgttgcactctatgctctcgtgaagacctattaatgatagagaaacacattctattcacttccatcttttagctcatnatttacatgagattagagagatactaccgcatcacatatggttattgtatcttatgtcactagttgaacgacttgagttggttatacttttgttattcttggcgtttgtcgccatcttttttcgctttttgaccttttttgttgttgccttttgacctttttacgaagattttttataaatacattatttctggtttaaatttaagaaattgatccttacttcggcgccatcattattcacgccgagattacacgactcggtgttaatataga

SEQ ID NO: 18404 - DNA, 1498 bp, Zea mays
cggtccctccctcgaggccgggccgggacttccaaactgcaacgaaaacccacgtctaaaacaggtggcccaccaacgattcacttccccgatcccagggggcggcgatcggaattcgcaacttctcccacgcggcgaacacggcagagatgatgagctcccgggccggatccatcctcctccgccacgccggctcccgtctcttcaccgcagcggcgatctctccggcggcggcctcgaggccactgctcgccggcggcaatggtgttccggcagtcatgctacggcttatgtccacgtcctcccccgccgctcccacggaggcgaaggacgaggcagccaaggcctccaaggtgggaggagacaagaaggcggtggtgatcaacagctactgggggatcgagcaaaacaacaagctagcgcgggacgacggcaccgagtggaagtggacttgctttaggccatgggagacgtacacggcggacacgtccattgacctcaccagacaccatgagcccaagacgctgatggataaggtcgcatactggaccgtcaagtcgctgcgcttccccacggacatcttcttccagaggcggtatggctgccgggcgatgatgctggaaaccgtggctgcggtgcctgggatggtgggcggcatgctgctccacctgcgctcactccgccgcttcgagcagagcggcggctggatccgcgctttgctggaggaggccgagaacgagcgcatgcacctcatgaccttcatggaggtggcgaagccgaggtggtacgagcgcgcgctcgttatcaccgtccagggcgtcttcttcaacgcatacttcctcggctacctcttgtccccgaagttcgcgcaccgcgtcgtcggctacctggaggaggaggccatccactcgtacaccgagtacctcaaggatctggaggccggcaagatcgagaacgtccccgccccggccatcgccatcgactactggcgcctccccgctaacgccacgctcaaggacgtagtcaccgtcgtccgcgccgacgaggctcaccaccgcgacgtcaaccactttgcatcggacatccattgccagggaatgcagctgaagcagtcccctgcgccgatcggataccactgaggatgtttgtgctcttcttaattttgcatcgctaataagcaattgtctttaagggaaggaaaggatgcttattgagttacgagtactgctacggcgattaggatattttccaaccagttgtttgagagtgaaacctattatatgtacgcatgttacatgtacatatctctaagtgcgagaggtgcttttctggcgtttatcacttcttcctggagttcctttgttcttcatgtcagctgaattgggctcgctaatatcgaatgtacaatttttgcataaaaaaaaaaaaaaaagtagaaaaaaaaaaaaaaaaaaaaaaaaaaaaaaaaaaaaaaaaaaaaaaaaaaaaaaaaaaaaaa

SEQ ID NO: 18405 - DNA, 4656 bp, Zea mays
  misc_feature (4445)..(4446): n is a, c, g, or t
gctgtgagctgttaaaaagctaaaaaccgtttggtcgaaatcactaaaaatcgttaaaagttattcgatatacgttttcacagttcaatctaaaagtcactaaaagcaggtccaagggtactttcatttttgcactacgagaaagtcggcttttagaaaaaactgcttccttgattcagctctttggtttggcttttgacttttagaggacaaaagtcaaagtcaaaagtcaaaccaaacacacccttacgcatgcagccaccggggcccctcttgccctgccctgcagctgtgggtgcagggtttggctttgcgtgcacatgcaagtaaacaagagttgtttttttttttgtcaatacatctagtgagtttggatgatcaagcgatgcgcagccaaccaatcacaccgatagatataactttttccttagtttcaagggtagttgttcacatttgagtcagcgacggtcctaacattttagggacccagaataaggttttaaatagagactcttcaaattatttttaatatataaatgttactaattaaacgctcaaaatacatctaaaaatatttatatcaaataatacataaataaaaaatatatattatagtattactttgaaattttcttctaacatatttagatattcattactttgttgatgagctattggatcacatgactagaattggaccttatgaattcgaggaccgaggcgaccgcccctctaccccaccctcacggccaccactgatttaagtgtaaaaaatacactctattgcttagataggtgttaactcgcctaacgaaaaaaaagaaagcatctaaataggactatgagtatagagagtagttgcctcgtttgactgacagcctggtcttggactcttggtggaagctggatcgctagtctttcttggtctacaagacaaacaacaaatgaggcaaatggatatgaaggatccttttgctttgatttctttgtagtccgcgtagagtagtacgtatactcgtactaccatgcatgtgtgtttgtactcccgcatagagtagcagtctagcacggctatttcgtactaccatggatatgatccacgtgggggtgtgaacggaatatttcaactcaaacgttacaagtattctaatcaggtgcttgtacgtgtcatttttatttatgtttgagcagtataaaacataaagattggtgtgttttgttggctaagtaggtgtaattaaagtcaacaactatggttcaaatcttatttatgtgtaattttaggttttttataatatgaatggaagagaacaggtgacacacaataatagtgaaaattgattcttttttatagtagagtataatttaattaaacatattagtcagttttattcatgcatgtatctagtgggaaagtgaaaatagaaaaacaaaattgcaagatttccatgtctcagtgagacatctgatgcgtgtaccaatttcgcatcacaagtagatacagattttagcgtgcaaaacgttacacgtgagaaccctaatgacacaggctgcttccaaccataagaaaaaaatcacggggtaattaaaaccattcgacttggagaagaagaaaggacctcctgggtttctggaagcccggggaagcaaggctccttccccgtcactgacggggcggatccaccagtcctgtataaaagtccttccccaaaacatccaggccccgccgccacttccaaactgcaacgaaaacccacgtctaaaacaggtggcccaccaacgattcacttccccgatcccagggggcggcgatcggaattcgcaacttctcccacgcggcgaacacggcagagatgatgagctcccgggccggatccatcctcctccgccacgccggctcccgtctcttcaccgcagcggcgatctctccggcggcggcctcgaggccactgctcgccggcggcaatggtgttccggcagtcatgctacggcttatgtccacgtcctcccccgccgctcccacggaggcgaaggacgaggcagccaaggcctccaaggtgggaggagacaagaaggcgggggtgatcaacagctactgggggatcgagcaaaacaacaagctagcgcgggacgaccgcaccgagtggaagtggacttgctttagggtacgcgccctgccttctcgggctcgctttgatcattgtgcagtttatctgccctaatttgcggttcgtctcggcggtggatcgattcgcgctagttgtgagtgattaatctgttgtttttgttgaagccatgggagacgtacacggcggacacgtccattgacctcaccagacaccatgagcccaagacgctgatggataaggtcgcatactggaccgtcaagtcgctgcgcttccccacggacatcttcttccaggttcgtgcccacgcgcgcacgctctctgttcaatagcgcggatgatcagttcggcttgcgtttctaattagtaggatcactaaaaactgattatactagtacatgcgccatgagaggttaagcataatggctcctggctgtgctcctgctttgtgggaagtcgcagcttgtatttgcaatttgcaacgtggatgaaatcgagtagtttacctcgaccacttcggggacccgattttattctatcgacgaaggtgggcactgccgcactgagcagtgacgactgacgcggacatcagcaaatggatctataatggtatggcaaatggatctatgatggtatggcagcctagagctgaaagttggatgttggtcccggtcatatcttaatttgagctaacttttttcaggtcgacacgatatgaaataattttgagctagactatattgtaactagatactaagaaaatagatctagctcggtccgaaacaaggcggaccgatgatcatgcagtgctggctcatacggaacacgtaaaaaacttatatatatttgtgactttgctatagacaaaattatataagaaagagaaaccaatgttttctataacttttgtaaatagataaaagtattggagcataaaataattatttaaacattagttttctaattcgtatctcacttcgtactatatcgcctttagcatggtccatttaatcatatcgtgtcgtgccagtgatcttgactaagtttgaggcatgacatggtgacctattttttcgtgctgtattgtactttagactcttattatttttcttcgtgttgtattgtactttagactcttattttcgtgccgtgacgtattagccccggtccaaactgcagcccaataaaataaaggcttgctgatatttgtttgtatcagcaattcatctttttaatctggcttttagaacttggttcgtagatgcatgtcgaaatgatctgcatattttgaaggaaggttgaaaggtcgatcattcatgtgctgttgtaagctgaccctgtgaattgggcgaattgtctgcagaggcggtatggctgccgggcgatgatgctggaaaccgtggctgcggtgcctgggatggtgggcggcatgctgctccccctgcgctcactccgccgcttcgagcagagcggcggctggatccgcgctttgctggaggaggccgagaacgagcgcatgcacctcatgaccttcatggaggtggcgaagccgaggtggtacgagcgcgcgctcgttatcaccgtccagggcgtcttcttcaacgcatacttcctcggctacctcttgtccccgaagttcgcgcaccgcgtcgtcggctacctggaggaggaggccatccactcgtacaccgagtacctcaaggatctggaggccggcaagatcgagaacgtccccgccccggccatcgccatcgactactggcgcctccccgctaacgccacgctcaaggacgtagtcaccgtcgtccgcgccgacgaggctcaccaccgcgacgtcaaccactttgcatcggtacggatacttccgaattccaataccagcaactctgcttgatctcatctcgttatgggattggttctgaaatctgaattggtatgagcttgtgccgtgcaggacatccattgccagggaatgcagctgaagcagtcccctgcgccgatcggataccactgaggatgtttgtgctcttcttaattttgcatcgctaataagcaattgtctttaagggaaggaaaggatgcttattgagttacgagtactgctacggcgattaggatattttccaaccagttgtttgagagtgaaacctattatatgtacgcatgttacatgtacatatctctaagtgcgagaggtgcttttctggcgtttatcacttcttcctggagttcctttgttcttcatgtcagctgaattgggctcgctaatatcgaatgtacaatttttgcataatccctatcttgtttgtagataatcanntgtgcttaatttcattgtcgttgtttgtgattggatagggatgacaacaagccctaaattttatactataaaatttaagtatcaattaggatcgagcgtatgttcaaatcagattatgatcgagctctatttttattaaatatttgaattagaaataatttaggattctaactaaggccctgtttgtttcaacttatagattatataatc

SEQ ID NO: 18406 - DNA, 2102 bp, Zea mays
cgcgtgggtcgtcgcaagactctatagtgagtcgtattaacgcgtgggcggacgcgtgggtttttttttttttttgccataaccaaaatccttctgagtccgagctattagcctaaagagtgctggcatctaactttctgcctttttgacatggaagatgtttcacttatgaaaataggattcatgtattcagatggcacaaagtccatgtacacagatactgaaccaattgatacggccaaaggaagttccatagataagtcagctatattacacctttgatttcttcgtgtgggcttcaaacagtcaaaccccggaatctgcagcactctcactttctcctactagttgaggagccacctgatgcctttaatcgggcatgtcgcccctctagccttgcttgaagtaattttgccttcagggtgttctccatcacacctactggctgttcaggtgagcattccgttatctcggggtccaaagatgtggattggtatttcagttgccgcgtggggctcccgacattacccagatcccccgaagtagtgccttcacaaaagagacttgttcgggagaaatgatcaaaggattcctgccccaggtaatcaacatgatgtgcatctgggttgttcatcgttgacccattgttggacccttgaataatttgggtgcctgtgcttccattctgctcttctgctggagtgattctggcattgctttgtgagctgatttctggtattttactggcaggctgcaatttgctgctactgggccttgcaatgcctttctgtaaataaactggcacactggacatgcataaaccttcagcagatataacatgaggatgctctgatcttcttttatgcacattcatggctcctgtgccacttctgcgggatcccatatgcccgtgcatattcagttcaaagcaattcaaatcactagcaatagagtcgtcatcatcttcagcaaactggggagcactggtggctccattcaaatggacagactcaagtgattgacgtcgtaatctagtattatcattcatatgtttttcattattcatagagctacctgcttttttagaaagaagaaaggcctgtatttcaccgctgagcctttctgttattgtggttttatgagccaattccccattgacatctgtattttgcatttgcattcgttcatcaagccatagttctgacatatggagcaccgaattatcaaatttgagctcataattcttgacatttctttgctttaccactctgagttcctcttcgtaattcctgatgcccattgcaaactggtcacaaagatcttctaagaggcgatttcctttcttctccttctcaaggtccttgactgacttgagaaacgctgactttatttcagacaactccatgcccaacttcctgagtaggtcctcagaatgcctcctcagacgcttctcatcctctagttcaccttgcagggaacgcacagctgtgtcaaccttcatgtgatccttgttttttctaacaagtttgttttcagagagttgtcgcatcagtgatgaaacttcgtgtctgtactgccgtctctcttgcaggagttcttgaatatgtgtctgagcctgctgtaactccagtttcaatccattaaccactgacaagttagcagtgtgctgttcttcaagactccaaattcgatttagaaccttcaatagttctgttgatgttttaaggctatagccttcccccatagatctacccatgatgcccaaagaacgagtcggacttctagttagattcacattggaatcctgtaaaatagagacacagcattacatgtttgagaaatgtgctttagtgttctaatatttgaagctggaatacatatctttgacacacattcaattgcttgtcataccccccccccccccaaaatcactaaataaatagaactattttgaactacaacgaaactgctacattgagataacattaatggcatgttcctagtaaaatgaattttcataaaattctgaaggaccacgtcatcagtgcagcaacaccatcaaaaccttttaatcctatgatggttggtgccaggggtaccga

SEQ ID NO: 18407 - DNA, 1855 bp, Zea mays
cattgggtacctcgaggccggccggggccatttcccatttgtagatccaccagccaggccggccgggaccgtcgcacagagctgggacttttttttaagcaccacagagctgggactttgagagggaggactcagcgggctccaaagccgacgaggataaagaggagcccggctccgcacgcgggagcgagaggatcgccggcgcaggatgtggtgcgcatcgtgcttggcgtccgcctgcgcgggctgcacctgcaacctctgcacgtcggcggcatcggccgtgtcccgccgctccgcgcgcctcgcttactgcggcctcttcgccgcctcccttatcctctccttcttgctccgccagttcgccgcgccgctcctcaagcatatcccatggataaatgcgtttgatcaaacaccaccagaagaatggtttcaaatgaatgctgttcttcgtgtaagcctggggaacttcttgttctttgcaatattttctctcgtgatgattggtgtgaaagaccagaatgaccggcgagatgcctggcaccatggtggctggattgcaaagattgctgtatgggctgttctcattgttcttatgttctgtgtgccgaacattgtcattactatttacgaggtactttcgaagtttggatctggcttctttcttctagtacaggttgtgatgcttttagacttcacaaataattggaatgactcatgggttgagaaagaagagcggaaatgggaaatagctttgctggtagtgactgtggtttgctatctttctacattggccttctctggtgtgctcttcatgtggtttaatccatccggtcatgactgtggtctcaatgtgttctttatcgtcatgacactcatccttgcttttgcgtttgcaatagttgctttacatcctcaggtccatggaagcgttatgcctgcttctgtcatttctgtttactgcgcatacctgtgctacacgagtctctcgagtgaaccggatgactatgagtgcaatgggcttcacaggcattctaagcaggtttcaatgagtgctcttatactcgggatgctcactacggtgctctctgttgtgtactcagcagtccgtgctggatcctcgactacattcctttcaccgccatcatctcctagatctggagccaaaaacccgctactcggtgacgaggaggacggcaaaggcgatggcaaagaaagcgaaccgcgacccgtgagctactcctacaccttcttccacctcatcttcgcccttgcaagcatgtattcagccatgctcctgaccggctggacgagcgctgcatcagagagctccgagctgatggatgttggatggacgaccgtctgggtgcgcatctgcacggaatgggtcaccgccgggttgtacatctggaccctcatcgccccactgctcttcccagaccgtgatttctcctaggcacccacgcacccatagcctatgagttgtttggtggtgttagttgcgattgtgaatatgaataagccgaagctgggagctggtagggatctggtattgtctctgtatgctatctggcatgcctaatgtgatggcactggttagtacctgtttgtatggccttgtatagaatatatttcgaccgagtgtaggttgtggactttaaagtcatatagctatacttgacctgatgtcaagtcgcggttgtgtgtaatgacgacaattatcatgtgtaagaatacgtctattgctcgtaatgttgtaataactacgactgtagcttgtgtttagggcatctacaacctactacataaatacataaataacatatatcttagggtttttcaacccggtgctctc

SEQ ID NO: 18408 - DNA, 806 bp, Zea mays
ccgtccgggaactaccgcctatcctcctgcgctctgccccccccccggcggcaacatcctctatctctctctctctctctctccctctctacctgccccgttcctcaccagtctcttccgccggcgtcgacgagagctgcgctaggtgatctcgactgcttcctcgccccccatggcgacggcgctcaaatcgttcctgaacagccccgtcggccccaagaccacccacttctggggccctgtcgccaactggggcttcgtcatcgcgggtttggttgacatgaacaagcctcctgaaatgatatctggcaatatgacagcagccatgtgtgtgtattctggactctttatgaggtttgcatggatggtacagccccgaaattatttgcttctggcatgccatgcttccaatgaaagcgtccagctctatcagttatctcgctgggctaggtctcaggggtacctggagaagaaagaaccagaggccaaacagtaaagagggtatccaacactgcagtcatttgttcaataaagaaaatatgctgtggaaaacattcattctgttgccaatgcagttttttttgtatgtttgcaaaatatgctgaggaaatttcatgatacctagcgcagttacaagtgtctgcttacttttatgtgcatttgtcaagacacatttgttttttacattgctgccttcctactatttggcactatttattttacctggctcatccgctcatgtgcccaaaaggcttagtaaaataaattcctggtcccctgtaccacaccattcccagattttatcc

SEQ ID NO: 18409 - DNA, 812 bp, Zea mays
ctcgagccgcccgggcccccactgcaggctgcaccggcctctccctctctctctctctctctctctctctctacctgccccgttcctcaccaaacttgtcgcatcgtcgacttgtgagtctcttccgtcggcgtcgacgagagctgcgctaggtgatctcgactgcttcctcgtcccccatggcgacggcgctcaaatcgttcctgaacagccccgtcggccccaagaccacccacttctggggccctgtcgccaactggggcttcgtcatcgcgggtttggttgacatgaacaagcctcctgaaatgatatctggcaatatgacagcagccatgtgtgtgtattctggactctttatgaggtttgcatggatggtacagccccgaaattatttgcttctagcatgccatgcttccaatgaaagcgtccagctctatcagttatctcgctgggctaggtctcaggggtacctggagaagaaagagccagaggccaaacagtaaagagggtatccaacactgcagtcatttgttcaataaagaaaatatgctgtggaaaacattcattctgttgccaatgcagttttttttgtatgtttgcaaaatatgctgaggaaatttcatgatacctagcgcagttacaagcgtctgcttacttttatgtgcatttgtcaagacacatttgttttttacattgctaccttcctactatttggcactatttattttacctggctcatccgctcatgtgcccaaaatgcttagtaaaagagccccctttgcgaagtaaaaaaaaaaaaaaaaagggcccta

SEQ ID NO: 18410 - DNA, 783 bp, Zea mays
  misc_feature (765)..(765): n is a, c, g, or t
aacataccgcctgtccacctgcgctcttcccgttccccaactgcaagtctgcaacatcctctctctctctctacctgccccgttcctcaccaaacttgtcgccctcgtcgacttgtgagtctcttccgccggcgtcgacgagagctgcgctaggtgatctcgactgcttcctcgccccccatggcgacggcgctcaaatcgttcctgaacagccccgtcggccccaagaccacccacttctggggccctgtcgccaactggggcttcgtcatcgcgggtttggttgacatgaacaagcctcctgaaatgatatctggcaatatgacagcagccatgtgtgtgtattctggactctttatgaggtttgcatggatggtacagccccgaaattatttgcttctagcatgccatgcttccaatgaaagcgtccagctctatcagttatctcgctgggctaggtctcaggggtacctggataagaaagagccagaggccaaacagtaaagagggtatccaacactggagtcatttgttcaataaagaaaatatgctgtggaaaacattcattctgttgccaatgcagttttttttgtatgtttgcaaaatatgctgaggaaatttcatgatacctagcgcagttacaagcgtctgcttacttttatgtgcatttgtcaagacacatttgttttttacattgctgccttcctactatttggcactatttattttacctggctcatccgctcatgtgcccgaatgcttagnaaaagatcgcgccctgcg

SEQ ID NO: 18411 - DNA, 779 bp, Zea mays
atgacatatttgatagcgggccgcaggctaagccattccttctaactgcaactgctgctcctctttgtctcccccgttccgttctccactgaactcctcgccctcgtcgacccgtgacccgtgagcctcttccactgccgccgtcgacgagagctgcgttagccgctagggacaggtgatttcggctgcttccctcatggcgaccgcgctcaagtcgttcttgaacagccccgttggccccaagaccacccacttctggggccctgttgccaactggggcttcgtcgtcgcgggcttggttgacatgaacaagcctcctgaaatgatatctggcaacatgacagcagccatgtgcgtgtattctggactgttcatgaggtttgcatggatggtacagccccggaattatttgcttctagcatgccatgcttccaacgagagtgttcagctctatcagctgtctcgctgggctagggctcaggggtacctggagaagaaagagccagagacacaacagtaaagagggtatgcaacactgcagtgacttgttcctttagtgaccatgcagtatgccgaggagatttcatatacctagcgccgttacaagcttctgcttgcttacttttctgtgcatttggtttttacaatgcgttatgcaatgagtttcccccaaacacgcaatgagtttgggcactattttcgttttacctggctcatgtgcccatagtgctttgtaaaagaccagtcgttgcaaaaattttggtcccgtccctcggccc

SEQ ID NO: 18412 - DNA, 2823 bp, Zea mays
  misc_feature (58)..(58): n is a, c, g, or t
  misc_feature (65)..(65): n is a, c, g, or t
  misc_feature (2760)..(2760): n is a, c, g, or t
caggggtggtctcgggccttagtgagctacaggcctagcccaggctgaaatctcgtanccacaanccagaaattaaagcgaaagcccagagcagcaagggcataggcattctcatatattcaccgggcttgtaagcccacttaacccaagcaagacctataacgacttaagaaacccgcccacgccgccaggcgcacgccaattcctccctctctcgccgaaaccctcctggacactcgctgcgatgggcaggaaaccctcctccgccgccgccgccgcggcgatggaccacgaattccttgcggccgccatgcccgccgacctcctggccgcggccgactgcggtggcatccacgggcatgctctcttcttcgacgccctcgtgcagctcatcccgccgcgcttttatctcccatccggcgacgaggaccgcccgtggcaccagggcctgtccaaggcggcaaaggcggccttgaaggccaagtcccgcgccaacaccaaggccgcccgccgcgcccgcctcaatccctccacgccgcccgcctccaccctcgacctcctgaagaagtccgtcgccggccaggcagcggaggaagaggaggagaagtcagaagaagagagcggggcatctggggatgaggaaagctccgaggatgatattgatgaggaagccggggatcaagaggatgaaatgccgattgcacccgctgcagtggtgtctgaggatcgttccgtgacctatgaggagctgcgagaacgccttcaacgccgcattactgtgcttcgaggcaaccggtgcaccaggcctgagttcttgaataagcccaggaaggagaagggtaagaagtcaaaggcgaagaatgaaaagaagggcaaaggtgagggcatgaagcgtaagcgtgatgatggcaccgaagatgtggatgtcaaggatgggaagaaggtaaagaaggaagctgaggagaagccagatatcatgtacgcaaatgtgtttgttgacccaaaggaagcaaggcgcaggaagaagaggagggttaagaacaagaagaaggcactggagcaggctaaacggttgcaggaggcaaagaaggatcctgagaaggcaagcaaaattgcttgggatgtggccagaagacgtgctgctggtgagaaggtccatgatgaccccaagctgattaaggagagcttgaagaaggaggaaaagcggcagcagaagcatgctgcgcagtggaaggagaggcagaaaactgtagataagcagaggaaggacaagcagaagaaaaggacagagaacatccgggatcgggcacagcagaagaagatgcgcaagattgagaagcgtgagaaaaaacttatgcgccctgggtttgaggggcggaaggatggttatgtcaacgagtaacatctgtgtccaagtttgtctggatgatgaattactatgtcctcgtttagagtttcatttgcccctatgggtagttggtgcttgtaataggttaccagatcatggctgctgaagtgccttaattattgaatgaaccgaacttttgttatatagcagttctacagatgattttggagttgctatagttaaaaaaaaaaaaaaaatttaccaattcatgccttttgctagttctttctaagttctgacgtaagagttcatgaactggaaacgctgaattgtgctgaggtggatgcctgttttgacacgatggataatagtgtttctgagataatgtttgggtatataggtatatagtggctttcatgagtcgtcagctttcaggaccagagtgaatcagaagttcaattgtgcatttgccatcttaataatatgcacatgctggaatctggatactaacctccctctgatcttgtaaacttttgttggatcccttgtttgtcaaccagtatgacttgtgattcactgcagagtatgaacaacacaatgtacaattggcatgttcgtgccagaaaattctatatggtctgtctgatactcagctgatcttgcaagcttctggtgcaatgaaacgtatcctgaattttttattcaactctttgtgatccattgctgctaatatgcaagtgtaatccgggttttacatcacacgaatgagttatttggaagatctggaagaggttttcaccacaactttttttctgtctttgcttggtaactgacttggaactggtgaaattacaatgggatacaagaatttactcagttatgttctctgaccaatttctttcaatttttctcaataaatattatccatttgttaaaaaaaacatgtgagcctgatctagctctacctggtttttggattgcggattcgtggtaattaactatcagcgtttgataccgtgagatcctgtcaacaaaaggaaaccgtagttggctccgctgatgccaacatcgcactggggcctgcaccttgaggagccatgaacaatttcggctaaatccaaggccctcgaaaccctaaactaaatcccagggcccttcaagcctccggggtcccagaagccgagcgccaagcctccgacttggcttaccagtaggtagggtaaaatagaggccgtagaattgtaaatgagactatatgacatgtttatagattgaagtttgaaatagaggataagataaatgatagaatatggggtctactcgagatagccttacagggccctgtaagctagggttcacagaagacggacccagatgttacaactagtacgatgtgcgtcaagacaatcacntggtgcggggttgatgaactaagaataacgttcatatttaatatgatgttgtggtcaagaaag

SEQ ID NO: 18413 - DNA, 761 bp, Zea mays
tttttttttttttttttcctagttttttttttttttttttagatagcttgtcaaacgctattctatatataatactgcagtatttaagaataatacattattttttaaaaactactgtaaaaaacttcactcctaaacaccctctaagtagtgtattgggttggtactactctaattagagaggcaaccacgtgcccttgtgggctgtaatgttctatatcatgtattgggcccattattattagagagtccatccaaatccaaatcagccggaaacgtattcagacggcctcggcgctcacttcttgtcgtccttcttccccgccgccgcctccggcttcttctcctcgggtttcttgtcgggcttcttctcctccttggctgggcccaccgagacgatgtcgaccttgccgagcttcttcagcttcttggcgacggccaccgtgtccatgtcgccgatcaccgtcatcttgttctccttcacgtccgccgcgatcgagtcgatgccgtagatgtccgcgacggcctccatggccttctgcttcgtcctgtcgtcggtcatggtggagatccggagcaccaccttctgctgggccatcgatctcttttcagcttcttggattggatttggatgacagtgtacaggaggggagagcgaggctccgcaccctcgatgagaagctctgtgtatctatttctggctgctatgctagtatatggtttgctggaagtggcatgaatgtgaacaagcaaggggccgg

SEQ ID NO: 18414 - DNA, 1637 bp, Zea mays
gggtacctcccggccggccggagacctgccttttcttcttcaagcgtgcacattccttccccacttctctctctctctctctctcgtgacgacggcgacggcaacgactggggcgacagtcgctgccgccctacttgccggttgctcggatcttcttcggcccgttagccgtcgacgagcaccaccagggcaaccagatacttcagtggcttcgcaaggatgtcctggtgcactattgagtctgatcctggtgtgttcactgagctgattcagcaaatgcaagtgaaaggtgtacaggtggaagagctttactctctcgatgtgggctctcttagtcaactgcggccagtatatgggctaatttttctcttcaagtggatacccggggagaaggatgaacggcctgttgtcagagatcctaacccaaaccttttctttgcgcaccaagtcatcactaatgcatgtgctactcaagctattctctcagttctcatgaatcgccctgaaattgacattggcccagaattatctcaattgaaggaattcacaggagcttttacaccagatctgaagggcttggctattagcaacagcgaatctatccggacagctcataacagctttgcaaggccagagccatttatttctgatgagcagagggccgcaactaaggatgatgatgtttaccatttcataagctatttaccttttgaaggtgtcctgtatgagctggatggactgaaggaagggcctgtgaatcttgggcagtgcgatggtgctgatgatcttgattggctacggatggtgcagccagttattcaagaaaggattgagcgctactcacaaagcgagatcaggttcaatctcatggccatcataaagaacaggaaagaggtgtacagtgctgagcttgaggaactggagaagagaagggagcagattttgcaggagatgaataatgcttcctccacagaatccttgagcagttcgcttacggaggtgatatcggcaatcgaaactgtcacggagaaggtcatcatggaagaagagaagttcaagaagtggaagaaggagaacattcggaggaaacataactacatccctttcttgttcaacttgctgaagatgcttgcagagaagcagcagctaaaacctctggtcgagaaggccaaacagcaaaagtcagcaagcccgagcacgagttgatggtgaaatgtcaatagactggtagcttttgccgatgtcttctgagcgtcgtgttatcttatcagatacattgccaagtcggcagctcagataaattatgaccgatgttatttataccatgttgcacgccgtgatgtatcagcagctatgccattttttttttgcagagcacgtgcgttgttgaagtggttaattttagtcgtttagagagattgtttgagagtaagggtaatggaatggactgaggaggttgaatcactcaatattcaattttaaataatgatgggttccagccctctcaatcccctccattccacctactcctaaacaaactcttaggtctagttttgcaactcttttttgtcaaggaattttcattttatcaagagaaattagttcatttatacttagaaaaatggagttgacaatct

SEQ ID NO: 18415 - DNA, 1703 bp, Zea mays
gaccgctatcggtcacactactctcactcctcactccgcagtatcaactggcctcggccgcacaaatcccgcagtccgcaatccccgacggcccacggcagagccaccagcagcagcagcagccccagaaatcgagcaaacaagctgctccatggcctcaccaacccgaacaccatcgcctccgccggcggtcgagcccatcgcgccttctctctcttcagaacatccgcctgtcaacccctcctgtgacggatccttctcgccggagaacccagcgccacctccacctcctccccctgctactccgcatcctcatactcccggcgatagctctccttcctcaattccgcatccctcggcgccacagcctcttccatctccgcctcctcatactcccgacgatagctctccttcctcaactccgcatccctcggcgccacagcccccaccatctccgcctccgccgagcgctgatgcttctcctcccctttcgcgacagggcgaaacgtcaccgccgcgcccatcgccccctccctcacccgctccagtatccccgcctactccagcgccggcgtcctcggaagccaagtcggagcaggaggaggcggaatcggctagcgaatcggggagcatgacgctagccatcgttctagccaaaactgaagatgcaacgccgccgaaggcctcctcggccgaggcgtccccaaccagatcgccgcagaaggaatcggccgtcaccatcgcgaagctcctctccgccgaagacctcgcggcgatggaggctaaggccacgccggacaaggttacacctccgagcgacgctgggtccctcgccgccgccgttactaccgttgggggagtcagtggcggcgtggggtccaagaggtggctcctaggcggcgtcccggagaaggtgcggcgcgctgagctgaggagggccgagctagggtttagggtttcggccgccgtgttctgcctggtcgcgctctccgtcatggcggccgataccacgacgggctggtccggcgactccttccgccgctacaacgagtacaggtacgtacttgctgcgagcgtcgtgacttttacctactgtggattccagttggtagccgaggtgcattacgttgtcacagggagacacatgattcgagccccattccgcagctacttcaatcttgccatggatcagatgttagcttacctcctgttgtcagcatcttcagcagcgctttctcgtaatggtgtttggatgtcacggtttggaggggatcagtttaccaaactgatcaatgtctcggcttccatggcattcctagctttcattgctctgggtcttaactcggtgatctctgcttactgcttcttcagcttggtttcatagagctaccgttgtgcattgcatgatgtgaataatactacctgtatgcttcttggagcactgaaccttgattcatgtgaaatttctacatgatttctgtgaaatccctaaactccaaagtgggcctatattgtagcagtacattgagtcaaggttggcctttaaaattttggaagcggaaaaaataaaaaaaaaaacaaaacgttatcgttttatactgaaagtctgaaagatacgcagcttggagaccactctctatgttgcgcccctttacatatgttcatatgttgtgatgtttaaggggtgcttgattcctcctttt

SEQ ID NO: 18416 - DNA, 3161 bp, Zea mays
gggtacctcgaggccggccggggttgttcggcccgtcgggcggccaaagcagcggcccccttatctccagggaccaggggaggtcgcacaccaacgcaccgtccttccctttcctcctcctcctccctctcctcggaaggtcaagtgacggtatttgtgaccatggcagggaccttactccagtcagttgccctgggaacaccatttgggggtcgcatgagaacccattgttggaggtcccatggcaccaggaggcctgcctctatgttggcagtgtcacttagccgccctgtcaagatgtcagcatttgtgggtctaagatcagtgcatagcttctcggtcacaccgacggtgtccaattccaggtcggcagttgcatcttacaggtcatcgcgacagacaagacgatctcgttttgtcactcgggcaatgtttgagaggttcacggagaaagctattaaggtcatcatgcttgcgcaagaggaagcaaggcgcctgggccacaactttgttggaactgagcagatcctcttgggtctgattggagagggcactggtattgcagctaaggtgctcaagtccatgggaataaatcttaaggatgcacgtgtggaggtggagaagattattggccgcggcaatggttttgttgctgttgaaataccattcacaccacgtgcgaaacgtgttttggagctctccttggaggaagctcgccaattaggacataattatattggatctgagcacctgctccttggactgcttcgtgagggtgaaggtgtggcggctcgtgtgcttgagagtctcggagctgaccccagcatatccgtacacaagttattcgaatgattggtgagaccacagaagctgttggtgctggagttggcggcggcagcaggcggcgggagaggcgtacgctcggggtgcggcgcgctaatttaacaaaattagcagaggagggaaaattagatcctgttgttggaaggcagccacaaattgagcgtgtggtacaaattttaggcagacgaaccaagaacaatccctgcttgattggagagcctggtgttggaaaaactgcaattgctgaaggacttgctcagcgcatttctacaggcgatgtacctgaaacaatagaagggaaaaaggtcataacccttgacatgggacttcttgttgctggcacaaagtaccgtggagaattcgaagaaagattaaagaagctgatggaggaaataaagcaaagtgatgagataatactctttattgatgaagttcacactctgataggagcaggagcagcggaaggtgctatagatgctgctaatatcttgaagcctgcgttggccagaggtgaattacagtgcattggagccactacactagatgaatataggaagcacattgagaaagacccagcacttgaacggaggtttcaacctgtgaaagtgccagaaccaacagtagatgaaaccattgaaatcctcagaggactgagggaacgatatgagatccaccataaacttcgttacactgatgaagctctgattgcagctgcaaagctgtcatatcaatatatcagtgatcggtttctcccagataaggcaattgacttgattgatgaagcaggttcccgtgttaggctacagcatgcacaggtccccgaggaagcaagagagcttgacaaggagctcaaacaagtcacgaaacagaagaatgaagctgttcgaagccaggattttgagaaggctggggaattgagagaccgtgaaatggaattgaaggcccagataacagccctcattgacaagagcaaggaattgagcaaagcagaggaagagtctggagagacaggacctatggtcaatgaagaagatatccagcacatagtatcttcatggactggcatccctgtggagaaggtttccagcgatgaatctgataagcttcttaagatggaagagactttgcacaagcgtgtcattggccaagatgaggctgtggtagcaattagtcgctccatccgccgtgctcgtgtgggtctcaagaaccccaacaggccaattgcaagctttatttttgctggtcccaccggcgttgggaagtctgagcttgcaaaggctcttgcagcctattactttggctctgaggaggctatgatccggcttgatatgagtgaattcatggagagacacacggtatccaagctgattggttcacctccaggatatgtaggatacactgagggtggccagctgacagaggcagttcgacggcggccatacacagttgtgctctttgatgagattgagaaggcacaccctgatgtcttcaacatgatgcttcagattttggaagatgggagattgactgacagcaagggaaggacggtggacttcaagaacacactcctgatcatgacctcaaatgtagggagcagtgtcatcgagaagggtggaaggaagatcggatttgaccttgactctgatgagaaggacagtagctacagcaggatcaagagcctggtcatcgaggagatgaagcagtatttccgacctgagttcctcaaccgtctcgatgagatgatcgtgttcaggcagcttaccaagctcgaggtcaaggagatagcggacatcatgctccaggaggtctttgacaggctgaaggccaaggacatcaatcttcaagtgaccgagaagttcaaggagcgggtggtggacgaaggctacaaccctagctatggtgcacgcccgctgaggcgagccatcatgaggctgctggaggacagccttgctgagaagatgctcgcaggggaggtaaaggagggcgactctgccatagtagatgtggactcggaggggaaggttgttgtgctcaatggtcagggcggcataccggagctctcaactccggcgatcaccgtttagctcgtacataacaaatgacaaaattaatagcatagtttttgttcaaacacattatcatttatggttagaatatctgtgtatatgtagtggtatagtcaatggggaaatcgttcctgcctctaaattcctttttttcaagttaaggtgtttcttttgtcgcaagttaatctgcctggttattaagatattattgtttacagagtgatggaaaaaaaaaaaaaaaaaaggccccta

SEQ ID NO: 18417 - DNA, 4434 bp, Zea mays
  misc_feature (4152)..(4152): n is a, c, g, or t
ctgcagggatgcaaatcctagataccaggaccagaacttcttaacgaccgccggtaaaatttactccggttattctcgtctaaaaagaattaagtaggattttaacttgtttatgatttaatctcactcaatctgctctaatctacatgggttgggtataaaacgaacatgccctaaataaattagaaacactacatacatatacatctccatgtattaaaggcatgcgcttgctactgctacctgcgaaatattatcaagaatggcaagtaaactcccctgcttggtgctcacagcaaattcgtctcacgcatattcgtcatccagctccgtttaaaatgcgtgctcattatccctcaagcatgcatatactatatatgatgcagatcatatatgacctttatacaattatcaccacctcgattcctcgcggcacatctttgcaccgcagaacgaccgtgcagtattttatacaaacatctactctcgatctacccatgagctaactcccaatatataagcgagccgaacttttctcctatctgagcactgctgctgctgaaaatggcgcctgggcttgcgatctgggtcgcgctggttctgcccgtcctccttggtctctcgtgcctcgtcgtcgcgctctcggaggatggtttgtgccggacttgtcacgcgctctttggtatttctgcagttctgcaaacgtgtgaattggcatggacatgtgcagaaacactggacaagctgcggttcgtgcgccacgcacaggacgcgcccctggtgtcgcagtacaactacatcgtgatcggcggcggcacggcggggtgcccgctggcggcgacgctgtcggagcactcgcgcgtgctgctcctggagcgcgggggcctcccgtcccgcaacatgtccgaccagcagcacttcacggacgcgctggcggacacgtccccggcgtcgcccgcgcagcggttcgtgtccgaggacggcgtggtgaacgcgcgggcccgggtgctgggcgggggcagctgcctcaacgccgggttctacacgcgggccagcaccgactacgtgcgcgccgccggctgggacgcccgcctcgtcaactcgtcctaccgctgggtggagcgcgcgctcgtgttccgccccgccgtgcccccgtggcaggccgcgctccgcgacgcgctgctcgaggccggcgtcacgcccgacaacggcttcaccttcgaccacgtcacgggcaccaagatcgggggcaccatcttcgacagcagcggccagcgccacaccgccgccgacttcctccgccacgcgcgccccagggggctcaccgtgttcctctacgctaccgtctccaggatcctcttcagacagcaaggtacgtacgtgcgtgcacggcttccgcattttttgttcgacagtgcgggctggcacgatcgcgctctgaagcggagaatcgtgcgctgtcgacagagggcgtgccgtacccggtggcgtacggtgtggtgttcacggacccgctcggggtgcagcaccgggtgtacctccgcgacggcgccaagaacgaggtgatcctgtcggcggggacgctggggagcccgcagctgctgatgctgagcggcgtcggcccgcaggcgcacctggaggcgcacggcgtccaggtgctggtggaccagcccatggtcgggcagggcgtggctgacaacccgatgaactcggtgttcatcccgtcgccggtgcccgtcacgctgtcgctcgtgcaggtcgtcgggatcacccggtccggcagcttcatcgagggcgtgagcggctccgagttcggcatccccgtctccgagggcgcccgtcgcctggctcgcagcttcggcctcttctctccgcagacggggcagctgggcacgttgccgccgaagcagagaaccccagaggccctggagcgcgcggcggaggcgatgcggcggctggacaggcgggcgttccggggcggcttcatcctggagaagatcctgggccccgtctcctcgggccacgtcgagctgcggtccgccgacccgcgcgcgaacccggcggtgacgttcaactacttccaggagtcggaggacctgcagcggtgcgtgcgcggcatccagacgatcgagcgcgtgatccagtcccgggccttcgccaacttcacctacgccaacgcttccacggagtccatcttcaccgactccgccaacttccccgtcaacctcctgccgcggcacgtcaacgactcccggacgcccgagcagtactgcagggacaccgtcatgaccatctggcattaccacggcgggtgccaggtcggcgccgtcgtggacgacgattaccgggtgttcggcgtgcagcgactgagggtgatcgacagctccacgttcaagtactcccccggcaccaacccgcaggccaccgtcatgatgctcggaaggtatatgggtgtgaaaattcaggccgagagatggaggaaatgatcgagatttcaagtttcagcatggtctagggactaagcctctagctgtgataatgaacatcaatcaacacatctgtaactgggtaactgctctagcctctagagtaggttttatttttctctagatattttttaatctcctctagacatactcctagcttccgcatgttgttggttccattccaccacacccctagatgcattgttcagcatttcgcgggaataatgagaattatgctgaaaaggcatgatcgctcctcctgcctattctacagaaaattaaataaagaaccgccatttcatcaaataaaccaaaggccgtgttctgtggattggaagggatcgaggaagattaaatcgtttctatttaattttcccttaatttcaactagttaatctcatggagttccttctaatctacttctaactgaacaagaccaagcccaaaagggaaaaacacttgaaatcgtcctgcaggatcaatttacattctgaacatttaccagtactttccaggatctacattggaatacctcggtccaaatgtgatattcctgaacctctttaatttttctaatacatgtacccaataaaggtataaattgattggctacttatatatgtactgaacgaatccagggaaaaaaaaggtcaaggggagaaagcccatattaccatttccccctgcttgcctgcaacctgtagctattgcaaaattttcaccctatctacgctctcaagaaaaagaggataagctagtgctagggtccccctgggcagaggccaccagacattatgtaagttgcacagctaaagtttatattgtgaggttttcctggatggccacaaacgagccacagatgttcccacccatatctgggaatgttgtgcatccgggtagcggtttcaccttgcctttacggtcaacgcttactggatacttcatgaggtggcctctcatctccgtcacctcatcggcaacaaactgcttccagttctcttccccaagatgacgtacacgcctcatgcactccaggctctccggatagttgaagtcttcctcaatgcttccaatatgctcagcccataaggacattctgtagccataaatctacaaggtaaaaatcaatatattaaacttaagagtatggcacactctgaaatcaatggcacccttaacataacaaacagctggaacaaatgtatagcctcaggaaagcagtagcaacgaggacatgaaagtataaataattccaagtctaatcacataataggagcttaggggaacagactggctttgtatgtctcgatattcgtggtacaccagatacttgtcagctattacctgtccacgtggggcagaaagcttattagcccatgtatattgtggctgatacgctcccatcgcaatctcagtgtctcttattccttccatggatctctggttaatattagctgatccaatgataacatactcatcatccacaatcatgccttttgaatgtacatagaccatgaatctcctatttttcctagcttgttcctgaacattaaatgcaaaataagcttgcatacacgccatattcaggagaagaacacagcatgaagacattcagttccaacactgattatatgagggcaagtaatgtttaggtaatgattacaanttcaatatccacaagtagctactttttgtagagctagttcagtatccacaagacacgatttttttgtcaagcatccacatgagtaagttaaatcacatcagccattgaccaagttcttttcaaacaaaaacctattccctttagcctttaagaatcgtcatgatatattggaagtcccaataaaattcagtggcagaaatagacaatccaattaatgttttcacacttccacgtacagtccaaaggaacaatatcagtgttgccaagaaaaaggagaactgc

SEQ ID NO: 18418 - DNA, 2065 bp, Zea mays
ctgagcactgctgctgctgaaaatggcgcctgggcttgcgaactgggtcgcgctggttctgaccgtcgtccttggtctctcgtgccacgtcgcgctctcggaggatgaaacactggacaagctgcggttcgtgcgccacgcacaggacgcgcccctggtgtcgcagtacaactacatcgtgatcggcggcggcacggcggggtgcccgctggcggcgacgctgtcggagcactcgcgcgtgctgctcctggagcgcgggggcctcccgtcccgcaacatgtccgaccagcagcacttcacggacgcgctggcggacacgtccccggcgtcgcccgcgcagcggttcgtgtccgaggacggcgtggtgaacgcgcgggcccgggtgctgggcgggggcagctgcctcaacgccgggttctacacgcgggccagcaccgactacgtgcgcgccgccggctgggacgcccgcctcgtcaactcgtcctaccgctgggtggagcgcgcgctcgtgttccgccccgccgtgcccccgtggcaggccgcgctccgcgacgcgctgctcgaggccggcgtcacgcccgacaacggcttcaccttcgaccacgtcacgggcaccaagatcgggggcaccatcttcgacagcagcggccagcgccacaccgccgccgacttcctccgccacgcgcgccccagggggctcaccgtgttcctctacgctaccgtctccaggatcctcttcagacagcaagagggcgtgccgtacccggtggcgtacggtgtggtgttcacggacccgctcggggtgcagcaccgggtgtacctccgcgacggcgcccaagaacgaggtgatcctgtcggcggggacgctggggagcccgcagctgctgatgctgagcggcgtcggcccgcaggcgcacctggaggcgcacggcgtccaggtgctggtggaccagcccatggtcgggcagggcgtggctgacaacccgatgaactcggtgttcatcccgtcgccggtgcccgtcacgctgtcgctcgtgcaggtcgtcgggatcacccggtccggcagcttcatcgagggcgtgagcggctccgagttcggcatccccgtctccgagggcgcccgtcgcctggctcgcagcttcggcctcttctctccgcagacggggcagctgggcacgttgccgccgaagcagagaaccccagaggccctggagcgcgcggcggaggcgatgcggcggctggacaggcgggcgttccggggcggcttcatcctggagaagatcctgggccccgtctcctcgggccacgtcgagctgcggtccgccgaccccgcgcgcgaacccggcggtgacgttcaactacttccaggagtcggaggacctgcagcggtgcgtgcgcggcatccagacgatcgagcgcgtgatccagtcccgggccttcgccaacttcacctacgccaacgcttccacggagtccatcttcaccgactccgccaacttccccgtcaacctcctgccgcggcacgtcaacgactcccggacgcccgagcagtactgcagggacaccgtcatgaccatctggcattaccacggcgggtgccaggtcggcgccgtcgtggacgacgattaccgggtgttcggcgtgcagcgactgagggtgatcgacagctccacgttcaagtactcccccggcaccaacccgcaggccaccgtcatgatgctcggaaggtatatgggtgtgaaaattcaggccgagagatggaggaaatgatcgagatttcaagtatcagcatggtctagggactaagcctctagctgtgataatgaacatcaatcaacacatctgtaactgggtaactgctctagcctctagagtaggttttatttttctctagatattttttaatctcctctagacatactcctagcttccgcatgttgttggttccattccaccacacccctagatgcattgttcagcatttcgcgggaataatgagaattatgctgaaaaggcatgatcgctcctcctgcctattctacagaaaattaaataaagaaccgcc

SEQ ID NO: 18419 - DNA, 1751 bp, Zea mays
tccgagataactgttcttatgccaagattcgccctttgactgtttcctttatcttatcttttataggattcttcctgcccgaaagcgttgatgacttgtgtggttttgacttccttaaaggtgccatgtcatttgacaacatctgggatgagattgcccaggcggcagagttctcatctagtgatagccctaacttatacattgtaagttggaatgaccacttttttctactcaaggttgagcatgatgcatattacattatcgatacccttggagaaaggctccatgaagggtgcagccaggcatacattttgaagttcgacaagaatacgacaattcacaaggtacctggggaaaagaaaccttgtagccccgactcaagtggaccaatgaaggattcttcaggttctgagagctctacgactgaccaggacagtgggaatgatactgaagaggaggtgcttgtgtcgaagggcaaagaatcatgtaaagagtacatcaagagtttcttggcagccataccaatccgggaactacaggcggacatcaagaaaggactgatggcatcaaccccattgcaccaccgcctccagattgagttccagtacacccagtcgtccccaaaagagactgcatcagccactcagcttcttaccatggaggccccctttgagttctcatggcctgaggcaccgccaacaatggaagtcacactaacatctgccgtctctgttgtgtagcttgtcaccctggtggcgaagaacccaaagacatgagacaacggcctgccctgatgttcggcatggagaacccttttttccttggttccctgcatggagggggagcctagatgaagattttggttcttctgtttgtactaatttgtttaatatgaactgactactacgggttattcctcctgggcgtaggagcgttctacctgcttttttttagaggtatcttccctcacctgctcgcttgtaatcttttggaaccctgtatgactaatcgaggaggaattcccctttgttataatgaactagatgccggcttatctgtagatgtaacatgataatatggtgccaacaagcaagaagctacgagttatgaatctgctagttacaagcagcatatgtttctcagggcctctgtgtgctgtatatggaagtaactggacctgctgtgaccaaaattagtttataactcaagttccttgatgatgcatttgcacataaaatgctgttcagtagtcgcatccaactggaagtcatttttcagagaatgcgcccacgagttgctgacaatatccacttcttttcgggattgacatgtgagagagagatggggctgtgatgcgtcaagatggttctatgcatagcttccgactcctgatcagcacagcagcactcctcctttccagtttcagttcctgaatcccaaacttcggtgtaactcttttctatagcgagcagcgaaaaccactaggagttcattttatacggaaaacaaaatggtgatttttttttaaaaaaagaatgctctgtacaacatacacaggtcgttcatcatggctgctcatacaacgtgctttgcttagaacatggttgtatatcttgaatgtgaagtgagcatcattgcacgcgtccccatgatgcacgcgttggaatgaaaataccatcttcgactataccccactgccactttgtgcatacattcctgttgtgatcttgttaactgagacatctttcagt

SEQ ID NO: 18420 - DNA, 977 bp, Zea mays
cggcagagttctcatctagtgatagcccttacttatacatagtaagttggaatggccacttttttctactcaggggggggcaggatgcatattacattatcgatacccttggagaaaggctccatgaagggtgcagccaggcatacattttgaagttcgacaagaatactacaattcacaaggtacctggggaaaagaaaccttgtagccctgactcaagtggaccaatgaaggattcttcaggttctgaaagctctacgactgaccaggacagtgggaatgatactgaagaggaggtgcttgtgtcgaagggcaaagaatcatgtaaagagtacatcaagagtttcttggcagccataccaatccgggaactacaggcggacatcaagaaaggactgatggcatcaaccccattgcaccaccgcctccagattgagttccagtacacccagtcgtccccaaaagagactgcatcagccactcagcttcttaccatggaggccccctttgagttctcatggcctgagccaccgccaacaatggaagtcacactaacacctgccgtctctgttgtgtagcttgtcaccctggtggccaagaacccaaagacatgagacaacggcctgccctgatgttcggcatggagaacccttttttccttggttccctgcgtgaagggggagcctagatgaagattttggttcttctgtttgtactaatttgtttaatatgaactgactactacgggttattcctcctgggcgtaggagcgttctacctgcttttttttttagcggtatcttccctcacctgctcgcttgacgcttgtaatcttttggaaccctgtatgactaatcgaggaggaattcccctttgttataatgaactagatgccggcttatctgtagatgtaacatgataatatggtgccaacaagcaagcagctacgagttctgaatctgctagttacaaggagc

SEQ ID NO: 18421 - DNA, 992 bp, Zea mays
ccacgcgtccgatgaggcagagttcaaaaaaaccgccggtgtgggcggacccgtgggtgagcgcactgctcctaatctaaaagccctggatcagtatgatgcactccaacaaaaggaaaaggaggttactgaaaggtttgaagcagctaggaaagaagaacgagagatatctgacaaatataactcagtcaagcaaaggaggtatgagctgtttatggaggccttcgatcacatatctaaaggcatcgacaaaatctataagcagctgacaaaaagccatacacatccactcggaggaacagcatatttaaatctagaaaatgaagacgaaccgtttctacatggaatcaagtacacagctatgccacctaccaagcggtttagagatatggaacagttatccggtggggagaagactgttgcagcactggctttgctttttgccattcacagttttaggccatcaccgttcttcatattggacgaagtagatgctgctctggacaatttaaatgtggccaaggttgccgggtttatcagatcaaaatcatgtgaacgtgttggtgatgaacaaggcagcgatggcgagagtggttttcagagcatagttatatctctgaaggacagtttctatgacaaggccgaggcacttgttggtgtttatagggactcagaacgaagttgctcgaggactctcaccttcgacctgagaaagtatagggaatcgtgaagcagcttttgttgaatgtttgtactatgtgtgtagttgcctgctccatcagcttgctagatagctgtcgtgagccttcgatgttttaactatctgtatactcctagtcctacataagtgctagctgaacaaggaccctgaaatattcatttggtaggtggataactgatgtttcgaacacgcataaacttttttacctgttgtatgaagccatttctccgaattactataatctgtttaattatttcgtggtgttcaattt

SEQ ID NO: 18422 - DNA, 7078 bp, Zea mays
  misc_feature (3901)..(3901): n is a, c, g, or t
  misc_feature (6322)..(6322): n is a, c, g, or t
tgcaggatcgaaatatcttcagatgtagagtcttatgcaagatattacaatcattatgatgttgtcaaggtactccagagacttgcactctcagatgcatatgtggatatatgcaggcaaataatggaatactggaaacatttactcggtagagttcagagtgagagatcaacaatattgaaagaagttggtacaagacatactccacaatccagcatgttgagttttactccaacaatgtcaggagatggaagtggctggacaactttaaaagatggtggggacagtaaaacagtagcacttcctcaaacaaatgtgcaacagaaaattttcgctaatcagtatacagtgtgctctgctgaacaaacggagaagaatgttgatgtttgcaagcaagctctgtcagctcagaacaacatacataatgcacctagaaatggagcttctggaccatttgtggcatcccccgtttctcatcagaatggatccattggaacgggtatgtctaacatagcacaagcacagccagctcatagtatatatcgtccagacttatccactgtttctgcaaagtcagaatcatttcgttcatctttgcaaggtaaacttcaccttcagatgtgtactgaaagacctggaaacatgagttgtggcaaggcagcaaagttgtcttcttttaaaccacaagcttacatggacctctacaatcatggcaacattgcagcatctgctgccgccaatctagctattattgcatccagtgaaggtaaggtttccacatcccaactgtccgcacaaccaaagaagaaggtggctgcaggcatgcctctacagttgaaagcattttcctcagcagtcgcacaatttgtttggccgagtactgaaaagaagcttatggaagttccaagagatagatgtggttggtgccttgcttgcagaagttcagcaagtggaaacaaaaaggcttgttttcttaacatgaccacatcaaacgctgctaaaagttctgctcgagttcttagcacaatgtgcgtaataaagatttctgacagccatttccccagtattgctgcttatttagccaacatggaggaaagtttgcgtggcctgttggttggttcactacaagacatgcagcagagagaacggtggcgtgaacaacttgaagaagcttccaactgcagaactgtaatacccctcttgcttgaggtgagttacaggatggcatcctttggtacctctcaatattctacaactgagttgtgataagcatatcactgtgaatgccggcagtgttaaagtcgtataaaatagaataatatttttttcagtttcttatgcagcttgagctaggtacataatatccctgcatgcattttatttaataaatgaaattaactctaacgttagaaaataacagaagttgttccaataaggcaacaaatcattgatatttgactcagaaatatctggcgaggtgttttgtgaaatgaataattcagtaatgaaagatacagacatacagtaaatttactttgcactatgtaaagctaaacttgtttcactttgaactggtatatgcatgtattttcatttctcgacagtatatgccacattaagtttttcttttagcaagaccttatgaaatgagactttgtgggtttcaatcatgttatatgaggcaccatgaacttgaaggtttcattagatttgatatggtttcatgatgtatttgctctaactgctggaccgccttcctgtctgtttaagcttcccagggtatctcacgaagggaagttctatggttgcttgtttctatcctcttaatgtaatacacacggtcgtgcatgttctcagaaaaaagacgtaagctggtgtgaaacttgctttaacataataggtacaaaataaaaatagtttggtaaccctagtgcaaagggaaacaaagagtaatgtacctggtgtgaacagcatttttctcgaaagaaaattctcctaatagagtcactgcgataaatatacaagatacaacacaacagaacagaacagaaaagttgcatggtaatgtcaccatgaattcattgacacaaccatggtttttaaagcggtatggcaagacaaggcgttggaccgccgcctagacgcctaggcgacacctttaaaacagtggacacaactctggtacgattataagtactagatgatgtcttttgtaggtgaacaaagaggtgtggatatatagtactccctctgtttcaaaatgtaggacattttggcatttttagaaacatagcttttgctatgtatctagatatacattatgcctagataaatagtaaacacatttaaactatgtatttagaaatgccagaacgaactttcaatttggaatggagggagtagcgggttaatgcgataatattgtgtactaattacttttggagaatcaagtaagtatgcaaaaaatggttctggaagaaagataaataacctagctgaaggttattgccataaatacagtgaaaacgaattcgactgttgtattaaaatttgttacatattaatgcagttggaaagcaacatccgtggagtagcattttctgcaagctggttcaagccgatagacgattggcctgcggaatctccttgtccatcaacaggggcatctcgtcctgcacaacaccaaaaacgtggggctggcggaaggcgtggcagaagacgtttgttggtgtctgaacccggtactgttactgatgatgacaacagctggacttggtggaccggaggaaatataataaaacgtactttgcagaggggggctcttctacattcaaccataagaaaagctgctcgccaaggtattatgtgttttaactattagtagtcttatctgatcctctatcagtaatcagtattcagaacatgaacaagttcccgtgattttgtcacctacttaggtggtaagaaaaggttagcaggtttatcttatcatgaaggttctaattttccaagacgatctcggcaacttttctggagagcatgtgttggactaagccagacttcgtctcaacttgctctgcaggcttgcatttttgtcctgatgttgcaaagaaaataccttagcacaaacctaataaccatttttctcaggttagatatcttgatgctcacatcagatggaaggagttcatctctccagatcaaattccttcagatggaaaaagttctgacgctgacttttctgcactcagaaatgctgtactctgtgataaaaaaataatcgacaataagataagatacgcactgaagtttcccaaccaaaagcatcttcctgtccgtctgacaaaaaatatcttggaagcagaaagtgatcaggatgaaattagaaaaatgtggttttctgaaaaccacgtgccattgtacatgttacgggaatttgagcagcatgctgaggctagctccttgcctactccaggaattccggaatgttttaccaatttatacccaaggcgagtgaaagcacctgacagagatgttttttcatatctctttcacaagggagaagtctatccctgcgcgtcatgcaagaagggtgttctctacaggtttttctgcctcgcctcatatactgattaataattatacgtttattctttttaagatactgactttttgaattttgtttgatcacatgcagggatattgttaaatgcagctcttgtcaaggtatggatatatgtcttgctctttagatcatctttttccattcgtttcccttgcaatatccaagaagatatttgatcaatctctaatattttgaatactttagtcacaatgttgctatctaaaactaactttcaggtaattgtcataaagagtgtacatcaagatctgttgttancaaaggaggcagtactacttccagtttgatatgcaagttatgtctccagaagcgaaatcttatgctcactagttacaatacaaatgcaagttatatccagcatctacagaagaataatggccaacagccagtgaccgctcccagaaatgtctctaaggttagttcttcccattctgctgagcctgcccccaaagtggaagccgagccagtcacaaaggttaaggcacaacgagttggaaatgtggaagctacaacccagccagttctaaatgtgaaagcccagccacccgccaaagtggtaactcagaacatcactagtgtccaaaagacaaaagctaaaaagtcaaagtccgaaaaaccaacgaaggctaaaaaagttcaagcgatcacatatttcggtctcatatggaagaaaaataagaacgacaaggatgatggaagcgagttcagggcgaatgatgtaatccttaaaagcaaggatggtataggttcgtcaataaaaccaaaatgttgtctatgtgacaaagcatattctccggaattcctgtatgtacgctgtgagaggtgcaaaagtaagtttatttatcttcgctgtagcttggagaattatccttttttgcgttatgtttcacttcttttgttaacatctggaaattgcacgcttacagattggtttcatggtgattccttgcaacttgaagaagataggattggtgagttggttggataccgatgctgtaggtgccggaggagggccatccccccgtgtcctcattcagataattatgtaaagcctgaacccgaatttagtgagcaaacagttgcaacatcatcggtgtcaactatgctatccagtgggaagacttctgcttcagcagatcaggacccactgcttgcttcgtatggaatagttgaaccaatcggggaagagacaggggatgttgatttatcagcgaacacggcaagcattgccccgcgaggccgcccgggccgggctataagaagagcactagctaaaacttctggataccttgaccaagctggtaaatctgtgaatgagtattatgtccagaaccagaatacacctccaggcaatggaaacatcaatttcagccacacgaatgagatttccttttcggaggctgacagcgtgggcgcttcaggactactggggtgggatttttcgagaggaaccgcgtatgctgccccacctggtttcacttctaatcgccagcagaaccgcactagccgtggcagctttgtgccggacgagtgtgagcgtgagccccagacttatttctcgttcactgagctgcttgaggctgacgacgcacagcttgatgacaacgcgtttgggatagctactggtctgcaaggtgatgctaacggctccggaagctttgtccaacgaggagttggttttggtggtacgtctttcatggcagaagatggagcttcgaatatgaacgtgccaacaaatggtcccacgcctgaagaggtagcgtgccacaacggcacgaacactcagccgccacctgatcccagatgttctgtccgtgacctccgcacacaccggtagtgctctccctgggaaccgaggcgtgtagagcctgtcgagagcggcaactggagttgtggtggttgccgcgaatggtgatgatgagcctctaaacttcactgccagttgcaatggcaggtaaatccaacggcatcccatatacttaccggatttctcgttaccggtcgctgggttgctgctgtcatgatgtgctactgatttctcggatcatttcattatttgatctaatcttaaccatcatacagttagagtagcgattaccgcttgggggtttacactgtacatactgaaaggatgggtcgacgacgacgtaccatttccattctttaggctatttatttttttggggtgggagttttagagctaggatgctgctagcacatagcaacatggtatatgggtcgtctggtaaaaaaaaccatattattatgtaactgtattaaccttggttgtctcttctcgccttctgagatacaagtgtctcttggtcaagagtgggtggccgtttctatgcctatgcagctatgctccagtattgtcgcatttgcctaggtaaaataactaactccatggcatgcgatttatgttccattcttcctttagatgaattactctctccagccatcaacacaagcgaactttttggatgccgtttaatctgtgtggcatgcttctggatttcgtttcaaatcagaactgtcggaacctttttataggggcagcagtgtcgttttctactcaccttaattcgctctcaattcagcgttgggtagttttttcctcgtgttctcgtcggttcacgtattttcagtatgatttggtccctacggctttggcgtgcntgctcaggtcgcaagccagaaatagacaatgtagattataagagtatttactctattagtaccatctctggccatccatttcagaaaaaaaataacagttatagtacaacatacaaaatgtagattataagagtactttccatagtgaatttgaaaccataagggtttattgggggggcaaagtttttcaatatcacagttttacaatctacattgcggtgctctctgcacagaagcggacggtctgcgacctggcgcggggtttaggtttttctgcctgatggtcggacggtccgcgcgtgtgtaagggcggcgaaggtcgccggcggcgcctgaatctcactcccgggagggaccccgtcggggaggagagatcctaggtgttgtctaggttcggcaggccgacctagactcttctaatcgacgtagagtcgaagagaagcggagaatttggggattggaaggctaaactagaactagactagaactactcctaattgtacaaggaataaatgcgagataaactggttattaattcgattgataaatacaaatcggtcgtattcctctgtatttatagaggagggggcttggaccggttacaaacaaattcctcgagccaattccgtgaatctcgtcaacaaacacaacaagaaactcggaactctaatcggttctgcgcgcgcggaccgtccgacccacaggcgtggaccgtctggaccgtccgctcgcctgttttgaggctcaacatatgcc

SEQ ID NO: 18423 - DNA, 1186 bp, Zea mays
tttgtaatggctgctacgctggcttcagtgtgttctgttccactgacatctgtgctgctactctttgaattgaccaaggattacagaattctacttcctctaatgggagctgttggtttagcaatatgggtcccatctgttgtaaatcaatctggtagcaaagatacattcgaggcaacatcacctcgtcatggctattcgtcattgttacctcccacagataggaatgagacagattggaggcgacaagatggagacgatgtggaactcacaattctagacgttgatccctaccactatggtagtaacaatgaggagatgcttcttgatgacttgaaggtatcacaagcaatgacaaagcattatgtgaaggtcacacctacattcaccatcgaggagacaacaaggcttatgcaagagaagcagcaaagctgtgttgttgttgtagataatgaagattttcttgagggaattgtaacattaggtgaccttcgtcgtaaaggatttgtgccaagtgaaaactctgatagtacccaggcaaattcatcgaccgtggatgcaaattcttctcttgtgtcatcgtgccttactcgaggttttcagttccatggcaatgaaagaggtctggtgacctgctttccagatacagacctgagtactgccaaggttctcatggaagttaaaggtattaaacagcttccagtggtcaaacgtggtgctggccgtagaaatgatgggaggcgtaaggtccttggccttcttcattatgattcaataggatggtgcttaagggaagagcttgagcggtggaaggcaatataccagagagagaatttccagcagactgcagttaatgggcactgaatatgcaaaattgaaggcttgtttacctcgtagcgaagaagataagatacgaaatatataaagtgacattccgataaaactagggttaacttaggaacactgctgttaaagagtctcctcatcaaagtgtaaattcttgagttttgccaagatatgcattctgtatcaaacatacacgatgaggtttaagaggtgatcgatatataagagatgtgtcaaaaaaaaaaaaatgatgtcaaattccccggcgggctgctgaagttcggacacgaaatatgtacagtaacatgctttgttcctttctgggttcatttttgtgggt

SEQ ID NO: 18424 - DNA, 2521 bp, Zea mays
  misc_feature (2005)..(2005): n is a, c, g, or t
ttgtggcagccatcttttgctactatacactagcaatctgtttagatataaatatgtgataatacaatgtttgtcccataaatattatgccagactaatatgtttcttttattcctagctacatcagacattcttttctacctatacatctatgtatatatctcaattattgatattctatcatctgtacttcacttttacaaccttaaatcgaataaattttttatttctatcaatcaacagcatatgccaggtaattattacagcaaatttgcatgtttatcatctattttaattcaattatttttattaaaaacatttttataatgctatttttatacacattacattgcttacatgcgcgcgctggtttcgcacgcgagtgaccagtactttactactttacaaagcgcgacgtaaaagtacgacaccgttcgtccacgtcacctttaaaatttttagccgttcgatcagattttagcggccaagaatccctccgtgtatcaaatcctggaatagcctcgatggttccagacggcgaacgaacggggtgaggaaaaggacccaccggcctgctgtccattgctcctagaagcatcgcgtcgtggatcggctttctccgtgctccgcctcgtcggcctcatgccccgtagccccgactccccatctgccgcctccacctcatgggccgccgggtccaccctcgccgtccagcttggcgacatctttgaccgtggtggcgacgagctccgcctcctgcaccccctccgcctcctggccccttccgctgaggcccgcgtcggcgcgttcctgccatagtcggcaaccaataggagcgtaaaactggagctagggattgaagctgttgcaggtatagtgaagttctgttttgaatcctattttagcttgataatctttctcaacatcatgcaaagatatgaaagtcggtttccgttcaagattagtagctgctctgcatcgacggtgctcctccgaatgcattttttatttacacaatttctagcttggtaatcttctcaacaccatgcaaagatatgacagctggtttccgttcaagattagtagctgctctgcttcgacagtgctccttcgaatgcattttttatttacacaaatgttcttatttgaaacttcccaaatgtatgttactatgtctcagaagtgcatgtctggccttttcaggtacatgtcatatataaatggacatgggcaggcactcccgctgagggtgcttcttggcttcgtctgtagaggcttgctgatatttggcataggatattgttaatttgtgggtatgatgcatggattatttgagatctttgagcagataaagcaatcattatcatctcaaagggagggtattgatttcatggccgtgattccccctctcccagtcaaagccatccaagccgcaattacttcagggacagggtgttcactggggctagaaggattctgtttttattgcacgacacatgacaacatatccaagtagtccttgattgatttagcagcagggagtaagcgtcttgctaaaagtggctccacaggtgaacttaggtgagtgtttggttaccatgtatttccagatcaatgacatactaaaattgttctttgcacatataaatacaaaaaaataggtataggaaaagaaatgacatgcaacccaataaatctttttgtatttatttataagaaatgacagaaaaaatctccctcattaaaataagtgaaagaatctaacaaccactaattatcttccaaaaaatcaattattatttttgcaccaaattgtaacaatactgaaaccatattcctttcatctcattttatctgtttaacacaatgattttaataagttcaatatcacactgtaaagagtgaaccaatgatttgtcttagactacaggcgttagctctcttttgatactaaatccatattcctttcatcctttgatctcatttaatatgtttaatacattgnttttagtacgttcaacatcacactacaagcatggttattttttaaagatgcctaccatttttatcggtcagactatttcttcttaagttgttccacgacattaatatttaccaatctatacatccatacatcattcaccaatgctagatcttggtagcgagacaacgttcttcgatgtttttgatggtcatggaggtaatcacaatatatgccttttatgttccttgaattagactgcctacgaggaataccattatgccaagtatttatagaacctctctttaacatttcacaacctcatacggtcataccattgctttacttaggaagagtagctgtcaaattctgtacaaaatacccgcataatcaagttctcaaaagtgaagcctattcagttggtgacctaggtcctactgtcctaataaagcttaaatatttcccacgcgtccgcccccgcctccgccctcgcggccgaaatgctctgttgatagtggctttctaattcaacataatccc

SEQ ID NO: 18425 - DNA, 6340 bp, Zea mays
  misc_feature (1)..(1): n is a, c, g, or t
ngggaaaatagctgtcaaattctgtacaaaatacccgcataatcaagttctcaaagtgaagcctattcagttggtgacctaggtcctactgtcctaataaagcttaaatatttattatatgtatacaacaaacacaaagttgattgtgtaaatgctctgttgatagtggctttctaattcaacattatatccctataactgcatatctgtattgaatatgataatgttatctgcatttaaatggacctgtgggtaagactcatatgaatgaacagccgtctagaggccattttgtatttacattaaagatatccaaatctaatgaggtagaatggaacattcactattatcataccaagatctaccaaaatatagtgttccttatgcgcgctttcagactcgcgacaatccctttttaaacaaatattttgcatgccaaataactaatcctgagaaagtatagctcccatttttttggttgaagaaaacagaccaacctggccaaagagtcattaacttgattgattttgctgcagcgatcgtcttgctaaaagtggttgtacaggtgatcgcttgaaggaaactcagctgagtgtttggttactataaattttcaaattttttagtgattctggtcaccatacaatttttttaattaaggaaacacaagtttagacagagttctactgctttactttgaagaaagtgactttcgttctcaatgggcctaaagagaatacttgatttaaggcattacgccttgcctagctgctatttctaattagtaatctcactatattgtatgccgaacagacacttcatgtccaatgtgcataccatactatttccagtctaatgctctaattctaggacacaacaaacttcacaggcatcatgtatgtcatgttctactttgttaagacttaacaataatctataaaacaattgttatgataatggtgagtcaaaacctgcacttatgattctgcttaaagttcttcttgtatctttacataaagttccatttgtgaaaaaagatacaaatacaaatcagtccataaatgaaaatatatgtaccaactcactattttttccataattcaccaacaggttcaagaaggacacatgagtatccgagaaaaaactcccaagaaatcttcccaaaactgaatgttgccttctaccatcaacaacctttgaagttctagggtgtttatttttgtatgttctctacaattatgtgtgtatatatatatatatgcttcttcatccttttcaagacaatttttataaatataacaacttgatttcaaatgttgaaacacgataatttacctaactctatttagatgactatatgtatatcttactcaaaatgttatcacttatattacaatttttgcccacgcgcgcaggtcgtctgcgcgcgccagttactagttactccctccgtttctttttagttgtcgttggatagttcaattttgcactatccagcgacaactaaaacgaaacggagggagtattaccaaggttggtggcacagggacacgtgcccacgtccacgcgtggcaccgcggcggtcttcgacaccgacaagcaacgaattggtcgcgtaccgcaccaaactcgatgcgaatagagataaacatagcggataaagcattgagtctagcgatgggacccttacccgaatcggtagagtatgcagcttcactcacattgcaaggtgactccacggtagaggagcaattctgtctccctaggtcactacacgtgcctagtgagtccccgaactcctccatgtgacctctcagatcctcttggtcaatcgctgatggctcgcctgcgttgaactcgggattcaaccatggcagctactctcctctctcccttcgatttgctctggttgctaggcgctcggttagctagggatctcaacgaactcgctggataaccagatgggacgagattggttggcaaagattcggttgaggattccgcgtccagctgggtcacgagttcgtttcatgcccgaggaggaaggagatgaatctagtacatagggcccacatgacagtagtggagtctgacgtgcggtgctctgcggcgtggagctaagccaggcgaacggggacgacgaggtcaaactgggccgagcccaggaaagatgccccaagagtgaggagtggttcgcttatttttttttctgttttctgatttttttgttttattttcaagttccaaattcaaatccactttagagttgagattcaactttaaatgcacaatccagaaatctcaacatgattcaaatttcattttatctctccatttatttattattcaattcatctggacgaatgcttctaaatacagtttatgaaaggaatcatccgttcaataaattgaaaatattccctttttgagtttctaaaatttagagtttcaagttttaaattctagtttaaaattttaaatctaaattgagcaatcataattaaatattgccatatatatatatatattaggaaaaaaatatttcaaaggtgagaaaatccatattaaaggacactttacattttagattattagaattttttatctaaatcccaatactacgatttttaggtttacaacttgatcgccttatgcctatgatgagacctatcgtggccttccatcgatgtgactagtccttacggctctttaaagagttggatggttggacagagatgtcttcagcgtcctttggattgtacctaccttaatggatgcactcctagccaggcacgtgtgccggacacttagggtgccataattgtgttagccctgcatagaggttcaaggggcatttcagatcgtggtgctagaaagtcttatatggctagtatgacctatgtttgttttagctcagagcgactggggttcgagtaagcctagtctaagtgactaggttggctcttgctttctttgatctatggttgggagtcgactttgttgggataaccaggtcgaggtttgcttgggacaacaaaggttagggttgacctggttggtgtgactataggtcatgattgctatggttggggctgattcaattgggatgaccggatcaggggcgacctagttgggatgaccagttcgaggctattcgagatgatctgggttggtcccaacttggttggtgtgactatagccatgtccactcggagcgaccgaggttagtgccgcctggtcggagtgaataggtcagggtcaacctggtcgggatgattaggtcagggccgacttggtcgggatgaccaggtcatgcctcacctagttagagttgattaggccatctttggtctaaatcgagttttgtccattgtgctcttatcttagagtgagctcttggtctatcttgagctaccctcgatatgggtacacaactcatagctttcaatatgcacctagatatacattttatctagatacatttaaaaactatacacctagaaaatccacttataatttgaaatggatggagtattaaacaatataatatatcttacggatttggatagactaatgtacaattcaagttcatggcttataaatattttttcatgttgagtcattttaaaattctttaacaagatattattttatttacacttgactgtccagttgtggttttcgtttagaggatgattcttctcgctttgcatcttcatagcactccaaaaaatgtgaatgttttgtttggggactggatcagtaggtttgacgaaaaagacaaaaaaattgatcttaatgggatgtggtgcagggttatgggctctatgaaaaatagaaactcagcctgcattgataataatgtttgtaaaaatcttgcggttttcatttggaggatgattcttctcgctttgcatcttcgtagcactcccaaaaaatgtgaatgatttgtttggggattggatcagtagatttgacaaaaaagacaaaaagctgatcttaatgggatgtggtgcagtgttatgggttctatggaaaaatagaaactcagcctgctttgataataatgtttgtaaaaaccctgctgatgcacctaggctgttttgcagacagaggtggtaaaaaggaaggtggttgcaggaagcagaacaatcaaaaaggtggttaacgacactttcaatcgctatctcggctagtctccgatggatagacgtattacattttaagttcatctttctagtgatcgtttgtgtgtggttatctagttgttgatgtatttttgatgtcttcctgtgctgtaatagccttcttcaggcgtagttggtgtggtttcgctaaaacatcgtctgtgttcttttatggcccttagatatctcgtcttcttaggctggctccaacaacaaacagctatattgcccagctatttcatggtttacctgctccctgtattttacctggtcaacgatgggcctcctgtttgcaacagaacaggcaaactggctgtgaccattggtacaatctgtttttgcgccaaagaaacaaagtatgctattggtccaaaagaaatggttgttgtgccaaagacaagccaatttgcctgttctctctcctcgcatgcaatttgcctgggctagataactagtccattggatgcgctacagtaccagttgcaagctaaattagctttggctggccgaatgcctggcctattggagctagcctaagtaagtggttgcactagtagtattggttagagagacaccagtactataagatggtttgtcaaaattcaatggttgtgatacaacctgcctgacttaggcaatctccattagatctcttatcccatcccctaatctcatatttcaaacttcattgtacaaacaatgtcatctatagtttcatgtcccttagtttatccaacccactgaaaatagtcttaataagaaaaaggaaggcttcgaatgatcacatagtctacatggcccattaagagttgcctagtacgggccaaaatgtaaggagtaaatgaaatagctgggccatagagggaaccttcatcagtagtaagaacattatttgtaactacttcggttatctattagattctcactctaacatctcgttgcatacagttggagagatcagaatatactcaacagcagcttggtagtactttggaggatgcagtaaacatgaatgaattaaaatatcaggaacatgtagtagtggtacactggtaccatggtgaaattgtccatatgctaatcttttcgtacatacatcaaacaagaaggtttcgaatgactggatttgtgcagatatggatatacatatggtagcaagtttgatgtggggctgattgctcaagacaatagaattactgatgtgctccgacacaactctcgtacccaggctctgcatttgtgaagaactcatggttatggtatgaagtggaagggatggatgtgtttaagagtttccacaacaaccacattttcttccacttcagcatcaatatatatcctcacactaggaggacgaatggactttggtctgattgtggcatttgatctcttcgtaggaagcatgaggagatcaagcatagcagacaatgagggatcacttgaagagaaaagaagtacactcgctgcactaaataataatgaatttgatgctttgagtgtttgctggataaattgattaatgtgaattttgaatacggcaaataccttgaagacaactcgacatattaggggcctatttggttcatggctaattatgccacactctgcctaaggttagtcgttcgaattgaagaactaaccttaggcagaaaagttaggtaaaatgtggcaagttagtcagcgaaccaaacagaccctaaatgcggtgtagcaaacaatgagattcattgccggaaaggacaacattttaaggagacaaacataaaagggcagttacagcgccggcaaaagtaatgacggagaagtcttaccgctccttcgtcagattcctatcgttcttttcttttctactaggcgcgcatctgtctcgcaagtacccataggctttgctcgacatgggtacagttggtgcactatttggacttagcatctgctttgttccacatggctatagtgggggcaacaattggatttagctccctgataagctcatggctacaatggggactgggggacaacaattagatttagcttcctgatgagctctttttcatgtggttttagaaacaatgttttaaacttcaaatattcataaaactaatttattttaagtcagtaatagtaccacataatggcaatggccgagtatactt

SEQ ID NO: 18426 - DNA, 2459 bp, Zea mays
acgcccacgcgtccgcccacgcgtccgcccacgcgtccgaccgtggtggcgacgagctccgcctcctgcaccccctccgccttctggccccttccgctgaggcccgcgtcggcgcgttcctgccatagtcggcaaccaataggagcgtaaaactggagctagggattgaagctgttgcaggtacatgtcatatataaatggacatgggcaggcactcccgctgagggtgcttcttggcttcgtctgtagaggcttgctgatatttggcataggatattgttaatttgtgggtatgatgcatggattatttgagatctttgagcagataaagcaatcattatcatctcaaagggagggtattgatttcatggccgtgattccccctctcccagtcaaagccatccaagccgcaattacttcagggacagggtgttcactggggttagaaggattctgtttttattgcacgacacatgacaacatatccaagtagtccttgattgatttagcagcagggagtaagcgtcttgctaaaagtggctccacaggtgaacttagcgatcgtcttgctaaaagtggttgtacaggtgatcgcttgaaggaaactcaggttcaagaaggacacataagtatccgagaaaaaactcctcaaatcctggaatagcctcgatggttccagacggcgaacgaacggggtgaggaaaagaacccaccggcctgctgtccattgctcctagaagcatcgcgtcgtggatcggctttctccgtgctccacctcgtcggcctcatgccccgtagccccgactccccatctgccgcctccacctcatgggccgccgggtccaccctcgccgtccagcttggcgacatctttaccgtggtggcgacgagctccgcctcctgcaccccctccgcctcctggccccttccgctgaggcccgcgtcggcgcgttcctgccatagtcggcaaccaataggagcgtaaaactggagctagggtctcgagctcgtccggggccatgtcatatataaatggacatgggcaggcactcccgctgagggtgcttcttggcttcgtctgtagaggcttgctgatatttggcataggatattgttaatttgtgggtatgatgcatggattatttgagatctttgagcagataaagcaatcattatcatctcaaagggagggtattgatttcatggccgtgattccccctctcccagtcaaagccatccaagccgcaattacttcagggacagggtgttcactggggctagaaggattctgtttttattgcacgacacatgacaacatatccaagtagtccttgattgatttagcagcagggagtaagcgtcttgctaaaagtggctccacagcgatcgtcttgctaaaagtggttgtacaggtgatcgcttgaaggaaactcaggttcaagaaggacacatgagtatccgagaaaaaactcctcaaatcctggaatagcctcgatggttccagacggcgaacgaacggggtgaggaaaagaacccaccggcctgctgtccattgctcctagaagcatcgtgtcgtggatcggctttctccgtgctccacctcgtcggcctcatgccccgtagccccgactccccatctgccgcctccacctcatgggccgccgggtccaccctcgccgtccagcttggcgacatctttaccgtggtggcgacgagctccgcctcctgcaccccctccgcctcctcgccccttccgctgaggcccgcgtcggcgcgttcctgccatagtcggcaaccaataggagcgtaaaactggagctagggattgaagctgttgtaggtacatgtcatatataaatggacatgggcaggcactcccgctgagggtgcttcttggcttcgtctgtagaggcttgctgatatttggcataggatattgttaatttgtgggtatgatgcatggattatttgagatctttgaacagataaagcaatcattatcatctcaaagggagggtattgatttcatggccgtgattccccctctcccagtcaaagccatccaagccgcaattacttcagggacagggtgttcactggggctagaaggattatgtttttattgcacgacacatgacaacatatccaagtagtccttgattgatttagcagcagggagtaagcgtcttgctaaaagtggctccacaggtgaacttagcgatcgtcttgctaaaagtggttgtacaggtgatcgcttgaaggaaactcaggttcaaggacacatgagtatccgagaaaaaactcccaagaaatcttcccaaaactgaatgttgccttctaccatcaacaacctttgaagttctcgggtgtttatttttgtatgttctctacaattatgtgtatattgttctccgcgctgccggcccctgtcgatctttataaatataacaacttgattt

SEQ ID NO: 18427 - DNA, 800 bp, Zea mays
acagcggccgccaccgcggtgaacagcaaccaataggagcgtaaaactggagctagggattgaagctgttgtaggtacatgtcatatataaatggacatgggcaggcactcccgctgagggtgcttcttggcttcgtctgtagaggcttgctgatatttggcataggatattgttaatttgtgggtatgatgcatggattatttgagatctttgaacagataaagcaatcattatcatctcaaagggagggtattgatttcatggccgtgattccccctctcccagtcaaagccatccaagccgcaattacttcagggacagggtgttcactggggctagaaggattatgtttttattgcacgacacatgacaacatatccaagtagtccttgattgatttagcagcagggagtaagcgtcttgctaaaagtggctccacaggtgaacttagcgatcgtcttgctaaaagtggttgtacaggtgatcgcttgaaggaaactcaggttcaaggacacatgagtatccgagaaaaaactcccaagaaatcttcccaaaactgaatgttgccttctaccatcaacaacctttgaagttctcgggtgtttatttttgtatgttctctacaattatgtgtatatatatatatattcatccttttcaagacaatttttataaatataacaacttgattttcaaatgttgaaacacgataatttacctaactctatttagatggagtatatcttgtctgctaaaaaaaaaaaaaaaaaaaaaaaaaaaaaaaaaaactcgagagagg

SEQ ID NO: 18428 - DNA, 1336 bp, Zea mays
gtgaagctgtgcgtaggatcaatcaatctcaatctcaccttgggtagagaccgcgcgcagccccagccccagcctcatggccgacggggtgttctataaatagagttccttgcgcccgcccgggccgggcacaacacaagagctactactacagctcctcatctcaagtgtgtagacgagacagagagacactgagagagcgccatggccagcctccaagtcactcctacttcggcgttcactgagtggaacgagctgaagttcgaaggcctgtacctgttccacacgcccctgggctcaggcgccaaccaagctcgggtcatagacaacaaggcgccgattggcatcggtgccaccgtagttaacaactggacagtgtatgacgggccagggccgaacgcaaagctggttgcccgtgcacagggcttgcatatccaagccggcaactgggtcaactccttcagcctagtgttcgtggatcaaaggttcagtgggtccacgcttgaagtgaccgggatagtagttgaatccggggagtgggctattgttgggggcaccggtcagtttgccatggcaaacggtgtcatcttcaagaagttccatgagcagagaagcgaagggaacatcatacaactcaccatccatgctttctgtccggtgctcggaccgagaaagcgctcggccgcaaaagttggaccgtggggtgggagcggcgggtctccggtggacatcacggcagagccccagcgtctgaagagcatcaccgttgctactggcatcgccgtgacctcgattgccttctcctacgtcgactccgccggccaaacccaatctgctggtcgctggggcggttccggtggagaaactgagccggtgatccagctcggcgactccgaggtgctcacggagctgtccgggacgatcggcaacgtcgacggccacaccgtcataacctccatcaagttcgtcacaagcctcaagacctacggccctttcggagcatggggggacgggagtgacactccgttcgcgatccccgtgcagcaagggagtgccatcgttggcttcttcgcacgagctggggtctacctcgacgcccttggcgtttacgtgcgatccctgtgatgagactctcacgagaggggcagctagctgctctgctagctccaccggctttcatcgcgtcaccctccgttttatttcctactgctacttgttgtgtcttgaataatttcgataaataaaggactccgccagagattggcacttgaatcgatccaaaaaaaaaaaaaaaaaaccggggggggggccccgtccccattttcccttaagaagt

SEQ ID NO: 18429 - DNA, 1233 bp, Zea mays
atctcatctcccatgggtagagacaacacaagagctactgactactatatggggccctcgaggccggccgggccgggacgcacaacacaagagctactgactactatagctcctcatctcattctcaagtgtgtagccgagagagcgccatggccagcctccaagtcactcctacttcggcgttcactcagtggaatgagctgaagttcgaaggcctgtacttgttccacaagtaccagggctcaggcgccaaccaaactcaggtcataagcaacaaggcgccgattggcatcggtgccaccgtagttaacaactggacagtgtgtgacgggccagggccgaacgcaaagctcgttgcccgtgcacagggcttgcatatccaagccggcaactgggtcaactccttcagcctagtgttcgtggatcaaaggttcagtgggtccacgcttgaagtgaccgggatagtagttgaatccggggagtgggctattgttgggggcaccggtcagtttgccatggcaaacggtgtcatctccaagaagttacatgggaagaccagcgaaggggacatcatacaactcaccatccatgctttctgtccggtgctcggaccgacaaagcgctcggccacaaaagttggaccgtggggtgggagcggcgggtctccgatggacatcacggcagagccccagcgtctgaagagcatcaccgttgctactggcatcgccgtgacctcgattgccttctcctacgtcgactccgccggccaaacccaatctgctggtcgctggggcggttccggtggagaaactgagccggtgatccagctcggcgactccgaggtgctcacggagctgtccgggacgatcggcaacgtcgacggcctcaccgtcataacctccatcaagttcgtcacaagcctcaagacctacgggcctttcggagcatggggggacgggagtgacactccattcgcgatccccgtgcagcaagggagtgccatcgtcggcttcttcgcacgagctgggatctacctcgacgcccttggcgtttacgtgcgatccctgtgatgatgactctgacgacagaggcagctacctgctctgctccagtcaccctccgttttatttcctactgctacttgttgtgtcttgaataatttcgataaataaaggactccgccagagattggcacttgaatcgatccataaaaaaaaaaaaaaaaaagcggcc

SEQ ID NO: 18430 - DNA, 1316 bp, Zea mays
ctcaatctcaccttgggtagagaccgcgcgcaccccagccccagcctcatggccgacggggtgttctataaatagagttgccattgggtccctcgaggccggccgggacaacacaagagctactactacagctcctcatctcaagtgtgtagacgagagagagagactgagagagcgccatggccagcctccaagtgactcctacttcatcgttcactcagtggaacgagctgaagttcgaaggcctgtacctgttccacacacccctgggctcaggcgccaaccaagctcaggtcatagacaacaaggcgccgattggcatcggtgccaccgtagttaacaactgggcagtgtacgacgggccagggccgaacgcaaagctcgttgcccgtgcacagggcttgcatatccaagccggcaactgggtcaactccttcagcctagtgttcgtggatcaaaggttcagtgggtccacgcttgaagtgaccgggatagtagttgaatccggggagtgggctattgttgggggcactggtcagtttgccatggcaaacggtgtcatctccaagaagtttcatgagcagagaagcgaagggaacatcatacaactcaccatccatgctttctgtccggtgctcggaccgacaaagcgcttgtccacaaaagttggaccgtggggtgggagcggcgggtctccgatggacatcactgcagagccccagcgtctgaagagcatcaccgttgctactggcatcgccgtgacctcgattgcgttctcctacgtcgactccgccggccaaacccaatctgctggtcgctggggcggttccggtggagaaactgagccggtgatccagctcggcgactccgaggtgctcacggagctgtccgggacgatcggcaacgtcgacggcctcaccgtcataacctctatcaagttcgtcacaagcctcaagacctacgggcctttcggagcatggggggacgggagtgacactccattcacgatccccgtgcagcaagggagtgccatcgtcggcttcttcgcacgagctgggatctacctcgacgcagttggcgtttacgtgcgatccctgtgatgatgactgacgacagaggcagctacctgctctgctccaacggcttcatcgcgcggattccagtcaccctccgttttatttcctactgctacttgttgtgtcttgaataatttcgataaataaaggactccgccagagattggcacttagaatcgatccaaaaaaaaaaaaaaaaaaaaagcccgtgcaaaaaactcaaggagggggcgcgtgtac

SEQ ID NO: 18431 - DNA, 2343 bp, Zea mays
gtccggtggcactgtgacccatctgagtatattgtataatttagcaaaaaaatatgtagttctaaggactcaaacacacaacctaatgtataagagactaaaacacatacatctagccaatgcagctgtaattttattgtgttatatattaaattcttatacttaatatatgtaaactattattttttaaaataaaaaatgtaaccgtatcgtgcccgtaccaacactacggtcgagatggtggcctaggcacgacactatagccgtgtcgtgccaggcactggcactatactagccaggccgggtcgtgcctagaccgtgctttttcgtgtcgtgcctaggctggcccatcatgttagtgccaaatgaccctctatagtaacaccgtgacatgttcatgatacagtcaaaaatccttatcttataataaataatccaagcaacaattaatgaatacaatatttttacagaaacgtaatattattgttcgggggtctaagcgtgtagcatgtggagaaaactggcctgtccttgcaacacaacaaaagctggtgatataaagaactcgagcatgcagttggtgggcggtgcacatctctttaacccattgactgacctcgtccccaacccaaccctggtgaagctgtgcgtaggatcaatcaatctcaatctcaccttgggtagagaccgcgcgcagccccagccccagcctcatggccgacggggtgttctataaatagagttgcttgtcccctaccttcggacgcacaacacaagagctactactacagctcctcatctcaagtgtgtagacgagacagagagacactgagagagcgccatggccagcctccaagtcactcctacttcggcgttcactgagtggaacgagctgaagttcgaaggcctgtacctgttccacacgcccctgggctcaggcgccaaccaagctcgggtcatagacaacaaggcgccgattggcatcggtgccaccgtagttaacaactggacagtgtatgacgggccagggccgaacgcaaagctggttgcccgtgcacagggcttgcatatccaagccggcaactgggtcaactccttcagcctagtgttcgtggatcaaaggtaccggccggccttctgtatttgaggagcaaggcatatatatctctataattaattcattattaaatatgtttatatgtgtggtgcaggttcagtgggtccacgcttgaagtgaccgggatagtagttgaatccggggagtgggctattgttgggggcaccggtcagtttgccatggcaaacggtgtcatcttcaagaagttccatgagcagagaagcgaagggaacatcatacaactcaccatccatgctttctgtccggtgctcggaccgagaaaggcaagatatagatagatagatagacacaataaaaactaaatatatacatacatacatacatatgtttcttataatttttttgagggaggatatgatatatatatatatatatatatatatatatatatatatatatatatatatatatataaagttaccatatttacatgcatatatatgcagcgctcggccgcaaaagttggaccgtggggtgggagcggcgggtctccggtggacatcacggcagagccccagcgtctgaagagcatcaccgttgctactggcatcgccgtgacctcgattgccttctcctacgtcgactccgccggccaaacccaatctgctggtcgctggggcggttccggtggagaaactgagccggtggtaagtggacacgcacgcaaatgcattattagtatatgctcagctcgcgacggacggactctgaaattcctgcacgcccccgcagatccagctcggcgactcacggagctgtccgggacgatcggcatcgtcgacggccacaccgtcataacctccatcaagttcgtcacaagcctcaagacctacggccctttcggagcatggggggacgggagtgacactccgttcgcgatccccgtgcagcaagggagtgccatcgttggcttcttcgcacgagctggggtctacctcgacgcccttggcgtttacgtgcgatccctgtgatgagactctcacgagaggggcagctagctgctctgctagctccaccggctttcatcgcgtcaccctccgttttatttcctactgctacttgttgtgtcttgaataatttcgataaataaaggactccgccagagattggcacttgaatcgatccataaaaaaaaaaaaaaaatagtgcttcaagtttccaactccattaattgtccattagatttacaacactgtgtccaaccg

SEQ ID NO: 18432 - DNA, 1237 bp, Zea mays
  misc_feature (8)..(8): n is a, c, g, or t
  misc_feature (166)..(167): n is a, c, g, or t
  misc_feature (1237)..(1237): n is a, c, g, or t
cgtctctngtgccacagtactttatgattgtagagaaggtggagagagaactataagaatgtggttgcctacatttgggagattgcattgcagcattctggctaaacacctcctcacattcataccattgtgtgcctacgaaacccacatgattgggaaccgtcannagagaaagctggcttattgttgggaaagggtttaacattttgacacgtggtggctacaacattagcacgagaccattacctagaacatcctaatcgtaaattgacatgggaggctctgcagctgtatttggtgcagctaaagctttgggacaaatcaagcctcctggagtagaggttcactttatagtcgctgcctgtgaaaatatgatcagtggcacaggcatgaggcctggtgacattgtaactgcttccaatgggaagacaattgaggtaaataacactgacgcagaaggaaggctaacacttgctgatgctttggtctatgcttgcaaccaaggtgttgaaaagattattgatttggcaacgctgaccggcgcttgcgttgtcgcactcgggcctagcattgccgggattttcacgccgagcgacgagcttgccaaggaggttgccgctgcttccgaggtatccggcgagaagttctggagactgccgctggaagagagctactgggagtctatgaagtctggcgtggctgatatggtcaacactggcggcaggcagggaggttctattaccgccgcgctgttcctgaaacagttcgtcgacgacaaggtccagtggatgcacatcgacatggccgggccagtgtggagcgacaagaagcgggccgccaccgggttcggcgtttccaccctggtggagtgggttctcaacaactcgtcctcgtcgtgaacaaaacccataccccccctcgtatcacaatgcctttccatgcgtttttttttcctcctcttttgtgctaccattccatagttgcaaactgcagagcgcctcttggcatgccaagtgtgcgtgtggtaccgttgcgatagaataatcagcatgggtagtggtgtcgggtcctttccctgaaactgaaagaaagcagcggcgtgcctgtcgccttccggctgccgctgtggtcatgttgtgtaacgcgtctctgccgagtgaaataacgtttgttccttgtgtttgtgccccgcacaagcacaaaagaaaaaagcgtcggaactcaaatgaaaaaaaan

SEQ ID NO: 18433 - DNA, 2153 bp, Zea mays
gccggccgggctggcggggacgcaaccgcggccgatatataccaagcctccgcgctgcctctatggccaccgccgccgcatccaccaccacctccgccgccgtgctcgcctccaggctcctccgccgcctgccgcgccgcctcagcgtgtcccgcgcgccgcccgcggcacccgcgtcgtcgtcgtcgccgcgcagactaccgtccctcgcccgccacccgctcggtcaccgcacccggatggggcacaccgccgccgctgcggccgcggccgccgaacccgctctcggactcaccaagcccaacgccgtcgagccgcctcaggtcaccttttccgcgaaagacatcgaattctccgagtggaagggcgatattctcgctgtcgccgtcacggagaaggatctgtccaaggacgcggactccaaattcgagaatgccgtcttgaagaagctggacggccagctcggcggcctcctgtcggaggctgcggcggaggaagatttcaccgggaagacggggcaggcggtggtcctccgcctcgcggggcagggcttcaagagggtgggcctgatcggtcttggtcagagcgccccgtccaccgccgccgctagccgaggcctcggcgagtctgtcgcgtctgttgccaaggccgctcaagctagcagcgctgcaatcgttcttgcctcccccagtgggatccaggaagagttcaagctgactgctgcagcagcagttgcttctggaaccgtgctggggttgtatgaggacagcagatacaagtctgaatcgaaaaaggtgcacctgaaacaggttgatattattggactgggttctggtgcggaggtggatcagaaacttaagtatgctaatgatctttcgtcgggtgtgatattcggaagagagcttgtgaactctcctgcaaatgtccttacccctgctgtgcttgcggaggaggcgtcaaagatcgcttctacttacagtgatgtgttcactgccacagtactagatgtagagaaatgcaaagaactaaagatgggttcctacttgggagttgctgcagcttctgctaaccctcctcacttcatccatttgtgctacaaacccactgatgggaacgtcaagagaaagctggctattgttgggaagggtttaacttttgacagtggtggctacaacattaagaccgggccaggctgcagcatcgagctgatgaaatttgacatgggaggctctgcagctgtatttggtgcagctaaagctttgggacaaatcaagcctcctggagtagaggttcactttatagtcgctgcctgtgaaaatatgatcagtggcacaggcatgagacctggtgacattgtaactgcttccaatgggaagacaattgaggtaaataacactgacgcagaaggaaggctaacacttgctgatgctttggtctatgcttgcaaccaaggtgttgaaaagattattgatttggcaacgctgaccggcgcttgcgttgtcgcactcgggcctagcattgccgggattttcacgccgagcgacgagcttgccaaggaggttgccgctgcttccgaggtatccggcgagaagttctggagactcccgctggaagagagctactgggagtctatgaagtctggcgtggctgatatggtcaacactggcggcaggcagggaggttctattaccgccgcgctgttcctgaaacagttcgtcgacgacaaggtccagtggatgcacatcgacatggccgggccagtgtggagcgacaagaagcgggccgccaccgggttcggcgtttccaccctggtggagtgggttctcaacaactcgtcctcgtcgtgaacaaaacccatacccccctcgtatcacaatgcctttccatgcgtttttttttcctcctcttttgtgctaccattccatagttgcaaactgcagagcgcctcttggcatgccaagtgtgcgtgtggtaccgttgcgatagaataatcagcatgggtagtggtgtcgggtcctttccctgaaaccgcacgcgtccggtgctggtcgtggtcaagccgtgcctgtcgccttccggctgccgctgtggtcatgtgtaacgcgtctctgccggagtgaaataacgtttgttccttgtgtttgtgcccgcac

SEQ ID NO: 18434 - DNA, 2181 bp, Zea mays
ccacttcgtccgagatttcaccgggaagacggggcagtcggtggtcctccgcctcgcggggcagggcttcaagagggtgggcctgatcggtcttggtcagagcgccccgtccaccgccgccgctagccgaggcctcggcgagtctgtcgcgtctgttgccaaggccgctcaagctagcagcgctgcaatcgttcttgcctcccccagtgggatccaggaagagttcaagctgactgctgcagcagcagttgcttctggaaccgtgctggggttgtatgaggacagcagatacaaatctgaatcgaaaaaggtgcacctgaaacaggttgatattattggactgggttctggtgcggaggtggatcagaaacttaagtatgctaatgatctttcgtcgggtgtgatattcggaagagagcttgtgaactctcctgcaaatgtccttacccctgctgtgcttgcggaggaggcgtcaaagatcgcttctacttacagtgatgtgttcactgccacagtactagatgtagagaaatgcaaagaactaaagatgggttcctacttgggagttgctgcagcttctgctaaccctcctcacttcatccatttgtgctacaaacccactgatgggaacgtcaagagaaagctggctattgttgggaagggtttaacttttgacagtggtggctacaacattaagaccgggccaggctgcagcatcgagctgatgaaatttgacatgggaggctctgcagctgtatttggtgcagctaaagctttgggacaaatcaagcctcctggagtagaggttcactttatagtcgctgcctgtgaaaatatgatcagtggcacaggcatgagacctggtgacattgtaactgcttccaatgggaagacaattgaggtaaataacactgacgcagaaggaaggctaacacttgctgatgctttggtctatgcttgcaaccaaggtgttgaaaagattattgatttggcaacgctgaccggcgcttgcgttgtcgcactcgggcctagcattgccggaattttcacgccgagcgacgagcttgccaaggaggttgccgctgcttccgaggtatccggcgagaagttctggagactcccgctggaagagagctactgggagtctatgaagtctggcgtggctgatatggtcaacactggcggcaggcagggaggttctattaccgccgcgctgttcctgaaacagttcgtcgacgacaaggtccagtggatgcacatcgacatggccgggccagtgtggagcgacaagaagcgggccgccaccgggttcggcgtttccaccctggtggagtgggttctcaacaactcgtcctcgtcgtgaacaaaacccatacccccctcgtatcacaatgcctttccatgcgtttttattttccctcctcttttgtgctaccattccatagttgcaaactgcagagcgcctcttggcatgtgataccgttgtgatagaataatcagcatgggtagtggtgtcgggtcctcctttccctgaaagaaagcagcggcgtgctggtcgcggtcaagccatgcctgtcgccttccggctgccgctgtgggcatttgtaacgcgtctctgcccagtgaaataacgtttgttccttgtgtttgtgcccccgcccgaaagaaagctgcatcggaactgatcttcccgagactccttcctccggagacgttgcttttgcttccgtccgcagagcaccagttggaatctcatccgtctcgaactggggtgagccacgtagctcatgcgttttggacttgtggccaccacacaagtgtgtgtgagttggtgagcgtgacggactgatgagtgacagcgtggtacgtatgggcgtgtggccggcgtggcgcgaaactggccaccgggaagagccagacagacgttcctgtgaggagaaatcgtcacaggtgacgtgcccactgccaggttggctccacgttaagcgagccgtgtcacctaaaaagccacagcccaggaacgcccatgggccgcggaggcccttctagccccttctgcccgcaggcgggaagtcggcaggtcaccaaaaaacaccatggtgcactaatataaaaggataaaccggagaatggatgggttaaccaatgaaggtggtttttgctttttttttgactagtatt

SEQ ID NO: 18435 - DNA, 1005 bp, Zea mays
cccacgcgtccgccgtcgcgggggtttccacaatcagcactgcagttgatcgagacactacttgcaattgatccagcagatcgcttaacagcgtcttctgcattaagaagtgatttctttacaaccgaaccttttgcatgcgaaccatcaagtcttccaaaatatcctccaagcaaagagatagatgtgaaacgaagagacgaagaagccagacgtttaagagctgttggtggtagagctaatggtgatggagccaagaagacgagaacacgtgatcgacctaaggcagttccagctccagaggcaaatgctgaacttcaagtaaatattgataaaagaaggtttattactcatgcaaatgctaagagcaagagcgaaaagttccctcccccacatcaagatggtgcggttggtgtccccttggatgcttcaaatcatatggatccactatacgaacctccggacccatcttccttcagcactgtgttcacttacgagaaaggcgctgtgcctacttggtctggaccattggttgatcctgctgcagtggtgaaccaaaagggcaagcacaagtccgggcgctcatcgaaacagccggccactgcccgtgctcggtaagatcctaaggatcgatatttacaggtaaaaaataaggagacttcaacatggtgggaaaatactccatggcggcacctgcacgctgttttgcaaacgaggcatgcaatgataaagtagtttgttggttacctgttgtcatgtgagtgatttttttttctagacttcgtgtataggctggggagggagttgaagtagttacttctgtacattaggttttctttcctgctctttaagcagctggtgatgttagattcatttgaatggaagcttagatctctagtgttcccgccactacacccccttccattgtaacagtgtgttccctgcataatcagttcttatcaattcaattgaaatcgtaagttttggtgaagctttgatggatta

SEQ ID NO: 18436 - DNA, 1298 bp, Zea mays
cccagcgtccgcggccgcgtgggtgaagattgcagattttggtctcgcgtcgttcttcgacccacccccgcatccgccgacgccgggccgggtggtgaccctatggtaccgcccacccgaactgcttctcggcgcaacggattacggggtgggtgtggacctgtggagtgcagggtgtatcctggccgagttgctcgctgggaggccaattatgccaggacgaacagaggtggaacagctacataaaatttttaagttgtgtggctccccaacagaagaatattggaaaaagtcgaagctacctcatgctacaatatttaagcctcagcagccgtacagaaagcgaataagagagacgtttaaggattttccacaatcagcactgcagttgatcgagacactacttgcaattgatccagcagatcgcttaacagcgtcttctgcattaagaagtgatttctttacaaccgaaccttttgcatgcgagccatcgagtcttccaaaatatcctccaagcaaagaaatagatgtgaaaagaagagacgaagaagccagacgtttaagggctactggtggtagagctaacggtgatggagccaagaagacgagagcacgtgatcgacctaaggcagttccagctccagaggcaaatgctgaacttcaagtaaatatcgataaacgaaggttcgtcactcatgcagctaagagcaagagcgaaaagttccctcccccacatcaagatggtgcggttggtgtccctttggacacttcaaatcatatggacccactatatgagcctccagacccgtcttccttcagcactgtgttcacgcacgagaaaggcgctgtgcctacttggtccggaccattggttgatcctgctgcagtggtgaaccaaaagcggaagcacaagtttgggcgctcatcgaaacaaccggccactgcccgtgctcggtaagatcctaaggatcaatatttacaggtaaaaaaaaggagacttcaacatgggggaaatgctccatgcagctgttttgcaaacgaaaaatgcaatgataatgtattttgttggttacctgttgtcatgtgagtgattttttttctagacatcatgtataggctggggagggagttgaagtagttagttctgtatattaggttttctttcctgctctttaagcagctgcgtttgatgttagatttatttgaatggaagcttagatctctagcgtttcactacacccctttccattgtaacagtctgttgcctgcataatcagttatcaattcaacgcctgtgc

SEQ ID NO: 18437 - DNA, 1126 bp, Zea mays
aaaagcgcttccagcagctccagccagttttttttagaaaccggtttttaaaaactaagataaaaaaccagtttttgatgaccttgggcgcctcgaggccggccgggaatcgaccccaccgggccaccgttccttgccaactgccaagcatcaccgcgaaatctaataactcgttgctcttcgtcttcgctccgcgatcgatccaggagggggaagcagaaggagggatggcggagaacccgcagctgtttgggaatgggatgccggtgccgttctacagtgagatgttcgtcctcgcccgggatggcgtcgagttccacgtcgacaagatcccatcagctcctggtggtcatgtgaaaacaaaaggcacaatttacctgtctaatataaggatggtgtttgttgccaacaagcatgttggcaacttctttgcttttgatatgccactgttgtttgtgcacggtcagaagttcaatcagccaatatttcactgcaacaacatctctggattcgttgagccagttgttccagacaaccagaacagggccctgtactcaactcacaccttcaaggtcttgttcaaggacggcggctgtggtactttcgttcctctgttcctcaacctgactgcatctgtgcggcgctacaaccagtttgaaacccagtctgctgctagcatggcacctcgtgtggaccctctgcaagctgtgcagactcctgttgatgacatgatgcgtcatgcgtatgttgacccaaacgatcctaccaagatcttccttcagcaacctgcgccagaatcgcagctgaggaggaggaactaccacggcccagctgatgcaaattagcgcttggctggattggcagaactcatgctcaattaagtgctgtgtccatttgagcatttcacctatccttgtcgtttaccacaactgacttcaatattcgggtacccctgggtcctgtgaccttacatatatagtacataatgttgcgagttctcgcaatatgtaatgtacataagtggcgtgttcatatattattgctggagcctggagggtcaacttggatgtgggttgcttggatattgctgatctgctggtgctgcatgtttctctgcatctatcaa

SEQ ID NO: 18438 - DNA, 1087 bp, Zea mays
ggccgggccggcatagggtacgtcggcccggcccggccgggacgcgtccaggctcggaggctccaacagcacgacgcaaccgaccccaccttccctttacgcgaagaagcatcaccgcgagacgcgagtcgtcctcctctctgtcttcgctcggcgatctatcaaggagggtgagggggagatggcggagaatccgcagctgtttgggaacgggatgccggtgccgttctacggcgagatgttcgtcctcgtccgcgacggcgtcgagttccacgtcgacaagatcccgtcagctcctggaggtcatgtgaaaacaaaaggcacaatttacctgtccaatataaggatggtgtttgttgccagcaagcctgttggcaacttctttgcttttgatatgccactgttgtttgtgcatggtgagaagttcaatcagcccatatttcactgcaacaacatctctggattcgttgaaccagtcgttccagacaatcagaacagggccctgtactcaactcacaccttcaagatcttgttcaaggaaggcggctgtggtactttcgttcctctcttccttaacctgactgcatctgtgcggcgctacaatgagtttgaagcccagtctgctgctaacatggcaccgcgtgtggatcctctgcaagccgcgcagactcctgtcgatgatatgatgcgtcatgcgtatgttgacccaaatgatcctaccaagatttaccttcagcaacctgccccagaatcgcagctgaggaggagaaactaccacggcccagctgatgcgaattagcgcttgctggattggcaaaactcatggccaatgaactgttgtatctgtttgaacaatttatcacaactggcttcaatatccgggagcccccgtatactgcgaatctgtggccgttacatcgtacataatgttttgagttcgctcaataatgatgtacataagcagtggtgtactggtgtgttcaaataatattgtagtgttaagtcaaaaaaaaaaaaaaaagatttgctggtgtttcgtgattgctgcagacatagaaatcgtatatagttcaaatgatttgaatcg

SEQ ID NO: 18439 - DNA, 1085 bp, Zea mays
actcctatgggccattgggtacctcgaggccggccgggacgcgtccaggctccaacagcacgacgcaaccgaccccacattccctttacgcgaagaagcatcaccgcgagtcgtcctcctctctgtcttcgctcggcgatctatcaaggaggccaggagggtgagggggagatggcggagaacccgcagctgtttgggaacgggatgccggtgccgttctacggcgagatgttcgtcctcgtccgggacggcgtcgagttccacgtcgacaagatcccgtcagctcctggaggtcatgtgaaaacaaaaggcacaatttacctgtccaatataaggatggtgtttgttgccagcaagcctgttggcaacttctttgcttttgatatgccactgttgtttgtgcatggtgagaagttcaatcagcccatatttcactgcaacaacatctctggattcgttgaaccagtcgttccagacaatcagaacagggccctgtactcaactcacaccttcaagatcttgttcaaggaaggcggctgtggtactttcgttcctctcttccttaacctgactgcatctgtgcggcgctacaatgagtttgaagcccagtctgctgctaacatggcaccgcgtgtggatcctctgcaagctgtgcagactcctgtcgatgatatgatgcgtcatgcgtatgttgacccaaatgatcctaccaagatttaccttcagcaacctgccccagaatcgcagctgaggaggagaaactaccacggcccagctgatgcgaattagcgcttgctggattggcaaaactcatggccaatgaactgttgtatctgtttgaacattttatcacaactggcttcaatatccgggagcccccgtatactgcgagtctgtggccgttacatcgtacataatgttgtgagttcgctcaataatgatgtacataagcagtggtgtgttcaaataatattgtagtgttaagtaactgctccgtgttgctgatttgctggtgtttcgtgattgctgcagacatagaaatcgtatatagttcaaatgatttgaattgaatcatttttattttt

SEQ ID NO: 18440 - DNA, 1036 bp, Zea mays
agcagtggtaacaacgcagagtacgcgggcaaaatttttggcacacaggctatttccatcatcgaggttctcaatctggttagacagcaaactgagactacaaactgatcctatccttatcctagagtattctctctggcggcatggttatgaatatgctatttccaatcactatgatcgccattgtgtttgggaggaagtagcacaaaataaaaagctgaacaagttcaaccacacaataattgaccagcaatttgagttttatcaagcggatggactgacaaggttcaacccatcggatcccagcaggcttctaccaagctatgtccctgaaggctcttttatcgcaagagagcacacaccgatgtccaacttattttcctgcctgtggtacaatgaagttgatcgattcacacctcgtgaccagctcagctttgcatatacatacttaaaactgagaaggacaaatcctgacagaccattccgtctcaatatgtttaaggattgtgagagacgatcaatagcgaagctattccatcaccggacagaagagagacacaacagtgcacaattaacaagatgacacatccttcctagtgatggagggcagaagagagaggtcagggattgtattctttgatatagttcagctatccacaagactctccattgaaactttatgcccctgtctaggagtttgtactttatataatgcaagccttctttcctttgtcactccagtcctgcaggccagttcccgcctaacatttttttgcagttgacaaggcggattaggagtttctaactgtttggtttttctttgttctccgtaaatctctgtttattcttttgataatatggcccatggatgatctggggaagctatgagtgatcatggacttttcccagattgcccatgcacaatgtattattaccacacctaaaaaaaaaaaaaaaaaaaggccattgttctcctgcaattctgactgaaatgtaccatacacaactagtaaattactcaccccttacgcgagtc

SEQ ID NO: 18441 - DNA, 828 bp, Zea mays
  misc_feature (801)..(801): n is a, c, g, or t
cattgggtacctcgaggccggccgggagacccctcgccgccgcgtgcccccgcgttggagcccgatcttgctggacgtcgccgcattcccaaatccgttaggcaatggcgccccctctcctctcgccaccgctgctcgccgacgcgctcgcgacgctcccgcgtccgcggacgcgtgggcgcccaacgcggcaactgcccaccgtccggctcgccggagccgtacgtggcgaccggtggagctggagtgcgcggagaagggatctcagggtatttgccacttccacggaagcggatcgtgaaagggaggaggaggatgtcgccgacgattactattccgttctgggtgtgatgccagatgcaaccactgaggaaattaagaaggcatactacagttgcatgaaggagtgccaccctgaccttagtggggaccaccctgacgtgacaaacttctgcatgttcatcaacgaagtttactcggtgctgagcgatccagcacaacgtgcagtgtatgatgagatccatgggtacacagcaacagcaatcaaccctttctttgatgacaatgcaccgaaggatcatgtgtttgttgatgagtttacctgcattggatgtaaaaactgtgccaatatttgccctggagtctttcaaattgaggaagactttgggaggtcaagagtctattcccagtcaggtagcacagagctaattcaggatgccattgatagttgcccagttgattgtattcactggacttccgctgcacagctgtcactcctcgagaacgagatgcgtaaagtanagagggtgatggtggtttgatgcttgc

SEQ ID NO: 18442 - DNA, 1436 bp, Zea mays
tgggattctcgaggcgaaaacggcactgtccccgcaaagaaagcagacccctcgccgccgcgtgcctcctcgttggagcccgatcttgctggacgtcgccgcattccaaaattcgttaggcaatggcgccccctctcctctcgccaccgctgctcgccgacgcgctcgcgacgctgccacggtctttcctctgctcccgcccaacgcggcaactgccaaccgtcgggctcgccggagccgtacgtggcgaccgggggagatggagtgtgcggagaagggatcccagggtatttgccgcctccacggaagcggatcgtgaaaggtcggatgaggatgtcgccgacgattactattccgttctgggtgtgatgccagatgcaacccctgaggaaattaagaaggcatactacagttgcatgaaggagtgccaccctgaccttagcggggaccaccctgacgtgacaaacttctgcatgttcatcaacgaagtttactcggtgttgagcgatccagcacagcgtgcagtgtatgatgagatccatgggtacacagcaacagcaatcaaccctttctttgatgacagtgcaccgaaggatcatgtgttcgtcgacgagtttacctgcattggatgtaaaaactgtgccaatatttgccctggagtctttcaaattgaggaagactttgggaggtcaagagtctattcccagtcaggtagcacagagctaattcaggatgccattgatagttgcccagttgattgtattcactggacttccgctgcacagctgtcactcctcgagaacgagatgcgtagagtagagagggtgaatgttggtttgatgcttgctggtatgggagcttccatcaatgttttccggatggcaagtgttcgttgggaaaagaggcaagcaaaagtcctggagaaagccagaacacggatggtgaaacaggagacgtcagacacgaggagctcttggagcgaggtctgggcatcatccccaccacgagacgaccaaagcaacggcgatggggaagcatcggagagggccaagagagcggcagctgctgccaggcggtggcgagagttctccaggcgaggtgcggacaggcctccaacgcacaagcttcccgaggcagtgggcaacaaggattagtagtagtagtagtccatggaacagagagatacttggcaatgttggtttgatcatattggctaaatgtacagtgccattgtctgtagaggcttgcagtgccttcccagctagctttgcacgcactcatgtgctccatttgtaaaatctaggtgagtaggtatatagtgatgttgataacctgaacctgtacgtagaagacaacaagcacccagtgctgcagaacaaaggtcaaacatgtacaatacaatagaacgaatacaagtgtatacatacttccgctgt

SEQ ID NO: 18443 - DNA, 2612 bp, Zea mays
tctctggactctctcgtcctccaaatctagcgtctcctgcactaataaaaagttgcctcattgttaattttgcacctatcatgtaatgttattgtatggatgacaaaatttagagaacgttgttaaagataatgaaaatatatatgatgaaatgttttagagtgtgctgtaaatcacaaatgatatatttttagaggttgaaatttagagaatattactcaggacaggattagaaggcgcttggggggacctccaaagactcggtagccgtgacgggcgttgagatcttgctgaccaccctaatgcaatgcagtaaccacccccacccgtatgccgtatagcatgtgtacgagaagcagctctgctgcggaaggcgacggggataggacgatcatggattcgcgaaaaccatggactagagaaaaaaatggtgtgctggctggagcagcatgggagtctgccacggacaatacatcacgtcacgtcttgtctttttctcctttcactcccagttcctgccactcggtgacttggacgttggcggacctgaccacatgcccatctctggatctggtgaacgagaatccaaatggaaattaccgggcgccatattactgtaacccgttatcgtgcgctttggctttagtgcgtccgtgacgtcacctgttcatcccaaaagaaaaaccagagaggtcgagttgtagagctgagctgcagtggggaaggatgaggtgacttgagtacgtacagtacctggagcccccccgggtgaaatggctggcgaaattttcttgtactagcaccggtgagtgtgacttggtggatccactgcccagtgcctccgctgaatggggtccaagacgcaggtaaaaaaaaaaagaagggaagcaaaaagatctgcgagcgaggtagagtatccgtaaaagataaacgtgtcactttccggctgtcaattgagactaggcatccacgtagcgtggccaatcaattcgcttgggagtatgtgcgtgcctgtggctaaacaatcccggctaaaccctgatcgatcaggataccattaaggtcgctggcaccgccatttgggtgaaccttctagagcgggcgtttgtttagtgagagagacagggcgctacagtggccagtggccagtgagagaccgtgtgtctggcaggtggaccctgcgcactccctcgcaacgcacagcgggcgccggccaatcaggggcatggaagtcggagccccgccagccagagccagtttcaagagccccatgcgatggcctgccagacttgccagtgcccgtgtggctaggggacgcgtgcgaggacacgcggaggcggggcggggctcgtgtcccctgccgtgcgcacacacggcatcgcatgcacggacctactaggctgccacgcggggctcctgggaaggcgtgccgagccacgcgtactcctacgtacgctgcgctgccgcgggaacgggcccacccccgcttttattattccctctcgcagcgccagcggatggtgccattggtgccccccggctgtggcccttgtcccctcccctcctccgcccggtggtgatgatgacggcctctttggagcggtacggcaggctcgtgtcgtgggaggaatggacggaaataaccccccttccttcctttccctggattccgttcctccgcccaccgttcgcctagagtgtgggccccgttctggttctgtgggcagggccgttgatagaagaaccacgggctgcacggtgaagatgtgctgtgtagctgcaaacatcaaactactgtactagtacgagttattacggccgttctggttctgacggcgtgagtgaacggctggtttttggaccgagctgccgtacgcgctacgtgggcacacacgcgtcgcaagaagagcagccgacgggtttagggagacgcaccgtcgtgtacgtgtacaccacccaactagtactacgaagcaccgcgatgccgttacagcaggttattaataagtttattatcactcgccgcgtcccagcttctgtgcgcatgcacttgctccgcctccggtccggtcacaaccgcgacaccggaccagcccatcccggatccatacatggaccaaacacagcggcggctcgatgaccacggccacgcgccggtggtcagtgcccacgcccagcaggccggtccagacaagagccggcagcaggagcagccgccgccgccgccgccttcttcgttgaaccagacggcggcgaggctcctgcgcgaggccaccgtctcccgcccggacggcgagaagccggcgtcctcggacatcctggccttcgcgcgctccgtcgaccgcgtggactcgcctctcgagtagctttttttggcttgcccactctcagtcagctactggctcactggctttgtttcttttcttctccatcttgtgttcgcaccgtaataaaaggggcaacagtagtcaacactttcctccctatttcgatcgtcagtttgtttgtcattcctgttaaggtcgagggattactgcaggcttgtcattccattttcgcgatttcgaaaaagaaaactcaacaataatgtgtaaaaaaaaaaaaaagcggcc

SEQ ID NO: 18444 - DNA, 2836 bp, Zea mays
cggacgcggggtttccaagcaccacgccacccgtacacggtttccagcagagcattccggaaggagggggcgcgatgtggcacgaggcgcggcggtcggagcggaaggtccacgacctcatggacgcggcccgccgccgggcgcagcgccgagccgtctacctcgcccgccgccgcggcgacccgcagcaggcgctccaggtctccggcacgcggtgccgcgttcaccgcgacgacgccctgtaccaggccaccgaggaccagcagggattgcccccgcggccgggatagcaagatgttttgattgacagatttgatggccgtgcattgcttgattttatccgagactcgagctctcgcccttttcgagtccaagggaaatctgaagaagaggaagagttagaggaatttgttaattttgaacgttaccgggatttgattaagcatcgtcgcagaggattttctgatgaggccggtttgcagcatgttgtgcaagagttggaggcaaaagctcttcttccttttagctttgacaaaccacaatcctcacagcctcctgctagcaaaggcgcatattcacaggttggatactcatacaagggagacggaaatgaggaatctgaagacctagacagtgatgacgacgacgaagaggaagaagttgatgatgatgacaaggacttcagtagtgatgatagcagtgatgaacgaatggaaagtatagcgaaagaatttgggataaaaagatataactggcttgtttacatggataaaaaaaacaaagaacaggagaagaggcagaaagaaattgttaaaggcgacccatctataaaaaaaatgagccgtagagaaagaaggaaggcttctcagattgagcgggaaaaggagcgggaggcagcacgttctgttggaagggtatcttatcgtgatccttatagggaacaaaggagaagcccatcatatgaagcatattcaaggggcagaagatcaagatcgagatcaagatctcgttcaccatcccattctaggcgtcatggccgtgggatacatgctgaaagcaattattggagcaagcaaaaggctcctagggttgaatatattactgaatttggaggttccgatgataccagtgaaccaaaagtttcagggatctctccgccttcgtctccaatacgaattgacatacctaaccggttgtctggtggtcaaattcttgaggcacttcacagtgatcctgcctcttctttgtctgtggaacaggaaagaactgcaaaacttttgaaaccttcccccagtacatcatcagcattagctaaactaagcaaggttgcttctgggggaactggtaaaactccccagactgaaaagaaagaaacaccacaagaaagacttaagaggataatgagcaaacagcttaacaagcaaattaaaaaggacacggctgctgagattgccaagaaacgagaacaggaacgacaaaggcaggaaaaacttgctgaagttggtcgatacaagcgtcgtagccgcagtagaagtcttagccgttccccaccaagaaggcggcgatatagcagaagccgtagtaggagcagaagcccaagaaggtaccgatcccgctcgctctccagttcccggtcgccctctcgctctccaaggtaccgaagcaggtcaagacactgaaaatatccaggcagccactaacaaagtgccttgccatgttgtagttaatttattttatagactttttcattcctgcagcgatgtgtactcatgagaagcctccgtttttgttttcttagtcctattatcgacagtgtgtgttccttgtgtttcagaaggtttattctctgttcctcatggcttgcccctttcaagcaagcgtaattttagggcatgtttggccagaccagcttccaggccgaatttagtagtattgccaagcagttcttttattcagaacaactttgatcgagaatgctatcagcttcctcagctatctgcagcgcatgccgctggagtccccctccgttaacactgtagtcgttatagaggtgacagtgctccttttgtcactgcagcgctgccccctccgtagccccctaggtagcagcttctttctctctcaggctgcgtagccccctaggtagcagcttctttctctctcaggccgtatcccatgtgtgtccctagacactgttgaggaccggattctgtgcatacggttgtttgttagctgcgaaaaaatgatgatgaattagaaatagatatagaaaaatgatattatatagttgtagtaaggtataggggagaatttagaggaaactgctgcgggagataaaaatttaggggatgaaatgttgatgatgatatagggagagaaatttagaaggaaccgttgcggatagtctcatagagagcagtaggagacttaccaagcagtcgcttgcctggatactggggtctgggtttgaaccgacctcatcctgaaacgagctgaaagcgacctacagtactttcttttcttcaaagaggaccgacagtgatttgtgtcattcatgagatggtcattgccattaagatattggcagtgaccacaggtaaacaatggccccgtggtctccggacgtcggtcagatgccaaagctgacacaacgtacaccacttgaccatagagtgggctagctacaggggaaaaaaatctatctgaactctgaagaaagaatctttgattcaagtaaaaaaagctcctgctctgctgtagtcgactgcccgcacgtgagaacccaacggcttcctgccatgatggatgccgatgctgaccctcctctcctctggca

SEQ ID NO: 18445 - DNA, 2049 bp, Zea mays
aatagccaatatgttcagaagtctattcccgttcagcttgtagcagcttcctagtcctagggttagatttccaagcaccacgccacccgtacacggtttccagcagagcattccggaaggagggggcgcgatgtggcacgaggcgcggcggtcggagcggaaggtccacgacctcatggacgcggcccgccgccgggcgcagcgccgagccgtctacctcgcccgccgccgcggcgacccgcagcaggcgctccaggtctccggcacgcggtgccgcgttcaccgcgacgacgccctgtaccaggccaccgaggaccagcagggattgatacaatggaatggaaagcaagatgttttgattgacagatttgatggccgtgcattgcttgattttatccgagactcgagctctcgcccttttcgagtccaagggaaatctgaagaagaggaagagttagaggaatttgttaattttgaacgttaccgggatttgattaagcatcgtcgcagaggatgtcggtacctttttggtttctctgttctattgctgttgctgtagaaatttcatatcttgcatccatttacatcacttgagggattgtcctaatgcacactttatttgtttctaaattggtacagaaaaagggtgctatttcttaattcaaagcactagttaactgaacatttacctagcttcttttcacagtttctgatgaggccggtttgcagcatgttgtgcaagagttggaggcaaaagctcttcttccttttagctttgacaaaccacaatcctcacagcctcctgctagcaaaggcgcatattcacaggttggatactcatacaagggagacggaaatgaggaatctgaagacctagacagtgatgacgacgacgaagaggaagaagttgatgatgatgacaaggacttcagtagtgatgatagcagtgatgaacgaatggaaagtatagcgaaagaatttgggataaaaagatataactggcttgtttacatggataaaaaaaacaaagaacaggagaagaggcagaaagaaattgttaaaggcgacccatctataaaaaaaatgagccgtagagaaagaaggaaggcttctcagattgagcgggaaaaggagcgggaggcagcacgttctgttggaagggtatcttatcgtgatccttatagggaacaaaggagaagcccatcatatgaagcatattcaaggggcagaagatcaagatcgagatcaagatctcgttcaccatcccattctaggcgtcatggccgtgggatacatgctgaaagcaattattggagcaagcaaaaggctcctagggttgaatatattactgaatttggaggttccgatgataccagtgaaccaaaagtttcagggatctctccgccttcgtctccaatacgaattgacatacctaaccggttgtctggtggtcaaattcttgaggcacttcacagtgatcctgcctcttctttgtctgtggaacaggaaagaactgcaaaacttttgaaaccttcccccagtacatcatcagcattagctaaactaagcaaggttgcttctgggggaactggtaaaactccccagactgaaaagaaagaaacaccacaagaaagacttaagaggataatgagcaaacagcttaacaagcaaattaaaaaggacacggctgctgagattgccaagaaacgagaacagaaacgacaaaggcaggaaaaacttgctgaagttggtcgatacaagcgtcgtagccgcagtagaagtcttagccgttccccaccaagaaggcggcgatatagcagaagccgtagtaggagcaaaagcccaagaaggtaccgatcccgctcgctctccagttcccggtcgccctctcgctctccaaggtaccgaagcaggtcaagacactgaaaatatccaggcagccactaacaaagtgccttgccatgttgtagttaatttattttatagactttttcattcctgcagcgatgtgtactcatgagaagcctccgtttttgttttcttagtcct

SEQ ID NO: 18446 - DNA, 6178 bp, Zea mays
caaaaagctccgctctccaccgccgcaccgaacgagaaaatcgtcccgaaacggtagacccgtggcgttcacgctgccggtgccgggcacgccgacggcagaaacgattttgcatgttggaaagtaacgagccccgttctggtcgtttcccgaaggattcgacggggggttggggaggattggacggagcacggaggagttcttcccgtggcccgtggtctggctgtctgacggcgcggccggtgcgctgtggcctgcagataacgctttttctagtcggtcccggtacgctagaggctagatagacgcgacggcggggccacgcgtccaggcgaggggaggggaggcttcgcgaatcgaatcgcgcgataaaacctgcggcccgccgcccatcccgccatcctgatccgctcgctcccaaatcctactgccgtgcgcgtcccgctcctgcggctgcgccccccgcgaggagaaagccggttagccacagccccacacgcgcgcatcacgccacaaccacaccacacggcaccagcctcctccgtcgtcaccgcctcgggcctcggccgatcgatcgggtctggcggcggccacaagcgtcgctgtttaataaatagccctgagcggcctccccctgcccctcagttcagcctcggctggacatcgagtttgtaccgggtgagctctctctctctctctcctttttgggatccttttccccgttcaatcctcctattgttttggcgccgagatcgaatcgctgggaggcccaatcgtcctcgggagcacgaaagctgtagttgtagctagtgttggcctgcgcaaccaatcgccaggtccccgccctcttcgttctaagcgcggcgcttctccgcccggttgctcctcctacggagtcggctccgtcctactacaccgtttcccccccaaattttctggcttttctgggcgatgatggccttaccgcccgccgccgcctcttgcgttggctggttacccgcgccctgagttcctgcaatttttttcttttgtatttctgattgctcaccttctttgttgtttgcgacgaccgtccggaaacacgacggaacgggggcttctacctcgagaaagctccccatgttcccatcgccttgtacttgcggctgcctagttagtacttcccctcgaacatgtttggcgcagttctctcagctgcaaatcacagatacgctagtgtgtgtcgagtacccagagttttcccttctctagaaaacatctctatctcgagtatgttgcgagtccttcatgccgtgggttctcggatcaactttaggctgaacacgggtattgtgggtgggtttgtcacaagacatgtcaggtcaggtgcctagtcctggtccacacggtctgttgtgggctcattcctgttgttgccgtttggattatctttttttttttttgacgagactagttttttttatatatgttcccttgctaaggactatatgcctatccgatccgcattagtccttctagatttatctaccattctcgggcacagttgttgtactgcaaggcttgatgattcaaaagctgtcgtcttatgtaagctgccatgtcattgcaggaaacagcttggtagtataaccactgaagatggtcagtgggaggccgcatggtgaattggactcatggttcaagagcctcatggtgacctctagcagcgagagggggcaggctgggagtggtggtccagcgccaacattaacaggatggaaggaccttccgatggagctcctggtgcggataatatccacagttggagatgataggatggtcatcgtggcgtctggtgtttgcacaggctggcgtgacgcgctgggatggggggtcactaatctttcacttacatggtgagcaactccctttccctcgctccccctgtttagtcaatttggcagaatgttttgaatttgcttttaatggttgaaaaaactgtgcactagctgttgcctgttggattggatttaaaaaatatagtgacaattttgcaatattccttttggatccttccgaattatatggtgctgcaactaattagacaagttagcaatgtgtttcaggggaagtattaggaaattcctttgttttgtttaccatgttatgctatgcattgttctttcagtcaaagcttacacttcccaccttatcgtatgtttttaaaacgtttttacttgtggaagcaacctgaatatttttagctctattatacgagttctgatctgatattgctgtaggtctatggaacttgccattagatatccatatgcttgttccataagaagctttggaacgcaactggacctgctcattgactttccatttgctttccttaaaagaaaaccttctggtcttcggtccatggtttgtctaagttgccaagccacaaagttggtctcctttgatgtaagcgatatgtcatatgtgaggagtggagaaaaccaagtcaatgaatggcttcatctaccatggtagatttttagcttgcacagaaaacacatttgtaccaaattacacgaggaactttaagttgcctttaaacaaaatatctgcatccatcactaaccttgaggcccaatgcaatggattgaatcaacttcacccctggatgatttattgtagttaatactattttcatcctacttttagtttgaggacgtcaatttcttcctgcctttaactaacagcgaacccctctgtgcttgtgtgctggtgatatgcataccttttaaataacacactggctaacctgaaaagtgtatcacttgcaggtgcaaactgagcatcaataatttaatgatatctcttgcccacaagttcacgaacttgcaagttctcactctccggcaaaacaaacctcagcttgaagacagtgccgtagaggctgttgccaactactgccatgacctacgtgagttagacctcagcagaagcttcaggcttagtgaccgctccttgtatgcgctggcccatggatgcccacggcttacaagactgaacattagtggatgttccagtttcagcgacactgcgttgatttaccttacctgccgctgtaaaaacctcaagtgcctgaacttgtgtggatgcgtgaaggctgttactgacagagctttgcaggtactttccgttatatcaagttttgcgaaccatgtttctagtatgaaacttctacttagtttctatagttttggtgcaggctattgctcagaactgtgggcagctgcagtctttgaacctaggctggtgtgatgatgttacagataagggagtgaccagcttagcgtcaggatgccctgatctcagagccgtagacttgtgcggttgtgttcttataacaggtatttgatctgattatttagtggcttagttttcttttgtgcttgttggccgcagccagttaagtctatgatggcagtacttatagcctcgggggtaactgagcatatcaatatcagcatacttgcttatagcctctggggtaactgaacgttttctggggcagttgatcactgtatacaagagtgaatttgtttgctcttcactagatttcttcgtttgttcttcactagatatcggtgtttgttgttattatttctgactcttagactaagcacattgagtgtttgttcttcactagcttatactgagccttgagctccatagtcttctcatcttttcaattctccattgcagatgagagtgtggttgctcttgccaacggatgtccgcacctgcgctcgctgggcctctacttctgccagaacatcacggaccgcgccatgtactccctcgcaaacagccgcgtgaagagcaagcgtgggaggtgggatgcagtgaaagacgggctcgcgaacctcaacatcagccagtgcaccgccctgacgcccccggcggtgcaggccgtctgcgactccttcccggcgctgcacacctgccccgagaggcactccctcatcatcagtggctgcctcagcctcacgtcagtccactgcgcctgcgccctccacccacaccgtgccgggagagccctgatggccaaccatgcgtactaataaacatgttggtggctttgcgctgatagttctcgcgaatggggacgcatgcctggggggtgatggcgtcgtccaggtgtagaggaagctccctgtgtacataaactcgaaacttggcggtgtgataaggcactgctgtggtaggactttgtgtgataatcatggagtggcgaatttctagagaatggcatgtactccagtgctacctggacattgaccagaaaaaatgtggtatctagttgccttctgtgtaagggcggacgtgttgggatgttcatgcatttacattaatctgataccttaatctgactaaaatctagattaagttacatatcaaatcattactttaatctcataacttaatctttatttagattcttgaattgagctgaaagatctaatgtgtacttattttatggactgcctaaatgttgatgccaaatgcctggctctgttgaaaattttgcataggagaaaataatgaaggcaaatgcacggctctgttggagaaattacatatctaatcatttctgactcgtgatttgactgtgtacatgagcatccaaacaagatccaatgtgtattcattcatcgactctgtagggttgcacttttgcagtcagatctgcctaaatctcttgatggcgaatgcatggctctgttggaatttttgcgaaggaaacaaaagcctagagggattagactgttactttagaaattcacttcgacaggccctatctatactaggggaaactgaaaaccccaccctataagttacttggtttttgtgtatgtcccttaaagctagtttggcaacttaaatttcgtctgggattagagagggttgctcaatcccctccaatctcaaagggattcggattcccaaactaacttttttttttgcaaatgtaaaaaaacatgtaacacctgtatggttatgttgcaaaaccatcccaaccaatttaagaccatttctaagagactacgagggcattcaggtacattacgaattttggaagtaggaagcaagcaagtcacaagccatcttcagctatgaactgcgcttcttagaaatattgttgcattagtcatgttaggaaattacattttaattcagtgtgcatcttcggccagagatgttcatgttcatatttctcctggcttccagtttgctgaagatggaaaatcaccaaatcagggcttctagttagtcctgtgtagttaggaatcagcaatctactgattattataaattgtgttgttgctttcgaatcataaccttatcccatatgtatatggtttcacattgtgcttgtcatgttgttagcctgtcatttaattcaagttcatcattgcaatatgtatgtcgttgcaaacgaattcagtcatctaactgttatctgtgctgcccccattaacatcattttttgtttgaaagaatggcataaagctttacgtatgttattgtcatgatacatttgagttgactgaatgccttctctattgttcagcaggcagtgcacaactgggattcgattttacaagactcttcaagttttgctcactcttcttcagtttacagtagatcttagctgcacatgacgttcaaaatcacacctttactgtcctaattataagaggacgttattactgtcccaggtctgcacgcgtccaggcgcattgctggacggactcagtgcctgcttgtccagtcaattattttaggcatgtgtagccgtgtaggattagatgcaatctgctggttattctcatcagttgtagtatttttttttatgaatcactttccactttcagttaagaattgtgagaataaaatacttcctgcaaaggatgaccgatagtgtcttgctttgctggacaatctatatctatgtaacttatattaaagagcgaaattttattatttgagttgactactacttctagaatcagtgtgttagttcctgggaaagtgggaacttaactcctactccgaatttatgaattcaataatatctgttacttgcataggtgctatgaataacatgaatagatttagagcttaaaatgtcatcaaatac

SEQ ID NO: 18447 - DNA, 1837 bp, Zea mays
aggagaggctagatagacgcgacggccggggccacgcgtccaggcgaggcgaggggaggcttcgcgaatcgaatcgcacgagaccattaccggccccccccccatcccgacatcctgatccgctcgctcccaaatcctactgccgtgcgcgtcccgctcctgcggctgcgccccccgcgaggagaaagccggttagccacagccccacacgcgcgcatcacgccacaaccacaccacacggcaccagcctcctccgtcgtcaccgcctcgggcctcggccgatcgatcgggtctggcggcggccacaagcgtcgctgtttaataaatagccctgagcggcctccccctgcccctcagttcagcctcggctggacatcgagtttgtaccgggaaacagcttggtagtataaccactgaagatggtcagtgggaggccgcatggtgaattggactcatggttcaagagcctcatggtgacctctagcagcgagagggggcaggctgggagtggtggtccagcgccaacattaacaggatggaaggaccttccgatggagctcctggtgcggataatatccacagttggagatgataggatggtcatcgtggcgtctggtgtttgcacaggctggcgtgacgcgctgggatggggggtcactaatctttcacttacatggtgcaaactgagcatgaataatttaatgatatctcttgcccacaagttcacgaagttgcaagttctcactctccggcaaaacaaacctcagcttgaagacagtgccgtagaggctgttgccaactactgccatgacctacgtgagttagacctcagcagaagcttcaggcttagtgaccgctccttgtatgcgctggcccatggatgcccacggcttacaagactgaacattagtggatgttccagtttcagcgacactgcgttgatttaccttacctgccgctgtaaaaacctcaagtgcctgaacttgtgtggatgcgtgaaggctgttactgacagagctttgcaggctattgctcagaactgtgggcagctgcagtctttgaacctaggctggtgtgatgatgttacagataagggagtgaccagcttagcgtcaggatgccctgatctcagagccgtagacttgtgcggttgtgttcttataacagatgagagtgtggttgctcttgccaacggatgtccgcacctgcgctcgctgggcctctacttctgccagaacatcacggaccgcgccatgtactccctcgcaaacagccgcgtgaagagcaagcgtgggaggtgggatgcagtgaaagacgggctcgcgaacctcaacatcagccagtgcaccgccctgacgcccccggcggtgcaggccgtctgcgactccttcccggcgctgcacacctgccccgagaggcactccctcatcatcagtggctgcctcagcctcacgtcagtccactgcgcctgcgccctccacccacaccgtgccgggagagccctgatggccaaccatgcgtactaataaacatgttggtggctttgcgctgatagttctcgcgaatggggacgcatgcctggggggtgatggcgtcgtccaggtgtagaggaagctccctgtgtacataaactcgaaacttggcggtgtgataaggcactgctgtggtaggactttgtgtgataatcatggagtggcgaatttctagagaatggcatgtactccagtgctacctggacattgaccagaaaaaatgtggtatctagttgccttctgtgtaagggcaaaaaaaaaaggatgttcatgcattttcattaatctgataccttaatctgact

SEQ ID NO: 18448 - DNA, 1108 bp, Zea mays
  misc_feature (5)..(5): n is a, c, g, or t
  misc_feature (7)..(7): n is a, c, g, or t
acggngnggaagttcgagttacttcttaagaggaagccttccttggcaaggcctgaaagctggaacaaaaaaacaagagtatgacaagatcgagtgagaagaggatgctaacctcaattgaggccctgtgtagatcttatccatcagaattcgttacatatttccattattgccgctctttgcaatttgaagataagccagactacagctatttgaagaaaaattttcgggatttattcatccgtgaaggttaccagcctgattatgtatttgattggactgtatcaaggcaagctgcggacaataacagattgcgactgagtgggaagacaggtgggttggtgggaccatctgtggatcgggctgaacgagctgcagcaaaacaggatgttccacatagattcactggtccagctgatgcattggctaaaagaaccggctctggttctggtcattatggagaacacacaaagcacagaactctgttggattcccttatggcatccaatatgggtgttgactcggataaaagaaggcattcatcgtctcgcaatggaagcacatcaaggaaggctcttctgtcaagcaaccgaggttctggagaccccagtgaaccaaatcgcagcagccacctagttccgaccaccaccagcagcagccgtccatcgaccaatcaaaggcttcaccactcaactggacttgagggcaggaccccatcatttccaaaacctggaagaatcggctatgatgatcccacaatgaggagttttgaacgccttactattagcgcagagaggaggaaatgaatctttggaagagcaaacgatctgagctgctcccggcgagtatacttcactgaatggattctgtgctgtgcatggtgctgagctctgcacatagcggtgctcgttgattcttggcacagatgatttgagttatgtacctcggccgcgaccacgctaaagggtagcgaagcattttacaccccgctatgagggaccggggatcggctgcaatgtttaagccgtggtgatttaagatgatgttgactctaatacttatataatgacaatgaaaaaaagttccctagaaaaaaaaaaaaaaaaaa

SEQ ID NO: 18449 - DNA, 1064 bp, Zea mays
ggtggtttgttctcatgattcatgaatgtggcaggggagggccaatatgattttttggggtttgggaaaatgcacttaatattttcttttgatgccttgataatattgatttagcttcatcagataatgtgggtggctgggtgcttgaagtaactgaaattctttgttcttctgtcttaagtcatgttcaaggccatgatgattgctaaagaatttatttacaaccctgtgctgatgactaaagagctcatgtcacaacattttcccttatggcatccaatatgggtgttgactcggataaaagaaggcattcatcgtctcgcaatggaagcacatcaaggaaggctcttctgtcaagcaaccgaggttctggagaccccagtgaaccaaatcgcagcagccacctagttccgaccaccaccagcagcagccgtccatcgaccaatcaaaggcttcaccactcaactggacttgagggcaggaccccatcatttccaaaacctggaagaatcggctatgatgatcccacaatgaggagttttgaacgccttactattagcgcagagaggaggaaatgaatctttggaagagcaaacgatctgagctgctcccggcgagtatactttcactgaatggattctgtgctgtgcatggtgctgagctctgcacatagcggtgctcgttgattcttggcacagatgatttgagttatgtacattcgtttaactcttccaaaaggttagcgaagcattttacaccccgctatgagggaccggggatcggctgcaatgtttaagccgtggtgatttaagatgatgttgactctaatacttatataatgacaatgaaaaaaagttccctagactagcattaaaaaaaaaaaaaaaaaaaaaaaaaaaatagagggggggcaaaaaaaaaaagcggccatttgatgtgtttgtgaaagtaggattttcatctatgcaatggagtatagcagataactgtatgcataaggtcccgttggatcaattagctactaataatagttagctagctaagggcatgcacagtaagggagt

SEQ ID NO: 18450 - DNA, 2729 bp, Zea mays
  misc_feature (602)..(602): n is a, c, g, or t
aattcggcacgaggcaaaggggcaacgcgtccaaccggccggacctcaccggctcatccctcatcggctcgaggggccaagtccccaaccccggctgacgactgtgcccgtctccttccctgattcatccgcaagcccacccgtcggcgatcgtccatgacggaggatcgagcgcacaaggtcgccgacgagcccgccgcctcaggcaggcaaagacctgaaaggaagaagaggaagtgggatcaacccgcggaggacttggtctccgcggcggtgacggctgctgccgtgtcggggatgcctgtgatgaatttcggtgctcttcctggcgttgtactgcctggcgtcaccgcatatggagctgctacattgccaagtgtagtccctgttccgtattcattgccgccccatattgcaccatcggtgctccagaatgctgctgcagcagctcagaaattgagtcaggcaaaaataccagatgaggtcattgcacgggaaattgttataaacgatgcagatccatctgtgcgatataagcttacaaaacgacaaacacaagaagagattcagaaatgcacaaacactgtcatcattaccagggngaaaatatcaccctccaaatttacttcctgatggtgagaagcccctctatctacatatctctgctggatctcagttgaaagatactgctgagcgcattaaggcagttgatcgtgcagcttcaatgattgaggaaatattgaaacaaggaacaacctcagagtccatatcggtccctttctcctctagcactggacaagctgttcgtccttttagtgcctcagtttttttgggttttgatgcagatccatcattgaatatcacagctcgaatccgtggtccaaatgtatgactatgtgatcctggttttatttgatcattttgttactagcacatctcagttaattttgttaattactcaatttatgtgctgttgtctttcaattttttgaaagatctaatcataaagctttctctggcatcccaatttggatgggagaaactgcttttctgctgttggtgcttgtgctcttttgttattatataggatcagtacataaatcatatcatgaaagaaacaggggttactgttgtactaagaggaaaagattcggagaatcttggcagttgtcatagtgaagcctcacaacaacctctacacctatacctcacacccatgcatttaaagaacctagaagctgcaaaagttttggcagagaacctcctggatacagtagcagcagaattcggtgcttccagaatttcttcttcaaaagtatatggtgctgttccacctcctcagcagttgttagctggtgtcgacacctcaggaacgaaatcagatgttcactatattgtagggcccaatgtgttatcgggagctacacattcctttgcggcgactggagttattgctcctgttgttgctcctgcagtgacagtgcaatcaggggctccaacatattctggggttccactacccagtaacatggcctatcctattccaccagcaaacggtggggcattttacagtggttatggggacatttatccccaagcaactccgttgcagcagctggcattcacactcaagcatgcctcatcgtcggcaactcaggctgttccagtgacgtccacaccaacaagcatggctacaaaggggaactcaatcttggatgcggagatggataaacgatcccgaaggaaattccaggaactaccggtttcgaagggcccagcaacagaaagtcagaactcacaacaggggtccaaatttgttaagacaggtttagatagttcaggtaacattgggagctcatcaattgcacctccgaagaaagttcaccctggatcaaatggaatgcttccggcagaagaagcggatatgccatcacatctctctatatccactaagatgctaccaccacccctgaagagcatgctgccactgccacccagaagcatgcccccaccaccacctaagagcatgcctccaccgccaccaaaatttccttcagatgagtttttgtcaagaaacgagaacaagttttttcctttaaaggagccaacagcacctccaaggtcctttgatgcaatatcagtcttgccatctgaacgacgaccaagggagcctaaggaggaaaaaacaaaaggcacacctgtgtctgatactttgctgaaacttattgattatggagatgacgacgatgacgacgatattgatgtgacagacaacacacctaagggcaatccaactcctggttcagagcagaaaccattttgggctgtttaaaactgggtctgctaacgtagtctagtgtgaattcttgttgataaggatgcttgctgccttggtgcatcttctgaattgaagaggcaatcgagctccttgttcgtgtactgtagtaattctaacaggcaatgagatttctttgaacttgtattcattctggcgtagtcaaaatgaaccgtttgttgttttggttcagatacgatgatgtttcgtttttagattcgacgttggttgctgaactcgtagcattttattgtcggtattatgtaattgttagagcctatgtcaattttatatccactgtcgtgcaaatttaatttttgtaatcagcctaaggtcacgacattgcttggaaacactttttaatgaaggaaaatggcaggacatatggtatggt

SEQ ID NO: 18451 - DNA, 2873 bp, Zea mays
tcctttcttagcttagcttgtgccatctttttataccccatcaattcttaccaacacaacttccaaggcgatttcaatatcaggatttggaatttctggcatatttgcttttgtttgtaaattagatgtacactgttgctgtcaactatactaaaaactttgtatgccattgtgagtttgtgacatctattaacattaaaatattctgcataaaaacatttgcccttttgtttatgatggcaccatcaaacatgggaagcacttctaattatccaggagttttgatacaacacagcacatattccacatgcaattcatgatcttatgttttatacgtgtacctgaaagaatataatcatcttattgtttagtccttgtttagcactttggaaattaataactactgtataaatctactttctttgatggaactttgcttgctcttgtagttcttgcagttccctcaacggagactacaattcaaatttgacattactattaaaaacaatagttggattgtcagattggcatcatcatgtttgttgtattcttatacctgcttctaacatctcatttcattccaggtattttctctgaccttgtctgaagctcacaggtggcaatagatatacatgtgggtttttcacaggcttgtaacaaatcggagtttgcattggctgtggagtgtaactgacaagatgcagagctcttcaaatatcttgttacttttttcagcaaatagaaatttaacctttgtgttttatctgtttctgtttgcttacagagttcactgatgttgattaacattgctagcatgccttaagttttgaaattggttggttggtgtagtcttgttattagttgttgttagtaggttttgatacattttatttctttccactctttagagaaagttttgcatttgcaaaatcttctcattcagtggaagctccaagcaatataaatatacaaattacacaaggtccttccatatgaaacttcacttagttaagcagactcgactcatctttgttatgttattatagactctcccaaggtgaaaattatatttacagcgcatctgcttctatattaagataacattctgaacctgtcaagggtcatgctaactagtattgtgcttccatgtgagatatgcttatatttgttctgtgtgcaaaattgtttctgatttcattcttatgcatgccattgcgttacctactctataacacaagaatttgatggatgaatgttcttgttttctttcatctttccagaactcacaacaggggtccaaatttgttaagacaggtttagatagttcaggtaacattgggagctcatcaattgcacctccgaagaaagttcaccctggatcaaatggaatgcttccggcagaagaagcggatatgccatcacatctctctatatccactaagatgctaccaccacccctgaagagcatgctgccactgccacccagaagcatgcccccaccaccacctaagagcatgcctccaccgccaccaaaatttccttcagatgagtttttgtcaagaaacgagaacaagttttttcctttaaaggagccaacagcacctccaaggtcctttgatgcaatatcagtcttgccatctgaacgacgaccaagggagcctaaggaggaaaaaacaaaaggcacacctgtgtctggtaatattgcacactgtaatttactttgtgcgtaggatatggtttaacttcaataatttacgtattatctctggttgttcatttatagatactttgctgaaacttattgattatggagatgacgacgatgacgacgatattgatgtgacagacaacacacctaagggcaatccaactcctggttcagagcagaaaccattttgggctgtttaaaactgggtctgctaacgtagtctagtgtgaattcttgttgataaggatgcttgctgccttggtgcatcttctgaattgaagaggcaatcgagctccttgttcgtgtactgtagtaattctaacaggcaatgagatttctttgaacttgtattcattctggcctagtcaaaatgaaccgtttgttgttttggttcagatacgatgatgtttcgtttttagattcgacgttggttgctgaactcgtagcattttaatgtcggtattatataattgttagagcctatgtcaattttgtatccactgtcgtgcaaatttaatttttgtaatcagcctaaggtcacgacattgcttggaaacactttttttaatgaaggaaaatggcaggacatatggtatggtaatttttaattcgacttctccatgacatgttcaaattcaagccaccaggagtacattaacttatgtcaggattttagttagactatctgtaacgctctttcctaaaaaaaaattctctataccgcacactacgcagccacgccacttaaatttcactccctatttttctcctttgtgcaatggttcctcctaaattcttcacttatatctcactataataataaaatattattttctatttatatttatcattcattatcaattttttctatttttctctttcctgcaacggttcctcctaaatttttcccttatatcccactataataataaaatattattttctatttatatttatcattcattatcaaatttttttctcaagtaacaaatattggcgtgcacggaatccgagggaaggggcctacacagtacacctttgatggtgtgatgtcgagtgtagcaagagggtaggggacgggtagcgctcggtgctgcaccgtgcgtgtgtccctaaacatgtacaagcttagtgagaggcgacaaacgtcaagcgctgcagacag

SEQ ID NO: 18452 - DNA, 4728 bp, Zea mays
  misc_feature (3522)..(3522): n is a, c, g, or t
aagcatctaagctttaaataattttaatatcaaatctctttattattcatagcatgaaaggacttcaatgttatatgatattcctctgatgagtttattttactttcgattctgacagcgcttccaactgccataatggaatttttttttggaacttcagactaccacacacagttttattcttgccagggaaaaaactggttctgccgtacaaagaatcacaaagttccatagaaactaaaaaaatgttaaacccaaagcaacattgcacaacctttgatcgcttactgatgttcgtctatgttgacagcaattcaactcccatgtagataaataccatgatatggtcttagtttggacatggcacgcatggtccgtacgtctacgtctttcttcgtcacgaaaactgtatgctgaaacccttctcagttttggtggcatccatactaccaaactcatcaaagtcaacccgagagacaccatccctgtaattaccccattcttcagttgagctgtcatcatcctcgtcctttgatgccgggacatgtaatccttctataggtgccggcaagggctcttcggtaaagtaccgatcattcagcagatcaacagcactggtcctctttgctgtgtcatagcaaattagctgctttatgatgctaacctcagtaggagatctgttaggcagacatgcttcaaggcctgtcggtttctcaactttgttaaaggaaatcttgttgtaatctggcaagtttgaacagcctggaaaggtttcttctgttatatcgcccaggacattgatgattctactaatctgatcaatatcagatatccctgggaacaaagcctccaatttcatcagttctgccaaaatgcatccaagcgaccagagatcaatctctagcccatagtttgttgacccatataaaagctcaggagccctgaaccacctagtgccaacacaagaagtgaaggcaccagaatcttcacctatgccttccatatcgtcagagtaggaggctgggtatggatcatcttcaatgtctcctgtgctgcacgtggcaagacaggatgcatgttcatcctgaaagctcattttgtcaacatcgctggatttttctcggagttggtccagttcacgcaggtagtcagcagcagttagggtctctggctcctgaccagcagtagcatctgattcataagatgttggttcctcttctgtcccttgtagcactgctggttgttgttgtggaacccatgtttccatgcctgaactttgctcgtgtgggtacatttcttgaaatgtaggtgctgactgctgaagtatcctagcctgagtatgtgtcaacaaaagcaaatttggtcaagctccaaccaattgaaacagaggtcacaaatataccattgactctcagagaacatgagtacacttacaggacacaagtttaacttcggcacttcttgcttagaatggtacaaaaaaataaccagaactaatgccttatattattgctagttaatcttcttaattgttagatgtcaccaggtcgtgagttcgaagcagcctctccgtattcacgacctcggtttattactttcacaaaccccaatcatgtgggagtcactagcactaggtttacccttgcactgggtttatccagggtttacctgttaaatgtcacctttgtgatgaaggcgaagaaacaattgagcgtttactgaatcacatgtgtctttgcaaagcaattctggttggccttcaggatctatagccacagcttggatatacttccttggatgactatttggcaaggataaattatacagttaaatggtcctgcccaaaaagagcttacttcccttgttctcttaggaccaggcagatctggaaacattgcaattgatgtgtttttatggtatttctcctaatctagatggagcgcttgtctttgttagtgaggatttgcaaatatggggtatgaatgtggctcaaggtatctcctacctgcttgcttttgcaccagaggaagggtatgcattggtcaaagttattaatatagtagccaagggtgcaaatgtaatcttagaactttctctgtgtgcaggtgtcttgtaagggatcttaccactttttcttctttaatatgatgaaattcagctctcttgagagttcaaggaaaaggataatgccttatatttttgaaattgtgaaacaaaacctgttgcgtgatttgttataaaagagaatctgtttcatgaacaagcacgaagctcagcaatcaaaatctttgaatctccaccactattgacatgcttgttgacacttgaagagttacttatttcagtgtggaaccaagaaactaaacaaagtttgatgttttgtgaaatagatttaatctatgtgcgcaattttttcatttatacaaatcctggatcaaattgcctttggtgagcagaactacattgttgttacagtacctgtgtagcacaaaagacaatgtgagttggcttgggctctagaaatttcttgcattggactcccaatcatgcaaaaaaaaaaacagaagaaaatagagttgggcagaaaatcgaagaaaattgagttgggcacatgagtactaggtaggatcaggtaagatagaacaaattgagaaatttcacattgggaagcaagggatgagaagtatttgcaaacacatattttgttaaaacagttgtcaattattcaaaaacagaaaaagtaataaatccagacaaaagctgaagaatcaaatatctctaactaccacaccattgcacgtcgatcacattatagatgtaatcaaccaattatcattctgttacttccttatatgcatgtgcacacaatatatgaagcctccaataagattgctataaacaaagtgcataatctttccagctttacaagtgcatagtctttccagctaatttagacgaccaacatataaaactaaataattgttccagctctacaagtgcataatcttttgtccttccacaaccatgtccctccagacacttaaattgcttctcattagttgtaccttaaaagtcatatgcccaaaggccattaaatcgtatgtaaaatcaaatacatctttgcaaacctataacttaagtatagtatatagttgcatcaacattttattaatcatatgcaacaccttgccgctacacaaaatgtaaagaagcaaataatcaaatcccattgaaaaacaaacacttaacgcttcatattacaagcattgaatagttatcattgctagctattagcaaatttcagttcataaaccgctaatttctaggttatcaaactagtcctctctgcaacatataaggtaaccaggtgcttttgtttttataactaaggtgcccagttatatgtcagcagcagcatcgacacctctactgaactggtggctcaggtgactataccagaagggacacgaagaggggggagagccagacggccgtgcgagcacgcaaagagtcccaactagntgacataacagatggcacacacgtgctccgagggaggactatttagtgagagttaagttagaagagaggaaacaaaaatatattatcaagaactcgattgtaacttgacctctgaagtaaaatcatctaaacctattctcctgatgtctaccttcctcaattcctatgctaacactacaacaatcgttcagttcaagtgaacttttttgctgaaatacaagtatgtttctcaagttatgaccctccctaactgaaaactaaccagttgtagctatctgcaggtgctagctacaaacattgttaaaaactgcagagcggctccctttgatgtctaacaaccaacgtaacaggggaaagaaatatgaacgtcaatccagcaaattcaacatatcatgtacagataacttaacattattcccaccactaattatcaacagatataccagtgaaacaatgtcactactactgagtgaaaacagatgattcacatgcaaacactaattacttcaaatctacaagccttcccaagccacatactctctgctcgcgccggttcatctcttgaaatgtaggtgctgactgctgaagtatcctagcctgaccaaaatcggcgactttgagcaccccgtcttcggagatgagcaggttctcaggcttcaggtcacggtgcacgacgccggcgcggtggcacgcggcgaccccctcaagcacctgcagcatccaccgtttgagttgcgaggcggggatgccttcccctccctcgcccccgcccgcgcgcctcctcgcgtcacgcacaacggcggcgaggtcgagcgggagccactcgaggacgaggacgtcgtcgtcgcaatcgccgccggggaagtggtcgatgagtgcgacaacgttgggggaagggggaatggcgaggagagcctcgacctcgctgcgagcgctgacagcgtcgtggacctccttgagcgcgacagcagcaccgtcggatcggcggcggccgcggtagacatcagcataggaaccggagcccgcacggccgaggacctcgtagcgggatgtgacatcagcgcggccgtggatgctccagctcccgccgccgccgacgatcgccataggtgtgggatttgggaaaaggatttgtattctattttgaccgagagaacatatacggtgtacatagaaatttggtgcacactattatattaaatcatc

SEQ ID NO: 18453 - DNA, 1863 bp, Zea mays
cccccaccccggcggctcttctccaatccaaattggtaaatttcccaaatccggtgcccccacaccggcatcctcacctcgtcagcgccgccggccttccttccattctccatccccgctcagtcggataggcgccggttggggaaaattctgttcggactgttcatcttgtcggcatgtctcattatcacagcgccgattttgaagagatggaggatgagtacgacatgaacgagccagtcgatgacatggagggggaggatgagtaccaagagctcgtgattagggactctgatgcggaggatgaagacgatgcggaccaattgcataagctctccgacacttcagcagcagatgcaagaagtgggaaagatattcaaggaataccctgggagacgatagaagtcacaagagaaacgtacaggcaggcccgactagagcagtacaagaactacgagaacatacctaattctggagtagcagcaatgatggcatgcaaatcaaccgagaaaggaagaacatattatgaattcagacgaaatactagatctgtgaaatccactatctctcactttcagctgagaaatttagtatgggcaacatcgaagcatgatgtctacctgttattgcattactctgtacttcactggtcggccttaaatggtgtggatacagaaattatggatgtacatggacatgttgcaccgagtgagaagcacccaggaagcttattagaaggttttttgcatacccaaattagtaccatggcagtgaaggataatttgttagtagctggtggttttcagggagagctaatatgcaaacacctagatcgagaaggaataagcttttgctgcaggacaacatatgatgataatgcaattaccaatgcattggagatattcaatacatctagtggagctcttcacttcattgcctcggacttcggctcgggggtaagagagtatgatatggaaagatatcagttgtttaagcatttccgattcgattggccagtgaatcacacgtcattgagccctgatggaaagcttgttattattgttggtgatgacacagatgctttacttattgatgctaattcaggaaagactattcattccatgaaaggtcacttggatttctcctttgcttcggcttggagcccagatggcctgacattcgccactggtaaccaagacaaaacttgtcggatttgggatgccaggaatctcaccgagtctgtccatgtcttgagaggcaacgttggagcaataagatctattcgttttacatccgacgggcacttcttgtcgatggcagaagcagcagactttgtccacatctttgacatcaaaagtgactacaataagagacaggaattggatttctttggcgaggtatccggtatgtccttcagccccgacacggacacactttatgttggaatctcggacaggacatatggcagcctacttcagtttggccgcctctacaattattcatacctcgactcactactatgaaggtcaaagaaaatatgtgttttccctcggcttataatcaacccagattaggcatcccaaatgaaatttaatttagcctggtattcctcgtaaagaatcctgtaccctggtgtatgtgtacataaaaaaactgtattttatagacaccagtagtctgctaccctgctttcagataggtatataaggtgtcaggattcaaatcgcaagttagatctcaattcgttatagcacaagatgaatccataaagtcagaactttgcatgttaagggcttgctcgttttgatctcaatccatatggattaagcgagattgagcgggaaaaaaaaaaaacccgcggcc

SEQ ID NO: 18454 - DNA, 1036 bp, Zea mays
  misc_feature (1019)..(1024): n is a, c, g, or t
cgggaaaaaaaaagagcggtgatgattttgtggactagagtttccgatactaccacggtagtatttggcgatccgtccgcccccgggccaattccattccaaatccgcagtccgcagacgagagtggaagcggggcacagacaggaagagaagccaatggcgctgtccctctccctcgcgcgccccgcgcccctcgccgtttccgccggcgcaggagccaggaagctacccgcagccagcctcgcattcccggcgaaatccttcttcggcgcgccgctggccgccaccgcggcctccgtcgcgtcgccgctcccgcgcaagccggccacctccaccacctcgctcgaggtcgtcgcggcggggaagaagggctacaagatgaagacgcacaaggcgtcggcgaagcggttccgggtgacggggaggggcaagatcgtgcggcggtgcgccgggaagcagcacttgctcgccaagaagaacaccaagcgcaagaagaggctctcgaagatggtgcaagtcaacaagagtgactacgacaatgttacgggtgcactgccctacctcaaagtgaataggaaagcaaactgagagctacgtggtcttcaaaaaatcattaagtttcgttccaccaaattgtaattttgtgtatcttccactgtatttccttctcaaaaatactgaggcatcatttcaaagcaagcaaaaaacaactcctggtatcaacagtatagcgatatttcagaatgaggtgcactgcttgctatagttgttatttagtcgcaaatatgtgcaagtaagagtggcacttgagccattagctcctcttaggatatggccagcagatcgtgtatatggctgtgcaagacactgttttgcaccattttatatatagactgcattgtttacatgatgaagcttgaaataggatatgggatgagtgcaactgctggagatagcctcagggagctaaacttttcactggtctgtcttaaaccttaatctaatggttttcatctgtnnnnnnaaaaaaaaaaaa

SEQ ID NO: 18455 - DNA, 910 bp, Zea mays
ttccggatctgtcggggccccccggcccgcccggcccgaatcccattccaaatccgcagtccgcagacggtagcggaagcggggcacacacagagaagccaatggcgctgtccctctccctcgcgcgccccgcgcccctcgccgtttccgccggcgcaggagccaggaagctacccgcagccagcctagcattcccggcgaaatccttcttcggcgcgccgctggccgccaccgcggcctccgtcgcgtcgccgctcccgcgcaagccggccacctccaccacctcgctcgaggtcgtcgcggcggggaagaaggggtacaagatgaagacgcacaaggcgtcggcgaagcggttccgggtgacggggaggggcaagatcgtgcggcggtgcgccgggaagcagcacttgctcgccaagaagaacaccaagcgcaagaagaggctctcgaagatggtgcaagtcaacaagagtgactacgacaatgttacgggtgcactgccctacctcaaagtgaataggaaagcaaactgagatctacgtggtcttcaaaacatcattaagtttcgttccaccaaattgtaattttgtgtatcttccactgtatttccttctcaaaaatactgaggcatcatttcaaagcaagcaaaaaacaactcctggtatcaacagtctagcgatatttcagaatgaggtgcactgcttgctatagttgttatttagtcgtaaatatgtgcaagtaagagtggcacttgagccattagctcctcttaggatatggccagcagatcgtgtatatgggcatgcaagacactggtttgcaccgttttatatgtagactgcattggttaccggggaaaaaaaaaaaaaaaaaaaaaaaaagataaaaaaaaaaaaaaaaaaggccccta

SEQ ID NO: 18456 - DNA, 885 bp, Zea mays
gcacgagaccattacctagaacatcctaatcaaaaagagaatcggtccagcccaagactaaacaaagcaaacttgagttgtttggaggcggagggagcagagaaatcccccaaccaaaccaaaccctcgccgtgccgccgcctccgactcctgctccgtccgagcctaccaccacagggcaagggcttcatccagccgcgtgcgagcctgaccgcccagttagacgatgagccgcagcctcggtatcccggtgaagctgctgcatgaggcggcgggccacgtcgtcacggtcgagctcaagaccggcgaggtctaccgcggctccatggtcgagtgcgaggacaactggaactgccagctcgaaaacatcaccttcacggcaaaggacggcaaggtgtcgcagctggagcacgtcttcatcagggggagcagggtcaggttcatgattatacccgacatgctcaagaacgccccaatgttcaagcgccttgaggccaggattaggggtaaaggctcagctgttggtgtcggccgaggccgcgcggtcgccatgcgggctagggctgctgctggtcgtggcggtggtcctgttggacgaggtggtgcaccccctgtgaggaggtagatctgtcgcgctatgtggcaaatcaagcttttgccctagttgcaaaaactttgcttgagcagcgatgctatatggttgttaagggtagcttatcagcagcagttcatgtttacagcatagatgcaggactttgtgtaactttgcacgagaagactgtggacagtttcgacgatgctatattgctattgagggtctgatttggataatactccctccgtcccaaaatattccaaaaaaaaaaaaaaaaaactcgtccccgg

SEQ ID NO: 18457 - DNA, 2542 bp, Zea mays
gccggccgggcctggaagtccaccactccaccactccaccccctcccccgctgctccaaaaggcgggcaccaaacaccaacccgagccccgagcacgagcgcccaaccaaatggcgccgcacaccaccgctggaggcgggggcggagccgaggatgaggtgtccgaggcggcggctgcatcccccgccctgcggcaccgccacgcgggcaagggcgaggggctgggcggcaatggcggcgctggggccgacggccaggcgtccgtggagcgggtgttcgcggacaaggcggtgccgtcgtggcgggagcagctcacgctgcgggcattcgtcgtcagcgcgctgctggccgtcatgttcagcgtcatagtcatgaagctcaacctcaccacggggatcatcccctccctcaatgtctccgcggggctgctcggcttcttcttcgtccgcatgtggaccgccgccgccgagaggatgggcttcctccgccagcccttcaccaggcaggagaacaccgtcatccagacctgcgttgtctctgcctacggcatcgccttcagcggtggctttggcagttatctatttggaatgagtgacaaaatagctaaacaagcaacagaggctaaagatgctaataacataaaggatcctcaccttggatggatgatagggttcctattccttgtcagttttattggtctctttgcacttgtacccctaagaaagattatgattgttgactacaagttgacctatccaagtggcacagccactgcatatctcatcaacggttttcacacacctgagggagccaagcttgcaaagaagcaagtaaagacgttgggcaagtactttgtgtttagctttttctggggcttttttcagtggttctacactgcaggggatgagtgtggattcaaaaattttccaacattgggccttgaagcttataacaataggttcttctttgacttctctcctacatacgttggagttggcatgatctgcccatacatcgtgaatgtgtctgttctgctgggtggtttcctctcatggggtttaatgtggcctctcattgccaagaagaaggggagttggtacccagctaacctggaagactcaagtttacatgggttgcaggcttacagggttttcatttccatcgctttgatccttggggacggtttatacaacttcattaaggtgctgatccgcacaattgcgggtttcatatcaatggtgcagcaaaattcaaaaagcatgcttcctgtttcggacaatggcagttccatgtccagtatggaggctgtatcctttgacgatgaacgtcgcattgagaattttctgaaagatcagattcccaagtcagttgcatacgggggctatgttgcagttgctgctatatctattggcacccttcctcagatcttcccgcagctcaagtggtactacattttagtagcctacgtcgtggcacctgtgctggccttctgcaatgcttatggaagtggcctcactgactggtctctcgcctccacctacggcaagctcgctatcttcgtgttcggtgcatgggctggcctctcacacggtggcgtgctcgttgggctcgcagcttgtggtgtcatgatgagcatcgtgtcgaccgcctcagacctgatgcaagacttcaagaccgggtacctgacgctggcgtcaccgaggtctatgttcatcagccaggtgattggcaccggaatggggtgtgtcatcgggccctgcatcttctggctcttctacaaggcgttcggtgacattggcgagagcggcaccgagtacccggcgccctatgccatcgtgtaccgcaacatggccatcctcggcgtggatggcttcggctcgctcccgaaaaactgcctcaccctctgctacattttctttgcggcagcgatcactatcaaccttgtcagggacctgaccccctacaaggtgtcgaggttcatcccgctgccaatggcaatggcgattccgttctacatcgggtcctacttcgccattgacatgtttctgggcagcgcgatcctcttcgtgtgggagcggctgaacaaggcgaaagcggacgcattcggacctgcggtcgcgtcggggctgatctgcggagacggcatctggaccctgccgcagtccattctggccctcgccaaggtgcagccccccatttgcatgaagtttttgtccagatcgaccaatgccaaggtggacagcttcctcggcttgtcatgattttacacagaatggcaagtagacacgccctcatcctgtaattattggtgcaagatgcaatcaccaggctacagctctgtaaaagagaagaggttttgctgtggagtgaccaaagctttgtccgtgtagtctgtgtcaagaggaaaatactcaatggccctctgcctttttttgtgcaattattaactagcgtattcacagttataggtatttttgaaatgtgaaacgttcactacaaatttttttttaacgaatggagcttttgaaaaaaaaaaaaaaaa

SEQ ID NO: 18458 - DNA, 730 bp, Zea mays
ctagccttttttttttttttttttgggttgccggcgatattgccagcgagatattcattcgttttaagctcactaactccagcagtgaatgacccagagacctcggttcatgtgctattcccacactgatctctttttcatcagttgtgggctatgcagcttgcctccctagcttcatgccccagccttattcacaatacatttctatcttggtattagacagcttagttctcctcagcggcggcggcggccttcttggccttgttgccacggagcttctgctcgggctcgggcttgacgggcttgttggacttcttgagggcggaggcacgctcaacggcagcggagcggaggtcagcacggtaaccgttcttggcagcctggttggcaacagcctggtaggtcttgcggttgctcttggatccactgtaagaggtcttgacaaggttctgggcgggcttgttgggctgggccttcttggaggtgacaacaatagcacccttctcgccagaggtgataccgagggccttgtcgttgacgaaaccagcgtgcttgcgggaagtcttgttggtcaggttaagggggtctcgggagaactgaacaccgccgttcttcttgctcttggcggagaagcagttgttgtcacggacgatctcccagatcagatccgaggaaatgttggagagctcctgcgcggtagacattgtgaatggaggttttggcgtgaaaa

SEQ ID NO: 18459 - DNA, 1313 bp, Zea mays
gcggtgggctccctcgcggccggcccggaccccagcgtagcggagccggcagccaagcagaaaaatacgagtatcgcacgcgcaaggcgattccgtccccattctccacccaatagggagctagagctacgagagggggaaacggggggacgggaataggcgtcgtcggccatgtcgtcgtcgtggaactcggtgggtctggcgatcctgtaccaggtgctgggctgggtcgccttcgccgcgtggtccttcagcttctacccgcaggtcctcctcaactacaagcgcaagagtgttgtgggcctgaatttcgattttctggtgttgaacttgacaaagcactcgtcctacctcatatacaatgctgctctcttcttcagcccattcatccagcaacagtatcatgacaaatatggtgacaaagagatgattcctgttgctgcaaatgatgttgctttttcactgcatgctgtagcattgacagcctttaccgtttttcaagtattcatatatgagcgaggaacacagaaagtctccaaagtttgcatatcaatttctgctattgtctggatcgcggctcttgtttgcctcattattgcttggccaaaaagtgactggctttggcttattgatgtattcaattcaatacaagttggcatgacagcaatcaagtacatccctcaggccatcatgaacttcaggcggaagagcacaattggttggagcgttggcaatatattacttgatctcacaggaggggtgctgaatttttgtcagatgggtgtgcagtctatagatcaacatactttggtgaatttctatggaaacattgggaaaacccttctttcattggagacggttttctttgatgtcctgttcattatccaacactacgtgttgtaccctgtcaagaaggacgagaatggtaaggcaatcatttctgaaagggtagccccccttatcaggccttcggacaagcctgaagaagataacgtatgatctagctgtagttatattgcgcgcattgcattcacgcgctgtttgcacacaggccacacacgcatgcgaattatttgttcaaaaggaattgctggcgcgtcttgattatattactgcttataacttttactacttggtgcactggtgagagatgtctcatataccaggttgcgggtttcaagtggccccgtttttattatcgtgatttgtgaaggttattagatatcatctcggccaacatttacgatcaatgctcatgtaaatatttggttgcattacatttctatggtttcataaaaaaaaacacacacccc

SEQ ID NO: 18460 - DNA, 802 bp, Zea mays
gcgcaaggtgcgaaaggcacttccctgcccgattggcgatttaagtggtggggccccgcaggccccatggcgggagtgaaagagaggtaggtggccggacggtggtggcatcgccaattcaactccgcatctgaatcggcactcggcagcgcgccagctccatagtgtaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagcagggcgactgcatcatcgatggggggaacgagtggtacgagaacacggagaggagggagaaggccatggaggagcgcggcctcctgtatcttggcatgggtgtctctggaggagaggagggtgcccgcaacggcccgtccttgatgcccggaggctcgttcgaggcttacaagtacgtcgaagacattgtcctcaaggtggctgctcaggtccctgacagtggaccgtgtgtcacgcacattggaaaaagcggatcgggcaactttgcccagatggtcccccaccggaatcgagcatgtcgacttgccccctgatttacgaagcataccccacgctctca

SEQ ID NO: 18461 - DNA, 720 bp, Zea mays
ggcactttccctgcctgattggcgattggtggccccggggccggccgggagtgaaagagagtaggtggacggacggtgctggcatcgccaattcaactccgcatctgcatcggcagcgcgccagctccatagtgtaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagcagggcgactgcatcatcgatggggggaacgagtggtacgagaacacggagaggagggagaaggccatggaggagcgcggcctcctgtatcttggcatgggtgtctctggaggagaggagggtgcccgcaacggcccgtccttgatgcccggaggctcgttcgacgcttacaagtacgtcgaagacattgtcctcaaggtggctgctcaggtccctgacagtggcccgtgtgtcacgtacattggcaaaggtggatcgggcaactttggccagatgggtcacaacggaatcg

SEQ ID NO: 18462 - DNA, 694 bp, Zea mays
actccaccggctcgccggtggacaaggcgcagctggtggaggacgtgaggcaggccctgtacgcgtccaagatctgcagctacgcgcagggcatgaacatcatcaaggccaagagcgcggagaaaggctgggggctcaacctcggcgagctggccaggatctggaagggcgggtgcatcatccgcgccatcttcctggaccgcatcaagaaggcctacgacaggaacccgggcctcgccagcctgctcgtagaccccgagttcgcgcaggagatcatggacaggcaggcggcgtggcgcagggtggtgtgcctcgccatcaacaacggcgtcagcaccccgggaatgtccgctagcctggcctactttgactcctaccgcagggacaggctgcctgccaacctagtgcaggcccagagggactacttcggggctcacacctacgagagggtcgacatgcctggctctttccacaccgaatggttcaagattgcgcgcaacatctccaacaactgatgagctgctcaacggatggcatgccatgccacgtacgcattgttgttgactactccagtcggtaatgagatttcctgcaggaacttgtctattgatctttgtaagttaattatttatatgaataaaataagagcagacatgcttgtgtttgggcaaaaaaaaaaaaaaaaaggccccta

SEQ ID NO: 18463 - DNA, 6272 bp, Zea mays
cgagtatatgtcagcagaaacataacgttatcagcagctggagaagctgaggttgcatgaaaccggttttctcaaaccgacaagaattacctttccccacaatcctgactccttatcataccaatatcttccaggcttgaggttcccaggaggtcgttggcagctaagcaaatcggtcatctcctcgtcgtcaagagggaaaccattgaccaggagctgctcaggccggagctggttcgcctggcactccttctcgaccttgaggatctgcctgacctccagggggccgagcaggcgagacagtatcctagagcccttcccgagcctggagcgcttggcctcgtcgatgggctggccaatgcaggtgacacacttgcggccctcgggcatggagcccatggcgcggagcaggcagtggccgcagtagcgcgcgtcgcagacgatgcacgactccttgctctcccacttgctcttcccgcagcggcggcagcaggtccgccctttcctctcggccggcctcgtcaccgcgacgtgctgctcggcggacgccgcgtcgtgtccgccgtccatctcgctgctctcgtacctgccgccgctgtcctcctccggcaccccgaacgtgaccacctgaggtcgcctcccctccggcactgcaggcctcgaggccttcgtggagcgggagccggagctgccggcgtcgtcctcctcgtcatcggaggaatccgacggcgtcatcctcgcggcacggcgatcagcagcaccagcccgggacgctgccggcgggttggcacgggcacgggccgcagcagggccgacgacgggcgcgacgggcacgacgccgctgccgagccccaggggccccgaggccggctcggcggtgggtatggcggggacgcagacgggctggatccgcgggagctcgtacgacacgtccggcccgttgtacgtcagcgcgaaggagtagtccatgtcgggcagcggctccgggatggtggtccccggcgggaacatccggcgcaccatgtcctcccagtcgccccggcccgccgccatgcctgcccggtgtagcagcaatccgtcgagcaccttgcgcgcgggcgactagtccgtcccggtgcagatagatattttccacccgcggcagcaggcgtagagacggcggggaattcaattcccgacccacccctgggtggagtggagtgaacggagtggcctcgacgacgaccggtccaacgagaggcaggctgggtcagagagaagaaatgcaacccctccactggcactagcggcggtcgtggccagccaaccagcaaccgcaaccggcggtgctggtgcaggcccgggcggggccccccaacgactcccgctcggcggctcgggtcagtcagtcagcaacgaacaacacatctttgcactgggcagcgtgggaactgccgttctccgccccgcccgcattatcttatcaaaccgacgctggacttgcaggaaaggaaaggcgctacaactttcctctgggcagtttgtttgaccggggaatggaatggggatggatggacgtggacggacggacgcagagtgggaaaacggatgaagaaggacgaggacacgcaggaggaggaagaccacgactgcactggccgctggcggtggaggtgggaccggtcgagcaacggcaggccgcgcgtgaatgatgagttgcttgcgtcagagcaccaccaaccatcgtaccctgccaccacggcccaccgggcccctggcgtgagtgggaaccgggtgggtgttgggcccgccgcgtcagaagcaccaaccgagccatggttcacgggctgcgggctgcgggctgcgggctgcggcggccgacgggaccggtgtgagcaggcgaccacgaaggggcccacccgtcggtggctgcctgcccccgctcgtcaacaactaccccgaaagccgccaagcggctgctgcgcaaggtgcgaaaggcaccttccctgcccgattggcgatttaagtggtgggggaggccggcccggtcggcagtgaaagagaggtaggtggccggacggtggtggcatcgccaattcaactccgcatctgcatcggcactcggcagcgcgccagctccataggtgaggcttcggatcccgatctccgcaccctgtccgattccagctccgtcctccccggatttcagttccaccgcgttgaggttttctttttttgtctcctttgggtcctcttgttcccgaagcatggggactgggggttgaattcgtgtagagatccagatgattgcgctgctagctccgatcgccgattttactctgctgcctgccggtccagatccatggaagcaagtcgatgaacttagagggcttccgctctggattttctttgaaaataagttagagtcctgtcaaacacctcttttctctgccaaacgatctacaaaatggctttagcttagaaaactgtttagttagaaaactgtttagcttagaaaactgtttactcggccaggggacagagagacgcattaccttgccttcttgctcttttcgcctctagcggtgctgtgtattcagttacttcgtctcaaagaaattcagttggtttcatcctatacacctatatgtagccggccctgtgactcgcagggcagcgtatgatctttgatcctcggcttatgtattcacctcatcggccgcttaaccttggtacatgaaaatagattttgtttccagggtcctgctcggcttatgtatgaaatagccattttttctcgcccaccagtgtaggaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagcagggcgactgcatcatcgatggggggaacgagtggtacgagaacacggagaggagggagaaggccatggaggagcgcggcctcctgtatcttggcatgggtgtctctggaggagaggagggtgcccgcaacggcccgtccttgatgcccggaggctcgttcgaggcttacaagtacgtcgaagacattgtcctcaaggtggctgctcaggtccctgacagtggcccgtgtgtcacgtacattggcaaaggtggatcgggcaactttgtcaagatggttcacaacggaatcgagtatggcgatatgcagctgatttccgaggcatacgacgttctcaagtcggtcggtaagctcaccaacagtgagctgcaccaggtgttctccgagtggaacaagggcgagctcctgagcttcttgatcgagatcacggccgacatctttggcatcaaggacgagcatggcgatggctacctggtggacaaggtccttgacaagaccgggatgaaagggacagggaagtggacggtgcagcaggccgccgagctgtcggtggccgctcctacgatcgaggcgtccttggactcgaggttcctgagcgggctgaaggacgagcgggtggaggcctccaagatcttccagggtgactactactccaccggctcgccggtggacaaggcgcagctggtggaggacgtgaggcaggccctgtacgcgtccaagatctgcagctacgcgcagggcatgaacatcatcaaggccaagagcgcggagaaaggctgggggctcaacctcggcgagctggccaggatctggaagggcgggtgcatcatccgcgccatcttcctggaccgcatcaagaaggcctacgacaggaacccgggcctcgccagcctgctcgtagaccccgagttcgcgcaggagatcatggacaggcaggcggcgtggcgcagggtggtgtgcctcgccatcaacaacggcgtcagcaccccgggaatgtccgctagcctggcctacttcgactcctaccgcagggacaggctgcctgccaacctggtgcaggcccagagggactacttcggggctcacacctacgagagggtcgacatgcctggctctttccacaccgagtggttcaagattgcgcgcaacatctccaacaactgatgagctgctcaacggatggcatgcccggtgttgactactccagtcggtaatgagatttcctgcaggaacttgtctattgatctttgtaagttaattatttatatgaataaaataagagcagacatgcttgtgtttgggcaaaaaaaaaaaaaaaaaacctgttaatcaatgcaccatgctccaaaggtgatgtacataattcagacaagtctcgatgatgtacatgttacagaactagcgaaagagttcagcttggtcgccgcagaaaacctccattgcctcgatgtgcgtccacattggagaggtcttcacgaaaggaggaggatgagttgagaagccatcaggtgttgtgattgaaacaaacttggacattggtctaccctcacaagcttttgggtgcagccagcagtgcaatctttgagctagtctccataactttgcttgcatggatgaagcacggtgatcatctcctgtgttaggggtccatgttcctcttctggtgcagccagcagtgttatctttgagctagtccccccccctttacttggcatagatgaagcacgatgatcatccctctgtattagggggtccatgttcctcttctggtgcagccaacagtgttatccttgagctagtcttcatagttttgcttgccgtggatgaagcacgatgatcatctccctcctgtattaggagtccatgttcctcctccccctccaacgcagaaaatggcccaaaagcgatgtcctggttaatcccgtcgcagcgtgcatcagttgtgggggtctgcatgacaggatggcacctcaacgatccaaatgatccatacgagacatatcagcctgtgacgcatggcttgttcggttagctctcaatccatgtggattgagtgggattggatgagtttgaatcccaaacaagtcaaacttcttcttaattttttccaatctcatccaatccatgtgtattggaaataaccgaacaagccctaagagggattgggcttgatgaccaccatctgacaaggaggttgctggtcacttgaatgaagtttgggtcatataagctcggttgaagcccatacataggttgtataggctgatgcaaccaacaattgcaatacgtgtttggttgtctgatcccaattagctaagatcaatatggcccatgtttggtttaccgtttttataagttgcacaaacacagctcatgtttgtttggttcactatttttttcaacaccgacaattacacaagatcgacatgacaaaactgctactatgtgttgagtaccaaattaaggaccggacggttcggccatggggccggacggtccggccatggggccggacggtccgcggtccggacagtttgcgcctgtgggccggacggtccgcgcgcgcgcagaacagattagggttccgagtttcttgacgtgtttgttgacgaaattcacaggattagctctggaagtttgtttgtaacgggtccagcccccctcctctataaaagcagaggaatacggccgatttgtattcatcaatcgaatcaataacacttttatctcgcatttatttcctgtacaattagaagtagttctagtctagctctagtttagcctcttaatccccaaattctccacttctcttcgactctacgtcgattagaggagtctaggtcggtctgtccgagcctagacatcacctaggatctctcctccccaacggggtccctcccgggagtgagatccaggcaccgccgacgaccttcgccgccccctgcgctcgcgcggaccgtccggcccagtgcgcggaccattcggccgtcaggcaggaaaccctagccctgcgcaagggcgcggaccgtcgggcccctggccgcggaccgtccgcccctgtgcagagagcacagccgcggtttgtgttgagtgattggcgcccgaaaaaggcaccaacaaactttttggcgactccgctggggacgatttcatatagacctatcgagatcgaccctcaatggcttg

SEQ ID NO: 18464 - DNA, 1910 bp, Zea mays
cccgaaagcccccggccggccggagcgcaaggtgcgaaaggcaccttccctgcccgattggcgatttaagtggtgggggagggaaggccgatggtcagtgaaagagaggtaggtggccggacggtggtggcatcgccaattcaactccgcatctgaatcggcactcggcagcgcgccagctccatagtgtaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaaccttcccgtctacggcttccatgaccccgcgtcctttgtgaagtccattcagaagccacgggtggtgatcatgctcgtcaaggccggcgcgccagttgaccagaccatcgcgacgctcgcagctcacttggagcagggcgactgcatcatcgatggggggaacgagtggtacgagaacacggagaggagggagaaggccatggaggagcgcggcctcctgtatcttggcatgggtgtctctggaggagaggagggtgcccgcaacggcccgtccttgatgcccggaggctcgttcgaggcttacaagtacgtcgaagacattgtcctcaaggtggctgctcaggtccctgacagtggcccgtgtgtcacgtacattggcaaaggtggatcgggcaactttgtcaagatggttcacaacggaatcgagtatggcgatatgcagctgatttccgaggcatacgacgttctcaagtcggtcggtaagctcaccaacagtgagctgcaccaggtgttctccgagtggaacaagggcgagctcctgagcttcttgatcgagatcacggccgacatctttggcatcaaggacgagcatggcgatggctacctggtggacaaggtccttgacaagaccgggatgaaagggacagggaagtggacggtgcagcaggccgccgagctgtcggtggccgctcctacgatcgaggcgtccttggactcgaggttcctgagcgggctgaaggacgagcgggtggaggcctccaagatcttccagggtgactactactccaccggctcgccggtggacaaggcgcagctggtggaggacgtgaggcaggccctgtacgcgtccaagatctgcagctacgcgcagggcatgaacatcatcaaggccaagagcgcggagaaaggctgggggctcaacctcggcgagctggccaggatctggaagggcgggtgcatcatccgcgccatcttcctggaccgcatcaagaaggcctacgacaggaacccgggcctcgccagcctgctcgtagaccccgagttcgcgcaggagatcatggacaggcaggcggcgtggcgcagggtggtgtgcctcgccatcaacaacggcgtcagcaccccgggaatgtccgctagcctggcctacttcgactcctaccgcagggacaggctgcctgccaacctggtgcaggcccagagggactacttcggggctcacacctacgagagggtcgacatgcctggctctttccacaccgagtggttcaagattgcgcgcaacatctccaacaactgatgagctgctcaacggatggcatgcccggtgttgactactccagtcggtaatgagatttcctgcaggaacttgtctattgatctttgtaagttaattatttatatgaataaaataagagcagacatgcttgtgtttgggcaccctctgttttctcctccctgttaatcaatgcaccatgctccaaaggtgatgtacataattcagacaagtctcgatgatgtacatgttacagaactagcgaaagagttcagcttggtcgccgc

SEQ ID NO: 18465 - DNA, 3915 bp, Zea mays
  misc_feature (556)..(556): n is a, c, g, or t
  misc_feature (628)..(628): n is a, c, g, or t
  misc_feature (676)..(676): n is a, c, g, or t
tggcatcgaagggttgagaacaacttaggagtgtgttgcatggatcatgggggctatgtgaaacttatgggctcataggggtggttggttgacccacttactatggtcccgctaacccaccttctgcattttgctaagatctgcaatactccatataaatgcaaaacttgtcattgataaaatatacacttcatatgtttatctttattttattccaaggttgttgatgctaatttgaatgtattaacttgtgatacttttactatcaacaacgttgttcccatggtttgtcatgcattgttctcgtccccatccccatctattgtgggccatccctgtcaggtcatccccatccccttggttcatatccttaccgtcgtcagcccaaggagagccaccacccaaatcctatctttcaactataagtgagtcatcgaacctacattctccattggttttttatattctgatatttagaaagaggttaaaagtgacgttaaacagataaattgctactctgtttacaatgcctatcacatacatgaattgccaatcnccaatcttcaatattttaagataaaaatggtgatttgtttatattaataatacacgtcacaataaatttatnacataaatatcctatgtgaatcagtctagtattgagcttactaaatgnaagtgagaacacaacaaatttcctagtgtatggtgtttttaacctacctataagcatgatgttaagtgaaagaaacatctatatatcaacatcgtgattgtgattagtgtagattatttaaataaatatatagttactttctagttagattggttaccatgatgtgtcaatatttagtaagtatcatgataggttaaccaaattgatggttgcctattagtcttgtgggaaaatgttacttattatgaaaatgatttatgagtactatgagaaacataacttgtgttttcatgataagtcatattgggtccctcccactttctccctaggcacttggattccttcctagagctacaccatttgtgccaatttttcagccttagggttccatgttgtgactataagtagtattaatcttttcttatactcaatttaacatatattctattttatcctaacacaattttgcaattagtcttagatgattgagccaattcaatggcttttattgtgctactaacattagatgtcaggatttcatgcccatagtgtggacatggatcttactgtgctatggatttgaacattgctttcaagataggatgggcctaaagagatagtagaagttagcaatgcacgaacgatggcgctgagccattttttgtataagtgtttctccacgcctaaatcatttcgtgtggctcttctggctctcgtgccgaagctgcatgcggagtcgatattggaaccacaccaaaagtcagattttttgaactttgaccaacaatatatacaaaattaaattattttaaactaaaagaattatatattatgatagttcaagtcatgataaatctagtaacttaaattttatgttgtaaaattttataagacatccggtataactggtcaaagttgatagtgattaacttaggacaaacctaagacacatgtagatggaggaagtagtcttttgtatagacagttttgtaaggccctttttttttttttttttttaagcaaactgcacttattccttttatcaaatcacatattcacatccacgaaaactgaaatgaattggagaaaacagggtaacatcgaccgatattaacagatcgtatgcattaataatcaagcagcaatttgctccttggtagaaaccttgacgtactccgccgccgatgcctcggtgctccccttgcactcgtagtagaacgcggccatggtgcaggtcgcaaacagctgcaaggcggacatcaagatgacgtacagaaactccaggagcaaccctgctgccatgttagtaagctcgcgtctcttggccagagtgtacataggggtcaaggctgcggcgagcacgccagtgacagaaatgaaaagcatgacccgtctgcgcttccccttcagcagccgccacgccctcccaagagcgccagcgccgtagcagccgggctcggccactgccacgacgacgctcatggagcagaggaaggagaagtacacgaggaagacgaagagagccaggaggagaagcgaccccacgaagaacaaaccgtagtatttcttgatcatgaggaccatgaccagaatagacatggcgacaaggagcgcaacgtaggtgatctccagtgcgtagacgaaggcgaacgtaagcacggggcctttcacctgcgccttgactctgccgaggagcgacccgatggtgtgcagctcaccggaatatgtcgagacggcggcaaacaagacgacgatctggatggctgatctgatgaccgcgccaaacagaaaataggctgtgctggtgagcaagagagccctggtgtcagcttgggtcttccggatgagtggaagtaagtccgggctacggaaatcggtgctgttgagcgcctttgtgtcgagattaagctcgactgcgaggggctggacgacgaggtcgttgccgacgaggagtagacaggtggaggcggcgataactgtgaagacagccgcgaagagcctccggttgtggctcgggaggagcaggccttctttgaggaaattgaagaacgatggtggggtcgagcttatttgcccggttgccatggctggaggtggaggctggaagctcgcgctagctagctaactagagagatagacaaggtaaggtcgaatagaagatgatgacctttaagggcatggttgagtccagccgcggcccgggcgaacagcaatcttatagaaaaatgttgatgccgaattgccacccgaatagaaaaagtcgccggccgttgtgagaagagtcagcagttagcacattgatatagcctatgttgcgtacgcgtcgcgtagccgttatttctgaaatctgaacgcgcttatgacttatgagttatgacggggtttggaaaaattttatattctacggagcatttctctgtagctgtagtgcggaagaagtccatctcaggctgtctccaacaagaactgtaaatgattatgtagtctaaatatagaggacatagacgtccgatgtgactacaacaaaatccgctaaatcgttcgctaaaatttctcgtccagcaaacctgggggactggtaagcgatcgcaatacactgtttcactcggcgcgcgtccttctgttcactcccgcgcaaccgaaggtagaagaagacgtggagtcgccgagccgacgcagcttcgccaccaactccgcgacgttcgacgctggccaccgccgtgcgcagggcagcgaccttcctcctgcgctccttctccggcgaacgtactcctgcgctctctctccgacgagccatgccgctcggcaaccgatatcaagacagcagctcccctgttcgacgaaatgtctctaaagcaaaatagagagatcaactatgttttttttttgtccaataagaatttcttttacaaaacatacttagatagcaatttcttcagaaagaaagattactaaattcgattacataatgtaattattttcatccgtccataattcaatttcgactgcacatggatgttttttgtttgcgtgtccgataaggaaaatatttacaatacaaatgtctggtagcttatttggctaaatatgaagaagagtaatttcaccataaaatgaatatatattctgtagcatattttaatttcacgatatacgaacgattttttagaaaaggtgtatgttgtgaaatttggtaaaaatgtagatataaagaactcattttagggaatgttgctgag

SEQ ID NO: 18466 - DNA, 725 bp, Zea mays
tttttttttttttaactgctcaaagttgatagtgattaacttaggacaaacttttttttttttttttcggaggaagtagtcttttgtatagacagtatagtaatgacctttaccccaccagaaaattaagcaaactgcacttattccttttatcaaatcacatattcacatccacgaaaactgaaatgaattggagaaaacagggtaacatcgaccgatattaacagatcgtatgcattaataatcaatcagcaatttgctccttggtagaaaccttgacgtactccgccgccgatgcctcggtgctccccttgcactcgtagtagaacgcggccatggtgcaggtcgcaaacagctgcaaggcggacatcaagatgacgtacagaaactccaggagcaaccctgctgccatgttagtaagctcgcgtctcttggccagagtgtacataggggtcaaggctgcggcgagcacgccagtgacagaaatgaaaagcatgacccgtctgcgcttccccttcagcagccgccacgccctcccaagagcaccagcgccgtagcagccgggctcggccactgccacgacgacactcatggagcagaggaaggagaagtacacgaggaagacgaagagaggcaggaggagcagcgaccccacgaagaacaaaccgtagtatttcttgatcatgaggaccatgaccagagtagacatggcgacaaggagcgcg

SEQ ID NO: 18467 - DNA, 1686 bp, Zea mays
agaggatccggctgcgtccgacctccttgcttttcgagaatccactgccttcgattcctagtttcccacggcagggcagcctcatcggatcccatgagccggcccacgggcgcgtgccttcacgcgtggcgactagggatggcaacgtgtacaataccagcagcagccgcaccgcgtgcgcatgtgggccgccacctccccggaattcggcaggcagctcgtcctgctctactgcttccttccttctcctcctcctcctccaccactctcctctgtcaccggcttccccccatcctgcccctcgtgctccagctcctccgggtccgggccaaccacgcgatggcggcgtccgccgggacggtgtacgaggcggacgcggaggccgtcgtgcgccggatcacgccggcactcgaccgcgccagacacaagggccaggcagggaagatagcagtaatcggaggatgtcgtgagtacactggagctccttattttgccgctatctctgccttgaaagttggtgcagatctttcacatgttttctgcacgaaagatgctgctacagtaattaagagctatagccctgaactaattgtacatccaatattagaagaatcttacagtgtaagggttgatgaacgagcatctgtttcttctaagattcttacggaagttgcaaagtggatggagcgctttgattgcattgttgttggtcctggccttggaagggacccctttcttctggaatgtgtgagtaatatcatgaggcacgcacgacaggctaatattccaactgttgtggatggggatggcctatttcttgtaaacaataaccttaatcttgttgaaggaaaccctcttgccattttaacaccaaatgtctatgagtacaagcgtcttgttcagaaggttcttaactgtgacgtagatgaggaaagtgcttctgagcagctaatcgcactttgccaaaaaattggtgatgtaacaataatgcagaaaggaaaagctgatgtcatcagtgacggtaaaacagttacacaagtgagtacttttggttccccaagacggtgtggtggtcaaggtgacatcctttctggaagtgtggcagtatttgcatcatgggcacgacactttggcttgacaaacgaagaaccttcagagaaaagagttaatcctatgacccttgggtgcatagctgcctcccttctactccggaaagctgcgtcacatgcttttgagaagaacaagagatcgactgtcacctctgatatcattgagttcttgggcaaaagcttggaagatatctgccctgccgagcactagctcctgccagtaattgtagtcatgcacgcggaagcataataatgtttatatgtctgttgaacagggtgttaccatgcctaattctaatgttgcccagtgatgttgagaactgtgcagtagaagcgtaatgtacaatggtgtttaatgtgggggctcttaaagtgttttagggagttatttgtaaaaaaaatcttagagccgtctctccgtgaagagacgcctctggctcgtaaaccaattaacaacagacgcttcacttcccactgtacgaatttgtcgtctgttctatcgatctgatgctatacaaatacatttaattctgtatttattaatagactacgtttagaggcaaaaaaaaaaaaaaaa

SEQ ID NO: 18468 - DNA, 711 bp, Zea mays
acgcggggacagtagccagatccagaagtgaacagagcctcaaacacagactagagaagataggtgctagcttagtgaggttaacccgtacgatgtcgctggaagacagtttcaaggagagggtagccatgtggcgcagggaacatgacattatttacaaccagctcccagtgctgctagagaagatggacatcctatttcctgcggagaacatggaaaactcggagcctgagaacaaatctgaaacaaagaatctggtcgccccgctgccagccgtgacgccggaggaaataggggagcgctacaaggatctggaggagagcatcaggggattcatcaaggatctggacgaggccgagaaggaggaggaggaggacggaggcacgagcgaggcggcatcgccgtcttcagtggacgatgagtaataatcaagagctgcaggagcatcacaagctaggacgacggaggcccctggggatcggcaggaggaatggatgatgatcgtcccatctaacaataattattattagttcctttcgttcatgtttctcggttgtctaatacagtattcgagtcctgcgtaatgcgtgtcgatctgtcgtttatcctttgctgttgctggcaagattaattgatgagatcaaccgggcgaacaccatgcatgctctgcgtggtacatctctcgcgtcctatacaaaaaaaaaaaaaaaa

SEQ ID NO: 18469 - DNA, 1163 bp, Zea mays
gactcctttgggcgattggggtcctcgaggccggccggggcaccagaccccatagctgacgacaccaccgtgtggtcgacaaaataaaaaggagagagagagatggccctgtcgtctcgccgtatggccgccgcaccattcttcgtcgtcgtccttctcgtcctcgtggcggcagagaggacgatgggcagggtggtggtggaagagacgctctgcctgtcgcagagccatgccttcaaaggcgtgtgcctcagcaacaccaactgcgacaacgtatgcaagacggagaagttcacaggcggcgagtgcaagatggacggcgtcatgcgcaagtgctactgcaagaaggtctgctagggcggcagcaagccccagccgtacggctggttgatccggttgcacactgcacagctcgtttgggcacgcggtcatgttccggcttctcggctttattttatttcttctttgttataataaatagactctgttagtcacgtgcgttttagtctgggttgtacgttattaattctctagtgtattgtatttgcgcaacgccctgtacttaacgtagccatgtattcgcgttgcgtggtggagaggccaacgatttaccttgattgtacaaaaaaattatatatatttgtgatggttatctttgaaaaaaaaaaaaaaaaaggggccccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaagggggggccccccccccccccctttttttcccccctaaggggggaaaaatgggcccgggggaaaaaaaggaaaaaaaattttcccgggggaaaaatttttccccccccaaatccccaaaaaaaaaaggcccgggaaaaaaaaaggaaaacccgggggggcccaaagggggggaaaacccccttaaataggggggggccaccgccccctttttaaaaagaaaaaaattccgggcccccgtttaaaaaaaacccccccccccccgggaaaaaggggtttgggaaatggggccctcccccccccccccccccaaaaaccccggggccggggattttgggggggggggggggttttcctccccccaaaggggggaa

SEQ ID NO: 18470 - DNA, 1192 bp, Zea mays
agcccagcatgggtccatgcacccgcccatgggccccgagctggtagttcgcaataggccagtcagaactaactaagcccatctcttgggccttggccagagagaggccgcgtcacatactcacattgcctgctcacaagccacaccgagcggcgcacgcggcaccctcttggatcgcgcactcgagagacgacacgacgcgagagccgtgccggggaagagaacgcgccgcaccgggcagcgaacgaaaccaagccaagccatggcagccaaccccaaccactgcctccgccgcctcgcctcagctctctcccacggtccccggcctccgactcctcccctatccctcctcttcccccgcctcgcgctctccagctccggcccctccacgggcccgccgccgccgccgccggatgccgtaaggaagggggagggagaggaagcggcggaagctagggccgccgaagccgacgccgaagcggggaaggaggaggagcatgaggccgacggcggtgcgcacgtgaacaaggccaccggcgaggtcggcggcccgcgggggcccgagcccacgaggtacggcgactgggagcgcgccggccgctgctccgatttctgaaccgccgctggccgcgaggtgaggccgtcagcgtcagcacggaacctgtggatgtggttccgtatcgtactgttggatctgtctgtcgtgtgctagtagtgtgcctgttgtcacctgtgcaaagggcggcgttaaatttgcgttttgcttcgtcttctggggaataaacagagttgacagtactcggctcaaaaagttcagatcgactcagttgttgttgtttttttttttttgccttgatttttcatctcgctcagctcgagtgagcaggttctgttgttaggttgcctgatcttggttatcaccggacgtaatgaaacaatggaacgcagtgcacacatcattgtgacttcttagaattccgcacaagcaaaggatgaaagttccttcttccctggttcccggtttggagttgcgaattgggattactggttgtagcgttgtttcagatcgaggctatttgtagcgctgtttcagattggggaaccgaaggctgttgatagtagatgcgatagaggaccagatgctgtatgtagtgttctttaatttggatgattcatcagatgttatttagct

SEQ ID NO: 18471 - DNA, 2256 bp, Zea mays
ccggtgcacccacgcggcacccccactacccgacctcaccacacacgacgcatcagatggatatgcagttgttatcggcaatttatgcaagcataaacgcccccgaccgcgtcccgaccacaccactatgccaatttacgcagccactattgtcaaaatatgcatgcataaacgcgcgacccacgcccgaccccaccacgatcccggtgcacccgtgcggcacccccactatgcccatttatgcagtcgtttccgtcaaaatccgtatgcataaacgtggaacacccccacacgcgacaccactatgtgcacccgcgcggcaccctcaccacccgacacgtcgcccgcgcccgcggacctaccttggtcgggctctctccagtaatggaagcccagcctcaaccctatatatagtctacggtatacttacgagtttgttgtaccatattagacctgtcgcgggtaacaggtgcgtgtttgatattaaatccgtgattgcgggtttgtaatcctgtacccgaggatttcaaattcgttgtgatccctaacaggagctgttgggatggtcttagactatctccagcatattctttattttattctctattttaaactttgtactaatatattttcgtgttcggcgaagcacatattcttactctgatctccctccatccactgattcgctccgccctccgccatggcaggccgcgtcctcttccgcgccgctgccttcggcctcgccgccgccggtgcgggttccctgcatgccatgtcgaattggatgcctccctcggagatctctcccttcagccggatagtgaagctgaagcccacgctcttggaatccgcgaacgtccttctggccgccctgctccgcgcgcacccgctctccagtgcgaacctgcgtgacgtccgcgcccgcgctgagctcgacctcgcgcgtgctgacatggagattggccatggcggcgacccagccgccgccgtggacctccgcctcctcctggcgctcctcgccacgcgcgacggtcgcgcgtacgacgcgttgcggctctacgcggaagcggcccgcgacgcgcctttcgacccccggccctgcgcccttgcggctaacctctccctcatgtgcgggcgagatgacgtatctgcggcggggatttccgcttacacccgcctcgtctccaccttgcaccagggatgggagtccgacgagaccagggagctcatccacgagctcgcggtcgcggcgacgctgggcggcgtgtacaagctccgcttcgctgatagtaggaacttcgtcatgcgcgtggccagcagagctgtggacaaggggctggtcgctgcgcagcaggacaaggcgctatctgcgaccgagaggcttcagttccgattgctacgcgtgttcctggacaccaaggtgcggcacgtcgtgaaggagaacctggccgtggccgacattggtgaggactgaggatgcatcttcgggttcattgtaagcaaacttacacagttatacacttatacttgtctcatcatcggatcaaatgaatgaatgcgattgcccaactttgcgtatccaaagagcagggtggatcggatccttcatgctagttgcacaaggaattttatatgcacaggctagttgtttaacctgattggtttctgctccctggatcaattgatctgtcagacagacaggcaccccctgagatagccatctagcaaatcaaatcactaatagtgctaactttggttgatcgtattcttcaattcttctcatggaattaatgcacattttgtgtgtgagctttaatttgttgttaatggtgatctggatccataatattatgtcattgcaaatttgaacttggtattttcttgaaactgaactacatggaaaaatactagcataattttgcaatgtaagaatattagtgttctttaccgtattcattttattttatgtgttttatcattgcataagtaaggagattacaatattacatgcacaataaaatagcaccgatcacatagaagggaggtttgattgtcgtccttagctggaatggcccacagattggcatggtcggacaattctcacttatcataatctgataattggatcttgtctgatattatgacatcattgcacagttttaattagtaggataactagttctggagtctgtttgatttcaaccttgaacagaagatgcaatgaatagggttgatgatctatatccttctgcggga

SEQ ID NO: 18472 - DNA, 979 bp, Zea mays
ccgggcttgctagaaccttgcgagttccgactccctcgtgccatcgttttgtgtcggattgcaaccagaatcgttccactaatcaaagtttatataaattagagaagcccggccgcaaaaaaaaccaatcggacggaaacgaaaaaggcctcactcatctccgtccgtccgccgcaccgtcgccgagcgccgctccgcgccggagacgtcctgtttttttgccgcctacgagcgctgtccctcttttctttccgcggctctgccccaacttctgcatccgaatctcccacgaagttgtcacggcgatggcagcgaccggcggcgtttcaactgacgatatcccgatcctgcaggcagagaacctcaccagcaacgtcaagtccgtccactacagtcgaacattcttgtcgatcattggtggagttgttgctggaatctggggattcacaggcttgacgggatttgtcttctactttctgataatgatggttgcatctatcgggctcttagcaaagtcaaagttttcagtgcagacatacttcgatagttggaccaggatttcaattgaaggagtttttggtggccttatgtcattcgtgctgttctggacatttgcttatgacattgttcatatcttctgatggacgtagaaagagctaccctccaaggaaaatatggaatttcatctgatgtcgaacattcccaatgggctctttgtacactcagtttttattttggtaattgttgatataatattttgtgatactatatcgttggacctaagcagagctcataaactgatgtagcaactccttcgcttggatgatctgtagcagttgtgatttgtcatttccagtaatgaatgtaaactttgattgatggacactcggaatttttttgcattatcacttgaaatgtgaatggccggtctggtgctgtctcacaaaaaaaaaagaaaaaaaaaaaaaaaaaagcggcc

SEQ ID NO: 18473 - DNA, 2734 bp, Zea mays
ccggccggggcgatttgcgagcgccgcatcgacccccaccgccgacgaacgccgcgccgccgacgtcctgccttctcctcgccggcgagcgccgttccgctgtaccctccgtgattccgccccaacctctgcgtccgaatctcccgcgaaacagtcacggcgatggcggcggccggtggcgtttcaactgacgatgtcccgatcctgcaggcagagaacctcaccagcaacgtcaagtccgtctactacagtcgaacattcttgtcaatcattggtggagttgttgctggaatctggggattcacaggcttgatggggtttgtcttctactttctgataatgatggttgcatctattgggctcttagcgaagtcaaagttttcagtccaggcgtacttcgatagttggaccaggatttcaattgaaggagtttttggtggcccgatgtcattcgtgctgttttggacgtatcctttttcgttgacaatttaaaaacagtactattcatactttatttctgttcttcttgtgcttatatagattatttgattagataggctgaagattgcaaccggctgggatggtaaaccaacatgttcatactccactggttgtagattgggtaacatgctgctattatcgagggactgaacgcctaccaacgaatatttcagatttgtgtttactgctgccatatattttgtcattgtggaatataaataaaaattcaacattttagacaatcatagaaaacaatcagtgaaccagcaaagcagtttatttttttctaaactcaaaacatgtttatgcgtctttcctatctatattcatctgttttcagtgttggtccgtttctgcatgagttcatccttgacgacgtatggacatttgcttatgacattgttcacatcttctgacggacatagaaagagctacactccggaggaaacacggaatcgtcgacgatgaacattcccaattggctttttgtacactcaatttttgtattggtaattgatatagtctgtagtgagactatatcggtgtagacctaagcaaagctcatgaactttgcatttccttggatgatccgtagcagttgcaatttttcatttcaagtgagggaaaaaaaaaaaaaagttttctggcacaatgttttgtaccctcgagttttctggcacttcgattgatgtacacacttctcaatgcttcaactgatcgagtcactgttaactagccatgtgcgtcttttgggaggaactacccatgttatttccaaatcaaaatgcgtccgtgatctaagaagcttcagcactgctaactgaacccatctcttcttatcaggccgaaattttctacacgggcctaagcccagatccaaacttccaaacgcatcttcctctcccatgctgcatcccgcagccagaaccctagccccctagcctcgtcgccatggcctcctccttgctccgctccggctacggcctcttccttcgccgccctcgcctttccgccgcattctccaccgctgctgccgaggagctcatcgacgtccgcaagctccccaccgactacgacccctccaccttcgacccgtcctccccgtcccgcccgccgccgtccgaccgcgtgtggcgcctcgtcgaggaggtctcctctctcaccctcgcggagactgcttctctgtcctctctcctcctccgccgcctcgacatcccctccgcgccacccatcgccatcctcaactccgccacggggctgggcggcggtggcgccacggccggcgcggcgggtgagaaggcggcggcggcagctgagaagacggtcttcgagctgcggctggaggcctacgatgctgcgagcaagatcaaggtgatcaaggagatccggtcattcactgacctggggctgaaggaggccaaggagctggtggagaaggcgcctgcggtgatcaagggaggcctatccaaggaggaggctcaggcgattgtcgagcgaatgaaggcagttggcgccaaggtcattattgactgattagaacaagccttttcagtggtgaggtcctgcaaatttatgcttcgtttcggatcaacttttaagtgcaaggatggatgagtggcttgtggagaattctcctctatgaacttgtggagaattgatgtggcattgcacaaataggttttcaagcgcgttaatcaaatgaacttgtagagtattgtatcaatgatcaatcactcatcattatgttgtcggatgtgacattagttgtggggctttgggatggaaatggactattatattgttatttgctatgaagattttgtgacctttgaattgcaaagtaaaaaatgagttactccatttccacattgtaagttgtttgggcttttctagatacataacttctactgtgtatctagacatcatgtacatggagacgcatagaaaaaaaaagatatgtatctgttcataagagtatgttgttttggacaaagtcgcccatatggataacattatcctgttttcttgaatttacatactgtttccatgggcttctctattggcagggttaatgctgctctgctcgtcactgttattgactgaaattttaaggcccaacggtctaaaactatccatgccatcatgtgtttcatcttagtctcttgaggaatagccttcactaacaggaaacatgaataaattattttcaagattaagataaaaagcatgcaca

SEQ ID NO: 18474 - DNA, 928 bp, Zea mays
gggtacctccagtcgggcccgccgaggccggccggaaacacagtccggaaggaccttttctcgtttttttctctcgctagcaccttgcctccttgcgatttgcgagcgccgcatcgacccccaccgccgacgaacgccgcgccgccgacgtcctgccttctcctcgccggcgagcgccgttccgctgtaccctccgtgattccgccccaacctctgcgtccgaatctcccgcgaaacagtcacggcgatggcggcggccggtggcgtttcaactgacgatgtcccgatcctgcaggcagagaacctcaccagcaacgtcaagtccgtctactacagtcgaacattcttgtcaatcattggtggagttgttgctggaatctggggattcacaggcttgatggggtttgtcttctactttctgataatgatggttgcatctattgggctcttagcgaagtcaaagttttcagtccaggcgtacttcgatagttggaccaggatttcaattgaaggagtttttggtggcctgatgtcattcgtgctgttttggacatttgcttatgacattgttcacatcttctgacggacatagaaagagctacactccggaggaaacacggaatcgtcgacgatgaacattcccaattggctttttgtacactcaatttttgtattggtaattgatatagtctgtagtgagactatatcggtgtagacctaagcaaagctcatgaactttgcatttccttggatgatccgtagcagttgcaatttttcatttcaagtgatggatatgaactttgatgttttctggcacaatgttttgtaccctcgagttttctggcacttcgattgatgtacacacttctcaatgcttcaaaaaaaaaaaaaaaaaaggcccgagaaaaaaaaaaaaaaaaggccccta

SEQ ID NO: 18475 - DNA, 1145 bp, Zea mays
ccggggggtacccccggtccctggccggcaggagcagtccaggactcgttttttttcttgctagaaccttgcgagttccgactccctcactcatctccgtccgtccgccgcaccgtcgccgagcgccgctccgcgccggagacgtcctgtttttttgccgcctacgagcgctgtccctcttttctttccgcggctctgccccaacttctgcatccgaatctcccacgaagttgtcacggcgatggcagcgaccggcggcgtttcaactgacgatatcccgatcctgcaggcagagaacctcaccagcaacgtcaagtccgtccactacagtcgaacattcttgtcgatcattggtggagttgttgctggaatctggggattcacaggcttgacgggatttgtcttctactttctgataatgatggttgcatctatcgggctcttagcaaagtcaaagttttcagtgcagacatacttcgatagttggaccaggatttcaattgaaggagtttttggtggccttatgtcattcgtgctgttctggacgtatcctttttcttcgataatttataaacagtcttgttcatactctatttctgttcttcatgtgcttgtgtagataggctgaatattgcaaatagttgggatggtaaaccaacatgttcatactctactggttgcatattgggtaacatactgttgccatctattttggtggaatataaatgaacaatattttagtcaatcggacaaaacaatccctgaaccagcgaagcagtttatttttcctaatctataaacatgtttatgcttatttcctatctatgttcaactggtttagtgttggtccttctctgctcttgttctccttgatgagagagatagatttgcttatgacattgttcatatcttctgatggacgtagaaagagctaccctccaaggaaaatatggaatttcatctgatgtcgaacattcccaatgggctctttgtacactcagtttttattttgggaattgttgatataatattttgtgatactatatcgttggacctaagcagagctcataaactgatgtagcaactccttcgcttgatgatctgtagcagttgtgatttgtcatttccagtaatgaatgtaaact

SEQ ID NO: 18476 - DNA, 782 bp, Zea mays
ctgcgcctatcttgcttctccggggacgggcgtacccatcgtcctcgatcatcccccggactggatcggaacggagatccagccggacctgcggtgatcccttccttttctcgtgtatatgatggattgtttcctttgcaggatagtatagtgagctagccaatgaagaggtaaattcgtcaggcttgtatcaagttagtagttcatggtgcctggatgagcagtagagatgctactggccgtggaaggaggagggttcttctcgtcttcagcttcggggtacagccatggccttgctctcttgctactcggacggaaagctgaggagaagcccgtcaaggcttcgccgtggaaccagtaccggctagtcgaccgggaggccgagcaggggtaccacctgccctccgccaaggatcaggcgcctgggaaatgtgctccctttgtctgtttcggatgcacggctaatggcctcgaggtggcgtctccttccaaagcggtctccagcaatgcgcttggtaccggtacctcacaggaagaagcatcttgttcagcaaacaagacgttgaacactagtggttccatcagtggcagtgagagacgaggctgtcttaagagcaactccaaaagggattctttggagcaccgtatagtggtgagcgagggtgaagaaccgcgtgagtctttggaagaggtgcaaaccttgagatctagcatggaacggaggaaagttcagtggacagatctcaaggtttgcacctcttccaaagactcacgcggttcta

SEQ ID NO: 18477 - DNA, 2727 bp, Zea mays
  misc_feature (850)..(850): n is a, c, g, or t
aatagtattctaacctttttttaatatttcttttttcctttcatttttcatcgtcttttaaactccctcgtaatgcccctggtttaatttctccattcattgccgaagaacaaatcttgagcatcgtatatgctgtgtttggctgaacgacgtcgcctgccttcatccaacaaactggttggtgcataggcattccaggcaagaatactattttcctgcgcctgtatagtgggttgccagcttcgtcaacaaactgtttcagatttaaatgacctagacctttttgaacactaaccatctctcatgcaagggctatttttctgagcctgttttgctgaacgtgcatgtcggctattcgatcaccacccagtcactggtgtactaaaatcaaagtctggttgttgcataggcatgaggccaattagaaggcttctcaggttgtttgtagttctggagcagcacaattattaggttgcttgcagctcataaacaggttgttggataatagtttccatctagtcacaattgtgatagtgcttggcatcatgttgcggcgctggagaaagaatcaggttgtggcactgctgctgaattgtgatagtgctttgcatcctcactaaaacgtgagccgaatactagagaaagtgtatgcagcggcgccgaacgatgagaaattaaatcagaggcattatggggagtttatatgatgacgaaaaatgaaaggaaaaagaaatattaaaaaaaaagttggaatactattttggagagtaatatcacttataaatactattatagatgaagattattttaaaaataccataaagaagaagcctattaaaacaggtactanagtagaaaaaaaactccgaccggacgacggagagaaaggcggaccaaacagaccaaatagacggagtcatttccacacttgtgtgcagacgtcactatggggctgtagccgagaagagagagacacggcccaacaggcataacagaccggaccatttccagccctcacatgggccaagctgcagccgacaacattccagatttaatatgggcctactacaacagcagaagaccggccccagaaatagtgaaatactactgctaggaaaatcgggacatgatgactgtttgttttctaagctcgttcgccccctctcttctctccgtccaacgacggcgcgattcagatccaggcatacaggccatccttccgccgccgcggactgcgcttaatcttccttctccagcagccgggcgttcccgtcgtcctcgatcctcccctggactggatcgcaacggagatccagccggacctgcggtggtcccttccttttctcggtaggccgccttgagtgaattcctcgttttctgtaatgcatattctttgcttactatgaatcctcaaatccgaatcttttatgtggtggatatgatggattgtttcctttgcaagatagcataatgagctcgccagtggagaggtgattcgtcaggctggtatcaagttcctagtccatggtgcctggatgagcagtagagatgctactggccgtggaaggaggagggttcttctcgtcttcagctacaggttacagccatggcctcgccctcttgctgctcggacgcaaagctgaggagaagcccgtaaaggtctcgccgtggaaccagtaccggctagtcgaccgggagaccgagcaggtgtaccacctgccctccgccaaggaccaggctcctgggaaatgtgctccctttgtctgcttcggatgcacggctaatggcctcgaggtggcgtctcctccaaaagcgacctccagcaatgcgcttggtaccggtacctcacaggaagaagcatcttgttcagcaaacaagacgttgaccactagtggttccatcagtggcagtgagagacgaggctgtcttaagagcaactccaaaagggattctttggagcaccgtatagtggtgagcgagggtgaagaaccgcgtgagtctttggaagaggtgcaaaccctgagatctagcatggaacggaggaaagttcagtggacagatacatgtggaaaggatctttttgagataagggagtttgaaacaaggtatggtccaaaaatcctatctttccttgcatgccattgtggcctggaaatatattgtgtttgtggttactaagtctgaacaccctattgtcaattgtcatacatgaatgaatgcacatttctaacttcttctattaatgaatccaaaatccaaaataaatgtgcacaacattatctcaattttttgtcatggttacttttgtgctattaggtaaccatcttgtgaggtaacttatcttcaagttttcaagtaacaaagataccacaaagttcgagtgttccatcttaatgagtagtctccaaccaaaaggttaaaacttaatgccttcttcctcagagtcaaatctcctctaaagccctatgcacatacttttagatgtaaagacaattccagatactaaaaatgtaacatatgcttaccaaaatgttctatattgtgaacatgcgcaagtgcatggagtttgcactagtttatatagctcattgaagaagcagcgcacctgcaccattaaaggatgcaagtatgtgtgtggtttctaggctcgctgctgtagtccctggattttattccattttagttccaaaattaccaaatatagaaactaaaacataattttagttt

SEQ ID NO: 18478 - DNA, 1464 bp, Zea mays
gcacgagaccattacctagaacggcctaccggccggatgatgactgtttgttttctaagctcgttcgccccctctcttctctccgtccaacgacggcgcgattcagatccaggcatacaggccatccttccgccgccgcggactgcgcttaatcttccttctccagcagccgggcgttcccgtcgtcctcgatcctcccctggactggatcgcaacggagatccagccggacctgcggtggtcccttccttttctcgcataatgagctcgccagtggagaggtgattcgtcaggctggtatcaagttcctagtccatggtgcctggatgagcagtagagatgctactggccgtggaaggaggagggttcttctcgtcttcagctacaggttacagccatggcctcgccctcttgctgctcggacgcaaagctgaggagaagcccgtaaaggtctcgccgtggaaccagtaccggctagtcgaccgggagaccgagcaggtgtaccacctgccctccgccaaggaccaggctcctgggaaatgtgctccctttgtctgcttcggatgcacggctaatggcctcgaggtggcgtctcctccaaaagcgacctccagcaatgcgcttggtaccggtacctcacaggaagaagcatcttgttcagcaaacaagacgttgaccactagtggttccatcagtggcagtgagagacgaggctgtcttaagagcaactccaaaagggattctttggagcaccgtatagtggtgagcgagggtgaagaaccgcgtgagtctttggaagaggtgcaaaccctgagatctagcatggaacggaggaaagttcagtggacagatacatgtggaaaggatctttttgagataagggagtttgaaacaagcgacgagagtctgtcagatgatgacccagaaaatgaaggtttccggaaatgtgagtgtgtgattcagtagatttcttgtgtgcacaacaagcctgacaggaacatctcctcatgggaagcccatgtcctgctgagaaggacatgccatatgttcttctgggaaggatatgccacacccagtgatttcattgcaactggaacgatcgatgacagtcgaaacaaagcaaacggtgatgaatcgatattgtgctagattatttgttggttctacgcttaactagtctgctcggcagggttatagtttcgatgcccacctgtacaataccaagatcccattcctttctttttgttgtcatgttttgtttctctgactttccatcacctttttcacgcccgctgtaccatatgaggctgccctgttacttctgccatggatggtggatccctgacttcatgctgttcccttttgttttgcccctaacgtgttgagtgatgtcttgttgacattttcgtccaaattggtaaaattcattcttcgttgcgaaaaaaaaaaaaaaaagaattcgga

SEQ ID NO: 18479 - DNA, 1354 bp, Zea mays
gccggccgggtccatggcggtctccctcgctctcaacgacgccgcgatccagatccagccaggtatcaagtcatccttccgccgccgcgtactgcgcctatcttgcttctccggcggacgggcgtacccatcgtcctcgatcatcccccggactggatcggaacggagatccagccggacctgcggtgatcccttccttttctcggatagtatagtgagctagccaatgaagaggtaaattcgtcaggcttgtatcaagttagtagttcatggtgcctggatgagcagtagagatgctactggccgtggaaggaggagggttcttctcgtcttcagcttcggggtacagccatggccttgctctcttgctactcggacggaaagctgaggagaagcccgtcaaggcttcgccgtggaaccagtaccggctagtcgaccgggaggccgagcaggtgtaccacctgccctccgccaaggatcaggcgcctgggaaatgtgctccctttgtttgtttcggatgcacggctaatggcctcgaggtggcgtctccttccaaagcggtctccagcaatgcgctcggtaggggtacctcacaggaagaagcatcttgttcagcacacaaggcgttgacaactagtgcttccatcagtggcagtgagagacgtggctgtcttaagagcaactccaaaagggattctttggagcaccgtatagtggtgagcgagggggaagaaccacgcgagtctgtggaagaggtgcagaccttgagatctagcatagaacggaggaaagttcagtggacagatacatgtggaaaggagctttttgagataagggagtttgaaacaagcgacgagggcctgtcggatgatgatgcagaaaacgatggtttccggaaatgtgaatgtgtgattcagtagatttcatctctgcacaacaagcctgacagaaacatctcatgggaagcctgtcctgctgggaaagatgtgccacggagactactttgccactgaaatgatcgacgacagtcgaaacaaaacaaacagtcatgaatcgatatcgtgctagattatttgttggttatatgcttaactagtctgctcagcagggttatagtttcgatgcccacctgtacaatatcaagatcccctttctttcttttctgtcacattttatttttctcgctttccattgtgttttcacgcccgctgtaccatatgaggctgccctgttacctcctccagggattttggatccctgacttcatgctgttccattttgttttgctcctgacgtatttagtgatggcttgttgatgcggccgtccaaattggtaacattcattcttcacttc

SEQ ID NO: 18480 - DNA, 2339 bp, Zea mays
cttccccgttctgtcctcgcggtcgcgcaggcgtaccaaacagctagggccgggggccgcagccgcgcgctcccccggcgccggccggcgccgccgagatggtgcgcctcctctatctccggaccccgccgcggccgttgctcccgcagttcgctgtacatacacagcggccacaaagtctgctcagagtttccccccgcttccgccctcccatccgtcttcggtgccgcgcgctcgacgccagtagaccggttgcggtggagggggagcgggatgaggaggacggtctcgaggacgaggaggagtcctacttctcggtcacctcgtcggggctctcggaggtggactacctaggggaaagcaccaggggggatttgaacgtgaggagggagcgcctcgaggcgcttgggaacagcaagtcaactttgcatggtcctattgaggagatagcttggaaagaagcgggagaagctgaaacattgcttcatgacttgggaattgcagacccgttttcagtaagacactctcctcgtggaattttctgcaccaggacactaaatcttcgatctatcagtgtagttggctacgatatggattatacattaattcattacaatgtgatggcctgggaaggacgtgcatatgactatgggatggacaacctcaagagcatgggttttccagtagatgaccttaaatttgaccctgacctggtcataagaggtcttgttattgataaagagaagggaaacttggttaaagctgatcgatttgggtacattaagagggccatgcatggtacccaaatgctttccactcgtgctgtgagtgaaatatatggaagagaattggtggacctgcggaaagaaattcgatgggagttccttaatacccttttctctgtttcagaagctgtcatgttcatgcagatggttgacaagttagatcagggattggtgccagctgaacttgggccactggattacaaaggactgtacaatgctgtttccaaagcactttttcgagcacatgtagaaggccaacttaagagagaaataatggctgagcctgatcggtttgtagagcctgatccagaacttcctttagctcttcttgatcaaaaagaggctggaaaaaagttgcttctcattactaattcagatttccattatacaaacaaaatgatgaatcatgcattcaatcgctttcttcctaatgatgtgggatggagagatctgtttgaaatggttatagtctctgcaaggaagccagaattttttcagctttcacatccattgtatgaggttgtaacagatgatggactgatgcgtccctgttttaaagtaaattcaggtggcttatattctggtggtagtgctcagatggttgagaaatcactagacattcatggggatgagatattatatgttggggaccatatttacacagatgtaagccagtcaaaagttcatttacgatggaggacggcattaatctgcagagaactagaagatgagtttaatgcactggtcaaaagccatgatcagaaagaaaagcttgttacacttatacaacaaaaagaaattgtgggggatcttttcaaccagcttcgcctggctctgcagaggcgctctaattcacgtcctgcacagacgcttgctgcaacttgtatggatgaccaggagcttacggagagtatgcaaaagttgctcattgttatgcaaagattagatgaaaagatcgggccaatgctagaagcagatggagaacttttcaataaaagatggggttggttgtcacgtgctggcctatgggataagagtcatcttaccaggcaaattgaaaaatatgctgatatatacacatcaagggtttcaaattttctgcactatactccattcatgtatttccaatctcaagaacagacacttgcgcatgatgcccattcctattctggaggaaaggacatcaaagttcattgagcatccgttcgtcacaatctggagattaggcaggaaagagggaacgtgatcattgtgattatggctgggatggctagacaacaacaattgtcgttttgaacaaattaattaatacaccttgtaagattgtatttatatataagtaaatctttagctatagcatgctgaatgattgttctgatagtcagtttgtttgtcgtggcctacctagagtttcatattgggaggcacagtacctgttttggtgtacctgctgctatttgcattgtatatgtgaaatgcgaagtgaagtatgacaaggtaacgataagtgacaaatcacgtcatttgatcctgcgcaaaacgatattaaaaaaa

SEQ ID NO: 18481 - DNA, 2663 bp, Zea mays
tgtcggattatatccgaaattgttccagctaattaaagattatataaattagagaagcaattcagttaaccaattcggcacaaacgaacaaggcctaaagtttatctcgtgacattgaaacatgctcttaagctagagctagttaaataggtggaggaggcttcggttgccatctcactctcgccgtcactccggcctcttccacggccgcctccgccgccgccgccgaccaccatagcaacagatatttcggagctcgcgccttacgcgcatggtttgctcgacgtgcaccgtaactaatcgactataagcgtggtgccgattgacgagatgatgccggtggaggaggcggcggcggatgactggtcggagtgcgcgttctcgctgacctgcgaggaagactgcgccgacctcggcgacggcgagctattcccgctctacagtgccggcgacgaggaggaagatgagtacttggagcagctggtgttcaaggagaccagcttctgctcctcctccgactcagctgccgactgcgacggcgatgaagaaggagacgaagaatactcttcgctcacctcagaggagtggttccgccaagctcgcctcgccgccgtcaagtggattcttgaggtgagtcccgatttccttagctctaaccccttcgcgccatcaggctggcacggcatctgattgcgtcgttcgcccattgcagacccgcgggtgcttcggcttcggccaccggacggcgtacctcgccatctcctacttcgatagcttcctcctccggcgacgcatcgatgtaatctatccgcgccgccgtttaaaaaaaaaaacttgtctttttttttaaaaaaaaaaaacggctatgcttttggggaccaacgcgcgaatgaatgcctgacgcgaggcattggcactggtggctgcagagggagacgatgccgtgggcggcgcagctgctgtccgttgcgtgcgtgtccgtggccgccaagatggaggagtgccaggcgccggcgctgtcggagttccacgccggcggcttcgacttcgactcggcgtccatccggcggatggagctgctggtgctgtccacgctcgggtggcgcatgggcgccgtcacgcccttggactttctcccctgcttctcctcccgcgtccacccgcatggcggcgccggcgccggcgccggcggccgcgtcgccatcggtttcatctttgccacggccgaaggttcgtacacatcaagatcgaatcttttttttatctcttttctgacatccagtgatctgtcccgcgtgaattgctctgactgtctggtctgtccggtgttcgactgtttgcgcagctggtagcgtgctcgatcacaggccgtccactgtggctgcagccgcaatcttggctgcaacctacggacctctgctgaccaaagaagcactgagctccaagatgagctgcctttctccatcttatcttattgagaaggtgagtcacttgcttccatcttctagtacgtagctgtgtagcattttgaccatagttagtgttctgtctggatgaaccttggattcgatgaactccacttcaccatttctctgtttctctgaccaggagcatgtacatgcctgctacagcatgatggttggggacatgagcaggagaggcagcaagagatcattgccatgttcaggccccgacgagattgccactagtacatatcattctgttctagttgatgatgccacggacaccgccgccttcgcctcggcggtggccgcggcgaggagtaagcagatcaggctggagctgacgggcatccattgaggaagctagcaccaccggggacacgatttttagccagatgtctagggggggcttggtttgatcttccctttcgttttctttccttcttttttttaacctatatgtttgcaaaaaaagaagagatttttttaggttcttttagccattgccatggggttggcgtttggctgctgtcagattggtttgatttggtttgtgagaggtggaagagatgaacaaagcagagggctgagcttccctatggagaggggagcttaggttaataagcccgctgcacagtgctccaacagggcactcgtttccagtgaactttatttcgaagttgcactgtttgataaaccattgttgatgcaatgctgcattgcatatggtggtgagatgcagagaagatgcaaaacaagcgaggttgagggttttgccattgtgtatagagagagggagagagagggagagatgtttccctttttcacttgtgcaagtgggtggtgtttcactctgcacctgcaagggtcacatcggtatgaacagaccctgtgtacttgtgtaaaaactcctcttgttcttgaggaactgagagagaatcagattgcatcaagctttgcctgcctgtgtgagtgtgtgtgtgtatgtcgcgacatccctgtaggtttcttgatcagttccgctggccgctgcagattttgaatgccactcattcagttctggctgcggctgggccatgccagcacttgttgctctgcttttttcttcaggatcagggaaggaggatccaatgcaaccctttccctgttccattgcagccagttcagctcagcacatgctaactgaatctcggccaaacc

SEQ ID NO: 18482 - DNA, 2261 bp, Zea mays
  misc_feature (3)..(3): n is a, c, g, or t
  misc_feature (9)..(9): n is a, c, g, or t
ccnggccgnaacttctgcgtatgcacgagtatttcgtgtgcaccgaatattgggatttgggaggacaggcgcccgcactccgcctccgcttccctccgcctcgactctcgaccgcatctgagcactccgccggaggtccgcctccgcaggcaccgccacgccatgtcgaagcccgcggatcagcagccgtcggacatgcaggtcgactcctccgtcgccgaggagaagccggccatcagattctccatcaacgtgcttgagctcatgagggaggcgcagatgcagcatggtctccgccagagcgactacacgcggtaccggagatactgctctgcacgactcagaaggctgtacaagtctctcaagtttttgcatggccgaggtaaatacaacagaaggaatataaccgagtcaacagtcacggatgtgaggtttctccatgtagtgttttatatggccgagcgagcatggagtcatgccatggagaagaaaactgctggtacaaacgcaaaacaacgcatctacatgttgggtcgatttcggaaagcagttaaatgggcatcacttttttcacaattatgttctgtaaaaggagattccaggacatctctagaagctgaggcatatgcttcatatatgaagggtgctttgttttttgagcaagacaagaatatagatgccgcaatgataaatttcaagaatacgagggctatatatgaggagcttgggaagtatggcagtatagaaaatcaacttttatgccgtcagcgcatcgacgaagtggagcctatgattgatttctgttcacataaactaggtggatcatatttacaagcacatgaactcctggatactgctaatgatcttctcaaggcgaagatggaggctgtattgtctgagacaagatcacagcaggcagcttccatgactgagtttaactggcttggtcgcacttttcctattacaaatgcaaagacccgtgtctctattttgaaagcccagcagcttgagagagacttgagtgctgcagccacagaatcagttgctgctgacaaaaagcttgctatatttgataaaatattttctgcataccatgatgctcggagctgcatccgcaatgacctggcttctgctggcaatgctgaggatataaaagatgacctgaatggtcttgacaaggctgttagtgctgttctaggattgagaactatagaacgtaaccagttacttgttagcattggtaaaagtaaattcacaaagcatcgagatgaaaaaaatgagcgaatcacaaagccagaagaacttgttcggctatatgatctgcttattcagaatgtaacggacttgacagatttagttagctctggaagaaacaaaaatgaagaagaaaactcttttattcatgagtatgagctgaaaggcttggctttccgagctgagagatgtttctttttggctaagtcatatagttcagcaggcaaaagagctgaagcatatgcattattctgccatgcccatactctcactggttctgcactgcaacagcattcaaacagtcatgacaaggctttaatacaagatctggagtttctatctaacaactgtagatcaaatagctgcatagaacatgcaacaggcattatggaggaggagattgttcctttaaaactttctaaaggagtctcaactatgtcacttgctgataataaaacaaaggagaacaagtatctccttgatatgctagagagctatgaatcagcgattggtgagccgaacaccaaagctccatgtcgcattgctcaattcccacctcctttccaagcagttccatgcaatcctattgtgcttgatatggcttacaactcagttgagttcccaaaccttgagaaccgtatgaaaaaagaaaagaagggtcttctgagcaggttctggggttgaaagatggcatatgcctaggattttggtacattgtcccatcatttgatatgctttgtgcatgaacggtgtaaaactagaatgtcctgataatacctctctgatgggtgaaagatcttcagtatcccgcccaaggatttttgagattctttatcagaaggttaatttagccgttgcaaagtacatctagctcggtgactgatcagcataaccttttgctgttactaaattttgagcaatgactgatttcttggattatcgatatttaaaaagataaaaaaaaaaaaaacaaaatagaaaaaaaaaaaaaaagaaaatgttttcaa

SEQ ID NO: 18483 - DNA, 2745 bp, Zea mays
ggcgaagcggcgccgggcgccggggggggagtacgagctgctgcgaccgatgggtcgggggcctactcgcaggtgtggctggggcggcaccgggtgcggggcacggaggtggcggtgaaggagatcgccatggaacgtctcagcaaaaagctccgcgagagcctcctctccgaggtcgacatccttcgtcgcatccgacacgataacgtcatcgcactccacgactccgtcaaggatcatgggagtatatatctcatactggagtattgtcgaggtggtgacttacatgcataccttcaacgtcataaaagagtttctgaaaaggttgctaagcacttcatccgtcagttagcatctggtctgaaaatgcttcgcgataataacgtggttcaccgagacctaaaacctcagaacattcttcttgttgaaaataatgaaaatactctgttgaagattgccgactttggatttgcaaaatttttgcaaccctttgccctagccgaaacactttgtggttcaccactttacatggctccagaagtcatgcaaggtcagaagtatgatgcaaaggcagatctgtggagtgttggtgtcattctatatcaacttgttactggaataccaccttttaatggggacaatcagatacagttgcttaaaaatatactcaggacgcatgaaatacgattaccatctgattgtgacttgagccatggctgcattgacttgtgcagaaagttgctgcggctcaattcagtggagcggcttacagttgaagaatttgtgcaccacccatttctttctgaacatgctccagagaggaccttgagccggacattatctgaaataagagatggctttccaataaataatatcagtccaacaaggccttcaagccaaagttcacaagaagattgtatgccttttcctttggatgatgagtcaagtggacaggatgagggtccaattcctgacagtaagagtccgatgaaatcttatgggtttcccacaggtaaaagattggataaaacttcaggccagagtccatcaaaacataccagtctgttctccaggtatgtcttgggaaataatcatgcacctagtagccaacaccatggccatactgataaaatgaccaaggaaagcaagattcatgaagtgcaaggtccaaaaggtgtttatccagaagagaccattaccttggacttcctagtcgttgtagatcaggaatatgtatttgtgtctggaccacacccagagggatcatcgtcttcaacaaatgcttctcagcagcttaacttaccggcaaaatatgataatttatctgtttcaccaccgaagttaactttcttgagtgcaccaatgccgataaacggtttgccgattaatagacaacaatctgctgggactggtagcttcgacagccactattctcctgcatctgtcatttcacagggatctgcggatataagtgatgccatggatcagcccccatctgattatctgacgaggattagattgttagagcaatatgcatcagccatagcagggttggtcagggatgagatcaaaggtggcaggcacttggtggcgttctctattcagctaattgttcttgcaacctggaagcaagcaattcatttatgcaatacctttgtagcttcacttgcaagggagagtccctcacaggatatccatatgaaggggcttagtgctgatgcttcgcatttgcttgcgaactcaaagctagctgatgatgtctgcgtgcagatagagaaacagtttctctccgaagttgaatatgcggaagaactagccagcactgtgggacagatagctgatggtacagagatgccagatgcaatcgaaatgatatttcagtctgctttacttacaggaaggcgaggcggtgttgatgagatgtttgggaaagcagcggatgccatgactgggtatacgagggcggtatccatgctgcggtttctcctgatcgaggcaccatcacttgccctcaaccctcctttgactctgacaagatccgatcggcatcgacttcgcacatacattgaagctctcaacaccaggctctgtcagatgcagagccagaggcattgactgctgccatgtgtcctcaaatcttgttcaggttgagggacggtagacttgtgcaatattttttcatttgtaaatatatttgttggcccaagataggacatgtaagatgtcagaaatttggaactaggcagagcagcgaaaatctattataactcgaccagactactattatgatatggaattaggtggagtgtacgtgttaggttcattctgtgtgaattcaggcagaagcttgaaaacgaaatgaccaatcatggtcacttgtggaaatgtaaactacttcgtagattctttattagtactctattccgtcggcgctcgcgatctagaactagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccttttgaagaaccaaattttacgcccccggtttggaaggataaaattttttttttgggtccccaaaattaattacaccgggccgctttttaaaacctgggtgttggaaaaacccgggggttaccaaaattaattctttttagaaaaaatcccttt

SEQ ID NO: 18484 - DNA, 1803 bp, Zea mays
caccttttaatgggggcaatcagatccagttgcttaaaaatatactcaggacatgtgaaatacgcttcccatctgattgtgacttgagccatggctgcattgacttgtgcagaaagttgctgcggctcaattcagtggagcggcttacagttgaagaatttgtgcaccacccatttctttctgaacatgctccagagaagactttgagccttacacaatctgacataagagatggctttccaagaaataatagcagtccaacaaggcattcaaaccatagttcacaagaagattgtatgccttttcctttagatgatgagtcaagtggacaggacgagggtccagttcctgacagtaagagtctgatgaaatcttatggatttcccacgggtaaaagattggataaaacttcaggccagaagagtccaccgaaacataacagtctgttctccaggtatgtcttgggcaataatcatgcacctagtagccaacaccatggccattctggtaaagtgaccaaggaaagcaagattcatgaagtacaaggtcaaaaggttgtttatccagaagattcccctatcattgattcattagagtttgtagatcaggaatacgtcttcgtgtctggaccacacctggagggatcatcatcttcaacaaatgcctctcagcagcttaatgtaccagcaaaatatgataattcgtctgtttcaccaccaaagttaactttcatgagtgcaccaatgccgataaatggtttgccgattaatagacaacaacttgctgggactggtagctttgacagccactgttctcctgcatctggcacttcacagggatctgcagatataagtgatgccatggatcagcccccatctgattatctgacgaggattagattgttggagcaatatgcatcagccatagcagggttggtcagagatgagatcaaaggtggcagacacttggaagcgttctctattcagctaattgttcttgcaacctggaagcaagcaattcatataggaaatacctttgtagcttcacctgcaagggagagtccctcacaggatatccctatgaaggggcatattgctggtgcttcccatttgcctgcgaactcaaagctagctgatgatgcctgcatgcagatagagaaacagtttctctctgaagttgaatatgctgaagaactagccagcattgtgggacagatagctgatggtacagagatgccagatgcaattgaaatgatatttcagtcggctttactcataggaaggcgaggcggtgttgatgaaatgtttgggaaagccgcggatgccatgactgggtatatgagggcggtatccatgctgcggtttctcctggtcgaggcaccatcactcgccctcaacccccctttgactctaacgagatccgatcggaatcgactgcgcacatacattgacgctctcaacaccaggctctgtcagatgcagagccagaggcattgactgctgccatgcgccctcaaatcttgtccaggtgttgtacaatattctttcatttgtaaatatatttgttggcccaaactagggcatatgtaacatgtcagaactgtggaactaggcagagcagcgaaaatctattgtaaatatatttgtagtgtggaattaggcagagtgtacgtggtaggttcattctgtgtcgattcaggcagaagcttgaaaaccgaataaccaataatagtcacgtgtggaaatgtaaacagctcggcctctacttcgtagattctttattatatattagtaaattagctcg

SEQ ID NO: 18485 - DNA, 8775 bp, Zea mays
tggcgaggcaaccgttgcaggggggtataaatagacacccaacaaaaactattttgttgctgtctatgcatagtttgcgggcacaccagaccagtccggtgtgtcacaggtgtgccactaaaccttctagtgacgtcaaccaataactagttttaaatgtccgtgcatagtctacgtgcacaccagaccgatctggtgtgtcataggtgtgccactaaaccttctagtgacgtcagctaacaactatttttaacaactagtcgttacaatattggggtccaacgtgccagttgtgcacactggactgctccggtgtgccatggctggcaagacccagtttacaaaatctttgcgaacttagtttgatgcctaattcagtggtacaccaaattggtctgacgttcactgaagggccgtgtcaaaaaacagacttaccgtgtaacaggtttggtgacctaatgctagtttatacgtaggaacacgctcaccgtgtatctggttcggtgccccaacagactggtccagtgcgcacagagacctaagaaattttccaagtgtgttttttttgttttggttttcactccgaactttttgcaggcttttgtgagatatctagcactagttttatgcaagtatacatcaccacactacatgagacaagcttagatcaagttactcatccaaaagccctttagtatggctaaaaataaataaaatgccctagctttgtattgagtgtcaataactcctttgacacttagaactaacggtccttaacctttcaatcattctttcttagccacctcataaattgtattcgtttgggttgttttcacttattgaatcccctttttttgggttgttttcacttattgaatcccttttttttgcattgtggtcgtatatctgcataatacacgttagtcacagaaatcttgtattgtcattactcatcaaaagcacttagagaattagatgctttcacacacgttttcttgttgtgtgtttttcaaactataaaaacttgaaaatagttgcgtacagagtttataaggcaaactttggcaaaaaaaaagggcgcgctgaggacaagccggccattgacgtcgccagatcatgcagctccatgccaattgcaggcacgatgcggtgtcaagcagtggaaacttctgagccgtgcaataaaacatactacacgtctacacacgaacaaaaaccatctctctcgttgttggtaggaaaaccgaagaaaattacagagcaagcttcggggtatggacctctcgtgttaaacgaagctccctgctggctgttgctgacagcgctgcccggccaccaatcccttccggacatcgccgctctgctgacctccgaatcgtccacggcggctggctcgcgattaggttgatccgccttgtttagtgccgggagacgcctctgatgtcacccatctttcagaggtttgtgtgtgagagtgacaaaagccacgcgaacgttgtctgagggcaggttcgtcatcttgatgccatttgtcgaccacgcgttcaaaccccggtgtctttcagttcctttcaaactgagcgtttcttcgaaggcctctctcgcggggtatatatattttttcagttcaaatggcaccacatttgtaaaacacgtttcaaataatcgagcgttttgttaagcgttgcaggtcaaaccgtcaaaggtatatgtccttgaatgggagaggggatgtgggacaccagctgcactctcgttctccgatcgagacgcatgtttggaacatgttcaaccgtttgattcagactccagatttttcgacggaaggactacctctacttttcccttgtgatgaagctgatgggaccatcttttttaatgattgaaaaagaaaagaaacgggttgcttagcgtcaaacattcaatgatttagtagtgcgtggtcagctgctgtatgcgaaaaagcagtgtagaaactagaccaaaaatctgccttttcttctcctaccataaacaaccgggcacgctcttcctgtgttgcggaggaccggcgggaaacatgcgtgctcgcagtcgtagcctcgcttactctgggtagtaggtgtttgttatttttgttaaattaagtacgactctgttttggcaatggtattgttttgagtaaattccaggacaaccagggcgggcgggcgggtatttgctgcagatgcaatgcaagccaggaaaacctgcaggtacagcgtcgagaactcgagataatggaggcagttggattggaggcagggtgctggattactggaaaagacggtcggcatcgtgctaccatgcgacagagaaactagcgaaggctagaaatgaaaagaaaaaaaaaactactacaggagtactggggaagaagagatctccgatgacatctgcagaacacgcagggcaggattccaaaacagagggaggcataaaaatgcaggggggagcatttcttttgctgctactagatattgcacattctgtatgtatatatgattccactccaacacctaattaaaacgcatacaaactgacaccgatctctcagtctcaccaaagctcagatgtttctttgatttgcccccaccggccacgggcacgcaacagcacccaaagctcagatatttcagtcgagaactcatcacggcgacccctgaactcctccgcgcccaacgagccgcctcaggttcccgaggtgcctctgcagggcacggcacgcgcgcgccctgagggcccggacggcgagcctgagcttcttgaggcggacgccgatcctgggcctggcccgcgccagcgctgacggccggggactcttcttctcgagcaccttgtggatgaggaactgcgccctgaggtgccgcgcctcctccgcgtccaccttgtccaccttggcgtacgcgaacggcgtcgacgcccgcaggagcagcatcttcggctcctcgcgaagcagcgactgcgaggaggagacgggatcgggagcggggtctcttggcgtgagcttcctgccgcctcggccgggcccgactctactgttatatataggctgctgccggcagccggctgaaccctcctgcagctgcagcctggctctgcctctggcctgtatttttttgtggaattattgatgggatcacgagactattaattagttggacaggccgtgtcaatgctgataacctttgtttatttttgtccgtcgccgagcttatttatctcacttctcccctatgaaacatggtgacatccttttccagagtcctagatgaaagaaacttcagtcacatctcggtttgtatctcttggacaagtcactctcgtgaagggccagaacaacacttcaaaaccattggcttcaggaaggaagaaaaatatatcaaagctgtaattgtgtacatgacgcccaaaaaaaatcacgagcttcgagtgcgaatcccagtacatggagaattttgcgctcccatcctgtctgaaacttagctgtctgtcccttttctctaaacagaggctgcatatttcttccagcttttaaacatcaagtccggactccgaggtaccatggcgctagtgtgacctttgaggattgttaagcccttccattccaggaacctccattccatacgatcaacagcaagcccagattcaaaaggaatcagaacgttaggccgggacacacggataagcctagagaacctggtgcagttccagctctctggtttggattcacttagctagttgttatataggtatcaatgtatgataggtaagtatattagctagcttattatccaaaagattcacttagcttagcttattatcctgttgttaatcaacgcatgcatgccaaggctgtcgttcgatgcaagtcaactgcaatgcccctcgcgccacttggcgcccctgacgcatcgcctaaaggttgccttgcgagaaaggtcagcttctgaccttcgtcatctcatcacctaacgcattacatgtcgcctctgccggcactcgtgacccgtgaggtcactgaagcaaccagacgaggcatgcatcattattctccttactaaattcaagcaaggtcaagatgctacattattctgttcatgagaagagaaggtcgaataacaccttattaaaagttaaggtactgctaggagaatgaaacctacagtttcttgtatgtacttttgtcaggctcgctcttgctatggatagatgcacggttgccattgttcacctgagtcctgatcctgaacctgcttgcattgccgtcccaggcctgggaatttgttgccatcccatttcagcttcccaaaagcgagctggaacaggcagccttgcccttgcagaagagaagagtttccagcagagcgaacaacggccacgaggctccgatccagcttaacacccatagtggtgaacgtcttgggcggtcaggcggagaaaactttctccttggatgctaccgctggccatttgtcgtcgtccaacgcgagggggctcatcagagttgaagtagccttttgctttctgttcgtcatgaccttgcgttgaatttgtcatccgaactagctactcatggctgtagcaattgtaaattcgtacctctatgcgaggaaattgtcaatgcagataccatttttctatcttctttggtccatactattatatgtcgtcgtgttgtagggcaaagggcctcgtgattggtcacttcattttcacagatccaaagatggcctggcatgtatgtacgataattagtttcatcagtaaaaaaaaagataagtttggattctatagtactcaaagcaaatttaggaatataaagttgcgctggaaatggagatttgtggatcatctgtcagtgagatgatgcggctactaccgatggccagcaacctcgatctatatagcccaccgaccaagatcgcacgaaacaaactacgagtactactgttcatcccctttcagcagctagcgcgtcatttctggccagccgtgcgagtcatcagagaaccaaacacgacaggagtgcacgacaccctacctcacctgtctgtctgctgtcccggcgcatgaacatgcaatgtataatatggggtacgtacacagtgcgttatatatacttatacgcatcgaaaatgcttgtacaccagaccactaccacaccgcatagtggtcgcattgctcgaaccggcccaacacgacggcggtctccatgcctcgttgccgtcagggagaagtcgaagccatcaagagggaggaggccctgccgctgccggcctcactgacgacgatccccgtcctcctcctcctccacgcgcgatgagcctcctgaggttcctgaggtgcctctgcacggcgcggcgggcgcgcgccctcacgccacggatggcgagcctgagcttcttcagccggacgccgacccttgcctgcttcaccctcaccagcgccggtggcctagctactcctagaccttaccgtaccgccctcgacgacgacgacggcgtcggatcgttgagcaccttgtggatcaggaactgcgcccggacgtgccgcgcctcctctgcgtccttcttgtccagcctgtcgtaggcaggtggcggcgttgctgcactcgccggcagcatcttggttcgcgacggcgtggcaagacgacgagggaccacgaacttcttgcacctacatgtgctgagttatatagtcgttgttcatttcttgcagctctaatccaagcaagttctgtgtccctcggaagattgcgcgtttcttcaagttataccgtactgtacggagacaaaacgatgcatggcacggtccgatcttttctgggccatacttttgccacagttccggtccatgcatgtccacgggttcagatttccaacttgtacgaatgaagaacagacgatggtgacctctcatctcactgtgatttgaaaggaccctgtacatctttgccatcgtttttgcctttttgtttgcttccaactcatttcatgtgaaaactacatttcttttttacttgtgccggcccattgactaaaactaaggcccgtgcctgacctgattttttgctcttttcttatcagggtacaaggacgccaaactttattgcgtataaatttttcaaatgaaatatggagagaagaaaatctttattgcgtataaattgtttcaggctccccctgccatggagcaagcttatacaaaaccctcacaaagcctttttccatgcagaggtagtgcctctgaattccaagtacagtgttgcctgttagttgttcagatgaaaaaaaagagaaaatgttgcctttcagttcagtgctgttctggtgaataaaaacgttgcgaaggggtatctttacactttacagctctgttttcatccggcctgtgatggaaattgtgctgcaaagtgcgcagggccgttggcccgacgacaagtattttcgtcgagagaagcaacgaaagcccactcctccaagccacccttcgctcaagtcatatttagcaccacctcggcagtcgacactgcagcacaccaacttaaatattcatcccgatctccctcactcgccgagctcagttacgagagcttgtaaccctagtgggggcattaaaggtggtgcggatgctttctgacggcttctgggcctgggcccatatgtgccactaggctggactgtccatcccaagttgggagtgtctggcggggctcagggcaagccttggacctctctaggcctgaagcggtaggcacggcgtgaggctggtttaacagagcagcgatcactgcccgcttccaacggtgggaggataacaggccggctgcactgagagcccaactcgggcccagatccacattaaagcagaccaccatcttttttttttacctttgtaaacctttggaggtcacatgttctccgccgctgcacccaacgtgttccgacttcagcagacaacgccatcttttttttctgcccatgggatccaacgtgttgggcccagcccagtatataggagtgcatgcagtggcgggcgatgatgtaaaaagatggctacttaaaattactaaggagtaaaaaaaattggtatgtataataaataccttacaaagtctggccatttggtatttgtaataccacaatatattacatacacatgatacatatcaaacaaaacgaagtcttagatgagcataagattgataaaaatttccggtaaaaaaggattgataaaaaccgaaattatccaataaaagtgataagagccaacatttgaaatatctaaaggataatgttgtatttagaattctatccattaataatttgtatttcagtaacttttcattgctacaatttatatattgttcccggcccgatttataattcatttatttttttactaagtttgaccgactcgtcttatttatttttctacaaaaaatcaaaatatatcatatgctaatcgatataatagtaaaaaatttataataactatgaaattttgaataagacgagccaaccaagctttaataaaaaaatcaaatgaatcataaattggaacaatgaaggtagtatgatgttttggggagcaagaagttatttcatttccccggtctgaattccgggaattaataacttggacttgttgcatggtctggagactttagttttttttttggtagaagttggatttatggagcaagaggtttcttatgagaaccgtaggatttgttggaagcttataatacaataatttcaccctactaggcatgtaacatgtttatgattaaagaatcgaataaactccacccaccatggttgaaatcctggtgatagccgtatctagttgtcctagtcggtgttgagaccaaaaagtgcgtcagtgcgtgcaaccagccaaccacttcaaactacactatagtatagtacgataaaatattaatcgacatgcgtgataggactacacgcatgctctccaaaacccaaacgattccgttccatgcccctccgacgccacttctcgtcgttacaaaaaaaagggcccatcagcgccacagactgacagtgatctagatcctcaatcaaccttctaggaaaggctgctgcttgtcgtcccacttgtccagccttgccctggcgttctccacctgcaggcgggctcacaagtccaacaggatacaacaatcatatatcatttcaggtctcgctgctatgaccaacatgtgcatggatggcaatatggcagggcatcgtgctgacagttcgtccatcacctccttgttccagtcggttctgaaggggtgtgattggttcccttccatgctgagcctggctcgcccaatcagccaggttatagatgacccggtttaatgtatgcaacagtccaatgtttggttaattgatggcctattttaattgttttaatgtatgaatcagtccaatgtttggttaattagttcaattagtcctggctataacgagacaatgttcggttgcatgtatcaaaagggtattagagtagagtaaagttcacaaatattttttcaaattttatacaacatgtgtggtatagtgtagcgctcggcaaaccgagtgcccgataaattgcactcgacaaagagttagattctgatagtgcttccaaagtcggacctgtgcgccatgtccattccaccagagcgctcacgcaaaccgcataatgatgaatctaataaaaatgctattaggaaattaaggtcagcttcattatact

SEQ ID NO: 18486 - DNA, 400 bp, Zea mays
  misc_feature (34)..(34): n is a, c, g, or t
ttgggtacccctcgaggtctcggccaggccgggngccgagctcagtagcgagagcttgtaacctaagcgggggcattaaggtggtgtggatgtttcctgacggattctgggcctgggcctgtatgtgccactggccggcctgcccgttccaagttggttgtggctggtggggctcgggcgaaggcctgggcctctctagacctgaagcggcaggcatggcgtgaggctggcttcacagagcagcgatcactgcccgcttccaacggtgggaggataacaggccgctgcattgcaagcccaactcggtccagagcctcattaaacagaccaccatcttttatttgtcatgtgtatttaaaaaaaaaaaaagaaaaaaaaaaaaaaaaaaaaaaaaaaaaaa

SEQ ID NO: 18487 - DNA, 912 bp, Zea mays
aggccggccggaaggcagtatgtacgccccgaggccagagctagtgatgactgatgactgacgagcctctatagcatacagcaccgcgcgcggcggagccaaagccaaggacggtccggtcgtatgaataagtatcacccccaccagaaccccacgccacacaccaggcacgccagcctcactcactccccagaccacctcacacgcacgaagcagcagagcagtggactggactagcaaggtgggcaacatgaagcctgcggccaccgccagagttgctggcctcctcttcttcctcgtcctcctcctggcgctgccttccctccgcgtctccatggctggatcagggttctgcgacggcaagtgcgcggtgaggtgctccaaggcgagccggcacgacgactgcctcaagtactgcgggatctgctgcgccacctgcaactgcgtgccgtccgggaccgcgggcaacaaggacgagtgcccatgctaccgcgacatgaccaccggacacggcaaccgcaccaggcccaagtgcccctgatgatattcattccttcgctccctccggggagccagctgtcttgcatgcgtatatgtaatgtatgtataggctgtgcaatgcatgcatacatgatacatgccgtgactctggatcggcggatgcctatgcatgcttttcactagctattattactactactactactcttcctgtcttcctactgtgtgcaccagagtgagagggacgacatgcatggcgatgacatgtcgtgttatgtgcactggcggccgcttggccaggtcataatccatgatgtgtattgtaatacgtacacacccttggctttggaactgctactagatgcatgacatcgtgcttcttggtaccaaaaaaaaaaaaaaaaagcccct

SEQ ID NO: 18488 - DNA, 815 bp, Zea mays
aaaggcaaggcagcatgtacaccaagagaggccagagcgagctagtgatgactgacgagcctctatagcataaataaatatcatccccaccagaaccccaagccaccaggcacgccagcctcactccccagaccacctcacacgcacgaagcatcagcagtggactggactagctctaggtgggcaacatgaagcttcagaccaccgtcaccgttgctggcctcctcctcttcctcctcctcctggcgctgccttccctccgcgtctccatggctggatcagggttctgcgacggcaagtgcgcggtgaggtgctccaaggcgagccggcacgacgactgcctcaagtactgcgggatctgctgcgccacctgcaactgcgtgccgtccgggaccgcgggcaacaaggacgagtgcccatgctaccgcgacatgaccaccggacacggcaaccgcaccaggcccaagtgcccctgatgatattcattccttcgctctgtcttgcatgcgtatgtaatgtataggctgtgcaatgcatgcatacatgatacatgccgtgactctggatcggcggatgcctatgcatgcttttcactagctattattactactactactactcttcctgtcttcctactgtgtgcaccaaagtgagagggacgacatgcatggcgatgacatgtcgtgttatgtgcactggcggccgcttggccaggtcataattcatgctctgtgtattgtgatacgtacacccttgcctttggaactgctactagatgcatgacatcgtgcttcttggcaaaaaaaaaaaaaaaa

SEQ ID NO: 18489 - DNA, 928 bp, Zea mays
tggggccccccgggcccgccggggaaggcaaggcagcatgtacacccagaggccagagctagtgatgactgatgactgacgagcctctatagcatacagcaccgcgcgcggcggagccaaagccaaggacggtccggtcgtatgaataagtatcacccccaccagaaccccaagccacacaccaggcacgccagcctcactcactccccagaccacctcacacgcacgaagcagcagagcagtggactggactagcaaggtgggcaacatgaagcctgcggccaccgccagagttgctggcctcctcttcttcctcgtcctcctcctggcgctgccttccctccgcgtctccatggctggatcagggttctgcgacggcaagtgcgcggtgaggtgctccaaggcgagccggcacgacgactgcctcaagtactgcgggatctgctgcgccacctgcaactgcgtgccgtccgggaccgcgggcaacaaggacgagtgcccatgctaccgcgacatgaccaccggacacggcaaccgcaccaggcccaagtgcccctgatgatattccttccttcgctccggggagccagctgccagctggggctgtcttgcatgcgtatgtaatgtataggctgtgcaatgcatgcatacatgatacatgccgtgactctggatcggtggatgcctatgcatgcttttcagttttcactagctgctactactactactcttcctgtcttcctagttcctactatgtgcaccagagagtgagagggacgacatgcatggagatgagatgtcgtgttatgtgcactggcggccgcttggccaggtcataattcatgctctgtgtattgtaatacgtacacacccttggctttggaaaaaaaaaaaaaaaaaaaactcgagactagttctctcctcgtgc

SEQ ID NO: 18490 - DNA, 2854 bp, Zea mays
cattgggtacctcgaggccggccggggctcatgcagccacgctggccccaccaccgcttcctttcctcttcggctgctccgcctcgcctcccagttcacagcccctcccaggctccgaatcggcggccacttctcattcctcacttccgtcctcgcgcaccaccccctccatccgttccggatggtgccttcgaaatcccgtccggcgccctagcgtagctcgggctcggccaggctccgggcccgccgcgccgttccgcagtccagctccacctccagatcttttcttgagtttaaggaagatgcttgcctttatttagaaggccctttttggtacgtcagcagtgttctttcctataggagtaaatgccattccgtagcatcgtgcgtgatgtaagggatggtttcgggagcttgtctaggaggggatttgaggtcaggtttctgagtcatcgcagagggaaatctcatggtgctgtccatgagctgcacgacccagtgcttgtggtacagagtagctgctgggctagcttgcctcctgaattacttcgagatgtgattgagaggttggagaccagtgaggatacatggccttctaggaaacatgtagttgcttgtgcagctgtctgcagaacatggagagagatgtgtagagagattgtcaagagcccagagttttctggaaaaatcacttttcctgtttccttgaagcagcctgggcctcgagatggaactattcagtgttttattaagagggataaatctacccaaatctacagtctgtaccttagttttagctctgccgtgcctgtcgaaaatggcaaattccttctatccgcaaaaaggaactgccgtgcaacatatacagaatatataatatcaataaattctggtgatacatctaggtgtacaagtaacaacacatacattgggaaattaaggtcaaatttccttggcacaaaatttgtaatatacgatactcatccgccatacaatggaactagtcaaacagtggcagggaaaacaagtcagagattctactccaagaagggatcaaccaaggtttcttgcaggtggtacagtattgcacaaatctcatacgagctgaatgtcttgggaactcgaggcccaaggcggatgaactgtgtaatgcactccatcccagcttcatgccttgaggctggtggcagtgtcccttgccagccggacagcattgcagcccactctgttggcggatcattcagcagtgtgtccttgtcaaagtcatcgactatggaccactctatgcatttcaccagttcccggctctctgatgccataacaggagatggcattgtgaacagaggccaggcattgaatgatgctgacgatgaagagtgcaaggacatgcctttgatcctccgcaacaaggccccaaggtggcacgagcagcttcagtgctggtgcctcaacttccggggccgggtgactgtcgcctcggtcaagaacttccagctagtcgcggcgacacagcctgccgccggagccctgaccccatcacaggcagccccgcagccagctccgcctcctccgccggaccaagagaaggtcatactgcagtttgggaaggtcggcaaggacatcttcaccatggactactgctacccgctgtcagccttccaggccttcgccatctgcctgagcagcttcgacaccaagttggcctgcgaataaatcctacctacaattctggtacctaccaaataatcaaaaacactgattgtcgtggtgttcgtccaagaaccgagtttagctgagacgccattgggcaccatgtgctggtgccttgttaactcagaaacgcgtgggggctgaatctgtttcagcagcttccttgtgataatctgtagctgctgcttcgctgctgttgtatcctatgctttcatttctttccggttccgctgtagcttcttaccccccggtgacattagttcggtacccgtatctggatatttttttagccttcttcgttggattgttcaccggtgatggcatgtattaacagagatagttacatacagatgtaatgaattcaggtctggataattttgctttcggttgctattggaaaaaaaaaagatggctgctgtcatcttcagcagggctacgactgctgtcacttttttttccctagtggactgctgatgtttcttttgctgtcaccttcagcagggtcatcagggaggtgactgatgaggtgtttatttgtttgttttgcttcaaagcgaggcctttagcacggacttttcgcgacgagtaaataaagctacacagataattgcaggcggagagagtaaccaaaatcttggggcgcaggtcgggagaaagatccgaaagggacctcgtatcatattctagacgcagaggcgtccctgtctagggtttggtgggatgacagagacggggtgcaatccaatgcaaatgcgatacagacgcacgctagttgctaatgctagctaccctcctcggtgctccccttgctcctgtggcgtgcgggaaaaaggcaacttaacaccagcatcgtccgaggcagcagcaacggacgactccacaagatcaaggtatgaattttcaacaggcacagggccttgctgcatccatacctcctgaagttctgatccaccccaacgtatgtacctagagctgcaggttttcgtgtcttctttatcaacaactcacagcagccaacaacttccatttacatcaaagcaacagtgcccagcgccacttcagtgcggcagcaatggcattggcgtcctgagtggtggctgcaatgggcatactgagcccaaactacctcaccgatagccaacag

SEQ ID NO: 18491 - DNA, 4098 bp, Zea mays
ctgacctctctgtgtcgtctcctcgcgagcccgtgaaccctgcttgtggttgtgcacccacaacagcaacaggatgctggatgcgtgcataaagttgcatgcaggccaaaactggctctcttcacaaggcacatccggccgggctcttcactctctcctccgtcgtctcgtcactcgtcagtcctcgctctcttcactcgctgaaaggcaggctggtggagtggaagcgcttcactccccttcgtgccagcccaggccatccgcccatcgccttccactggactcatctgcttggcactcctcgcccagtgcttggattcttgcacttggtgcttcccttcgcctacctcacatcaccagcccagatccaatccacacgagatttgcgacgctccggcctcccggcacgaagcctttctagggatcgccacacgccggccggggcgaaaaaagctcttcttggagcccttctgcttggcctctccctctcttctctcccggcgtcattctcgccgctgcctgcgagcaacaacaattatggccgccgcgacgtcgcgcgggccagcgtcggtcgccatctgcgcgctcgccgtgctccacgcaatggctgcgctgtgcgactccgccaccgcggcggcggcgacgtgcgccggcctggccccggccaagcaccggccggaggtgatatccatcgccgacttcggcggcgtgggcgacgggcggacgctgaacacgtgggcgttccgcaaggccgtgtaccgcatccagcaccagcggcggcgcggcggcacgacgctgcacgtgcccgcgggcacctggctcgccggcagcttcaacctcaccagccacatgacgctcttcctcgccagaggcgccgtgctcaaggccacgcaggtgcgtactgcgtagtgcgtacacgtacgcgagatgctacgagctgaagctgatggatcgagcgaaaaggccaatggcatcgtgtgcaatgcaatgcgtgtttcgagtagtagacgggatgtgtgctaatactatgcatcgtgcgtgcatgggctgccgcgcgcgcaggacacgaggggatggccgctggtggagccgctgccgtcgtacggccggggcagggagctgccgggacctcggtacgccagcttcatcctcggcgacggcctccgcgtcgtcgtcggttcaggggggctgagcctcgccttcccttgctcggctaggcttcctcctctgcctactgctctgtcaatatgttgcttactactgtgtgcccgtgagtatcctctatctatctgggaggacaaaaaggctgacatgcacaaggtctccttcctcgtcggagaagactgaatcctgcacaaacatatatttgccatactactgccatagtgcgtaccacgcgtccactccaaaaggttcacaaggcagcacgggactttgtataaattacttactactggatcacaatcacaacacacttttgtcagtgctttgcttaaactaaattctgaggcccataccatactcctagctagatactagctggtaccagcagacagcagagcctgaattgttaattccattcactatcctctgggatcgtgatctcgtccctttccttgggcattgttaggtgacaggggagtcatcgacgggcagggtgaggtgtggtggaacatgtggaggaggcggacccttgagcacaccaggccaaaccttgtggagttcatgcattccaccggcattcacatctccaacatcgtcctcaagaactcacccttctggaacatccatcctgtttactgcgagtaagcgcgctaactacttagagaatctaaaatccacggccccaaaatcaataatcctgaatcatgattacatacattctaccaaaatagaggatttaaattccttcttttcagcaacgtggtcgtaaccaacatgatgatcttggcaccacgtgactccccaaacacagacggagtcgatccaggtatgtaagctattgcatctgcagctcctgcccgtgtcactcagtcacacatgcgcgctcgctcaaataaagaaaccatggcggtgcgcatgcagactccagctccaacgtgtgcatcgaggactcgtacatatccaccggcgacgacctggtggccatcaagagcgggtgggacgagtacgggatcgcgtacgggcggccgagcgccggcgtcacggtccggcgcgtgaggggctcgtcccccttcagcggcatcgccatcggcagcgaggcctccggcggggtgcgcgacgtcctggtggaggactgcgccatcttcgacagcggctacggcatccacatcaagaccaacgtcggccggggcggctacatccgcaacgtcaccgtcgacggcgtgcgcctgaccggcgtgcgcagcggcgtccgcatcgccggcgacgtcggcgaccaccccgacgcgcacttcagccagctcgccgtgcccacggtcgacgccgtgcgcatcagcaacgtgtggggcgtcaacgtccagcagcccgggtcactggaggggatccgggcctcgcccttcacccgcatatgcctctccaacgtcaagctcttcgggtggcggagcgacgccgcctggaagtgcagggacgtgcgcggcgctgcgctcggggtgcagccgtcgccctgcgccgagctcgccaccagcttcgcgtccgcacggtcctcatgcagctagttagtgtcagtgatgcctagctaattaatttctgaattctgatgatgggtgtgcttttaagtttgggctttgttttacttattctatggcaccgatgtctgtctgtctgtctttgcttgctcaatcacttactttaggcttccactgctaaagtgctaatcgttcagaaaaccttaccactgcaaataattttgtactccctacattctaaattataaaatatcttagtatttatagatacattaatgtagctataaatttaaaacaactaagatgttttataaattgaaacgaaggaactaatactctttataatgtttaattaactgtggtgcgcctaatccagatacaaatttaccatcagggcatgtataagctagatacagctttgtggttgtctaggtacacgatacaacttagatacagcttgctacaatagggcgtatctaagtctgctatcttaataaatgcatctatatttcttgtattgaattatgtttgattaaatgtgcacataactttgtatacaaacatgtgtttagataaaaaccgcatagttcagatttcttgtaataaaaacgcatgcaagaatacaaacgtatgcactagcaattaaactgaactgatctattagcgtttacaaaatctgaacaagaatacaaacgtatgctatctgacagagttccttttcagtataccccatatgctgagctgaatacaccagttcagtgaatacattctattcagtattatgtacagaactttaacagtaactaaacaagagatatattgaccctttggatgcctgctgttcgaccattaatttacaatggaaactacactgaacttttatgaaatctgaaaatactttctatgctacctgacagagcttttatgaaatctgaacaagaattcgagctgcacatcttgaagaacaaaagctgccgctgcctaaactaaactgatcaacaccggtgattttacgatttttgcgctaaactgaactgaatactgaataccaccaagtcttggcatagaaagtactggcgtagaaactggactgatcaacagcgaaactgaatagcaccaagtattggcaatacatacatcaacaaagcacccgaaacaagatatatattcagtcactaaagaaatttatctaacaacgaaacaagagatatatgttagattggatggtgcctagaatcaattactaagtccatagaataccaatccgtaactgaaaaacctcgatgacgagtagatctgttatactgagaggaatagggaagcatacattcattattgttgttgacgcgttctgtgcagtggtgatggagagttgtcgtttgccgtcggcatcacctttgttgccctgcag

SEQ ID NO: 18492 - DNA, 1953 bp, Zea mays
ccgggctcttcactctctcctccgtcgtctcgtcactcgtcagtcctcgctctcttcactcgctgaaaggcaggctggtggagtggaagcgcttcactccccttcgtgccagcccaggccatccgcccatcgccttccactggactcatctgcttggcactcctcgcccagtgcttggattcttgcacttggtgcttcccttcgcctacctcacatcaccagcccagatccaatccacacgagatttgcgacgctccggcctcccggcacgaagcctttctagggatcgccacacgccggccggggcgaaaaaagctcttcttggagcccttctgcttggcctctccctctcttctctcccggcgtcattctcgccgctgcctgcgagcaacaacaattatggccgccgcgacgtcgcgcgggccatcgtcggtcgccatctgcgcgctcgccgtgctccacgcaatggctgcgctgtgcgactccgccaccgcggcggcggcgacgtgcgccggcctggccccggccaagcaccggccggaggtgatatccatcgccgacttcggcggcgtgggcgacgggcggacgctgaacacgtgggcgttccgcaaggccgtgtaccgcatccagcaccagcggcggcgcggcggcacgacgctgcacgtgcccgcggccacctggctcgccggcagcttcaacctcaccagccacatgaacgctcttcctcgccagaaggcgccgtgctcaaggccaccgcaggacacgaggggatggccgctggtggagccgctgccgtcgtacggccggggcagggagctgccggggccgcggtacgccagcttcatccacggcgacggcctccgcgacgtcgtcattacaggtgacaggggagtcatcgacgggcagggtgaggtgtggtggaacatgtggaggcggcggacccttgagcacaccaggccaaaccttgtggagttcatgcattccaccggcattcacatctccaacatcgtcctcaagaactcacccttctggaacatccatcctgtttactgcgacaacgtggtcgtaaccaacatgatgatcttggcaccacgtgactccccaaacacagacggagtcgatccagactccagctccaacgtgtgcatcgaggactcgtacatatccaccggcgacgacctggtggccatcaagagcgggtgggacgagtacgggatcgcgtacgggcggccgagcgccggcgtcacggtccggcgcgtgaggggctcgtcccccttcagcggcatcgccatcggcagcgaggcctccggcggggtgcgcgacgtcctggtggaggactgcgccatcttcgacagcggctacggcatccacatcaagaccaacgtcggccggggcggctacatccgcaacgtcaccgtcgacggcgtgcgcctgaccggcgtgcgcagcggcgtccgcatcgccggcgacgtcggcgaccaccccgacgcgcacttcagccagctcgccgtgcccacggtcgacgccgtgcgcatcagcaacgtgtggggcgtcaacgtccagcagcccgggtcactggaggggatccgggcctcgcccttcacccgcatatgcctctccaacgtcaagctcttcgggtggcggagcgacgccgcctggaagtgcagggacgtgcgcggcgccgcgctcggggtgcagccgtcgccctgcgccgagctcgccaccagcttcgcgtccgcacggtcctcatgcagctagttagtgatgcctagctaattaatttctgaattctgatgatgggtgcgcttttaagtttgggctttgttttacttagtctatggaaccgatgtctgtctatctgtctgtccgtctgtctctgcaggcccctgctcaatcacttactttaggcttccactgctaaagtgctaatcgttcagaaaaccttaccactgc

SEQ ID NO: 18493 - DNA, 2251 bp, Zea mays
  misc_feature (479)..(479): n is a, c, g, or t
gcacgagaccattacctagaacatcctaatcgaaaaacctctcctctcgcttttcaccttccctcactccacagtttcccaggaaggggtagccgtcccgtcccccactcctcccgttcccgtgctgctctcagcaagaagaacaagggagaaggaaacccaccacaccacccctgataaaagaaggggacgcacgctcccgctcccgctcccgccgcgacgccatggacgcctgggaggccaccaaggcggtgttcgaccgggtgcgggcgctggacccggacaacgcgtccaagatcatgggcctgctgctaatccaggacaacagcgacaaggatctcatccgcctagccttcggccccgaccacctcctccacgccttcgcggccgcagcgcgcgccgacctcgccgccaggcccgcgtccccgccgtcgcccgtgcccggcccgctccaccagcccgcctcgccctgggcgccngccctccgaccacgcgcccgggtacgactacgacggcgccgacgccgacacattcttctccgacgactacgactgctggtccccggccggcgccaccgcccaccgccgcagcttctcgcttagcgacgccgagctcgccgccgccgccgccggccccggcgcgtggcggccctgcatgtacttcgcgcgcgggttctgcaagaacggctctacctgccgcttcctccacggcctgcccgaggccgcccccgacgccgcggagcgcgagatggccgtcatgcgcgccaaggccctcgccgccgccgccgccgccgcgcgcccgcaacagcagcagcagcagctcatggcgtccgcgttcccgttctcgccgtcgccgtcgccgcccaagggcgccaacctcaacctcctgctccaccaccactacccgcagcaaagcgagccccaaaggccgggggccgccatgctgctccagggcggcggcggcgacgacatgcacagtagcaggttcccgctgcggtcgcccggccggatggaccgcggcgagctcgtgtccagccccgccgcgcggcagatctacctgaccttcccggccgactccaccttcggcgaggacgacgtctccaactacttcagcatgtacgggccggtgcaggacgtgcgcatcccgtaccagcagaagcgcatgttcggcttcgtcagcttcgtctacgccgagacggtgaggatcatcctgtgcaagggaaacccgcacttcgtgtgcgacgcgcgcgtgctcgtcaagccctacaaggagaagggcaaggtccccgacaggttcaggaagctgcagcacccgcacctcggtgacttcgtcgccggctgcacgtcgcccactggattgctggattccagggaccccttcgatctgcagcagccacagatcggaccaaggatgatgtacgggaacatcgccaaccacgaggcgttcctgaggaggaagctcgaagagcagcagcaggccatcgagctggagggccgccgcttcatggggctgcatctcctcgacctcaagatcaggggccaccacctcggctcctcccccgccacgaccgtcgtggggcaaggcgagggcggcaagggcagtggcaatggcaatgccgtccagctggaggatgtcatcgtccaagatactcctacgaagatgaacagtaacagccttgcaatgagtgcgcctgcagctgctgtatctgctgcagccgatgcaggaggcgagcacgaggagcagcaggaagcagggcacggggaggaaggcgacggcagtcccaagcaggcagtcaaccttggggaagacgagaagacggaatctggccccgtcacagctccacccattgttgctcgtggattccaagaaaggttaagactgttgttgtggagtatttcttttggggaaaggaacggggagaaaaggcaggaggatagagaagcaaagcagacttggatcaactttcccttttctttccttgagcatgttttgccggttcatcatagaaaaaaaacgttagccatcttgacataaacacgctacagttatcttcccggcctaaaaaaaaaaaaaaaaaataagcaactgcataaaagtgggctaggtatgtagtgctgtgcggatcattcgttggtggttttgaatctttgattgaaccaacaaaattgaggggaaaaaagaaagcaatggccgaaaggcagggggaaaagggaaacaagtgctgccgcagctaatggctgttgttaagctg

SEQ ID NO: 18494 - DNA, 1885 bp, Zea mays
  misc_feature (1869)..(1869): n is a, c, g, or t
ggccggtgcaggacgtgcgcatcccgtaccagcagaagcgcatgttcggcttcgtcaccttcgtctacgccgagacggtgaagatcatcctcagcaagggcaacccgcacttcgtttgcgacgctcgcgtgctcgtcaagccctacaaggagaagggcaaggtccccgacaggttcaggaagctgcagcacccgcaccacggcgacttcgccggctgcacgtcgcccaccggactgctggattccagggaccccttcgacctgcagcaaccgcagattggacctaggatgatgtacgggaacgttgctggccacgaagcattcctgaggaggaaactggaagagcagcagcaggcggccgagctgcagcaggccatcgagctggaggggcgccgcttcatggggctgcacctcctcgacctcaagagcaggggccaccaccacctcggctcctcccccgcggccatggccaccaccactctggggcaaggcgacgacggctgcaaaggccgcagcgccaacgggaatgacaatgccgtcgccttccatttggaggatgccaacatccaagatactcctaccaagatgaacagtaacagccttgcaatgagtggtgggcctgcagccggtgcaggaggcgagcacgaggagcagcagcaggatggggacggggatggcagtcccaagcaggcagtcaaccctgggaaagaggagaagacggaatctggtcctgtcacagccacgcccattgttgcctgtggattccaagaaagtggcgtggtggagcacatcttgcctgacagcccctttgcgtcccccagcaaggcctccactcaaaatgggagcatcatcagcaatgcggcttcatccctcttccccccgcctgcatccaccatggagctgcccccgtacagctcttgcttcttccaggcgcccaggttttctcctgggcatgaagccattgggctgtgaatacagagcaaggggagggagggggtctactttcctctaatctgtgaggactatcggtgaccccgtccagtggaggcaagagttaggaagctttgattaacaaatactaggtgtatgttcagagagagggacagcaacaacagcaaccaaaaagagagagagagagacaaagacaagtctaggttgttttagctctaggccctaagtatatgatgatagcagtcgtataaataacagtgttttagtaagtatctcctgccgggtatgaagactcaagaacaaaggtcagatctcgcgtatgctcgtttgtagcagtgtggatctgatacaggtaattgaaacctttagatggtggtagggctagtagtgagcagtagacgacaactagtcctggcagccagttgtagtgaggtgacatggctgcatacagacatccaaccaaaggaaacagagggtgtggtgtggaaagaaggggagagtggacaaaagccagacatggctggcgctgctgctgcataggcacaggcacaggcacagggaaaggtgatgagacgagaggggtggggtggtactctgctgggaccggcgcactcacgggtgcggagaatcagcttcgcctcacgagcgatgcagcagcggagacacagacacctctcgtctgcgtactgtttcgcccatgctcttgtcttgtacgcatgcagcagcgctccttgtcctttggctccatcgatgtattacctgctcttcttttcaactaggagtttagcggacaaagaaatgaaaaagtaattagcagtcatttatcttggtcaaaaaaaaaaaaaaaaaaaaaaaaaaaaaaaaaaaaaaaaaaaaaaaaaaaaaaaaaaaaaagaagaaaataaaaaaaaaaaaaaantaaaaaaaaaaaaaaa

SEQ ID NO: 18495 - DNA, 2828 bp, Zea mays
  misc_feature (63)..(63): n is a, c, g, or t
  misc_feature (2772)..(2777): n is a, c, g, or t
cgctgcttcagggcccccgcggcggcggccatgctgctccagggcggcgacgacatgcacagncagggttcccggtgcggtcgccccggatggaccgcggcgagctcatgtccagccccgccgcgcggcagatctacctcaccttcccggccgactccaccttcagcgaggaggacgtctccaactacttcagcatgtacgggccggtgcaggacgtgcgcatcccgtaccagcagaagcgcatgttcggcttcgtcaccttcgtctacgccgagacggtgaagatcatcctcagcaagggcaacccgcacttcgtgtgcgacgcccgcgtgctcgtcaagccctacaaggagaagggcaaggtccccgacaggttcaggaagctgcagcacccgcaccacggcgacttcgccggctgcacgtcgcccaccggactgctggattccagggaccccttcgacctgcagcaaccgcagattggacctaggatgatgtacgggaacgttgctggccacgaagcattcctgaggaggaaactggaagagcagcagcaggcggccgagctgcagcaggccatcgagctggaggggcgccgcttcatggggctgcacctcctcgacctcaagagcaggggccaccaacaccacctcggctcctcccccgcggccatggccaccaccactctggggcaaggcgacgacggctgcaaaggccgcagcgccaacgggaatgacaatgccgtcgccttccatttggaggatgccaacatccaagatactcctaccaagatgaacagtaacagccttgcaatgagtggtgggcctgcagcagcagcagcagctgctgcgtctgcagccggcgcaggaggcgagcacgaggagcagcagcaggacggggacggggatggcagtcccaagcaggcagtcaaccctgggaaagaggagaagacggaatctggtcctgtcacagccacgcccattgttgcctgtggattccaagaaaggttagattgttgttgtggaggattttaaaaatacctaccaaatgggcacaccacaccacaccacaggccagtacagtatttctttttgggggaaaggaatgggaggaaaaggtagtttagagaaacaaagcaagcaggctggctgcatataactttcccttcattccttcaggcatgttttgctggatcacagaaacagtttaggcacattgaaccaaaaaaaagaggtcctgccaaacaaattggttgcatcaccctagctataagtttggcaaagaggttggttgggcaatccgcgatagcaaagcaaatccaacaagtttggttttatcattatgctgtatagtatacaaatctctgggctttaggcctaatgtgcctctattaaacaactgcaaaagagaagtcattgccgcatctaatggctattgttttaagctgtattacacttgttgcaacttgttccctttcttttgggtttgcccgtccctgatctttcctggactgatatgtttcttgtttgcttggatgacagtggcgtggtggagcacatcttgcctgacagcccctttgcgtcccccagcaaggcctccactcaaaatgggagcatcatcagcaatgcggcttcatccctcttccccccgcctgcatccaccatggagctgcccccgtacagctcatgcttcttccaggcgcccaggtagaaacccagccacttctcttcagttctttttttttcaatacaatagcagagttgtttggtactaagaagctgtttgttttccatcaggttttctcctgggcatgaagccattgggctgtgaatacagagcaaggggaggagggggtctgctttcctctaatctgtgagtaagtgtcaacatccctacctggccttttgagaaagctgtaacagtcagctgctcaatcattacacataaaaaaacccacccttccctacctgacggtcgtgttaattgtttggctttcctctcatctgtgaggactatcggtgaccccgtcaagtgagtggaggcaagagtaggaagctttgattaacaaatactaggtgtatgttcagagagagggacagcaacaacagcaaccaaaaaaaaagagagagagagacagagacaagtctaggttgttttagctctaggccctaagtatatgatagcagtcgtataaataacagtcttttagtaagtatctcctgccgggtatcaagactcaagaacaaacaaaggtcagatctcgcgtatgctcgtctgtagcagtgtggatctgatacaggtaattgatggtggtagggctagtagtgagcagtagacgacaactagtcctggcagccagttgtagtgaggtgacatggctgcatacagacatccaaccaaaggaaacagagggtgtggtgtggaaagaaggggagagtggacaaaagccagaccggacagacatggctggcgccgctgctgctgctgctgctgctgcataggcacaggtacagggaaaggtgatgagacgctgctgggaccggcgcactcacgggtgcggagaatcagcttcgcctcacgagcgatgcagcagctgagacacagacacagacacctctcgtctgcgtactgtttcgcccatgctcttgtcatgtacgcatccagcagcgttccttgtcctttggctccatcgatgtattacctgctcttcttttcaactaggagtttagcggacaaagaaatgaaaaagtaattagcagtcccttatcttggtcnnnnnngaaaagaaactaggaaagttacttttgcttgacaaaacattatggggttgt

SEQ ID NO: 18496 - DNA, 639 bp, Zea mays
agaagtcatcaagacatacctaagctcgcaagagtagttgctagtacatgtcgtggtttgccccttgctctcaatctcattggtgtggccggcaccaggagagagagctctagtccccccccccccgataccaataagcaatttgctcattagagaacagagaaaaaaaaaaacaatggcaactcaagccgccgggatcttcaactccgccataacaaccgccgcaacctccggcgtcaagaaactccactttttctcaacaacccaccgtcccaaatccctctccttcaccaaaaccgcaatccgcgccgagaaaacagattcctccgccgccgctgctgcagcccccgccacgaaagaagctcccgtgggattcacgccaccgcagctagacccaaacacaccgtctccgatcttcgctggaagcaccggtggtcttctacgtaaagcgcaagtggaagagttctacgttatcacgtggaactcaccgaaagaacagatctttgagatgccgacaggaggagcagcgatcatgagagaaggtccgaatcttctgaagctagcgaggaaagagcagtgtttagctttggggacaaggcttagatccaagtacaagatcacttaccagttttacagagt

SEQ ID NO: 18497 - DNA, 1607 bp, Zea mays
gcacgagaccattacctagaacatcctaatcgaaaagaccaatcgttcctatgaagatcaccgtgcagtcgtcgaagctggtcacgggcagctccagcggcggtcgtccttcttccgccgatgccgccgaggcggtcccgctcacggtgttcgacaagctccactacgatctgtacgtgcatgccttatacttcttccacccgccagcgccgcccagctccgtcctcgaggccgggctcgccgccgcgctggccgagtacccggagtaggccgggcggctcggcgtggacgcgcgcggcaaccgcgccatcctgctcaacggcgcgggcgcgcggctcgtcgaagccacggccgccgccgccgacgtctgctcgctcgacagcgtcgtgccgccggagccagcgactcccgcgaccatgagcctgcaccccagcgccgaggacgccgtcgacggcgaggtcctgctgctccaggtcacgcggttcgcctgcggctccttcgtcgtgggcacggcggtgcagcatgtcgtcggcgacggcgccgccttccactgcttcgtgagcgcctggggccaggcctcgcgcggcgccgccgtggaccccgcgcccgtgcacgaccgcgtgtccttcttcgtgccccggcacccgcccttggtcgagttcgagcaccgcggcgcggagtacaagcggccgcctcgccctcgcgagggcgaggagaaggccgggggcagcgagtcaggggccaaggccaaggccaacgccgacgtcggcgaaaagcagctggtgacgcgtagggtgaactttagccgagagttcgtcgccgagctcaagacgagggcgtcagcgggggcgcccttgccgcggcggtacagcacgctgcagtgcgtggcggcgcacctgtggcggtgcgtgacgagggcgcggaggctcgacgcgcgcgcccgcaccaccctccgcatcgccgtgaacgggcggtcgcggatgaggaacccgcgggtgcccgaggcgtacgccggcaacgtcgtgctctgggcgcgggcgaccgcggccgcaggcggcctggtacggagcccgctcccggaggccgtgcggctcgtgtccgaggcggtggcggccgtggacgacgcctacttcaggtccgtcatcgacttcgccagctccggggccctggaggaggaaggcctggtgccggcggccgacccgttggagacggtgttcagcccggacgtcgaggtgtacagcctgctgggggcctcgttccaggacttcgacttcggcggtggcccgcccttcttcttcatgccgagctactcgcccgtggagggcgccgtattcgtcgtgtcgtctttctccggcgacggcagtatcgacgcctacgtccctctcttcagccacgcgatggacatcttcgacaaatgctgccactccctgcctgctgcggacgcacgactttaggcgcgttgactttgcttcgtccgagatgatacatttcgtgaaataatcatttgcaaaaaaaagaagtaagatggattcggttatcatgtcaggagatgaatattaaggtagataattaagatatttcctaaaaaaaaaaaaaaaagtaaaacg

SEQ ID NO: 18498 - DNA, 623 bp, Zea mays
  misc_feature (26)..(26): n is a, c, g, or t
  misc_feature (29)..(30): n is a, c, g, or t
  misc_feature (44)..(45): n is a, c, g, or t
  misc_feature (57)..(57): n is a, c, g, or t
  misc_feature (71)..(71): n is a, c, g, or t
aagctggagctccccgcggtggcggncgnncttttttccccccnncccccgggctgnaggattttccccanctcactagtcccccccccccccccccaagaaaagcctttcgtacctgtggtggtgtcgctcccacagctggcccctaaagtctcaagcttctcataagtctcctcaacaccatggtctttcagatattgaatgacatggtctccaataacggggctagtcactgcatcaagcacgagattcctctgacggagcagttcaccgtagtgatcggcagtctcccggagactgcgcttcgatgcccaagagcgggtcgcgtattgacaggaaagttgacgacgttcgcagcgagtacagggagcatttccatcgcactgagagagttggctgtgtcagattatgagaattcagggctcatttcaaaagaagtggcctggaagagcactaagcagcatagatgcaacccctgcgcttttgggccacacaatccacttacctttgctctcttctcccggcaactctggcaagctgtgtgtgttatgctgtttctttttgcatggtttgactggttgtcttgatgactcgggcattatgaaagatgaaaatctttaaca

SEQ ID NO: 18499 - DNA, 524 bp, Zea mays
  misc_feature (17)..(18): n is a, c, g, or t
  misc_feature (524)..(524): n is a, c, g, or t
gagagagagctcactannccccccccccccgaaaccagagagccgtcagggagagcaaaacaaagatcggagaagatgaagacgattctttcttccgaaacgatggacatccccgacagtgttaccatcaaggttcacgctaaagtgatcgaagtcgaaggacctcgcgggaagcttgttcgcgatttcaagcatctcaacctcgatttccagctgatcaaggatccagagactggaaagaagaagcttaagatcgattcgtggtttggaacacgcaaaaccagcgcctccatcagaaccgctcttagccacgtcgataacttgatctccggtgttaccagaggtttccgttacaagatgaggttcgtgtacgcccattttcccatcaacgcctccatcggcggtgacggaaagtctatcgagatccgtaacttccttggcgagaagaaggtgaggaaggtagagatgttggatggtgtaaccattgttcgatctgagaaggtgaaggatgagattgttcttgn

SEQ ID NO: 18500 - DNA, 1979 bp, Zea mays
cattgggaccctcgaggccggccgggggtctcctcccagacgggcccaaatctatcgcaaacaggcctcgtctcgtcctcgtcctcgtccgccgccaaatcgaacccccccaaaccctagctacccggcgcaacgtccccttcccgcctctccgcggcgctgcgtgacacccggcctccgctacgaaacaccggggcgggtgtagcctagcgggcgggccatggcgtcaacggtgctggaggcgacgcgggcggcccatgaggatctggagaggctggagcggctcgcggtgcgcgagctgcaacgggagcccgctaacccgcgtgaccgcctctttcagtcccaccgcgtccgccacatgctcgacctcgtcgtctccacctccggcaagctcgtggaaatttacgaggacaaggacaatgctaggaaggatgagatcaacactcatcttactgcacccacgcaaagtggactgtttagcaagtactatgaaaggctcaaagagatccgtgaatatcatcggcggaacccatctgcccgctttgttagtacaactgatgactatgaagagcttctaaaggaggaaccagttattgaattcactggcgaggaaacttttggccgttaccttgacttgcatgagctttataatgagttcataaattccaagttcggaacactgatggaatattcagcttatgttggctgtttctcccagacggacaagatctcacatagtcataaagctaccagaaaatacagagaatacttggaacatattttggaatatctgacatcatttctgtatcgcacagagccattgcaagacattgataagatttttttaaagctggagagtgaattcgaggaacaatgggccaatgaaggaatacttggatgggggaataaagggacagaaaaagagtctgaaatagatctcgattactacagcacagttgaagaacttgttgagcttggcccagaaaaattaaaacaggctttagctgctcgaggtttgaagagtggcggtactgttcaacagcgtgcagatcgtcttttcttgttgaaggttacaccgttggaacaactagataggaagcattttgccaaagttccacatactaaagatggctcaaacacagctcctaatggtaatgctttcaaggaggatatgaagaaagaaattgcattgatggaagtgaagatgaaacgtctttgtgagctgctagatgaggcctttgtaaggacaaaggaaaatgcggagaagaagcttactttgacatatgaagagatggaagcagaacgggaagaggaggaggtacaagttgacactgagagtgatgacgaagagcaacaaatctacaatcctctcaagttgccgatgggttgggatggcaaacctatcccctactggctgtacaagctacatggccttgggcaggaattcaagtgtgagatatgtggaaaccatagctattgggggcgaagggcttatgagcgtcatttcaaggaatggcgtcatcagcatgggatgcgatgccttggcattcccaatactaagaatttcaatgaaattacatccatcgaggaggcgaaagcgctctgggagaaaattcaagcacgacaaggggtgaataagtggcggccagacctagaggaagagtatgaagatcaggaaggcaacatctacaacaagaagacctacactgacctgcagcgtcaaggcctgatctagggctcctgctggttaaagttgtcgggatttgttcagaacttatctcatgtagttgtaactctgaaaatattggcccatctggcatacattttatgtaataacatgattctccggaactcatgtgcttttcccggttgtcatggttgtctcgtgtgtctgtttgcccagcttggtcgtccgtagctatgttatgttttatataatcgtaaatgtgttcttgtattaagcacaagttggtgtttgc

SEQ ID NO: 18501 - DNA, 1006 bp, Zea mays
  misc_feature (81)..(81): n is a, c, g, or t
  misc_feature (1004)..(1004): n is a, c, g, or t
cattgggtacctcgaggccggccggaccgaaccggctgacaaaaatttcgagcagcagagtaaacatgggcgggaattttntggcgccatccattctcccgccgccgcctgcctatttagcccccggcccccgccggcccggccggcactcagcccactaccttccatattttccctcatctcccgccgcctgcacccaacaagcctctcgacgctagtcatggccgcttccaacggcgccgccgcggtcgacgagaccgtcgccgccaccgactccgtgcaggagcctccccagaagatctccaagatctctcccctgctcaaggtgaagaagctctccgagaaggccgtgctgccgtcccgcggctccgctctcgccgccggctacgacctctcgagtgccgaggagatggtggtgccggcgcgtggcaaggcgctcgtgccgaccgacctcagcgtcgccatcccgcacggaacctacgcgcgcatcgcgcccaggtcggggctggcgctgaagcactccatcgacgtgggcgccggcgtgatcgacgcggactaccgaggccccgtcggcgtcatcctcttcaaccactccgacgccgacttcgccgtgaagcccggcgacaggatcgcgcagatgatcatcgaggtgatcgcgacgcccgaggtcgcggaggtggaggacctcgacgccaccgtccgtggggacggagggttcgggtccaccggcgtctgaagggattcggtgtctaggttaggatggcgatgcaagccttggtgtcttttgttggctctaagaaatcgtgatgttcaccatcactatcctgctatcgataattagtattgagattagtacgtaggttgcgtagttagctcgatgcacgtactattgtcgagaactcgctattctgtgatgttgaaaatgtctaatgatcctgcagtactgtcgcattagacccatgaagaagccaatttgacggcggaaaggaaaaaaggaagtttanat

SEQ ID NO: 18502 - DNA, 1356 bp, Zea mays
gtgcgtggagtccactagttctcttctagcttctggatcaggagactcaactgctagaatctggacaattccatatggtccatgtggttccgacatgcaaccatattctcctggtgttcatgttttgaaacattttaaaggtcggaccatatgaaaagagcaaggatgtcaccacgctgcgcgggcccggccgaggtacactactcgctacgggctcctacgatggacaggcaagaatatggagtagagatggagacctgaagcagacactgttcaaacataagggacccatattttcattgaaatggaataagaaaggagattttctcctaagtggaagtgttgataaaactgctattgtttgggatacaaagacatgggaatgcaagcagcagtttgaatttcattcagctccaacactagatgttgattggagaaataataactcctttgcaacatgttcaaccgataacatgatctatgtttgcaagattggggaacagcgtccaattaaagcattcagtggtcatcagagtgaagttaatgctataaagtgggatccgactggttcttttttggcttcatgttctgatgattggacagcaaagatatggagtatgaaacaagacaaatgtatatttgatttcaaggagcataccaaggaaatatacactattcggtggagcccaacaggcccaggaacaaacaatcctaatcagcagttgcttttggctagcgcatcttttgattcaaccatcaagctttgggaagttgagcagggacgccttctgtacagcttgtccggtcataggcaaccagtgtattctgttgcatttagccctgacggcgagtacttagcgagtgggtccctggatcagtgcctacacatctggtctgtgaaagaaggcagggtcctgaagacctacagaggtactgggggcatattcgaagtgtgctggaacatagaaggcaccaagattgctgcctgtttctccaacaacaccgtctgcgtcatggatttccggatgtagcccaaccagtaggggtagcgacgtagtgcagatcaagcctaaaacaagtctggatcacaagcccttcccatggaaacgtgtgaagagagcggaattgttagcagaatgcagatcttaggtggtggtttttttttttgcccatgtacagttcttttttcctaggttatactgtagcgatgcgttagtagcatggaaatgttttggtggcaatcctcctaatttctgaatgcaatcttaccatatttaaactcttaagtattccatcgttttatatagtcgagaaatacaaatttccattattgacccttggaaaagagttgtagag

SEQ ID NO: 18503 - DNA, 2748 bp, Zea mays
gggggcctgacccattacagagggtcaagagagtaaatgtacccaaaccctaatacagttccaacacaatcatacataaagagtacatagtgtattgcgcatccgcggtctgaaactaaaacacccgtgtgctggcaaccattgtggtaccacggaaccagcgtgccactaaactatgtctctcgctgtatcttttttttttttttttgtcaggtacctacaacaccctggtgttgttaggcgataacaatatctttctaggatgacaagcacaagctccaaacagatagacaaaactagcttaagtcaaatatgagaaaatggccagaacatgccatagcattaacacaaactttcgaggcgtttgcagtttgatctagttgtccaacttggtgcaagagggtattttcatagcatccatttgggtttaatcactccatgagagtttcaggccacaaagttcaaggacggaggacagttctggctgaccttatcttgccatttccttagtgttttatcaagtgcccttggccgttcataaccatttgtaggaacatcatttgcactttcatttgatgcttgttcctcattgtactcatcctttccttctcgtcgccccctaacttgctgtcttgattcaggcttccagcatgctttcgcaagcgacttgccaagtaaatcagcaatatttattgccatgttttcagcctgctgcacatgaggaaagttatcttcctcaaaatgatgtgacaaccatagatacattgataggacctgatgttttgtctcaaggtccagaagctcagcgtcattttttgcagaaccccttggtattcccattgcgatgccaacacgacggctatgagaatagttggtggcaaatcttaaaagatggtacatggcttttggatcccttatatttaccggagcaaagcaaaaattatagcgatccttgaggcatagcccctgcaccctctcaagcatattagcaaccttcttgatactgtcctgctggcacatgaagtatgttttatcgatgcgacaactatcacggaatttatccaacagatcattaaaagaaaggttagggaattggctggcaaacatttcaacttgctcaaagcaaggaaaaataccagctttttgtgcctcctcaaatggctgctgcaggcactgaatcaaataatctaaatcatctttcaagaaagttgttgtgagtccatctggatagacactgcccctccgaccagcacgaccagcaatctgctttacctgcgaagcgggaactggaaccatcctttccccattgtattttgccaagctatagaacacaactctcctaatgttaaggttcagccccataccgactgcatcacttgctataagcacatcatactcattatcctgctcgttgaacaactttgcttgttgtcgtcgtgtctctggtggcagagctccatagataacacaacacttgtgctttgtaaacttctcaattgccagcttcacctcgaatatctccttgcgtgagaaagcaacaacgcagtcaccagagcggatattcttgaggtccccaagaagtgtctttgcttcaacaacaagaggcttgaatctctcatattgatgcaccaccaaatcatccccagtatctgcacaaatcttctggacaatcttgagcacgctagggtcaccgcagaggtgtatctcatccgccttgagcccaagcacagcgcgcgaccacgcaaagcccctgacagggtcagccatcatctgtatctcatcaaccacggcgacttcgtagagctcctcagtggacatcatttcaatggtacatgcgacatggttggagaaaggcacttccttaacctcttgtccagtgcgcaggctgcagtagacaccgagcgcattgaccttgtcgaagatctccatggcgaggagacggagcgggctgcagtagaccccagacttggctgcggcaaagcgggtgagcgcgttgtgcgtcttgccgctgttcgtgggcccgcagtggtacacgatacggcggcgcatagcgcgcgcgaaggggtaccaggtgtgcggggccgtgaggtcggccgcggccatgaccgacctgtgctgcctcagcttgtctgcgaagttggagaagcagaactctgcgaaggccgggaggaggagctcgtgtgcgtcctcagcggggagcgagaggagatgcgccgcggactcccgggagagtcgcgggaggatgaacccgcggaagcggcggacgtaggatgggaaggcagaagaggggacgtagagcgcgagcgcctggtcggatatggccggacttttggcgaagccgcggacgaggcctacaatggcatcccacgtggccttcggcaggcggcaggatccgacggcggggtccgaggcggatagctcgcgccatagcttcttcgggtcaagagaagacgtcggtttctgggtgggatcgccggctgattcgccggtggagaagaagcggtgttggggtgggagccatggggacgagggttgcggaaaggtgcggtggaggtgagagaggagaggtaatatgagacggtggtgcgaggtggagcggcggagaagcgccgcggcaatggcggcggccatgaggttggttggttaggccggcggcatgaggctggggcctgggggaagaacgactgaacgagggatccaaatcctgtgaacttttcgattaggatgttctaggtaatggtctcgtgc

SEQ ID NO: 18504 - DNA, 1684 bp, Zea mays
  misc_feature (1671)..(1671): n is a, c, g, or t
  misc_feature (1679)..(1681): n is a, c, g, or t
ggataagggaaaagagaaagaacgtaatgaggagcatgaacggcgtcctggtggcgaacgagagagggaacaccatgacagagaaaaagaacaagtcagggagaaggacaaatctgaaaaagataggggcccggattcggcgcggcagaaagagaaagaaagagaaaggcagcaggcagagcgtattgataaggttaagcacgaggatgactctcttgctggtggaggtcgcactccaatggatgtaagtacaactgctcaggagatatctaacactgatgttactgttttggaaggacacagttcagaggtttttgcttgtgcatggagcccatctggttctcttctagcttctgggtcaggggactcaactgctagaatctggacaattccagatggtccatgtggttccaacatgcaatcatctcctcctggtgttcatgttttgaaacattttaaaggtcggaccaatgaaaagagtaaggatgtcaccacacttgactggaatggtgaaggtacactgctggctacaggctcctatgatggacaggcaagaatatggagtagagatggagacctgaagcagacattgttcaaacacaagggacccatattttcattgaaatggaataagaaaggagattttctcctaagtggaagtgttgataaaactgctattgtttgggatacaaagacatgggaatgcaaacagcagtttgaatttcattcagctccaacactagatgttgattggagaaataataactcttttgcaacatgttcaaccgataacatgatctatgtttgcaagattggggaacagcgtccggttaaagcattcagtggccatcagagtgaagttaatgctatcaagtgggatccgactggttctcttttggcttcatgttctgatgattggacagcaaagatatggagtatgaagcaagacaaatgtgtatttgatttcaaggagcataccaaggaaatatacactattcggtggagcccaacaggcccaggaacaaacaatcctaatcagcagttgcttttggccagcgcgtcttttgattcaactatcaagctttgggaagtcgagcaaggatgccttctgtacagcttgtctggtcataggcaaccagtgtattctgttgcatttagccccgacggcgaatacttagcgagcgggtccctggatcagtgcctacacatctggtctgtgaaagaaggcaggatcctgaagacgtacagaggtactgggggcatattcgaagtgtgctggaacaaagaaggcagcaagattgctgcctgtttctccaacaacacagtctgcgtgatggatttccggatgtagtccaaccagtagggtggtgcatatcaatcctaacacaaggctagatcataaatccgtcccatgcaaatttgtgaagagcggagttgttagcaaaatgtagatcctaggtggcttcaacttttgtccatgtacatttcgtttttttttggtcatacttaccttagagtagcaatgtagtagtggaaatgccttaacagggtttagtagcatggaaatgttttggtggtaaattaatgaattaatctgagatgtactagtttgtagtttgcacataccgtcgtgtcaatgtcttttatatggaactacataaaaaatttaanaacccaannnccc

SEQ ID NO: 18505 - DNA, 1586 bp, Zea mays
ctcagatctcttggtgctcctgctgttctgttatctctcccaccacgcgtccgctttcgcggatttaaggatacaaagacgcctctatacgcaactgtggctggagatgcgatcaatatagttttggatccaatatttatgtttgtgttccaatatggtgttagtggtgccgccatcgctcatgttatatcacaatatttcattgcatccatactcttatggagattaaggttgcatgttgatttgttgccacctagcttcaaacatctgcagtttggccgatttcttaaaaatggttttctgctacttgcacgagttattgccgcaacttgttgtgtgacactatccgcttcaatggccgcacggctaggttcaactccaatggctgcattccagatctgcttgcaaacctggttggcttgctcacttcttgccgatggattggcttttgctggacaagccatacttgcaagtgcatttgctcgtaaggactatccgaaggccaccgccacagcttctcgtatcttgcagctggccttggtcttgggacttctcctaagcatacttcttggtgttggtctgcgcatagggtccagattatttacatccgatcagggtgtactgcatcatatctacataggaataccgtttgtctgccttactcaaccaatcaacgctctggcttttgtttttgatggtatcaattacggagcatcagatttcggatatgctgcctactcaatggtccttgttgccgttgtcagtatcatttgcatcctcactcttgaaagttatggcgggtttattggaatctggatagctctggtgatctacatgagcctccggatgtttgctggattttggaggatagggacggcacaagggccctgggcttatcttcgcggctgaacatagaggcagagctagtaacctgactcaccagcacgacgagcacatggtttattattgttcacggaagtggcagtccttgatgtggtctcgtaaatatgccatacggactcagggtctttttggtttgctacctaacttgtcatactttgcctaacttttctgcttaaggttagttcttcaattcggacaactaaccttaggcaaagtgtggcgcagttagccacgaaccaaacagtccctcagttcgtcaaacttaggtctgtaagtttggcggatgtgtaggcactcacatcgttaaacaaatctgttgtactggcctagattgtgacagatgcaaaattatgtcatggttggctactatgcgtagcagggctgcaatacatgtttccatcaggaaggctgtcacaagtttaacacacttgttgtaccaaggcgtgtgaactatagctattttttctgtcctaggacaaactgtgccacgacgtgttgtagctatttttctgtcccgtattcatatgagcagatacatggtcctgcaagtaacacatatatgtaactaaaaatggtgaggaccgttccatgtatgtactctgtgcttcctaacgtgtagggcccgttcggttgtaccaaaatgagtcaggattcattccagctcatcaaaatctatctcgtgc

SEQ ID NO: 18506 - DNA, 752 bp, Zea mays
  misc_feature (748)..(748): n is a, c, g, or t
cattgggtccctcgaggccggccggggtgctatacatcccgaatgtgctatacatcccgaatccgacgctccatcgagtgtgtgcggcggcgggaggagacggaagagaacgatgcaggcggtggcacgggcgcgtgggcttgcggctgcggctgtggctgcgcggccgtcggcgatggaggcagggcaccgcgggcaggtgcagcaagcccggggcattgtggtgcaggtgagggacgggaacctggagcgggcgctggcggtcatggagcgcaagatgaggtccagcggcatggagcgccttatccgagcgcgcacccactaccacgtgaaagactcggagaagcgcgtgctcgcgcgtaaggcgcttatgcagcgcgtccggtcccaggagctcggcaagaagctccgcgagatcctcatcaagaaaatcaggggccagtgaggacatcagcgcattggccatttacgggcagcatctgtgtgggtgctccctttttgagcgtgtggagaataaactcaactgcgaccttgagcaagagaacttttgctatattgcatgaaggacagattgagaataaaactagtttttggcgaacgaactattgtattttattgtacaatttagtatctatatatggatttaactgctgtttgtgctggacttagagcctttttgtttgggattataatatgttcagattatataatctaacttatatcaagagaacttttgctaaaaaaaaanaaaa

SEQ ID NO: 18507 - DNA, 749 bp, Zea mays
cgagcgtgtgcggaggcggcgggaggagacgaaagagaaatatgcaggcggtggcacgggcggcgcgtgggctcgcggctgcggctgcggctgcgcggccgtcggcgacggacgcagggcaccgcgggcaggtgcagcaagctcggggcatcgtggtgcaggtgagggacgggaatctggagcgggcgctgtcgatcatggagcgcaggatgcggtccagcggcatggagcgcctcatccgggcgcgcacccattaccacgtcaaggactcggagaagcgcgtgctcgcgcgtaaggggcttatgcaacgcgtccgttcccaggagctcggcaagaagctccgcgagatcctcatcaagaagatcaggggccagtgagggcatcaacgcattggccgtttaccggtagcatttgtgtgtgggtgcttcgttttgagcgcgtaacaatgctgggtactttcatcgatggttctgtggcgcagcctgagaataactcaacctaccttgagcaaaaaggcttttgctatattgcatggaggacagattgatggtaaaactattgtttttttattgtacaacttagtatatatatggatttaattactgtttgtgcttgacttgtgtgcatgcaaatgctgtctgagcaatgtgtggcaatgcttcaacggatgaaaacggaaaaactttttactgaaacatgttttacacaaaagacgtttacaacagtttccaatcctggcctcttgtctc

SEQ ID NO: 18508 - DNA, 745 bp, Zea mays
ggagaaattgcacacttgatagattgagtgagattggggagtgcactgttcctttagagaagcagattgctgaagaggaagaggaagaaattgaaatgttattggaaaattatcttcaacgatgtgaatcatgccatggtcaagcagagagacttctgaattctgcaagagagatggaagactcgatttctgtgaacttaagttctcgacgacttgaagtaagtagagtggagctgctgcttcaagtgggaacattttgcgttgcaataggagcattaattgcaggaatatttggcatgaatcttaaatcatatctggaaacaaatgcgtgggcattttgggtgacgactggtggaatagtagttggagcagtagctggatttttcgtcgtatactcgtatctaagggctaggaagatattgtgaaccctgtaacatctgtatgttaggatattttttggagctgtaaataatgtcattagcacatccagtgagggatatgcgtgttccaaactatgcatggtttgtgtactctgtactcttgcgagaatgttgccaccctatgtatttgtagttgcccgttgagacggaaataggttagaactcagaaacaaatatttggtttccaccctcagacgatttctcgtagctgcattttactatcctgtattgaaaattcgtgtcaacatctgacttagtcttctaaattttggtaatgcactaaaaaaaaaaaaaaaaaagcggcc

SEQ ID NO: 18509 - DNA, 7511 bp, Zea mays
  misc_feature (6308)..(6308): n is a, c, g, or t
atcttacttgcttgtagtgatgtcagtctactgctggagacaaagaagtttttgtcctcaaaatttgacatgaaagatcttggtgaagcgtattttgttttgggcatagaggttcaccgagatagaacaaaaggggtattgggctgtcccaaaagttatacatacaaaagattttaaggagattcaatatgcacaaatgtagtgcatcacctgcaccaatagtcaagggcgacaaatatggggattttcaatgccctaggaaccagtacgagctcgaccaaatgaaagtggttccatatgcttctgctgtcggaagcctgcagtatgctcaagtgtgtacgcgccctgacttagcttttgttaccgggttgcttggcagatttcaatgtaatccagggattgagcactggaaattggtaaagaaagtcttgcggtatttgcaaggcacgaaaggcctcatgatgacgtatagaagaacagattcactccaaatagtggggtacacagattctgattatgcgggagatgatagaaaatccacatcgggatatgtgttcactctcgcaggtggagctatttcatggaaaagctcgaaacaaaccgtcactacatcgtccacagagtatgccgagtttgtagcgtgttttgaggcttcggggcaggtgaactggttaaagaagttcatacccggtttaaaggtggtcgacagcatacataaaccactaaagttatactgcgataatgctccagcagtacagtatgctcacaacaataggtcaagtggtgctgccaaacacattgacataaagtactacgttgtgaaggataaagtccgggatcaaataataagtcttgagcatataagaagtgaaaagatgctcgcggatccgcttacaaaaggcttaccacccaaagtgttcaaagaacatgtagccggcatgggtttaagggaaagcctatgattcctggactataaatagggcctaaagttaaagtaactgtttcagatcggagatgtgtattgtagctgtcaaatctatcgacgattgatcgtgacgatgaaacatgctctatgcacttatctgtgatggaacgagtaaagtgaaaagtgttgaagttaaagtttaaagtttaaagtgaacgatgagatcaagggggagaatgttggattgatctccaccaagatgggcccaacggacatcttgggcctttgatcgcgccctgatcgggggcgcccaacccgatatggttggtgggcccctgtcacactgcgctataaataaaagggtgggggccggcggctcggatgacgtgtttcactagagccgtactccccaccgacaaaaccctaacaccgatctgagagggtgcgcagccagtgacgggaagacaccgccgttcatcgccgtcgacaacctcgctgcatcaaccttcatcaacgaacctgatggcggacggatctacatcctccaacacgcctgcgcttcccaacgacggtaacaatctaactactgttctgttctacaaattaggaacccgaaattactcaatagaatacagattaccccgctgatctactcttagagatcctgtaaatcttaccaaccgttcaataaaataattccacacataatgcagctacttgtaacatactcttattacgagagtgagttggatgaagccactgtttacatctttatctttaaccaaaacccttctgagagcatatgttaagaacctccattgataaaactgttttttattttacctagtttaacatgtacaaaacggctctaaacgactctttgataaaccggtgatagagatataccaaacatggcctaataaacaaacaaaataggattatatatatggttgtccctgccactctgtcggcctgacctagcaaacaaaatcaaagccgctgcctacaaatcttgaagcgtgcgaacatgaagacgagaattattgggcacagcaattcacaaaacgtcacgtcaaatcacaacagcacaaataataacttaatcagttgggttacacttaattcactccattcacaatattcgccatatgggtctatgtctacatttgctactacctccgtaagcgtacatttgtcaccttgaaaagcgaggaaagtaagagggacagagagatgactgatcaaataattaaaaaaaaagagagtcgcggaacggcggcatggaggagaaagaaaatttgaagaacggatatatatataagaatcatgaagtgcaagaagaattaggacgtggaacaagagcagtaaggtgtgtaggcgcgtagccaactgaagaacatgtacaccgctccatgtggccccactgtagagtgtctcctagctagctcctcggtgtctgcacgcacagaaaaaatattccccgttccttagcagccggtatggcttgaccatgcacagtgcaaacaaattatgttgatattataaatttctagttcttatgtgtcgtagaaaaaaatcagtatccaaataaattatttagttcatcgtcatcgcaatgaacaaagatgtttagctgttatattatttgtgcaggccttcagggtctataccctttttttagacaaactagctatttgcaaggaggctcgatgaatgcagggcaccttcagcaatccaggaataactgatgactctttacggtaaaaaaaatggcgcattcctctcacaccaaaactcccaaatcactagcataatcaggcttctcaggccgattctattttccattgaggctctggctctcatcgtccaccattggagaactaaatcatgttggccccaagcattaggagataaatcttcaactactgcccatcatgccacctctatccaaataatgcgcctgataaaacgacaaatcgaagaagaggtgtagcgcaatttcttgaaaggtgtggtagagtgcacacaccgggttatggtgccatttctcttcttgccaagcggttagtcatcgaaatcctgacctggatcgctagccaaccgaaaaaattacagtttggtatatatagcccagttctttccaaagggtctataccgccatggtgttagccttaatttcacctgatcctacctgttatatgcatggatatcacggctctatgcatgtcatgacaatggaaaattcaatgcatcatatttgtttacgtcttgtcacaagaggaatcattttctgtccttgctaggctaagaaaagagtgtttgatgaagtgtttctgaaataaataaacggtgaaatgacatcattttacacggctgctgcatggcgaggccccccgagcccatgcatgcatatgcatctctcctctctatataaagggctccatggtgcccccctcgaggccggccgggccgggatctctcactactacatacatcaccaactaggatcgatctctcgacagcaaatagctagcaatggagaagtacaccaaagccctagcgtcattgctcaccatgctggtgctggcacctctcctcgccatggccaccgacccagaccccctgcaggacttctgcgtcgccgacctcaacggcaagccatcagtgaacgggtacccatgccagccgccgtcgtcggccggcgaccagttcctcttctcgaccaagatcgccacgggaggcgaccccctggccaacccgaacggctccaacgtgacggagctggacgtttccgagtggcccggcgtgaacacgctgggcgtgtccatgaaccgcgtcgacttcgcgcccggcggcaccaacccgccccacgtccacccgcgcgccaccgaggtcgggctcgtcacccgcggcgagctcctcgtgggcatcgtcggcagcctcgactccgggaacaggtactactccaaggtggtccgcgccggggagacgttcgtcatcccgcgcggcctcgtgcacttccagttcaacgtcggcaaggaggacgccaccatggtggtgtcgttcaacagccagaaaccgggcatcatcttcgtgcccctcacgctgttcggctcctctccgccgatccccacgccggtgctctccaaggcgctccgggtggacgccagtgtcgtggatctcatcaagtccaagttcaccggtgggtactgagactgagacccagcatgcatcttgttagcgcactgtgcatgcgccgacaatggctttgcgtgatatttctcgttacggaatgggcgacgtcgtggagatccgcaacagtttgatacgccaggaaaataaaataatgtgcgtcagagcacgtataataagctatattactatcgttaagattcagtcgtaataaaaagtaaagattattcttgcttctgtgttcactgcctagctagtctccgggtcaaatgtatttgctcatttacttcaaaaaaatgtatttgctcattttacatgtaataataagaatggatctatatataaaaaaaaaaaaaaaaagaaagaaaaaaaaaaaatataagaaactaattaatggtttaatgagagcacctagaaggggtaaatatacgatcctgtaaaattaactctaaacaacacaaacttgatttataatatgtgttagagagaactaaaaccaagttagtatgaaaagagagaagcaatgagaactcttcacttgattactcctttaagatgagtattaaacttaaggagtgtttgaatgcactataaataatagttagctagctaaaaattgttagttggattagctagctaacaaatgagtgaatgactagctaactattaactaatttaccaaaagtagctaatagctgaactattagctagagtgtttgaatgtttcaactaattttagccactaactattagttttagtgtatttaaacacccccttagaagcaatattacaattgagtagagaactcgagaagacagttgttgggtacctaggaacagggtatccaaagaaggtcctgagacctcccggagacggcccacgaaccgggcggtccacctgcgaagcagctcggtgggaaggtccaaaagaccactcgaggacagcccgccaagccgaccaaccccgttttgcattgtacaccgtactgttcgtagagtaaagtttaaatatggtgatggaatgagtaagatgatgaagatagtcttaagcgaagttggttgtaaataaagaaacccaatcacacacaacgtgaaagtgtgccattttatcaacaatatatatatagatgacggtttaaaatgcccacgcaacaagcaagtatggcattctcctatagtgccagggttcgcacaacgaccgaggcgtggtgggatgcatgaccgttggtaggcacaaaacatgacccgtttaggattcgtgtggatacccatgtggccatgtatcctctttatttcatgtgtttgagtagtttgatatgtaatttaggctgcagtcactcgaacccccataaaataacaccgggcacacagaacaaaaaaaaaacaggtagccaaatctaaggagtagaccaaaccattcttagacacatttcatagtgttgtatagaggtagcagattcttaccacttaatttgttatgtttagaaagagtagaacagttatcaaaattcgcgaatttatcatatatatacgtcttttactatacgtggacaaacacatttcggttaaagaaatatatagccaacgacgccaaaccgtttgatgtcatttatattcatttaagatcagttcaaatcgtttctgttttacgtccaccaacgcgtgttgcattgctcgtttgtctggaaattagctagctgctaagcaaataataagtgcaagattgagcttcttagatcttattaccatcttcttttctaactccgatccgaacgaactccaaacatatatactgtagtagtagcctcctcggtattttcgttcgcttaaaaaagatagacacaaaaactcttcttggctacctagcctgtgttcgatcagataaaataggattatctatgcgagtatgcgacaataatccactgtgcctctgcctccctgcttgtcttgtctccctgaagcaaccgccgccgttgttatctgacgagacattactccctctgttgtcaatttgcatggtatttagaaatagctacttttatactgaacttcaatggttcaaaaacttcagaaaaacgctgaatgtatgtttattccactcactctatacgagcttttcttgttgctgttttttcttatgtggctcctgaataagggcaaacaaatcctcgattatatgagcgttgagttnagtaacgatcaagctgtggcgtgagtttacacgtggaacaagagcgcacaaaggtgcatgcgtagccaaatgcagtactcaagtgtttagaaatgggtttttttttttaatctcttccgctctgcgctgtccgcgtgcagaaaatcagaaatgttgccgttccttattagcagccggtatggccttgactggagtactgacacagttcagattcttttctctcttggagagattttgtgccactaaagaaaatcaattttctcaaatacataaaaaattagtgtattagtacttattcatccatacggctagaatacgatcaacgttaatataccaccacctctagttctgaactaataaatcacgagctattagatgactttaatcgaagctgagtttaatactggagtagtatgtgtgtagcagtatccgtgacggaaaccttgccacagatgcggttttccagtaacacacaagctggcaaaaactttctcggttttgggatatatacgccacaaagtttagtaactcttgtccacattagccactgcgctacgtcactacatgtgtatgaccaaagctctcagctacaactttgagaaacgcatgtttgtttgttttttaaacgtgagctctgggtcccatttgaaataaacttgcgtgttttctttctatctaaaaggcagcaagaaattcgctgccaatatgttaaaaggtaaaaaaaaaagcaatcgacttagcgttctgcagcctcgcacagttaaggagcctagccacttttcagaaaacagctaggagaaaagaaagtgaagggactgctcgatatggctgcaagaaaataaatagaaaagacagaacatggacatctaataactcaaatgacaactagaaacatcacccaacattagttgtttctatactactctattaaaaaactaatatagacgtttagtgatacaacagctttacccttttcactgacaatttaagttcgtctcacgcgtttcaactggttctcccgtcccaacttggcgccgtgccctgtggagcccagcgcctgcgcagccagctatcgtgcctgctcaacatctgaccctacccgcgcatgctaccacaccacgcaaaaaatagtgaagggcaagcactcgagttcacacccccctgctttagaaatttagggttaacaaccagagcacacgtacc

SEQ ID NO: 18510 - DNA, 1111 bp, Zea mays
ggccgcccggccgggcgggaaaatccatctctcactactacatacatcaccaactaggatcgatctctcgacagcaaatagctagcaatggagaagtacaccaaagccctagcgtcattgctcagcatgctggtgctggcacctctcctcgccatggccaccgacccagaccccctgcaggacttctgcgtcgccgacctcaacggcaagctgtcagtgaacgggtacccatgccagccgccgtcgtcggccggcgaccagttcctcttctcgaccaagatcgccacgggaggcaaccccctggccaacccgaacggctccaacgtgacggagctggacgtgtccgagtggcccggcgtgaacacgctgggcgtgtccatgaaccgcgtcgacttcgcgcccggcggcaccaacccgccccacgtccacccgcgcgccaccgaggtcgggctcgtcacccgcggcgagctcctcgtgggcatcgtcggcagcctcgactccgggaacaggtactactccaaggtggtccgcgccggggagacgttcgtcatcccgcgcggcctcgtgcacttccagttcaacgtcggcaaggaggacgccaccatggtggtgtcgttcaacagccagaaaccgggcatcatcttcgtgcccctcacgctgttcggctcctctccgccgatccccacgccggtgctctccaaggcgctccgggtggacgccagtgtcgtggatctcatcaagtccaagttcgccggtgggtactgagactgagacccagcatgcatcttgctagcgcactatgcatgcgccgacaatggctttgcgtgatatttctcgttacggaatgggcgacgtcgtggagatccgcaacagtttgctacgccagggaaatacaataatgttcatgcgtcagagcacgtataataagctatattatcgttaagattcagtcgtagtaaaaagtaaagattattcttgcttctgtgttcactgcctagctagtctctgggtaaaatcgtatttgctcattttacatgtaataataagaatggatctatatataaaaaaaaaaaaaaaaaaaaaaaaaaaaaaaaaaaaactcgaggagggg

SEQ ID NO: 18511 - DNA, 950 bp, Zea mays
tcgccgacctcaacggcaagctgtcagtgaacgggtacccatgccagccgccgtcgtcggccggcgaccagttcctcttctcgaccaagatcgccacgggaggcgaccccctggccaacccgaacggctccaacgtgtcggagctggacgtttccgagtggcccggcgtgaacacgctgggcgtgtccatgaaccgcgtcgacttcgcgcccggcggcaccaacccgccccacgtccacccgcgcgccaccgaggtcgggctcgtcacccgcggcgagctcctcgtgggcatcgtcggcagcctcgactccgggaacaggtactactccaaggtggtccgcgccggggagacgttcgtcatcccgcgcggcctcgtgcacttccagttcaacgtcggcaaggaggacgccaccatggtggtgtcgttcaacagccagaaaccgggcatcatcttcgtgcccctcacgctgttcggctcctctccgccgatccccacgccggtgctctccaaggcgctccgggtggacgccagtgtcgtggatctcatcaagtccaagttcgccggtgggtactgagactgagacgggacccagcatgcatcttgctagcgcactgtgcatgcgccgacaatggctttgcgttggcggattgatatttctcgttacggaatgggcgacgtcgtggagatccgtaacagtttgatacgccagggaaataaaataatgttcatgcgacagaccacgtataataagctatattatggttaagattcagttgtaataaaaagtaaagattattcttgcttctgtcttcactgcctagctagtctctgggtaaaatgtatttgctcattttacatgtaataataagaatggacctatatatatatatatatatatatatatatatgtaaaaaaaaaaaaaaaaaaaaaaaaaaaaaaaaaaaaaaa

SEQ ID NO: 18512 - DNA, 2695 bp, Zea mays
gtcgaggttttgtttgttcaaggctaatttgttttctatcccatggctttcaagatataagattttaactaagttttgataaaagtgtaaaataaaaatccaaaattgtagctagatataatatcaagagcttggcctgcgttaaatggagaatgaaaaacagattcgaaatatggtgtatttttctataaacttagttaggattagataagttacagtaaaaaaatgaccgaattcattaacataaacgatacttttgtaataaattgagaagtaccactagtatatatatacgtttgttatacattcaacgcaacgcaaggcagtcgcgtgatggagcacgcagccagttgcagctgcacggtcccatccaacctgcatgccaaagtttggtggcgtcaaagtcaaaactcatggcaagaagagtattgtcttctgtgtgcaaaagcaagtacattacggacggaaaatactttttttttttttttgtttctttttttttttctttttagagaaaattgtcgtccttgtcataccagtaacgaattacgactcaaattacacatctgtataatcatgtttcgcataacaaagtgagctaaaaaaatttgcttacaaaataatgccaggggaaaggacttttttccccagcatatgttttttttttcttatcttgcctacaaaattgctaatggtgtttgtgtacagcctaaaacacatggtgttgcttgcgctctggagaaccaataaacacgtgagcaacacgtgaacaagaatcatccgctatcactatcaagattgagaagggtaaagaattggcgatgccaaacttgaatcatgatctcttcacaactgccactgcgaagtgagggtggtgtgtaaactcaaacgagaccctcagagacggatcgccagctccaacttggctgataatatttagggctatcctgttgtgctcagccacctgctctatccgacggacctcagcgagtttttctggttcacttgcaaagctgccccgtagtgagggcactatcttctgaatttccttgaagaagttgtacttcaccaaatcctgtgacaaaaagagagatcaaggcttagtaaaactaagcagatgacagaaatgagaagggtttcagcagggaacactcaccgacatgcctgcccgggaagatgattccttgaaactgtagaaggaaatgtgctcagggactcgagctttcagaagaagatcaaagtgctgcatgaatctctgggaagagtgattgagactatgtcagaaccgtttaagccatatttaaaagggcagttagaagccacaacaaatccaatcacacctcttgttcagtgttgaagatacttggtaattggaatgacctactttcgtttctgaggacagctagcatctgcattagcaataagagggttattgttcagtttctgcattagcaataagatggttattgttcagtttctgcattagcagtaatgtagtgattgctcaattgcgtagacgatagttgtacaaatgtatgctttgcaacaatatgatttccagatgtatgctgcacggacatgatttccggatgactgtatttttccgtacgtaccatcgagagtccctctgatagcaaaagatagcattgaggcaataaacaagacgacgaaaatgccatatcccgagctgaatccttcaaatgatccttcttctttttcccctttcttcgtgctgaacatttgacaatgcgtgttaagttaaacaaaaaaaatactaaaacgaagacatcatgcattagtgaaaatggtatgtcacccataaaaatggtgcaagagacaaaatcaaatgttttacaatatatagacaaccaaatacccgctacaacctgtttctacatgtcatgtaatttcaggggaaaaggctcctgtcataaatcagagagatcggatggcaaaagtatgtgtttacggtttctgagtcatcagatctcagctaacgccctctgatgtctgtcagaagagcgttttttcagtttcaggtattgttctactttatttgccattcagctgtaatttgacacaaatcaaccatgcagcatatgggaccaccatttttaaacaagccatatattatccactctgctttattttaacgcatatttggaatagaactggattgccatattttgtaaactgtatgttctccattttgtaattcttacaattcatttttttcctttagtttttctctttccacaactcctatctctttacaaccaaatttcaaaacacggtcaacataaaagcaacagcacgtctgatagatattagtatgcaagttagcttgaatgctatgtggtcatttttataatagcaacaaccaagctaggtttagaattccataagtccctcatcttattagactagcaaccatgttctcgaaactcgaaagggaaaggaacgtggagcaatacttattatgtgtttgtactatgggaacataaatgtccccagaacaaggaacatgaccatgttttgggcaactaagatagtcagtctattacatgtctagtatgagagctggataattcacatgtgacattaaaacttacaggtttcactactggccagaactcgtaaatgcatcttttctattagctttgtgagcacccacatacatgtaccagtacaccat

SEQ ID NO: 18513 - DNA, 2086 bp, Zea mays
gaagactataaagcaagctgtggactcgaggctcgccggccgccacagcgcagcaatatgctccaatgcaatcatgcatgcagggacaacagttgataccttcctcagagaaaacttggaatggctaggtagggcaaccaactgggccaagttcagtgccactgctggactaggcgtcattcacaggggccatcttcaacaaggccgcgcattgatggctccctacctgcctcagaatggtgctggtggtagtggtagcccatactcggaaggaggtgccctctatgctcttcgtttgattcatgccaaccatggtgaaggaatcaaagagttccttcgtgagagtcttcgcaacaccacttctgaggtggtccagcatggtgcttgtctgggactcgggcttgcagcattaggtacatcagacgaggaaatatgcgaggacatcaagaatattctgtacacagatagtgctgtggccggtgaagcagcgggtattggcatgggtttgctcatggttggcacggccagtgaaaaggccacagagatgcttgcttatgctcatgatacccaacacgagaaaattatcaggggtttgtcacttggaattgcattgacagtgtatggcagggaagaagaagctgacacattgattgaacaaatgactagagatcaagatcccatacttcgttatggtggcatgtatgcattggctctagcatacagagggactgcaaataacaaagctatccaccagcttctgcattttgcggtgtcggacgtgagcgatgacgtgcggaggaccgctgtgttggctctcggcttcgttctctacaacgagcctgaacagacacccagaatcgtgtccctactgtcggaatcatacaatccacatgtccgttacggtgcagctctagctgtcgggatctcctgcgccggaacaggattaagtgaagccatctccttactggagcctctgacatcagacgtcgtcgactttgtacggcagggcgcgctcatcgccatggcaatggtgatgatccagaccaacgagtcctacgatccacgcgtcggagcattcaggcgccagttggaaaagataatcctcgacaagcacgaggatgccatgagcaagatgggcgccatactggcttcaggcatcctcgacgccggtggcaggaatgtcaccatcaagctcaagtcgaggtcaaagcacgacaggctcaccgctgttgtcgggctagccgtcttcacccagttctggtactggtacccgctcacctacttcataagcctggccttctccccgacggccctcatcggcctcaactccgacctgaaagtgcccaagtttgagttcctgtcgaacgcgaagccgtcgctgttcgattaccccaagccagtgacccagcagaccacagccacgtcagtcaaggtgccggcggccatcctgtcgacctatgccaagtccaaatccagggcaaggaaggacgcagagagcaaggccaaggcgaaagcagaggactcttccagtgcttctacttcgatgcaggtggacggcgcttctgctgctggtgctgctgcagagaagaaggccccggagccagagcctacgttccagatcctgacgaacccggcccgggtcgttccagcccaggagaagttcataaagttcctggaagacagcaggtacaagccggtgaaggctgccccctcggggttcgtcctcctgcaggacctcaagcccacggaggccgaggagctcgccctaaccgacgcgccgtcaaccgctgccacgacaagcaccccggcatccagcgccggcgagccggttggcatggctgtcgacgacgagccccagccgcccccggccttcgagtacacgtcataaataagggtggtgatcgtcggatcaggatgtgtgggttgggttgtgttgtctgtaggaacttcgtactggtgttggatggcgcgcggaacccgggcgtaccactaagctcatttatttaacttgaaaatatattttttttttccaaaaaaaaaaaaaaaaaaaaaaaaaaaaaaaaaactcgagggggggcccggtacc

SEQ ID NO: 18514 - DNA, 1486 bp, Zea mays
ctcctcccggccgggttttgacgccccagtccccagtctctccacctagaatcgaatccgcgatcttcttctgctccaagcaaagccgcacccacctcgacggacggcgagcagcaagagggcaagcctgtaccctatcgactcgaacctcggagcggcggatcggtactcgtaggcagtggcggacatggcttcggcggcggtgatggtgagctcggcgggctccctgctggcgatgctgcaagagccggcgccggagctcaagctacacgcgctcgccagcctcaattctctcgtccacgccttctggcacgagatctccaccagcgtctcctccattgagagtttgtatgaagacgaggagtttgtccagaggcaacttgcagcactagttgcctctaaggtatttttctacttgggcgagctaaatgatgctctgtcatatgcacttggcgctggacccttgtttgatgtttctgacgactccgattatgctcaaacactgttagcaaaagctttggatgaatatactgccatccaatcaaggggcactggggaagaaaaaacgatcgaccctaggctggaggccatagtggaaaggatgctggacaagtgcattcttgatggaaaatatcaacaggccatgggtatgtctgttgagtgccggagactggataaactggaggcagcaatttcccgatgtgataatcttcatggagtgctttcatattgcatcaatctgtctcaccaatatgttagtcaccgtgaatatagattagagattctacaatgtcttgtcaaaatatatcagacattgccaaatccagattatttaagcatttgccagtgtcttatgttcttgggtgagcctgaaagtgttgcgagcatgttggacaagctgatttctggaagcaaggatgatgctctccttgcataccaaactgctttcgatcttgctgaaaatgaaaatcaggctttcctcctgaatgtgcggaatcaccttgatgcactgagttcacatacttctgcccacgtggaccttgacagcggaccgactgtaccaagtaatcaaactaacgctgctacagaactgtctggggatgtccagatgagagatgacataaacatgccaaacggcagtgctaccactgtggattcaaatgcagcaacacatgctgacaggctgacaaaaatcaagggtatactgtcaggagaaacatctattcagttgacattgcagttcctatacagccataatagatctgatcttcaaattttgaagactataaagcaagccgtgggaatgaggaacagtgtctgtcacagcgcagcaatatgctccaatgcaatcatgcatgcagggacaacagttgataccttcctcagagaaaacttggaatggctaggtagggcaaccaactgggccaagttcagtgccactgctggactaggtgtcattcacagaggacatcttcaacaaggccgt

SEQ ID NO: 18515 - DNA, 1738 bp, Zea mays
attttttcgcatgggttcactgatcaagttgtgtgtagtttgcattggtggccatagagttcccatgttcatgtcctgctacttttcttttaaatatggtgcttcatgcgcctgtgtacacatacaaacatattacatgtctaacaacttggaccagagcaagtgaaaattgttacatatataataaatccaccctgacatcagcctgtgcctacaagtcttgcccccatatatagcagagggaagacaccaaaccacaagaaaaagtagcaaaagaatttgaagagggattgaggggggaggggagctgtctccttcgatctcgttcttgcctttttgcctctctcgaggtcagcttttggtggactcagcaaaacaaatggcgtagagcggggagcaagagattacgcacgccgcgggcaccgatttccttcaagaatctgcaagaagcggaggatctgtcgagtccgactgttctaagaagcagctcgattctcgaaaccctagctagcaaagtagcaagctagctacaagagaaggaagctggcgaacaggtggtgggacgaggggcggctcggcctgccggagccatccctaggcaagaaccaagaagaaatggcgccttcgtccaaggacggcgccaccgagcagccgacgagcggtgggagcggcgacgaccgggagaacggcaccggtgagcccaaggaaggtgcggtggtcacgggcaaccggcggccgcgcgggcggccgccgggttccaagaacaagcccaagccacccatacttcagtgacacgtgacagccccaacgcgctgcgcagccacgtgatggaggtggccggcggggccgacgtcgccgagtccatcgcccacttcgcgcgccgcaggcagcgcggcgtctgcgtgctcagcggcgccggcaccgtcaccgacgtcgcgctccgccagcccaccgcgccgggcgccgtggtcgccctccgcggccgcttcgagatcctctcgatcaccggcacgttcctgccgggacccgcgccgccgggctccacggggctgaccgtgtacctcgcgggcggccaggggcaggtcgtcggcggcagcgtggtcggcacgctcatcgcggcgggccccgtcatggtgatggcgtccacgttcgccaacgccacctacgagaggctgccgctggacgacgccgaggaggatccagggcaggcgcagctgcctcccggccccggcggaggcccccctctgataatgggcgggatagccgatccctcggcgatgccaatgttcggcggcggcggcggcggtgtgccgccaagcctgatgatgccaggaggcgccgccgcctccggtgcgggcctgcagctcgggcacgaggggcttgcttgggctcgtgcacggccaccgccatactaggaggggatccatgtctgagaaattcgagtagaaatggaggatcgttcatcgctccggcagcctcaaggacgagctgagtgcgactcatcatatagttacttcaagctagaactgaagatcgaattaagcatgctgccaggagcaaataaaaggttgttcgactagctaatacactatctggtaagaaggtaaactagtactttatactacgactacaaactgcatgcatgtgagataccatcgagcttgcactgtatatatatggtttagatgcagcgtgataaattagatgacgggatgattattgtaaaaaaaaaaaaaaa

SEQ ID NO: 18516 - DNA, 1998 bp, Zea mays
agaagttgaagagcaaattgagcaaactctagctatggtttgtgagaattacaagtcgctagatgactctataccgttgggtttggcggaagattttaggcctccaactggattggctgctgctgctctggaaccagctattaagttgtacagtcttctacacgacgtcctatctccggaagctcaactaagattatgtggttacttccaggcagctgccaggaagcgtacgaggcgttacatgattgaaactgatgagtatgtatcaggaaattcagaaggcttcagggtagatttggtaaccgttaccacggcttaccagaagatgaaaacatttcgccgcccgccccgcggccgcatttttacttggatattgaaattcataatcagcacatacttcccagttttgttgatctgccaaatttagctgcctccatctatagtgtagagctgtcaaatcgtctacgcgcttttcttgttgcttgccctcctgctggtccagcatcacctgttgctgatttggtggttgccacagctgattttcagaaggatctggctagctggaatatctgcaatataaaagcaggtgttgatgcaaaagagctgttccatttgtacattgtattgtggattgaagacaaacgcaggatgttactggaaaactgcagactggacaaggtcaaatggtcaggagttaggacccagcatatgacaacaccttttgtggatgagatgtatgatttgctgaagaagacattgacagagtacgaagttatcatttgtcgatggccagaatacatattcgttctcgagaatgctattgcagatgttgagaaagcggttatcgagtctctggaaaaacagtatgcagatgttttggctccactgaaggattgtattgcaccaaaaaaatttggcctcaaagttgtccagaaactcacaaagcgcaattcaacggtgccctacactgtacctgaagatcttggcattctcttgaatacattgaaaagattacttgaggttttgcgacctcggattgagagtcacttgaaatcatggagttcttgtatacctaatggaggaaattctgcggccattggagaaaaacttagtgaagttacagtgacattgagagctaaattccgaaattacatgcaagcagttgttgagaagctttcggagaatacccgtatgcaaaataccacaaagctcaaaaagatcattcaggattcaaaagagttggttattgaatctgatatccgcagcaggatgcaggccttgaaggatcagctaattgaggcaataaatcatgtgcacaaagtatctgaagtacatgtttttttagccatatgccgaggtttttgggaccggatgggacaggatgtgctgagtttcctggagaatcgcaaagaaaacaaagcctggtataaaggtgcacgagtcgcaatctcagtattggatgatacttttgcatcccagctgcaacagctgctaggtaatacagtcccaccgaaggacctagagccacccagatctatcgtggaagttcgttctattctctgcaaagatgcaccccgccagaagaattctagtttctattattgatgatcaggcttaactgtacatagtagtcatgcgctgcgcgtgcagcttttctcttggagagaaaagctccaaagtgcccaaatagccggatctttataaagaaactagaggaggctcaatggtatctgagaagcttgccttgtgttacaccatatctttttgctagttaaattggctatgttcccattgcctgtggatgtggactacattcggaaagtggattgtgcttcagagtgtagtccaattgacattgtaggttagcttcattggtaacacttacctgtggttaagcagttgctctatttgttcttagggatttttttgaaacaacaaaaaagaactttctggttaaaaaaaaaaaaaaaaaacaagaaaaaagttctctcctcgtgg

SEQ ID NO: 18517 - DNA, 1550 bp, Zea mays
atctgtgagatctccagacttaccgattgagcccacaccactttccgctggttataaatcacccctcacctcgaccccggcagctgcgaggaacagagcgaaccgagcagagcactgaagcagagcgagcgagctgtccggccaaaccctcacggccgcctccacaatgccgcgccatctcgcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggcgggcggatgggtggcgtggggcctgaacccgacgggcgagggcatggccggcgcgcaggcgctggtggcgctggcgggggccggggccgcggcgcccgccgtgcggacgtacaacatcacggggtacgtcccgctgggcaaggcctccacgccgctggacttcccggcgaccgacctcgccgcggacgccgcgggcggcaagatccgggtgtacggcaagctgcagctgcgcaaggggatgaaggccgtgaaccaggtgtggcaggtcggcgcgtcctccacgggcggcgcccccgacaagcacgcgttccaggcggacaacctcggcgccaagagcaagctcgtcctcgccggcaaggcccccgcggcggccgaggccccctcgcccgccctcgcgcccgaggccggcggcccgtccgcgggcggcgacagcggcgcgggcgcgtcctcgtccacggcgccgtccaagtcccccaacgccgccgtgcccgcggccggcgtgtccgcgcccgcgctacttgcgctcgcgctggtggggtttttggcggcggtatggtgacgcgtgaatggtggagccatcatcccggcgaaggtggcggcggcgggctggggacgaaatatcgcgctgttttctttttattggggttcgtttttaagctttgtttttggccgtgaaataaaaatagttgctgtacttgttgagctgttgtttggtagagtcatagtgacgatttattattactagcagtaccgagtctgtgatcatggccgagagattaagctcggattagcagtggccagcaagatgagctggcggccggcgctcttcagtcgccggcgatgcaggcaacgccggccggttgattagaagattttgtgcacgtttcctgatgtctccactgcacgctttgtttccaacccttttaccctttcctctccaaggagatgattagttactctgtctcactcgacaagctcgtagacggcaattgagaacacctcgctcgctcgtcgttctttggataagagcacgatgggaagaaacagcgcactacgccagcgcggccggctgttccaaaaggcgtccagctcggctggtactgcaacgaagcaaagcaaagcaccgcggaaagaaacacaacaatggcgctcggctctcattgcag

SEQ ID NO: 18518 - DNA, 2823 bp, Zea mays
tgaataatttacgtgggtagtgttgtgagccgtcgcgcacaagtaaccgactagttgcaaatcatgttgtggtggcctgtgacgttgatgtgctggcccatttcagatttttggtttattttttggtggcctgttggagagcataacaaacaaataattgatgaacattttaagcagctccaagaactacttttaattttaagggtgattttataggattttttttttgagatgaaagtcatcccctcggcaacctgccttcaaacgagtcaatgcgccatccaggccgttaaattcaaaacggagggctcgggatgggattcctccggatccggccgctaacggctctctgctgctgtccccgtcccgagccaaccaacggatttccaaaccccaattcttctccgccattcttgcctctgccgacgccctctaccctatttcaaaacatttcaaaccactcttcgcccccttcctctcctctcatccccttcccccctccactctctcgtgtgtggtctcgcccctgaggttcctgatcgcaccatctccctccggcgacagtccgccgccccgccccgcgcgctcgacgaggccgctccgggtggtgaagaggtgagtgtcctacttgtgattcgcccagagattggatccggtcgtccgctgcatagcatgaatcctccgctgaggggggaaccgttttgagagatgggtggggtgttgtctcagcttcctgtttagcgctgtggaaccgttgctctggggtacgtggtgcgcgcggggaggtatgtgtgtgttgccgcgaagttgcgtttgatctgtggaatcgcgcctgcagggtgctgctgcagtgtctcccctctcgctatgagtagtgctgtgaaggaccagctacagcagatgtcgacgacgtgcgattctctcctgttggagctcaacgtaagttctttatctatctaattccacagttttctctccgatctttttgttggtacgccgttcggcgagcccggtgcgggataaattaaggcatttttcctgggtcgtgtcaggtgatttgggatgaggtcggtgagcccgacatggcgagggaccggatgctgctggagctcgagcaggagtgcctcgacgtctacaagagaaaggtcgaccaggccaatcgatgcagggcccagttgcggcaggccattgcggaggcagaggccgagctcgctggcatatgctcggccatgggcgagccaccgatacatgttaggcaggttagtttctgtgctttgaagtatcatataccatgaaagaaacaagtgacatttgagtactactgctgtactgcagaaagatattctacagaattttctctcatgatcttttttgtcattgcaactttagggctgtgatagtgtgatagctattggctagatgtgcaggttacttgtactctgctatattgaaggcttacaaaaataactgtagtgtgatctactggtaattcttaccctctgtagtgaaaaatgttagtagagtaagaacttgaatggtttaagggagtaaccgaacaaaattgtccggtattgaggtcaggaactgcatgcattctggtatgaagactgaatgtttcagtagtgactccatcagtaatttgttttctttcaaatggcagtcaaatcagaagttacaaggtttaagggaagtattgaatgcgattgtcccatacttggaggagatgagaaagaagaaagttgaaagatgggaccaatttgttgatgtcatcgagcaaattaagaaggttgcatctgaaatcaggcctgcagattttgtaccctttagaattcctgtggatcagtctgatctgtctttaagaaagctggaggagctaacgaaagagctgcaatcccttcagaaggagaaggtcagcatcacttgttcaaatcctctttatctgtctaatgaatattactccccatgtctattattttccttcaatactcatacaagtctataaatcttcttgtctgtgcctgtttttaacagagtgatcggctgaagcaagtcatggaacatcttaacactttgcattcgttatgcgaggtgcttggtgtagacttcaaacaaacagtaaatgaggtgcaccctagcctgggtgaggctgatggatcaaagaacctaagcaactgtacaattgaaagccttgcatcagctgcaagcagactgcgtgaattgaaagtccagaggatgcaaaaggttagcactctttgtatcacttaagaaatttcaatgattcagcgcagtcaaccgtcaatctttttgattattcagtgcattcactagtgtcaaatttgattcttcagcacaggcaaccctcaacaattttcaattatttagtgtctttaacattgttaatatgaaattctgaatgtcacagcttcaagatttggcctctagcatgcttgaactttggaatctcatggatacaccacttgaagaacagcagatgttccagaatgtaacgtgcaatattgctgcttctgaacatgaaataactgagcctaacaccctctctattgacttcctcagctacgtgagttcattgttcttcagatattgctcatgccactgttgctatgtttttctatgtttgagcttggaatgttctgagattgtatcttgatctaaaatataggtggaatctgaagttttaagactcgagcaacttaaagcgagcaagatgaaagaccttgttctaaaaaagaagacagaactggaagagcataggagacgtgctcatttgattggcgaggaaggctatgcaggggtaccggccga

SEQ ID NO: 18519 - DNA, 2690 bp, Zea mays
  misc_feature (689)..(689): n is a, c, g, or t
  misc_feature (694)..(694): n is a, c, g, or t
cccacgcgtccgcccacgcgtccgcccacgcgtccgaaacatttcaaaccactcttcgcccccttcctctcctctcatccccttcccccctccactctctcgtgtgtggtctcgcccctgaggttcctgatcgcaccatctccctccggcgacagtccgccgccccgccccgcgcgctcgacgaggccgctccgggtggtgaagagggtgctgctgcagtgtctcccctctcgctatgagtagtgctgtgaaggaccagctacagcagatgtcgacgacgtgcgattctctcctgttggagctcaacgtgatttgggatgaggtcggtgagcccgacatggcgagggaccggatgctgctggagctcgagcaggagtgcctcgacgtctacaagagaaaggtcgaccaggccaatcgatgcagggcccagttgcggcaggccattgcggaggcagaggccgagctcgctggcatatgctcggccatgggcgagccaccgatacatgttagacagtcaaatcagaagttacaaggtttaagggaagtattgaatgcgattgtcccatacttggaggagatgagaaagaagaaagttgaaagatgggaccaatttgttgatgtgatcgagcaaattaagaaggttgcatctgaaatcaggccctgcagattttgtaccctttagaattccntgtgngatcagtctgatctgtcattaagaaagctggaggagctaacgaaacccccccccccccccccgaaggagaagagtgatcggctgaagcaagtcatggaacatcttaacactttgcattcgttatgcgaggtgcttggtgtagacttcaaacaaacagtaaatgaggtgcaccctagcctgggtgaggctgatggatcaaagaacctaagcaactgtacaattgaaagccttgcatcagctgcaagcagactgcgtgaattgaaagtccagaggatgcaaaagcttcaagatttggcctctagcatgcttgaactttggaatctcatggatacaccacttgaagaacagcagatgttccagaatgtaacgtgcaatattgctgcttctgaacatgaaataactgagcctaacacgctctctattgacttcctcagctacgtggaatctgaagttttaagactcgagcaacttaaagcgagcaagatgaaagaccttgttctaaaaaagaagacagaactggaagagcataggagacgtgctcatttgattggcgaggaaggctatgcagctgaatttagcgatgaggctattgaggcaggagctgttgatccttcgctggtgctggaacaaattgaggctcacattgccacagtgaaagaggaagcctttagcaggaaggatattctcgagaaggttgaaagatggttgaatgcatgtgaggaggaagcttggctggaagattacaacaaagatgacaatcgttataatgccgggaggggggcccacttgacactcaaaagggctgagaaagctcgtattttggttaacaagatcccaggactggtagatgttttaaccacaaaaattgtagcctgggaggcagaaagaggaaaggaattcacatacgacggtgtccgccttatgtcaatgcttgaagagtacatgatcgttcgccaggagaaagagctacagaagaagaggcaaagggatcagaagaaaatccaggatcaactcaaagctgagcaggaagcgctctatggatcaaaaccaagtccttctaagcctcaaagcacgaagaaggcgcctaggcactccatgggtggtgcgaaccgaagactgtctcttggtggagccactatgcaagcccccaaaacagatatactgcactccaagacagctcgtgccgccaagaaggctgaagatttgggcgctttatctcctagtagtagaggcttggacattgccggtcttcccatcaagaagttatctttcaacgcaagcactttgcgagaggcagaaacaccgcgcaagccttttgcccagatcatgccaggaaacaacgtctcaccgatgcctacgcggcccatctccagcgccacagaggaagagaacaaaacccccaggacatttgtaggagggctcaatgcgaaaacgccggcgacagtgacggctcctatgcagatggcgatgacaccagccgtggctaacaaggtcatagccactcctgcaacccttttccaggagaaggcagattcgccagcactgccagcggacatcgagtactcgttcgaagagaggcggctcgctgtttacctggccaggcaagtggcttaaactcggtcattcacgtagttgaaagctgaactgactgcgatttctcgtcagaggccaatgttacctgttggtcgatactcgatagtagtcggcctcgttcgtaccttgcagtactattctgattcatagccatatttgctacagctagtaaggatttatttgggtactctaatattgatctcaatccacatgtgttgaaatgaattggagtgtaaattaatttaagttacacttcaatctatctcaatacatgtggatttgggagttttagacccgtatcgtaagttgtatagcttcacctggttgcatcgtggatgacctgttattgtttattactgttatccaacggcctcgccgccggcgacagcaacggtctccgagc

SEQ ID NO: 18520 - DNA, 2658 bp, Zea mays
tttctttgccgcttcttggttccatggtggtctctggtctctggtctggaatggttactgtgcgtgatatataaacgcgcggcacatgtacgcaggcacagaaaatcctggctcgtgcgatgcgacctcttggctctcgctaggttgtatgtgtgtgtgtgtttaaaagcctaatctaccgcaccagcggcctctagtgtctcctcctcctctatccctcgcaaagcaaacacacacgcgctttctcggtgccaccaccagcagcaccccgtctccgtcccggcccccgacgcccggcgggacatgaagaaagacgaggagggcgccaatgccaccgtcgccggcgacggcgacgcacgacgacgttccgcgctccccgtccgcctgctgccgctccggtgacggtgacccctacctagctctctccttcgtcctcgccttctgagtcgccgtccttcttgcctctatggagcgagctcgccgtcgccgttaccgtcgtcgtggtgcagaccagcggctcagcggattgaggggagccctggcggcggagaaggcgtcgtacgtgttctggtgatgggtgcggatttggcatgcgggaaagccaggcatcgtttttttttaatttcccccctcggtggtgattgttgctagctgttgctgcttttgttgtcagttttagcccccttttttcaccttctctcttctttttgaccccccctcccaactactttgtagttttgccaatcacggttctactaagaacatatcggttatcggagagcgaaatgttcgtgcggattctgctctttatctctctccctctctctatgtataaagctggctaccatgctttggcaacacgcgcgacttaactgcagctgtgcaatgctacagcctacagcagctcaattaactaactagtccaatacgaaataggagtacctttctctcatcattcttcttttttacatgatgcaagcaaacaatgtccttcggtgatgattattaccttctgaaaccatgaatcctgcctgccttttgtttgtttgtgtttcaactgtgtgtctaatagtgcaatgcagttactgtttactgcagctactgtgcatgtaaagcgtggcataataatgtaatccccggtagattttcagcgctaagcatttctcgtgcagataagatagagcagcagcagcccgcagctgatccttaccgctgcggctgtgtatcaattaggcctcgccggctgcactagccatgatgaatcccatggagaagagaggagaagagaagagaagctagccacaaaagggatgaggtgacagatgagggggagagccagacagacaacctaactggcgaaccctatgcagtcagatgcccctgcctctgaccaggcaaaaacttcagcggtccccaacgatgcagcaaaatggcattcagaggcagtagtgatcggcgaaaccagacgggccctctgcgtgctgtattttgtgtttcacacaggatgggcatagcttggttctatgattgagctgtcattggtgatatgggaagcagcgggttctaagaactactcgtgtactgcctgatattattgttgtttgttctgggatgtgctgcgggcgtgcctgataaatgggcgatggcatgcatacagttgttctcaatcttgtgaccttgttaagaaccacatgataatgcgcatgtatgtatgtactccaagaatacagtcttttttttagactcttgatttaaaatacgtataaatatactatcgatatttatatctctaaacaaatctgttatataaaaatatatttctatgtcatttaacgatacttgttacacataagaaatgttagttaaatatgtgactcgtctaataattgtgagaggcgcatttattaattttggaagtgaggtccttaggctgtccgcagtgatgactctaaagcatacgctaccgccgtatgcagtaaatgaaacgctgcagtggcgcacgctacgagcgacggtaaatatagggtggccttcagaaacgctatttgcagggtatacaaggctccaactgcaaacgtacgggcacatgcaaagggcacagctggtgcagtacgagcacatgcaaagggcgcagctagcgcaatagatctgcacagcaaacggagtaaagtgaaagaaaataatataatatatgatagttgatatagagttgatatatagagtaaatatgaccgcagaagattgtgatatagagtagataatattgctgaataagatagaatattccttttggagtacgaatttagggtagcatgagtgcggatagccttatgccgtatcacatcatatccacacatcaatgtcccaatgacaagttgacaacagcagtgtgttcgtagttccctttttcctgttggtacttcgctatactgtaatgtaggtaggttcttttttgaccagccaggtgatatcaggtcacttcacttgccttaattagctaaatcaagaacttctttaagtagatctgttaaatgtgagtactctaaaccctatattccacatcgaatctaattatatatacatctgttaaatgtgagcacttttctacacggatctgatcatattttaaccaagtctcttaacccaacactgttcttt

SEQ ID NO: 18521 - DNA, 634 bp, Zea mays
tgtgttaattcgcacttcgagcggcccgcgggggctcctactcacttgctactggaaactagggacaggctaaccaagctggaaccagagcaggggtttctcagtcaaatcagaagttacaaggtttaagggaagaattgaatgcgattgtcccatacttggaggagatgagaaagaagaaagttgaaagatgggaccaatttgttgatgtcatagagcaaattaagaaggttgcatctgaaatcaggcctgcagattttgtaccctttagaattcctgtggatcagtctgatctgtctttaagaaagctggaggagctaacgaaagagctgcaatcccttcagaaggagaagagtgatcggctgaagcaagtcatggaacatcttaacactttgcattcgttatgcgaggtgcttggtgtagacttcaaacaaacagtaaatgaggtgcaccctagcctgggtgaggctgatggatcaaagaacctaagcaactgtacaattgaaagccctgcatcagctgcaagcagactgcgtgaattgaaagtccagaggatgcaaaagcttcaagatttggcctctagcatgcttgaactttggaatctcatggatacccacttgaagaacagcagatg

SEQ ID NO: 18522 - DNA, 2094 bp, Zea mays
tcgaggccggccgggccgggtcccgtgcctctctctccgctccctctgacttgttcgcttgccgtcctcgctcgcggcaaagctgcagcgtgtctcggctccggcgcgccaccgctcgggacgcccgacggatccgctcccgcgtgcgctcgatatcccttgcttcaacggtccaagtcaacccccccaccaaatcgccgtccgtccggccgctgccgcaccctagcaggatcgcagcgtgcacagctcttcttcaatctgcaggattgcagccacgcacaagtcgtagctgtttccttggaactttgagctttggaagatgccaaggagaacaggaaatgctgcttcgaccaaatcagttgaattggtcaaacaagaccaaatggagtttgatcatcctgatgaggtagatgaagaggaagaagttgagtatgaagaaattgaggaggaggttgagtatgaagaggtagaggtagaggaggaggaggaggaggaggaggaggaggatgatgaaattgaaggtgtgcgtgaagttgatgctaatcatgacagtaaaatagtggatgatgatcccaaggatgggaatgaaaaagaaaagcatgctgagcttcttgctcttcctcctcatggagctgaagtttatgttggggggctttcctctgatgtatcttctgaagatctcaaacaactatttgaatctgttggagaagttgcagaagtgcgaatgcgaggaaagggggataacaagacatatgcttttattaatttcagaactaaagagatggctttaaaggccatccaaaagttgagcaataaagacctaaagggaaaaaagataaaagtttcatcctctcaggctaagaataggctttttattgggaatgtaccccatgattggacacctgatgatttcaaaaccgcagtggaagaagttggtcctggagttttaaaagttgatctcatgaaggcaccaggctcaggtcgcaataagggttatggctttattgaatactacaaccaggcatgtgcagagtatgctaagcagaagatgtctactccagaattcaaactagatacaaatgctcctactgtcagctgggcagatcataagaatgctagtgaagctacatctacttcacaggttaaatctctatatgtcaaaaacctccccaagactgttactcaagagcagctgaaaaagctgtttgagcatgttggagaaatcacaaaagttgttattccacctgcaaaatctgggcatgaaaatcggtacggttttgttcattttaaggaacggtccatggttatgaaggctctgaagaacactgagagatatgaacttgatggtcagctgctggattgttcacctgcgaaacctcctgctgataagaaggatgatactggatcatctcctactgcaaaaggacgtccattacccccaagttatgccccacttggatatggactagcgggagcttataatccacttggaaaaggactggcaggtgcttacaattcccctggaaacggactggcaggtgcttatggcgtgctttctgctcatgccgcacagccaatgttgtatgctccaggtgcttctccaggttcaacaatgatcccaatggtcctaccagacggccgtcttgtatacgtaccacagactgcagggcagcagcctgtgcatgtgacttcgcctctgccacagcaaggcggtcgtcgattcggcggcggtggcggatccagctccggcggaaagcgacagaggggagatgatcgtggcagtagccgcaggggctggcaccgtccgtattgatgtttgccatgccgctgatttgcaattagaagttagaacccagcaattagcatatttatcgcagtaccatgctggaaactgtactttgaattatttgtttttcctgtgtgcttcgtaacaggcctgccctaaaaagaatgatagtaccgcaaggggcaaatgtagtggtaatataatctatacatttgtaaccatcttcatcctgcgttgaccgtcttaggttattaaaataaatatatttcctccgttcttttttaaaaagggcgaccggtatatagaat

SEQ ID NO: 18523 - DNA, 2139 bp, Zea mays
  misc_feature (49)..(49): n is a, c, g, or t
ctcagcggtcgcgcctggggtctccggctctccgctcgccacgcccacncccagggccactgccacgcttacgcgttctagggacgccgccgacggttccgcccctgcgtactctaggtatcccgtgtccaacggtccacccccaccgcaaccgccgtccgtccgtccgtccgcccgccgccgcaccctgctagggtttcggccaggccggatccgccgccgcctgtagattctcctatccgaccgcggcgcctcgagccgcaccggcaacctcggacctgaatacctgatacactgcacttcttcagtccgcaggaccacagcacgcacaattgttcttcaatctgcaggactgcagccgcgcacaagccgtagctgtttccttggaactttgagctttggaagatgccaaggagaacaggaaatgctgctccaaccaaatcagctgaattggtcaaacaagaccaattggagtttgatgatcctgacgaggtagatgaagaggaagaagttgagtatgaagaaattgaggaggaggttgagtatgaagaggtagaggaggaggaggaggaggaggatgaggaggatgaagaaatggaaggtgtgcatgaaattgatgctaatgatgaaagtaaaatggtggatgctgatgggaaggttgagaatgaaaaagagaagcatgctgagcttcttgctcttcctcctcatggagctgaagtttatgttgggggcatatcttctgatgtatcttctgaagatctcaaacaactatttgaatctgttggtgaagttgtggaagtgcgaatgcgaggaaagggggataacaggacttatgcttttattaatttcagaactaaagcgatggccttaaaggccatccaaaatttgagcaataaagacctaaagggaaagaagataaaagtttctccctcccaggctaagaacaggctatttattgggaatgtaccccatgactggacacatgatgatttcaaaactgcagtggaagaagttggtcctggagttttaaaagttgaactcatgaaggcgccaggcttagatcgcaataagggttatggctttattgaatactacaaccaggcatgtgcagagtatgctaagcagaagatgtctaccccagaattcaaactagatacgaatgctcctactgtcagctgggcagatcctaagaatgccaatgaagctacatctactgcacaggttaaatctctatatgtcaaaaacctccccaagactgttactcaagagcagctgaaaaagctgtttgagcatgttggagaaattacaaaagttgttgttccacctgcaaaatctgggcatgaaaatcggtacggttttgttcattttaaggagcggtacatggctatgaaggctctgaagaacactgagagatatgaactcgatggtcagctgctggattgttcacttgcgaaacctcctgctgataagaaggatagtactgtatcaacacctactgcaaaaggaggcccgttactcccaagttatgccccacttggatatggactggtgggagcttataatccacgtggaaagggattggcagatgcttataataacccccttggaaatggactggcaggtgcttatggtgtgctttccgctcgtgctgcacagccaatggtgtatgctccaggtgctcctcccggctcaacaatgatcccaatggtcctaccagatggccgtcttgtatacgtaccacaggccgcggggcagcagtctgtgcatgcgacttcacctctgccacagcaaggtggtcgtcgattcggtggtagtggcagcggtggtggcggatccagctcttccggcggaaagcggcagaggggagatgaccgtggtagtaacagcaacaacagccgcaggggccggcaccgtccgtattgatgattgcaatgccgctgattagcagttagaagttagaaccgagcagttagcacattcgtcgcagtaccatgctaaacggtggtttgaattatttatttaccatgctggaaacggtagtttgaattgaataagacaaagtttttggaaaaaagtcaacgctgtcgaatattcgtgaactgaggtattaccttagtcaagcttgaagaataaaaacta

SEQ ID NO: 18524 - DNA, 1469 bp, Zea mays
ccacgcgtccgaaaatctttggtggtggtgtctatattgtccagacctagttttgctacccaagaacatgagtacattgtagtacttcctggttctttgtgacacctgattaatttgtatatctttgcacttcaatactaactagacgctattgtttttgttcttttcacagggaaagaagataaaagtttctccctcccaggctaagaacaggctatttattgggaatgtaccccatgactggacacatgatgatttcaaaactgcagtggaagaagttggtcctggagttttaaaagttgaactcatgaaggcgccaggcttagatcgcaataagggttatggctttattgaatactacaaccaggcatgtgcagagtatgctaagcagaagatgtctaccccagaattcaaactagatacgaatgctcctactgtcagctgggcagatcctaaagaatgccaatgaagctacatctactgcacaggttaaaatctctatatgtcaaaaacctccccaagactgttactcaagagcagctgaaaaagctgtttgagcatgttggagaaattacaaaagttgttgttccacctgcaaaatctgggcatgaaaatcggtacggttttgttcattttaaggagcggtacatggctatgaaggctctgaagaacactgagagatatgaactcgatggtcagctgctggattgttcacttgcgaaacctcctgctgataagaaggatagtactgtatcaacacctactgcaaaaggaggcccgttactcccaagttatgccccacttggatatggactggtgggagcttataatccacgtggaaagggattggcagatgcttataataacccccttggaaatggactggcaggtgcttatggtgtgctttccgctcgtgctgcacagccaatggtgtatgctccaggtgctcctcccggctcaacaatgatcccaatggtcctaccagatggccgtcttgtatacgtaccacaggccgcggggcagcagcctgtgcatgcgacttcacctctgccacagcaaggtggtcgtcgattcggtggtagtggcagcggtggtggcggatccagctcttccggcggaaagcggcagaggggagatgaccgtggtagtaacagcaacaacagccgcaggggccggcaccgtccgtattgatgattgcaatgccgctgattagcagttagaagttagaaccgagcagttagcacattcgtcgcagtaccatgctggaaacggtggtttgaattatttatttaccatgctggaaacggtggtttgaattgaataagacaaagtttttgaaaaaaagtcaacgggtgtcgaatattcgtgaactgaggtattaccttagtcaagcttgaagaataaaaactatgctgtgctcttggctggactccaaaaaaaaaaaaaaaaaaaactcgagagtactctag

SEQ ID NO: 18525 - DNA, 1672 bp, Zea mays
gcaccagcttggatggatctcctttgtggagatccaaatggtccccatagtgatgaagaatatttagctagagtcaactggatgcataatagtgctcttgctgttcaagttctcaacaggtcacatacgaaacttaagggccggtcgtctggtttgagtccccgtgaaggacgactcttactagaagagcagcatgatgtatggatcacattgcatgattgcttcactccactagacaaaggagtgaataataaacatccaggtggctttatttgggccagtgaaaaaacaggattcaggcatttatatgttcatggcaatgatggagcatgcttaggacctctcacacaaggtgattggatggttgagcacattgctggtatcaatgagagtaatggacttatatatttcactggaacattggatggaccattggagacaaatctctaccacaccaatctctttccagattggagccttcccttgcaaacccctaaaaggctgactcgtggaactggccggcattcagtaattctcgaccatcagttgctgaagtttattgatgtgtatgacacagcaaaatctccacctgtgatcttgctgtgctctttgcttgatggaagtgtaattatgcccctgtttgagcagccactgactattccgccacttaaaaagttccagcagttgtctccagagatagttgaaattacagcgaaggatgggaccaatttatatggcgctctctaccttcctgacgagagaaaatatgggccacctccctacaaaacactggttaatgtttatggtggccccagtgtccagcttgttagtgattcatggatgtgtacagttgacatgagagctcaatatctacggagcaagggtatattagtttggaagatggataatcgaggatcggcaaggcgagggctgcattttgagggacaactgaagtacaacattggtcgtgttgatgctgaagatcaattagaaggggctgagtggttaataaagaagggccttgcaaaacctggccatattggtatctatggctggagctacggaggatttctctcagcaatgtgcctcgcaaggtttccagacacattctgttgtgcggtgtctggtgctccggtaacagcatgggatggttacgacaccttttacacagagaagtacttgggtctgcccgcggagcatccggatgcttacgagtacgggtcaataatgtaccacgccaagaacctgaaagggaagctgctcctcatccatgggatgattgacgagaacgtgcatttcaggcacacggcaaggctcatcaactcgctaatggcagagggcaagccctatgaaatcctccttttccctgacgagaggcacatgccacgacgccttggtgatcggatctacatggaggagaggatctttggttttttcgagaggagcctttgagagggcgtttgtataaatttgttgcccacatctgggctgtgattgggatgtttttggcatatggattcaggttttctcattcacacctgtatttatcactagcgcagttatctttgattcttttgccagtcttggatggttatcagctgtttggctgcgtttacaggtttcagaataagcaaaaacttcatatcaaaaaaaaaaaaaaaaaagaaaccta

SEQ ID NO: 18526 - DNA, 2466 bp, Zea mays
ccttaccaaacactactaaaggtagagcaaagctgctccgttccacacttgctccaaaacaatcgagcaaagctgctccgtttcacattgctctaaaaccaattactatctaaggttgtctataatagatcgtgtaaaataaagaatttgtattatagataatattatttatagagtaaagtttaaaatagataataagataaaagataaaataggatagctacccgagagactaagaccgaatacaatgacggtcggtaccgagctggggctatggccggtaccgacaccatcgggcacgcctgcagtttgtagtactgatatcggcccgtagcgttagctacctaccgcccacctgctgccacatttcatctatttattggtccacgtccgttgatgtcaaaaaaatcaaaaaactaaaaaaggtatttatgaattatgtaacttttattttcagatattatgtaatttactatgttttataagctatgtcaattttatactcgacttatgaactatgtaattgtatttgtttctatgaaatatatagtttttatttgtttagttatatattcagatgaattttaattttgataaaacgccatgttttattttaaataaaagtacgcaaaaaaacagcatgatgctgagatgacggtaggttaacgaaagagattttaagactatggctgtgtttggtttgctataggttttggaatccgaatttgcacagaatctaaagtaggagtatctcaatatacagctggagctagattctacagattttatatataagcacactaccctatcacaatatccaatatgtttgattaagtatgagatatttttatgtggattctaaaaatccaggataaccaagcagcgtagctgatctgagacggtagatatatatgccagtcgtagcgcgcacgtgtcgctgtcccataccacggtacgcgtctcggggatctgattcccctatcgcgagggctagcagacaacacagcacgggcagcgcaacgcaacgctgcttcccgtagagcgcgtcacttgcgcgttactgtatttctcttgtcggaagcgtgtcgtatgcttcgtcgcgtgctttccttgtcccttcatcccttgcattgcatgccgtgttcctttcttttattcgcagttcctgtcgtctttctttttttgttctttgtattctgaaagtgttgtacgatcccttattccagcttgcaagtaaatagagcttacatgacacgaaacaaggggccgcaagaaaagaactttcagccggtcatgcatgcatggacctccggcttgccggagcgtcgcgaaccgccgccggtgagcattgcacgactcggcggcggtgcctccggctgctctgccatttccagcgcaagatcaacgcgcctccgtttagatcataaaaagaaggcgaccaattttaaacaacaggtctatatcagacaaactgagctgaaacagatcacattccgcgcaaatttgcaatcacacgggtgcagacagcagaaatcctgattaaccgagcacaccacacacagcaatcagaacaaaagtcaacaaacataatcaaatcgtcgccaccaccgatcgacgaatacaaaaccgcgcaacacgaacgcaatgcaataaggcttgtgtgccatgccaccagctatgcaagctagatctagcagttcttctccgccttggcgagcttgcacgtgaccttctggaacacgacggcggcggtgcccggcggcgccagctgcagcttgagcgggcacgacgcctggatcttgcacttggtgtagcgcgccgtgtagcgcacctccccgtcgacggccacctccacctggaacgtccccgtggcgttctccttccggaactcggcctcgccggcgttcccgagcatgacgctactcgtcgtgcccgggggcgcgatgtggtacactctggtcttgccggcggggtgcttgtcgcccttgtcggccagctggaagcggtcgaacatctggtcgtcgaacttgtactgcgcctccagcggcttggtgttcttgaggctcatggcccagttcgggttgcggatcaccagggtcacggacaggttgtacgacagcgacgtcaccggcgacgtcgccagctcgaaccgcgtcagcgaagcgtcgtccacggagacgtcgatgtggcgcacgaaaccgaaggcggcgacgaacaccacgatgaggacgatggccaccacgatgccgaggcacagcaggcagtacttccactcgccccacttgtcgcagcactcgtcccagcactcgtcgagcttccccctcatgtttcgccggctagatgttcttcaattttgtcgactctgggtgctgagatgctgatgactgacgagcgtggaagacgaggaagggcagctcctgggttcctcttctccctattgctgggtctgggtctttaatgcaagac

SEQ ID NO: 18527 - DNA, 957 bp, Zea mays
cattgggtacctcgaggccggccggggcccagcccaccaccacaggcataagtaagttatcatccagtaccagaacagaaccatcgatcgagcttggttgctcggcagcagctagcaatggccgccaagggaggtgatgagctgaagctgctgggcgtgtgggacagcccgtacgtcaacagggtccagatcgtgctcaacctcaagggcctcagctacgagtacgtggaggaggacctcctcagcaagagcgagctcctcctcaagtccaacccggtgcacaagaaagtgcccgtgctcatccacgccggcaagccggtcgccgagtcgcaggccatcattcagtacctcgacgaggctttccccggcggcacgttcccgtcggtcctcccagccgacccctacgcacgtgccactgcccgcttctgggccgccttcgtcgacgacaaggtcgggtctccatggcacacggtcctgttcgcgcgggagcacgggaagaaggcggacgcggcgtcgcggatcgtcgcggcgctggagacgctggagggcgcgttcaaggactgctccggcgggagggactacttcggcggcggcgccatcggcttcgtggacgtggtcctcggcagctacctgggctggttcaaggtgttcgagaagatggtcggcgtcagggtcctggacgtggcgaggacgccgctcctcgccgcgtggggggagcgtttcgcggcggcggaagcggccaaggacgtcctgccggatgacgttgataaggtgctcgagttccttcagaagttcctggactagactaggtgcgcgccaccatgtgctcggtgctctggtgtccaacccgatgtttgtttgctttggtcattttccgtgcgctgttaatgggcctcggatgtttgccagttgattttatagaatcttaatctctactacctattaagagagttcctc

SEQ ID NO: 18528 - DNA, 2624 bp, Zea mays
caggtttgcgcactacctaacgtgctagtgcaatcataattcggctgattggatgcttgtgttcggacctgcaggctcgggtgaccctggcagacccgatacggcagttttttgcgtatgagtggatgcaaccaaatgattataaaatgacttgttttacattcatttatgtagtctgtgtctcccttggtagccaaccaaacaagagcttagagagagttaatgtatatggtggtccaaaacgatacggtgaaacatatggaatttgtatatcttggactcctgggcagctgggctcctggccacagcccacacaccacaggcataacagaacagaaccatcgatcgagcttggttgctcggcagcagctagcaatggccgccaagggaggtgatgagctgaagctgctgggcgtgtgggacagcccgtacgtcaacagggtccagatcgtgctcaacctcaagggcctcagctacgagtacgtggaggaggacctcctcagcaagagcgagctcctcctcaagtccaacccggtgcacaagaaagtgcccgtgctcatccacgccggcaagccggtcgccgagtcgcaggccatcattcagtacctcgacgaggctttccccggcggcacgttcccgtcggtcctcccagccgacccctacgcacgtgccactgcccgcttctgggccgccttcgtcgacgacaaggtacacgcacaccaccaaacatcatcatcttgaaagctgcaagcaacaaacaaactaacttctcatggtttgccttgggtgcgtgtatgcatgtgcaggtcgggtctccatggcacacggtcctgttcgcgcgggagcacgggaagaaggcggacgcggcgtcgcggatcgtcgcggcgctggagacgctggagggcgcgttcaaggactgctccggcgggagggactacttcggcggcggcgccatcggcttcgtggacgtggtcctcggcagctacctgggctggttcaaggtgttcgagaagatggtcggcgtcagggtcctggacgtggcgaggacgccgctcctcgccgcgtggggggagcgtttcgcggcggcggaagcggccaaggacgtcctgccggatgacgttgacaaggtgctcgagttccttcagaagttcctggattagatgcgcgccaccatgtgctccggtgtccaactcccaatgtttgtttgctttggtcattttcggtgcgctgttaatgggcctcggatgtttgccagttgattaacttgattttatagaatcttaataatattctaaaacaagtagtcaggcggccacgtctacaggaaaacttctaccgtgtgatcaagacagcgagaaatatggtgcctcagattcccatcagtatccagagtcttccagtgacatacactgtgtccgattttcatcatgctctgcatcttcttcctacaatcctacctcggtgagttcgtccgtgaccacctcggcctcccctcctcattatctttgccctcatcggcggcggtggagcaaagcctgcccgtgagccgtgcccgtggtcaacttgctgccatggccggtggacgtggtccacgccgagctgctactgtgtgcagcgaagcattgagcggggctggtactgctagggcattgagctgattccgtctgttccctctgctccggtcctggctctgcaaccgtccgtcaccaaggagggcatgtgcttcgttttggcgagcacaccagccgtgtatggaccgtccttatcctctcctgtctgcgagcaatctcctaggcttcctaaatttttggtctttttttttattgggaacaaaaaacgtgtagaatttactatgtaaatttcttatttttagcattgaggctattaatcttcacaaaaattaaaccttaaattcgttttatatctttttaaataactgatataaaattcggatatctatccaaatacgaattcggatgttttttcatctttttgttgttgaaaaaaaataatgcacataaaaaagtatacaaaaatttatttaaatattttataatattcttaataatattaccaaaaattaactttaattctatatatatatttatattaaaatattaaatttgtcatataagtcgaatgctttagaaacatccttacttcctctcatcaatattgttgcccccatcgccagcaatggagctccagcgtccagcaccgccgagacttccgactggccgtgtcaccgtgtgagctccagcgtccagcaccgccgagacttccgactggccgtgtcaccgtgtgcgatgaccactgagtctccttttccctgtcgccgactagggtcgcgctcgcaacggtcggaagccgcaaccgtagctcgacgtggtctatctttcttgttaacagctaatttgacaaccccatatttttttaattgatttttattttttaaaactgttcattttgtcttagaaaaatagtaattcttaaaaaaataaagttgtcaaactagcattaaggcccgattttacccaagtctacgtttagagggccaagctgaattattacagattctatataggaaccagcagtaaaatcatgaaattttaatcagcctataa

SEQ ID NO: 18529 - DNA, 2132 bp, Zea mays
atcaaaaaaagaaccatctctttcacgttctcgcctccccatgtccatcgccacgatacctaaaaaaagatctacgcagcgaaaagggccgcggaaaaaacgagttgtacgcgtcggctccgcttcttgatcccaacaccgccacgataatataatactaaatctatcgtccgcaccaccagcgagtgaaggaggagcctgcccgcgcctgcgcctggttgtaattgtagctcacgctcacccttcagttgaccaccgctgcggcagcaatggcggcgagtcgccggcagcaccgccgcggcttcccgctggtcccgctgctgctgtcgctcctggcggccgccgcgtacggccgcctcatctccgacggcggcccgcccgcgccgctcctcccggtcatccgcctcgcggcgccgccggccgaggccgagtgcgagcagacctacggcttcctcccctgcaccaccaccgtgctcggcaacctcttcctggtgctggcctacggcttcctcatgttcaaggcggccacgttcctgtcggcgggcagcgagctgctgctagagatcatggggcccggcctcgtcggcggcctcctcctccccatcctcggcgccctccccgacgcgctcctcgtcctagtgtccggcctctccgggagcaaagaggaggcgcagagccaggtgctgatcgggatggggctgctcgccggttccaccgtcttcctcctcaccctgctctggggaacctgtgtggtcgttggcaagtgtgacctcgggccaggccgtgaggcagtagatgtgacagacaccaagggcttcagcttgactggcactggtgttacgaccgacgtgcagaccagctacgcggcacggatcatggggctatctgtcatccccttcatcatcgctcagttccccaagatgttgaagacgcaccacgggcagcgcctcgccatgctgctggcccttgtcgtgtcgttcgcgctcgtgcttgcctactgcctgtaccaggttttccagccttggattcagaggaggaagctcgcgtacgcgaagcacaagcacgtgatctccgggatactgaggcacgcccagatgcagtcgctcggccgcctgctgaacgacgacggcacgcccaatgaacaagtcatcagaaagctgttccgcaagatcgacatggacgagagccggtccctgtcccgcgccgagctccacgccctcatcgtcggcatcaacttcgaggaggtcgacttcgacaggacggacgcggtggacaaggtcatggacgacttcgacacgtcccgcaacgacgtcgtcgaggaggaggagttcgtgcaggggatgaggaagtggctggacgaggccaggcgcagcgtgcccgtgggcggcgccttctccagcaagttcatccacgagtaccacgagaggacgaggcaggagcacgacgagctggtcgacaggtccgacgaggcggtggagagcgtggagaaccccgggtggtgcatagccaaggccgtggcgctgctgctgctgggctccgccgccgccgccgcgttcgccgacccgctcgtggacgccgtccacggcttctccaacgccacgcgcatcccgtccttcttcatctccttcatcgccctcccgctcgccaccaactccagcgaggccgtctccgccatcatcttcgccagcaggaagaagcagaggacctgctccctcaccttctccgaggtgtacggcggcgtgacgatgaacaacacgctgtgcctcggcgtgttcctggcgctcatctacttcaggaacctgacgtgggacttctcgtcggaggtgctcatcatcctgctggtctgcgtcgtcatggccctcttcaccagcttccggaccacgttcccgctctggacctgcctcgtcgcctacatgctctacccgctctcgctcatcatcgtctacatcctcgactatgtcttcggctggtcataggctcatcggagtgaacgcctggctttttgacagccgccggtgtttctgtttgccctccttgtgattttaactatatgtccagactttttctcatgtgatgctgcgatcatgttctgctcgcgtgggttcctcgtgtatccgaagccctggccctac

SEQ ID NO: 18530 - DNA, 1415 bp, Zea mays
gcgggagtcagggccgtataaaattcggcccgcccccgcccgcccggaccgcacccagaggaggcaaggagcccatccacctggtcctgctctcaccacaccgccgcgccaatggcggctcgccggcagcaccgccgcggcttcccgctggtcccgctcctgctctccctcctggccgccgccgcgtacggccgcctcatctccgacggcggcccgtccgcgcagctcctctcggtgatccgcctctcggggtcctcgccggccgcgggggcggccaacaaggccgaggagaagtgcgagcagtcctacgggttcctcccctgcaccaccaccgtgctcgggaacctcttcctcgtgctgacgtacggctacctcatgtacaaggcggccacgtacctgtcggcggggagcgagctgctgctcgagatcatggggcccggcctcgtcggcggcctcctcctccccatcctcggcgccctccccgacgcgctcctcgtgctcgtatctggcctgtccgggagtaaagaggaggcacagagtcaggtactgatcggaatggggctgcttgctggttccaccgtcttcctcctcaccctgctttgggggacctgtgtcgttgttggcaaatgtgaccttgggccaaaccgtgaggcagttgatgtaacagacaccaagggcttcagcttgactggcactggtattacaaccgacgtgcagaccagctatgcagcgcggatcatggggctatctgttatccccttcatcatcgctcagttcccaaagatgttgaagacccaccacgggcagcgtctagctatgttgctggccctcattgtgtcattcttgctcgtgctttcctactgtctgtatcaggttttccagccttggattcagaggaggaagcttgcatacgcaaagcacaagcacgtaatctctgggatactgaggcacgcccagatgcagtcactcggccggctgctaaacgacgatggcacgcccaatgacgacgtcatcagaaagctgttccgcaagatcgacatggaccagagcgaatccctgtcccgtgctgagctgcacgccctcatcgtcggtatcaacttcgaggaggttgactttgacaggacggatgcggtggacaaggtcatggacgacttcgacacgtcccgcaacgatgtcgttgagcaggaggagtttgtgcaggggatgaagaaatggctcaacgaggccaagcgcagcgtgcccgtgggcggcgccttctccaccaagttcatcaatgaataccacgagaggacgaggcaggagcacaacgagctggttgacaggtccgatgaggcggtggagagcgtggagaaccccgggtggtgcatcgccaaggccgtggcgctgctgctgctgggcgccgccatcgcggccgc

SEQ ID NO: 18531 - DNA, 6635 bp, Zea mays
  misc_feature (17)..(17): n is a, c, g, or t
  misc_feature (4318)..(4318): n is a, c, g, or t
  misc_feature (4322)..(4322): n is a, c, g, or t
  misc_feature (4393)..(4393): n is a, c, g, or t
cggccgcgtgggcgggngtcagggccgtataaaaaactcccctcgcctcccgtccggaccgcacccagaggaggcaaggagcccatccacatccacctggtcctgctctcaccacaccgccgcgccaatggcggctcgccggcagcaccgccgcggcttcccgctggtcccgctcctgctctccctcctggccgccgccgcgtacggccgcctcatctccgacggcggcccgtccgcgcagctcctctcggtgatccgcctctcggggtcctcgccggccgcgggggcggccaacaaggccgaggagaagtgcgagcagtcctacgggttcctcccctgcaccaccaccgtgctcggcaacctcttcctcgtgctgacgtacggctacctcatgtacaaggcggccacgtacctgtcggcggggagcgagctgctgctcgagatcatggggcccggcctcgtcggcggcctcctcctccccatcctcggcgccctccccgacgcgctcctcgtgctcgtatctggcctgtccgggagtaaagaggaggcacagagtcaggtactgatcggaatggggctgcttgctggttccaccgtcttcctcctcaccctgctttgggggacctgtgtcgttggtggcaaatgtgaccttgggccaaaccgtgaggcagttgatgtaacagacaccaagggcttcagcttgactggtataatgctttcccttatgcaacatgtttctaatggagaccacctaatataatggtagtctctgtcatgtactcaatcaccagtcctgaacaatcgtctccttttttactgactggcaaaactggtggcaggcactggtattacaaccgacgtgcagaccagctatgcagcgcggatcatggggctatctgttatccccttcatcatccagcgctcagttcccaaagatgttgaagacccaccacgggcagcgtctagctatgttgctggccctcattgtgtcattcttgctcgtgctttcctactgtctgtatcaggtaagtaaaatcagtctcctgagaggatagcaggttataagatttgtaaggataacttcgacagtgaaattggatcctcaaatcttgcacccgggttttccacagccgatccagttcagaggaggaagcttgcatacgcaaagcacaagcacgtgatctctgggatactgaggcacgcccagatgcagtcactcggccgtctgctaaacgatgatggcacgcccaatgacgacgtcatcagaaagtgcgttcccctgaacatcctgttgttgcataaccacggtaggataggagagcactaataataattcatggagatggagatggtgatgtcatggaccttttcttatgctgacgcgcaggctgttccgcaagatcgacatggaccagagcgaatccctgtcccgtgctgagctgcacgccctcatcgtcggtatcaacttcgaggaggttgactttgacaggacggatgcggtggacaaggtcatggacgacttcgacacgtcccgcaacgatgtcgttgagcaggaggagtttgtgcaggggatgaagaaatggctcaacgaggccaagcgcagcgtgcccgtgggcggcgccttctccaccaagttcatcaatgaataccacgaggtaatctgctccgcccccgcagcctccggtaggcttaggaattgtggacggcagtgggcagagcactgatgaatggaatggaacggaatggaatttgtccagaggacgaggcaggagcacaacgagctggttgacaggtccgatgaggcggtggagagcgtggagaaccccgggtggtgcatcgccaaggccgtggcgctgctgctgctgggcgccgccatcgcggccgcgttcgcggacccgctcgtggacgccgtccacaacttctccaacgccacgcacatcccgtccttcttcatctccttcatcgcccttccgctcgcgaccaactccagcgaggccgtctccgccatcatcttcgccagcaggaagaagcagcggacctgctccctcacattctccgaggtacgtacgtggtcggcgttgctgcacctgtaccactgacaaacacccaacgtgggcgactgatgcgccgtccgcagcagacatttttttatgacgcttcttcttggttgactgatcggcaggtgtatggcggcgtgacgatgaacaacacgctgtgcctcggcgtgttcctggcgctcatctacttcaggaacctgacatgggacttctcgtcggaggtgctcatcatcctgctcgtctgcgtcgtcatggccctcttcaccagcttccggaccacgttcccgctctggacctgcctcgtcgcctacatgctctacccgttctcgctggtcctcgtctacatcctcgactacgtctttggctggtcataggctctcatcggcgcctcgagtgaacacgaccctgattggagcacctgggttttaacagccgccggtgtttctgcttgaccttgtaattttgactcatgtgaagctatctgtccagacttcttatatttctttgtgtatccaaagcacgcacgtacttcgtcaaacagcagctgcatgttttcagctcccttgtctgtacgtacatattgattttattttacctcaattgttagagttgtttgttataaagtttaaactaaaatttacaccaaaccggttaaaacacatatataggtttaaggccctgtttgttttcttctaggattatataatccagcttaggattatataaacacttaaagacttgcttatggattattataatctagggctctgtttgtttacccttgagattatataatctagcttaaataagttaagagacatatataaacaacatagattatatattctaaatatctaaattatgataatccataagtaagtcattaggtgcttatatataatatatatgagctggattatataatcctaaaaaacacaaacaggatctacatatttaaattatagtatattgtttatttgtcttttaatttattttagctagattatatataatctagagggtaaaaacatatacataaacatccagacatcgagacaagccctaccgaaccggtatcaaataaatggtttccgttgaagaaaaggccaatttttcatctccttaacttgacaaatattataaaaaaaatgtgctacatgcctttttgcctattgttttgtaaaacggcttcaactccgtgaaaaattaagctgtcatttagaagtccgagtcctagtcttgccaaattggcccttaaatcaaagtcataaaaaataaaatcataaattctggcactgtttggtaagacttcacttcaaaattacagcttcactataaaacaactccaacatattgttaaagtgggtcatttcgcttccacatgtactccagtttttgtaataactaataacatgctgggtaatttccgtataacttcatgagtaggttacccagcatgttatagctacgtatagctagacctttgaggagtttcgaagatttcataaaactagcatttggttttattttttttaaagttagagctcgtatagctagacctgtttagatagaagaagctataacataactaaaattcttgaactgaaccctagatcaggggtcactagatcgtaaatagaagtatagaaccataactgcaaaaatcattaaaaagaaacagacagattgtggttgacctgaaacggcggcttgcgtatagacacttccagtgccatcatagactcaacgtcgacatggtttcagaggcagagcaactacagtagcacttccataagagaactacctgcacctgatacgaacaagcaagaatgaaattcctaaattatcaataaaacgaagttcagggtacatcaatgtggatacgagtcacagcttcgcagagagcacttcttttgagaatgccctacaagatgacatcgtccacactgaacgatccgtttcggccgcttcatgctctcgatctttagaatcttcatcttgggtcgaccaggaggcctccggatattgggtgggctgagcatcatcacatcggccttgctggccacaccttgtaacccgggagaagaattgctccagtggctcctgtctggaattggatgtattggctgcgaatatgtttctcggtacttcattacactgaagcagtcatgagcatagaagcgcgggtcttcgccacacgaaagcagcgcggcggtagcatgtgcgcatggaatgccgtagatttaccatcggcggcatgngcangacctagcttcagtgtccacgatgtttgtccgctccgacgacacgatctcaaactccaccttgtttgctcnaaggacctggtagcactgcgagtcatggatggcttctgaaacaagtttctcagctgacggaacaagaactgagttgtatgactgtgccaagttctgacgctcagcaaaccagcaagtcagttggtgccttatgtgctcgatggcctgcacgatgggaagttcgtgacagtcaagcgacaagttgtacaatatctcggttatcccaagactaaaatggccgtatctgataccctgaaagcaaggggctgcccacaggtttggtgcgaaacgctgtaaccatggcatgacatcttgaactcgcatcatttcatttacctttgcatcaaattctgatgctgtgagagcataaacagcactccagaaaaggttaagcagtttagtattcttgaactcgtcaaggaaactctcgctcacgtatctcaggcaaaaaccatgaaaagcagtggggaaattagatccaactgctttaaccacttgccgctttctctcagaaagtatagtcaagaccggcatcttatctgtgttaactccaagcatcttcctcaattccgatataaaccaattccagttatcatcactctcagaatcaacaacaccaaatgctagagggaacatcatgtgatcagcatcaatagctgaagcacaaagcaatgtcccaagatactttcccttcaagtcagccttgtcaatttctagaaggggcctgcacccattcaagaaaccataaatggatgcatgaaacgagacaaacagccgctggaaggcattccctggtccaatacctccatatgttgcgacgctaccaggattcgtcttaacaatctgctcacagtatgcaggaagaaggcggtatccatcctcaagagtaccattaactgcagccatgcttctctcctttccacgccatgcctgcatataagaaacagcgacaccatgctgctcccgaatatcctgcagtatctcctttggcttaatctgagggttatccctgagccttgcctcgacagacctagcaacccaaccaacagtagcctgctgatgatgcaggttcagaacaccctcacatttgtggtccccatgcaaagtcctgacagtgaaagttggaacaccagggcacttagcgatgtgcacacgccaagggcaaccttcttttgagcactttgcgatgaaacggctacgatcagatttcaccacacggagctcatagtgcaaagcaatggccatgtccttgacagccctccgacaagtgtcaacatctgcaaactcttgaccgatgacaagagtttgcacacctggtataaggctctgctctgactggaccaaaatctggttgccttccatcaatgagcagacccactagccgaagaatatatatttctctgaatcatataaaactttcaaaaaccttgatagcaacaaatgtgaattatccttttagctgcaaaatactgacctgcacagcattaacaaaagtaaattatcattaaatcaacaatagaaagtttcgtacaatacaaggaaatgggcttatggctacccatcattcggtacaaacattagattagtgtcctgcctattggttactagattagaccatctgctttgtattggagtgtagaaagtgtatctatatagcaatttagcatcctgtttctggtagtaacgtcatcagtttgctaatggatttgtgggcaaagtttcctgaaattaaaacttgagacagatagcctccctctaggccttgacagaaccacctctccaggagacccaacatgcccaagtgtggccaaatttaattaaaaaaagtgtgacctcaaaatcgtttgaagtcctttagtaaacctacattgtatgctggtgatacctttggctacacctgcaggctggcctacgcaaatatgtatttaccaaaaaaaaaaaaaaatagcatcactgaccaagggaaaagactgctgttcaagcaagccttatgcgaagcgtggaagcaagcctcccgatcctttagatcatggtccaaccatagatcacatttaacatttaaacccccaccagctcacgcaatttgatcaaaagttcacttgataaactatggttgcatatatggttgaatcatgatctaaatacccagggggttcgcttgcatgcttgcacctaatacttgcttcacataactaagtccgattagatttgcaaaggtgggcagtggacaccatcagcttcctggtaattcaagtcggcacat

SEQ ID NO: 18532 - DNA, 732 bp, Zea mays
  misc_feature (29)..(29): n is a, c, g, or t
  misc_feature (40)..(40): n is a, c, g, or t
  misc_feature (701)..(701): n is a, c, g, or t
gcacgacgagctggtcgacaggtccgacnaggcggtgganagcgtggagaaccccgggtggtgcatagccaaggccgtggcgctgctgctgctgggctccgccgccgccgccgcgttcgccgacccgctcgtggacgccgtccacggcttctccaacgccacgcgcatcccgtccttcttcatctccttcatcgccctcccgctcgccaccaactccagcgaggccgtctccgccatcatcttcgccagcaggaagaagcagaggacctgctccctcaccttctccgaggtgtacggcggcgtgacgatgaacaacacgctgtgcctcggcgtgttcctggcgctcatctacttcaggaacctgacgtgggacttctcgtcggaggtgctcatcatcctgctggtctgcgtcgtcatggccctcttcaccagcttccggaccacgttcccgctctggacctgcctcgtcgcctacatgctctacccgctctcgctgatcatcgtctacatcctcgactatgtcttcggctggtcatagacctgattggctcaagtgaacacctggttttcagacagccgccggtgtttctgtttgacctccttgtaattttaactatatgtccagactttttctcatgtgatgctgtgatcatgttctactttctctaataaaaaaaaaaaaagactcgcgatctagaacntagcggacgcggtgggtcgtaccagcgtccg

SEQ ID NO: 18533 - DNA, 5811 bp, Zea mays
tctacgcagcgaaaagggccgcggaaaaaacgagttgtacgcgtcggctccgcttcttgatcccaacaccgccacgataatataatactaaatctatcgtccgcaccagcagcgagtgaaggaggagcctgcccgcgcctgcgcctggttgtaattgtagctcacgctcacccttcagttgaccaccgctgcggcagcaatggcggcgagtcgccggcagcaccgccgcggcttcccgctggtcccgctgctgctgtcgctcctggcggccgccgcgtacggccgcctcatctccgacggcggcccgcccgcgccgctcctcccggtcatccgcctcgcggcgccgccggccgaggccgagtgcgagcagacctacggcttcctcccctgcaccaccaccgtgctcggcaacctcttcctggtgctggcctacggcttcctcatgttcaaggcggccacgttcctgtcggcgggcagcgagctgctgctagagatcatggggcccggcctcgtcggcggcctcctcctccccatcctcggcgccctccccgacgcgctcctcgtcctaggttcgcaatcctcttccctccgcgctttgctactgaaattcgtcagttggttagtttttagctttctgaaaggctggaagcaagatccgatccatcaaagccttttgactttctccctttcactttctacgtgcctttgcataattgtccttttctttaaataaaatttttactacagcaagcagtacacgtttatttaccaaaccataaagcttcctgtgctgcgaaacagtagtatctggggaaggttatgtgtatgtggctatgtgcagattctgacgttgtcacagtactaacacagaggatcagaactaagcacagcagatcagatctgcgatccaagtatcgcagccggtgtaccaatggacttaaattacagatatgacatagcaccttgttgccttgttcaacaacgaccggatccctgatcagatcattatcatggtttgtcctcatctgtctgttgatcacgtgttgcagtgtccggcctctccgggagcaaagaggaggcgcagagccaggtgctgatcgggatggggctgctcgccggttccaccgtcttcctcctcaccctgctctggggaacctgtgtggtcgttggcaagtgtgacctcgggccaggccgtgaggcagtagatgtgacagacaccaagggcttcagcttgactggtacattgcttcctctgtcctctctatatctgttggttgtttatcatgtgatttcgaagtaggatgctgacaacaaaggtttcagctctccatttccaaagagaggatgctaaagctggcaattatgaacaattgcgttcttttttactgactgccaagattcggtggcaggcactggtgttacgaccgacgtgcagaccagctacgcggcacggatcatggggctatctgtcatccccttcatcatcgctcagttccccaagatgttgaagacgcaccacgggcagcgcctcgctatgctgctggcccttgtcgtgtcgttcgcgctcgtgcttgcctactgcctgtaccaggtaaacgagatagatacgtttctgacagggagcgacggctctactagattgttaagggtaaaaaaaaaactttgagacggtgaaactggatcctctgaaatccctgcaccaggttttccagccctggattcagaggaggaagctcgcgtacgcgaagcacaagcacgtgatctccgggatactgaggcacgcccagatgcagtcgctcggccgcctgctgaacgacgacggcacgcccaatgaacaagtcatcagtgtgtggggttccttccctctctctcaactgctgtctgttgtgtggcccgtagttaggagcttagcacactgttttcgatcgtgcaggctgttccgcaagatcgacatggacgagagccggtccctgtcccgcgccgagctccacgccctcatcgtcggcatcaacttcgaggaggtcgacttcgacaggacggacgcggtggacaaggtcatggacgacttcgacacgtcccgcaacgacgtcgtcgaggaggaggagttcgtgcaggggatgaggaagtggctggacgaggccaggcgcagcgtgcccgtgggcggcgccttctccagcaagttcatccacgagtaccacgaggtacaggagaggacagcctccagtgggttattaggaactgtgcactgactgactgaatggaatggaatggaatgggactgtgcagaggacgaggcaggagcacgacgagctggtcgacaggtccgacgaggcggtggagagcgtggagaaccccgggtggtgcatagccaaggccgtggcgctgctgctgctgggctccgccgccgccgccgcgttcgccgacccgctcgtggacgccgtccacggcttctccaacgccacgcgcatcccgtccttcttcatctccttcatcgccctcccgctcgccaccaactccagcgaggccgtctccgccatcatcttcgccagcaggaagaagcagaggacctgctccctcaccttctccgaggtatgttaatgctgccccgctgacaaaacactactagcgtacgcctgcaacgggcgttcttaattctaatgattgttcgggcaggtgtccggcggcgtgacgatgaacaacacgctgtgcctcggcgtgttcctggcgctcatctacttcaggaacctgacgtgggacttctcgtcggaggtgctcatcatcctgctggtctgcgtcgtcatggccctcttcaccagcttccggaccacgttcccgctctggacctgcctcgtcgcctacatgctctacccgctctcgctgatcatcgtctacatcctcgactatgtcttcggctggtcatagacctgattggctcaagtgaacacctggttttcagacagccgccggtgtttctgtttgacctccttgtaattttaactatatgtccagactttttctcatgtgatgctgtgatcatgttctactttctctaatccctcgtgtatccgaagcacacaacagtgcattcttcagctccacactcccgtgccagactcatttggcacgcctagcggctccggctgcggctctacccgaagccctgccctaccaaaccggcatcctttttaagtcacaaatggcccttaaatcaaagccacaaaaaaataatattatgaattgtaaattggaacagggatccctagatcgtaaatagaagtatagttttttttttttttttaaaatcataaaaaacagtggcagattatcattgctctgaaacggcgtagaagacacttttgagtgctatggacagacggtgcccaaagtcgacacgcttccccagaagcagagagctacacagaactaccgaagtacttgtacagaaggactacctgcacctgacgcgaaaaaaagcatgagatccctaagctgtcaataaaacagagttcatgtacaccaacggacgtgtcagcttcgcaaagagcacttcttttgagaatgcccaagaagatggcatcggccacactggacgatccgcttcggccgcttcatgctctcgatctttagaatcttcatcttgggtcggccaggaggcctccggatattgggcgggccaagcaccacatcgcccttgctgaccgcaccttgtgacccgggagacgaatcgttccagtggctcctgtccgggatcggatatattggctgggagtaggtttctcggtacttcatcacactgaagcagtcatcagcatagaggcgggggtcttcaccgcatgagagcagcgcggcggcggcatgtgcgcatgggatgccgtaaatttgccatcggcggcacgagcagaacctagcttgggtgtccacaatgttggttcgctccgatgacacaatctcaaactccaccttgtttgctcgaaggacttgatagcattgtgagtcatggatggcttctaggataactttctcagctgacggaacaagaaccgagttgtatgactgtgccaggttctggcgttcagcaaaccagcaagccagttggtgcctgatgtgctcgatggtttgcacaatgggaagttcatggcagtcaagggacaagttatacaatatctcggttatcccaagactaaaatggccatatctgataccctggaagtaagaaaatgcccacaggtttggcggaaaacgctgtaaccatggcatgacatcttgaacctgcatcatttcatttacctttgcatcaaattctgatgctgtgagagcatacacagcactccagaaaatgttaagcagtttagtattcttgaactcatcacggaaattctcactcacgtgtctcaagcaaaacccatgaaaagcagtggggaaattagatccgaccgctgcaaccacttgccgttttctctcagaaactatagtcaacaccggcatcttatctgtgttaactccgagcatcttcctcaattccgatataaaccaattccagttatcatcgctctcacaatcaacaacaccgaatgctagagggaacatcatgtgatcagcatcaatagctgaagcacacagcaatgtcccaagatactttcccttcaagtcagccttgtcaatttctagaaggggcctgcacccatttaagaaaccataaatggatgcacgaaacgagacaaacagccgctggaaggcattccctggcccaatacctctataggttgcaacactaccaggattcgtcttaacaatctgctcacaatatgcaggaagaagtcggtatccatcctcaagagtaccattaactgcagccatgcttctctcctttccacgccatgcctgcatataagaaacagcgaccccatgctgctctcgaatatcctgcagtatctcctttggcttaatctgcgggttatccctgagtcttgcctcgacagacctagcaacccaaccaacagtagcctgctgatgatgcaggttcagaacaccctcacatttgtggtccccatgcaaagtcctgacagtgaaagttggaacaccagggcacttagcgatgtgcacacgccaagggcaaccttcttttgagcactttgcgatgaaacggctacgatcagatttcaccacacggagctcatagtgcaaagcaatggccatgtccttgacagccctccgacaagtgtcaacatctgcaaactcttgaccgatgacaagagtttgcacacctggtataaggctctgctctgactggaccaaaatctggttgccttccatcaatgagcagacccactagccgaagaatatatatttctctgaatcatataaaactttcaaaaaccttgatagcaacaaatgtgaattatccttttagctgcaaaatactgaccaatgaaagcaaaaaacaagtgccagcacagacagatctacgttccacgcccgtgcacaagagggcggcagcaggaaggtgggtagagtgcttcgcttcggtggaaggcggtgcggaggagttcgcgtcccggggagagggaccgccgatggacgtgatgagaatagcaagccgcgatgggagcgggcgaagtggataagcggcgtcggtcggtttcggcgccgcgccgccgcgccgggaaggggagaggaaggatcaaggatgggtcagttagggatggggtcgatgtttttttttaccatcagaatccattacatttgacctcaaataaaattcagtccgcatcatggttggatcggcagacccacatcatctagcccggccgg

SEQ ID NO: 18534 - DNA, 2045 bp, Zea mays
  misc_feature (1431)..(1431): n is a, c, g, or t
  misc_feature (1512)..(1512): n is a, c, g, or t
tggtccaagtgatgtgtatggttcatggatgtaagaatctgatgccatgttcatcaagagggaaaactatcattggaagagtggccatttgccatgggtgaaggtggaggaaaccattagatggagggcgcttggaatagagaggagcgggaaaaggacttggttaaaagaaaactttttttgttgttacatgttgcttgttgaacctaaaaactcagaggtgtataaataaccattcactaaaaccaatataacctcaaataacctattctaagtaccgcaaggttctgacttcacatctaatgaacatatatgtttttgatctctttttatggctgctggcgcagagtgcttgttattgacgtccctgtattacgcagaatgggatgaccaggaagaaggcaacgaagccgtccagcagtgggaggatgattgggatgacgatgacgtgaacgatgatttctcgctgcagcttaaggaagagctggacggaagcaacggccagaagagctgaagtattatttctctactttatataaatgatttttatatggcagctacttttggaaccgttgatgtgctttggatgtgaaagtttttggacatcagtcggcaatttgacagcactgtacgtgttagttgtcgttaggatatgtctctagccgaaacgctagaatccgccacaatgtctacgccccaactgtttctcttaaaagagtgccgcaactgtttttgtccctacgcccgacctcgttctttagcagtaatccaacagttctgtatatccactcctaaaacctccgagctaccaaatgaggattgcttgcgtatctttcccttacaatcacggtttagtggatgaaaaccgatcttcccgtgcgataacactttggttcacggtgaatgataacgtttaaccatgtttgtaagtccaaccataatcagatactgatatcgtcttattcaaacttgttatcgttgttaatgaagtatgaatcattacagttgccttttatattatatttcttgaaccaaccggaatttagaagtctacaacaatatccggcataggcaactgtgcgtttgcatggacaacgacatcttgagtttgatggaattggagcgatgatattgctgctgccggacgagctcaaggtttacaaaaccgacggtaaaccgctaggtttatcgaaaccgccagggacggtaacggtttactagcggttttattttgaattcaatccaaatttaaaaaaaattgaatttttttataaaacaatatatgataaaaaactacatgttttactgagtaatttagtatagaatgtatttaaatttaaatcagtttagccaacaaaaaaatagaacaaagtatggacccgttaacccgttaacaaaaaaatctaaacatctctattgggcctctcctcngggacctccccagctcccctcacttttcccttcacttacctgagagctgtcgtcgccgcacacgcaaaagccgtcgcctcngcgccttttactagcggctaagcgcggcaaaccgccggccaggagcggtttatcgcccgcttcgccgctgcccctcggcgccgtcgcagatcccctcaccgacggtttccatcgcaaaaccggcggtaaaccgcccacgagaagaggtaaatcacgttttatcaccggtaaaccggttatggtaccaagatttagctctgttttagatatttagtgtctagatttggatttttaatgtttatgttttcagatttcattcatgtttgtgttaataactgtaattgttagattccgttcttgaatttttaatatttaatgcctagctctgttttagttatagtatatgtaactcataatattatttactactactgtaaatatgatttggtattgttattatagatgtgatggcttatgtttatgtattagttatggtttagttattgtttcaagttatatgatatttttgccacatctgtattctataggagacatgtcagatgaagatagagatagagaaagagaaagagata

SEQ ID NO: 18535 - DNA, 965 bp, Zea mays
gccggccccgcccgggtctcctcttcaggatgacaccggttccttcttccgtcttcttcagcttcgtcactttaccgtcttcacttatcagatctagtaacgctgacattgtggtcccggggtggtgccttggctgacctgaccagcaagcaaataggcccagccaactccgatcccaccggcaccagccgcccgcaacccgcaaagctgcttcccggactagctagggtttcgtctacgccgcttgatctagtcctctctcccggcacgcgagggcgcagcgttgatggcggcggcaccggcggacgctaaggcggaggccgccaagatggacctcctcgaggacgatgacgagttcgaagagttcgagatcgaccaagaatgggatgaccaggaagaaggcaacgaagccgtccagcagtgggaggatgattgggatgacgatgacgtgaacgatgatttctcgctgcagcttaaggaagagctggacggaagcaacggccagaagagctgaagtattatttctctactttatataaatgatttttatatggcagctacttttggaaccgttgatgtgctttggatgtgaaagtttttggacatcagtcggcaatttgacagcactgtacgtgttagttgtcgttaggatatgtctctagccgaaacgctagaatccgccacaatgtctacgccccaactgtttctcttaaaagagtgccgcaactgtttttgtaccaaaaaaaaaaaaaaaaaagcagcagtaatccaacagttctgtatatccactcctaaaacctccgagctaccaaatgaggattgcttgcgtatctttcccttacaatcacggtttagtggatgaaaaccgatcttcccgtgcgataacactttggttcacggtgaatgataacgtttaaccatgtttgtaagtccaaccataatcagatactgatatcgtcttattt

SEQ ID NO: 18536 - DNA, 1108 bp, Zea mays
ggtggatcttcattatgcccattatatgtacctccaagacgaaatagaggcataaatcacaccatgttgaagcatcaaagagtttttacaataaggcttaggttagatcatcctcatcatcctcttgtttcttcagctcattctttgccctcagcagcagtgtcgttttccaaggatccaggcgtgtcatgccgtcaaattccttgatggcatcagtaaatttggcaatatctccatcgtccattgatgcagcaagatcagctaaaagtttgtattcacgagttcctgagaaagtcggatcgatttcctggtatctctccaacgaattttgtatagcaacagcatcagctctacatagttggcagattcctgcattaaggaggatgcctctgacactatacttcagcagattgttgttaattgattgacgagcaatttcttcaaaaatctcagttgcctttgggtactgttccaactgcgcagcaatttctgcaactttctgcttaatggtgtttgattgagatgtctgtccttcactgtcgaaaagatcagcggccctttctaggtaatctgaagccttctccaaatcctgctcttgctgataaatctcaccaatgtccttgcagtatcttgcagccatgctcaatctaccaatttccagaaaaagattaacagcctggtctagcgcttgcgcagcttcctgaggtgagaattttttgtagcagtttgcagcttccacataagctgaggcagcttcatgcttactatcacccttcatatggcaattagcaatcttgatatacacagatgcagctctgttccagttcttcgagagcttgaaaaagttggcggccttatcgtataggtcggcggcgtcctcgtacttggagccgaagagcccccagccggagagcttcttatccgccttcctctccgtgtcgtcaccgcgagcctcgtggtcccccatcgctgccgacgggccgctgctccgatcgcttgtgccggcggcgaagcgaccaagatttgttgcgggggaggagcagaaaacgaagggagaggaggaaggggatcggaaacgcagcacgcgaccccgcaaacaaaaaaagga

SEQ ID NO: 18537 - DNA, 2678 bp, Zea mays
cgtgcttttactacggttgttatatatcatataaataggtaatgagatgtttattcaaacataattattgtttatttctaaacactaagttacatatggtctagtggttagccctaaatttttagagcagggggcgtggattcgagtgctcgctctgcactattttacgaggtgtgatagttgtatgggcggggttgggtgttggacaggcgatgtagctggttgcgcgggcgctgggggtccatagggcagtaactgagagagcgtgggacccacagagcacgacatcgagtcggggcgcatggggcaggcctagagtgtttatatggaggccgtggtagcaccaggtgcctacattaagtttttaatagagtagtataaatttatgatcggtgctcatgcaagttagaataactaatgtttaagaatgatcaatataatgagatgatgcatcataagtttatttcacaaatttgatgaaatgagtgcattcctcgtattattactaattattagtttatagaggaataaaacagtgatatatcaattcattctattccacaaactaaataaaaaagtgaagagcgaaaagatgataaacaatcttattccaaacacgctgatagagtccggttcctatagatcacttccatcatcgtgatccagactgatatcgcatgctcatacaggtcaatgatatggaatctgattatagcatgtttcgagtttcgtcacatgtttactgatcctttattatgtcctgatttttcttttttgataaaaggactgtttctgatttggagcaagtaatggactaacacgttcgaggcgaattcatcgcaatccggccatggagacatctttgctaaagttcggcgatcggggctgccccaggattgaattctcactcatttttttggcgatttgataaaggaacgtggtcggcatgcgcagagtttctttttctttctttgctccccacatggcaaaactggatcgcaactaacccctcataacactaaaaccaactactactaatcatagagctacagtgtaactcgtaaacacaggaactgaaataatccaaaataggacaaaaaattgagtacaaaaattgcgacaggtctcaacagagacgcgcagcagatttgcagccactaccaccgaaaccaaatcgctccctcccgggagccaaaacattgctagggtgccccggtccttgtctcgcggttcacagtagagcggtggcaccacgtttttcctaatcctcttcctgttctacttctacccatttgttccgtcgcttcaacggcacggaagagaatcgctacccagccaatcgaagtcttctcttgccctgctgtatctcatatcctgttgcgcgagattcttggcgattctgctactggtttttatttttattttgctagttcttgaaatttctttcacgagtgtcagtagccaactgctgataacaacatcctatcgttcctgtagcccctttccgtgaccttgccaaagaatttgctcttctctgtgcgtgtgcaatttcttccgctacagctcaaggatccgctactctgctgttttgggagattcgccatgggcggcggggccgttaacgaccacttcccgggggccagcgacccgctgctccccacgaagcgggatggggacggggacgaggacgacgcaggtgcctccgcgttccacgagttcgacggcgcctccttcgccggcgcggtgttcaacctctccaccaccatcgtcggcgcgggcatcatggcgctaccggccaccatgaaggtgctcggtctcgtccctgggctcgtcatgatagtgctcgccgcgctcctcaccgacgcctccatcgagctgctcgtgcggttcagccgggccgcgggcgcgcgctcctacagcgcggccatggccgacgccttcggatggtggggtaggaggctgctccaggtctgcgtcgtcatcaacaacgtcggcgtcatgattgtgtacatgatcattataggtaacatcaccttaggattgtgatctcttggccattgatttgagaaattggacttatatattatactgcaagtagtagctcaatcacttttcggattattcttgagtcttgaccgtggatttaggagcagatgttgcttcctgtgcagcatacaccgaatgaaaacgaaatattgggcaattgactgtttgtgctttcaataaatttctgctcattactggaaaacatgtttgttaattggcagtatatgtattttctatttctgtataaggtctgagaccccatgggatttgaaaggaaatgtgagtttgtttcacttgtggccgaccagaacgccttttacattttcagtctgcactttatataattcaatttcaataaaatgatactacttcaatgtttccccaattgaaggatattagttcctactgacatacaaatgttcaatgtcacaggcgatgtgctttctggatccacttctggtggtgagcatcactatggtgtgttagaaggatggtttggaatacactggtggaatgggcgtttatttgttctccttgtcacaaccctttgtgtgttcactccactagcatgcttgaagcgtattggtaagcaattgagctaccaagaagttatttcaggctgtagatagtta

SEQ ID NO: 18538 - DNA, 2179 bp, Zea mays
  misc_feature (84)..(84): n is a, c, g, or t
aaaaaaaaaaaaaaaaaaaaaaaaaaaaactaccacgcgaaaccaaagtggttcttctccctatcaaaaaaattgctagggtgnccccgaggccggcccgggttctcgcggttcgcagtagagcggtggcaccacgtttttcctaatcctcttcctgttctacttctacccatttgttccgtcgcttcaacggcacggaagagaatcgctacccagccaatcgaagtcttctcttgccctgctgtatctcatatcctgttgcgcgagattcttggcgattctgctactggtttttatttttattttgctagttcttgaaatttctttcacgagtgtcagtagccaactgctgataacaacatcctatcgttcctgtagcccctttccgtgaccttgccaaagaatttgctcttctctgtgcgtgtgcaatttcttccgctacagctcaaggatccgctactctgctgttttgggagattcgccatgggcggcggggccgttaacgaccacttcccgggggccagcgacccgctgctccccacgaagcgggatggggacggggacgaggacgacgcaggtgcctccgcgttccacgagttcgacggcgcctccttcgccggcgcggtgttcaacctctccaccaccatcgtcggcgcgggcatcatggcgctaccggccaccatgaaggtgctcggtctcgtccctgggctcgtcatgatagtgctcgccgcgctcctcaccgacgcctccatcgagctgctcgtgcggttcagccgggccgcgggcgcgcgctcctacagcgcggccatggccgacgccttcggatggtggggtaggaggctgctccaggtctgcgtcgtcatcaacaacgtcggcgtcatgattgtgtacatgatcattataggcgatgtgctttctggatccacttctggtggtgagcatcactatggtgtgttagaaggatggtttggaatacactggtggaatgggcgtttatttgttctccttgtcacaaccctttgtgtgttcactccactagcatgcttgaagcgtattgattcactaagctatacatccacaatatctgttgctttggcggttgtattcgttattattactgcaggaattgctgtcatcaagttgataggtggacaaattccaatgcccaagttgtttcccactgtttctgatttggcatctgtttgggaactttttacagcagtgccggttcttgtcactgcttacgtttgccattacaatgttcacccaattcataatgagctaaaggactctacccagattaagccaatagtacacacatcattgacactatgctcgaccatctacatcacaacaagtttctttggatatctcctctttggtgaatctacactctctgatgtgctctccaactttgattcaaatcttgggatcccatacagttcagtcctcaatgatgctgtcagagtgagctatgctgttcacctgatgcttgtgttccccatgatattccatgcattgaggcttaatttggatgggctcctcttcgcctctgcaaggcctctgtcttctgacaacagaagattcggcataattacagcatcgctcctcctagtgatttttgggtctgcaatcttcattcctagtatttgggatgcctttcagtttactggggcaactgctgctgtctgtatcgcctttattttcccagctgcgatcactttaagggattcacaaggtattgccaagaagtgggacaaaattctggcgatcttcatgattgttcttgctgttgtatcaaatgtagtagcggtctacagcgatgcctacaaaatattcaacaaggaaagtgctccttctaatgcctggatcggggagtcaactgaaaatagatcttcgtggtggcttgtacgttagttggccaataaaatattcatagttcatttaggctttgtttttggtgatttgttccacgggccatggtctgctcaaatctcattgagttttgtgtgtatatctacgataggtatgaaaatttgcacaaaccgaagtgctccggtaccataaaaataattgtgtcaaatctgaaattacagagttacgatcatgatgactctttttgaaaaaaattgtatcggatgtgaagtaaccatcgatatctcttgtaaaagctccggcc

SEQ ID NO: 18539 - DNA, 3021 bp, Zea mays
tgtcgatgtaaggatcgagtgggagcgggtccaggagctagttcatgagcccactgttgggaaacttggagtgctcgtccaggaagtactccttggcgtcgaggccgaagtggccgacctcgtcctccatgcccatcaacgtgtatgcctgcaagcacgacgtcctgtcgacgctggcgcggtcaggtacgtgcttttcgatggggaggtcgagctcctggcccgacgatggtgaggagatgaacgtcgcagaccttgcgcgcacggatattggaccgacgtgcctacgatcgaggtgttgatgctcggcacggtgtggatgcctagtggaggaagcaagtcctgggagcccggggtcgcgacacggacgaccgggggcagatcgacccggtcgcagggagagtccggatccgaatcgaggaaacagtggtggaaacagggctcctcgtcgaagatggacgtctcgtcacagggctcttcgcagcgctcgtcctggcagcgctcgacaccgtcgtagtgtccgctgatgcgctcggacaggcgtgcctccatgagtcgcatttcgttgagcagcttgcggatggcggtgtcttggttgctccatcgtggaagatcggggtcgtcgtggcacaacaacaagcggatccaggagactgaatctgataccagatgttagcacttaggaaggagaaatttgtcattatgaaacatagcagatgtgaattcgacgaaatagaggtataggtgggggattcgacagtctggaaaagtagagaaagaccaaactctgaaatagacaagatttctctattacccgctgacgacatagattaatctcccgtcccatcgccgtcattgcctgctcgtgtcgcgctccggccgaccgtcgtcgctgcctactcgtgtcttcgtccgatcgtgcccatcgtctgcgcagcagccactggcctgtgccccggccccctgccaatgccactcgttctccacctccgcttttcaccgtccaaggacccggcgccatcgagtagcttctagaggtagtagaccacggggagctaccgaataatctagcaaactatatacattttagatgttagctcagcggcctaagaacagccgataacagatcctcaagacagcccctatgttctttcccatttccagaacttaataaactacaaatattcagtaataggctaaaaggaaaaggaaaagatcaacaggaacaccatatggtaaactgaaaggtaagatgtctgctacagctcaaacagaatcagggcctagagcagctcaacaagttggtgtaccatcagttcatacactttgtgtcaatgaaaaaaaaactgaggcatgcaatcagaacatgctagtttacattttgtttttccagcactgggagctaccgaacatgacggatgtagccaaaaaaaaatggatgctaccttgtactgaaaatgcagggactgttcacctgcattctagccctgcctccaatgctcgccggggcttagtttttcagctggctcccaatctgcctgaacccattggtcctcgttaattcatcactgcttaatcgaacagtagaattagtatcttctacggcaatattggagccctctttcagtggtctgcctctcttggtaccaccagctgcagcgctgttcttcagcttggcatcgtcaatcctaatcgaaaaatcgacctgttctacaaatttttcaacatctgcttgatcgatcttactggcgaagcgcttttggggccttcccctcctcttctttgcaggcacgacttcttcgccgctgctacctttgtcgcccctcctccttctccggccactgcgcacaagggcgacggcaatggctgctgctgccacattggtgagcagtcaccgtcaccgatctccacctcagaccactgtcgctcgtcctccatctcccagcgcccacaccattccctgtgcgcccactgccgacgatcccacggtcagcggcccgctcctccttcccacgcccgacaactccaacgtcgtggcgcagggccagcgggtgcgccgccgagcggaacggcttctcgtgcacgacgacggccgcggcggccaggtgtgccgcgcactgcagcgccaggaacaccgtccccagggactcgccctctccaccgcctctgttgaccaggcaaaggacgagcagcaagggcgtagaacgcggcgagggcaccgatcgtcgcgacctctgttcatctacatctcagacggaggagagcagcagcaacgttaacaggtagctgacggcgtgagcatcaggaaattaatctgtgtcggcagcgggtaatagagaaatcttgtctattccagagtttggcctttctctatttttccaaactgtcgaagccctcttatatgcctccatttcgtcgaatccacatctaccgtgttttataatggaaaatttctccctacgaaggggatgagagagatgtgctggagtagagaaggcttggagaaggggatagcagcgaagaagacgatctcgtttgataaaaaaaaaaaaaaaacatatcctttataaccaacacacgccgttcttatattccacacgttcactcggcctgctaacacttacaaggcctacttcggcccagccaaacgaacattagcgcgtctggtccgtttgccgcaatcgttgccttcacacattcacactcgttgcgttcaccttcagtagcgatgaaaacggacggaaacggacggaaaaacccttctcccgtttccgctcccgcaattcttcatcggaaatgggagcgggagcggaacaaccacgggcggaaacgggtccgggttatacgggtttacggaaacgaaccaaaacggccgaaaattaactgaaaacgaacggaaattacctcaacggaaaaattaatcggaaaataagtccacatcaccacatgattacatgaccagttgaccacatagccattgaacaacatgaaaataagtccacaatagtacatgagcacata

SEQ ID NO: 18540 - DNA, 481 bp, Zea mays
atagacttatagtcacactcacacaccgacacacacatatggacacaatataaggtcttcattcttcaatgtcttcatgacatcaaacacacatttgtaagatttcttcacagctcgccatcttcattcatgaattaggaatcactatcccggtcatgttcctgtaggatggagacgcctgtgctgcttcctgcttgctgtcgtacgcccgaccgaccgctgattcttgcttgctgcttcctgcttgctgtgccaggctgccggcggaagcacgtgcgagttggccgtcgacgagtcggccgctcggcggggctgaagcctggggattggagtcggccgtcggcgagtcggccgctcggcgccggcggggctgaagcggtgaagcatggggtctggggattggaggtgtccaggcgtccagccaggcagccaccgagggaatgggcttagggttagcgttcacgtgtgtgtggagaactgg

SEQ ID NO: 18541 - DNA, 1811 bp, Zea mays
  misc_feature (1755)..(1755): n is a, c, g, or t
gccggccgggtccgagagcccgccacacaaacccctgcctcccaccagaaaagcaagcagaccacacccacccgcctctaaaccaaccagcctgtccccattccccgtccccggcgatgcacgccagcatccactccctcccgtcagcctcttcttctccccctgatgagcgctgagttctgtgctgccgctgctggtgctgtggccatggagctcggagtcggggatgtgatggggctgcagcaaggcatcgccgccgccaccgggccatcgtccggagacagcgacctgggtcttctcaagcgagcaggcctcgcccaggcagccacctcctacccctcccctttcctcgaccaacagaagatgctcaggttctccaaggcggcggcggctcacacgtcgccctcaggcctagacttcggaggaggcccgagcgagcaggctttcctgctgtccaggaccaagcggccgttcactccgtcgcagtggatggagctggagcaccaggctctcatatacaagtatctcaatgccaaggcccccataccttccagcctgctcgtttccatcagcaagagcttcaggtcatccaacagagtgagctggaggcctctttaccaaggctacgcaaacgcagactccgacccagaacctgggaggtgccggcggacagacggaaagaagtggcggtgctccaaggaggcgatgcctgatcacaagtactgcgagcgccacatcaataggaaccgccaccgttcaagaaagcctgtggaaaaccaacctaaaaaggccaccaaggaggtgcctaccgctgctgctggctcgttgccgtgtgccgggccacaaggtagcttgaagaaggcaaaagttaatgactccaagccaggcactggcagctattggacagatagtttaaacaggacaatgctgagcagagagaaggcaaacaaaccgacggacgacgagtctttgctgcttagttctacgaagaacagccagcccaccttgtccctgctcactcaactgaagcagcagaacaaaccagataagttaggtcccacaccggaaaatgagccgaactcggacacgatgttgaaagcctggggtggcagccaccacaagagcatttcctccacacagcgccatgacgctgaatccctccaatcagtcctccaaaatttcagcctagcccagaatgacaggttggagtcagaaaagaacagatattctgattccgtgctagtctcatcggctttctattctgcagacggtccacaaactacctgccttacacctaacatgacacaagtgcagcaggactgcatatcaagctcctgggagatgcctcaaggtggacctctaggcgagatcttaacgaactccaagattagtgaggactcaagcaagtgtggatctaggtcatatggttggctattgaatcttgaccatgcaccatgattcctcaatccatggagagcttgacatagatatctcaccactgatgcaaacaatggtcaggaaagaaagatggttcaaatgaccgtattgtttgccccatgcatgctcgttatctacatttgtacttctatttttgtagcatccagctgttgaattatcagttcttctgaatctggctgtatcttaaagatattctagtttgcgtcaactgatatcttgcttgctagatgtttaatgatatcagcggtccattttaatcaaaagaaaagtgtttcaaaaaaaaaaaaaaaaaagcanagttctaaagaactactgtacttatgaacatttttctcactttttttcagacatgc

SEQ ID NO: 18542 - DNA, 840 bp, Zea mays
tgattcatcactgcttaatcgaacagtagaattagtatttctacggcaatattggagccctctttcagcgggcctgccttctcttggtaccaccagcttgcgggcggctgttcttcagcttggcatcgtcagcttcttcttggtcggcatcgacctgttctacaaagttttcaacatctgcttgatcgatcttactggcgaagcgcttttggggccttcccctcctcttctttgcaggcacgacttcttcgccgctgctacctttgtcttcgtggctcctgacagtggttagcttcttccctctccctcttcctctgcccatggattcaatttcagctgtgcaaatgttggtcagtccaaccactggagctgcaggctctgttgaagctgctccttttgttttatcagatttgcttgttggaaatgaagtacttcgtcaagacaactggtcttagacaatctagtaaaaaacggatacactagagatcttccacagagcttgcgtctactccaagcagcgtcatgcaccccgtttgtcaagtctgctggcgaaaagatggaagctttgccggtgctggagaaaaaggaatgccgaggacccagcggatcggtggcgagctttaggtcgcggtgccggaagtaccgcagatcggaaagccgcagcgaagattgggacgtgggtgagcaggaagggaagggaagcagcaggagggtttctatcaacgaacagctagcgccctggtgttctggatggctgagctccaatagctgctgggtgctggggcagcacactggcttgggtttagagaggagagagatgggtctcggccggcctcgagg

SEQ ID NO: 18543 - DNA, 2310 bp, Zea mays
ggctcccactagaaaagcacacccaccttctctctcttcaccagcctgtccccaacaggccaacaatgcacaccaacatccactctctcgtcaggctcctctcccccaaaaatgagcgctgagttctgcgctgctgccggtgtcgtggccatggagctcggagtcggagatgtgctggggctgcagcaaggcatcgcaatcaccgcgccatcgcccagggacagcgacctgggtcttctcaagcgagcaggcctcacccaggctgcggctgctgccccctacccctcccccttccttgacgaggagaagatgctcaggttctccaaggcggctcacacattgcactcaggcttggattttggaggcccaggtgagcaggctttcctgctgtccaggaccaagatgccatttactccctcgcagtggatggagctggagcaccaggctctgatatacaagtacctcaatgcaaaggcccccataccttccagcctgctcatttcaatcagcaagagcttcagatcatccaatagagtgagctggaggcctctgtatcaaggctacacaaatgcagactctgacccagaacctgggagatgccgacggacggatggaaagaagtggcggtgctccaaggaagcaatggctgatcacaagtactgtgagcggcacatcaacagaaaccgtcaacgttcaagaaagcctgtggaaaatcaacctaagaagaccaccaaggaggtgcctgctgctgctggctcattgccatgtgctgggccacaaggtagcttgaagaaggcaaaagttaatgactccaagccaggcattgtcagctattgggcagatagtttaaacaggacaatgttgagcagagagaaagcaaacaaaccgacggaagatagctctttgctgcttacttctacgaacagccaacccaccttgtccctgctctctcagctaaagcagcaaaataaaccagataagttaggccccacactggaaaatgagtcaaacccagacacaatattgaaagcctggggtggcaaccagcctagccacaagagcatttcctctacagagcgccatgatgctgaatccctccaatcagtccttcaaaatttcagcctagcccagaatgagaagatggagtcagaaaagaacaaatattctgattccgtgctagtttcatcgactttctattctgcagacggtccacgagctacctgccttacacctaacatgacacaggtgaagcaggattgcatatcaagctcttgggagatgcctcaaggtggacctctaggcgaaatcttaacgaactccaagaatagcaaggacttaagcaagtgtaaaccaaggtcatatggttggttgttgaatcttgaccatgcaccatgattcctcaatccatgaagagcttgacatagatatcccatcatgtaggcaaacaatggtcagaaaaaggttatgaccacattgcttgccccatgcatgcttgctatctacatttgtatttctgttacgtagcatttagctagttgaattatcagttcttctggatacggctgtatcttaaacaagttctagtttgtgtcagatgatatcttgcttgctagatgtttcatgttccactttcaacaggaacttcagacaaccactttgattgacaaaaaaaaaaaaaaagaaccagctctagtaaacaaggttccaagaaactacatgcacgcttttctgactcttgtttttttttcaaacatacaggagagctgtgtcatcattatattaaatacgagtacatgttaaacagatgaccatgtagctcccgttgcaaacattgaggtcatttgaccttcaaaatggctgcgacgtaaaacagcagagtacccacttgtaggaatccctttgacaagccacaaaactaactactgccatcacacagtttgagtgcttttccaaaaacaatcctaccagggttccaaacatagtttctggtcaatgatatatgcaattcatgtattataattggaacatggcctggatagaaagagcagccaggtggccacaaaagaacccaggttcatgtatacgacaatatgatggccacaaagaatccaagttcatgtatgacaattcgatgcaagaaaaggatccgtggccgctctgacatcatcatccagaacagctatgattacatctgagaatgcaaaagactgatgaagcagtgcacaaatatctatcgaactttagaactcgccaaaaatcacaacagacaagtaaccagcagcataattttggagattatgtcaccaaaat

SEQ ID NO: 18544 - DNA, 3666 bp, Zea mays
  misc_feature (690)..(690): n is a, c, g, or t
ggtacgtcctcacacacaagcaacaacatcatttcacccatgctcttcaagtttgttgtcgatcaacgccgtaacagtaatagtgtctcaacgacatccacgcgggtggagatgaaacaatgtgatgccatcacaatgagagaaacgatgacgacgacgacgtcttggatgcccatggcccttgggagagaggtggtggcgacaatcaaatgattctctctagcatatagatccttgctaatggcttcccccccacccccaaaatcattaatgttctcatatattacgattgtctcttgaacctatattcaacacacagttattgccttcttatgaaacgaaattgctcggtaaaaaatgatccaagttggtattaattatatcttgcaactgtaatacaccacaccttttccttaagcttatgaggagagtacatgacatatgagttcgttcacaccaatggcgatgaaagaaaacactggtacctttggttgtagatttgatattctcctttaggctgaccatagtcaacaactgcacacgataccctttaggatcgagttgtgtgtgcagatgcagcgatatactttacatagtactctaaatttagagtgggcaagagaaaccttcatttgtagagtatatactctcatacttcactgtgctcttatgttaggtgaggagatgggnagtggggccagcggtaagagtgtttgatatatgtattgataaaaaatgtgatatttttaattgggttaagatatagagtgattatggatgtgtgagtttggttactgtattttaaaatgttgatgagaaggatagaatattatttttagagtaggaatttagaatataataagtgcagatagccttaacaactcactgcttctccttcggtggtactcgctgacaactcactggcataaaccaaatattgtacagcattgtattgagctaaaaaaactctcggaactcatgcaaagacaaaagaatggatgaaaggaccggagatatttaagccgcccagcgcccacccacacccctgcctcccaggctcccactagaaaagcacacccaccttctctctcttcaccagcctgtccccaacaatgcacaccaacatccactctctcgtcaggctcctctcccccaaatgagcgctgagttctgcgctgctgcgggtgtcgtggccatggagctcggggtcggagatgcgctggggctgcagcaaggcatcgcaatcaccgcgccatcgcccagggacagcgacctgggtcttctcaagcgagcaggcctcacccaggctgcggctgctgccccctacccctcccccttccttgacgaggagaagatgctcaggttctccaaggcggctcacacattgcactcaggtttggatgcctcctcagtcctcatcaacacatcttccctcatgcatcttcattcttccttcccagttcccatccatacggagatatcacgccgcatgtgcatgttcttggatggatatgttctctgcaaaacatgttagacaggggtagtaagacggtctctagcggtagtgtaaaatagggacgcgaaatttaaaataggggatgagacagagtatcctctctcctaatcaccattctcatctcctatgccaaacttcaatctacaaatattgtttaacagtgtcacgcacagttctacgtttaaacgattcaccgcggccagtctctgtacactgagaatggcctaataatattcaaaaagaaaagcaaaagtcaaaaggagaacagcggtgcagcgttcattgaacttgatgagcgctcatgagtgctaccttatatggaggggcctagcctagcagcaatagggatttgcaaagcactagagctctccctgggtcctggggtctggggccctgggcccctccctcaccgccaaggctgcctgtaaacatttcatctgcttttttttttaccttcacacttttgtctctggagataaggttgctgtttgcttcagcatttcagatttggtcagactaaaatattctccttgtttcaccgtcatctaggcttggattttggaggcccaggtgagcaggctttcctgctgtccaggaccaagatgccatttactccctcgcagtggatggagctggagcaccaggctctgatatacaagtacctcaatgcaaaggcccccccataccttccagcctgctcatttcaatcagcaagagcttcagatcatccaatagaggtactgaaccagaaaactaaggttttctacttcaaaactactggcgcttgcaaccaaccaagatagaagagaaatattactttgcaaaggtgcagcgttacatggtaaacaaaaaatgctggcagtggcagctctgtagtatttgaaactgcaactcattaggttcaatgtatgaatgccatggaatttcaaagatattacaccaaaaaggaaccaccattttgtacctaaacactcgtatgccataaaggataaccacagtattgctttgaatatagatgccagagcttgacagacttctctaacgaagtgagctggaggcctctgtatcaaggctacacaaatgcagactctgacccagaacctgggagatgccgacggacggatggaaagaagtggcggtgctccaaggaagcaatggctgatcacaagtactgtgagcggcacatcaacagaaaccgtcaacgttcaagaaagcctgtggaaaatcaacctaagaagaccaccaaggaggtgcctgctgctgctggctcattgccatgtgctgggccacaaggtagcttgaagaaggcaaaagttaatgactccaagccaggcattgtcagctattgggcagatagtttaaacaggtaaatactgtattcttacaccagagtcatctccttatataaggcaccctattttagcatgatatctgaacaataaaatcccaatttaatacttgtgcatcctattaagagcatgcatcctggaataatgttagtatgctgaggttctagttaatattaatttttattttagttgccacttagcagtcataataattcccattccacaaccttgtactcattttcaggacaatgttgagcagagagaaagcaaacaaaccgacggaagatagctctttgctgcttacttctacgaacagccaacccaccttgtccctgctctctcagctgaagcagcaaaacaaaccagataagttaggccccacactggaaaatgagtcaaacccagacacaatattgaaagcctggggtggcaaccagcctagccacaagagcatttcctctacagagcgccatgatgctgaatccctccaatcagtccttcaaaatttcagcctagcccagaatgagaagatggagtcagaaaagaacaaatattctgattccgtgctagtttcgtcgactttctattctgcagacggtccaagagctacctgccttacacctaacatgacacaggtgaagcaggattgcatatcaagctcttgggagatgcctcaaggtggacctctaggcgaaatcttaacgaactccaagaatagcaaggacttaagcaagtgtaaaccaaggtcatatggttggttgttgaatcttgaccatgcaccatgattcctcaatccatgaa

SEQ ID NO: 18545 - DNA, 1417 bp, Zea mays
acagtaattcatgtacctgtgtgtctgtcaactgcgtatcctgctgggatgctggagtagacatatcgggtatagtttggggggccggacacgtacatccttctttacgtatcatgtaaaaaacattgtttaaaataatggcatcaaaacgatatcgacaaatgattgcataacttttttatattgacgtaaagaccataaaactgactaccctgtctggggaagaatatcatctgattttgatgtggttttctgcacatcataagcatcttcgttgtcccccgcctcggcacggaggacctcatcaattaactcgccaaaaacatcagatagattgtattgtttctcaacaatctgctgaagagtctgtttaataactgaacacgccttaccaacctccgcatcaaaatgtgacagcttctctatgaaacccaggcggtggcgggatggaagctgattcagcttgcttgatatcaaatccctgatgagcgggagttcgatgtgaattgagtgctgtccagatgggtcaggacgaggtacatcaaaagtgttggtcctggtcttatgctgttgtaaattgaaaattattaagtaaatgtatagcatatcactgaatattatgttgaaattctatgacaaacaaatatataaatagaatcatgccttgaattgtgcatcaacgggtggtacagctgtgtagcaggtctctgaggagcttcggaactaaaaaaaggcgtgaaagatggagtaaaacttatacaaacatattaaattgataaatgagattcatatgtttaatggaaaatgcaaaaaaacatcacaaatatgcttacaaacgggcataaaggtatgtgaacgttatcatatgcatgtaaataaatgattgacacataaaaaaaataccgagcaatgtccaaatgcttcttctcctttgcgtatcttgcccttgtcagctcttgtcagggcttgaataatattcctatcaaagtatttgattcgtggtgttccacgtttgttctggggtgccgctgagtcatgcagatgatccaaataatactgcctaccgcgctcgttctccgcctctgcttttcaccgtccatggacccgacgccatcgagtagcttctggaggtagtagatcgcggggagctaccgaataatctagcaaacttatatacatttagatgttagctcaacggcctaagaacaacagataacatatcctcaagacaacacctatgttcttttccatttccagaacttaataaactacaaatattcagtaataggctaaaaggctctgtcgaagctgtgcaaatgttggtcagtccgaccactggagctgctccttttgttttatcagatttgcttgttggaaatgaagtacttcgtcaagttgtctagtgtgtctcggccag

SEQ ID NO: 18546 - DNA, 544 bp, Zea mays
tatattacaactctctgcctcttctgcttacatcatacaacaagcttctctctctggtagccatggcttcggctactttctctgtggccaaaccatctcttcagggtttttctgagttctcaggacttcgaaactcctctgctcttccctttgccaagagatcttcttccgatgagtttgtttccttcgtcagtttccaaacttctgcaatgagaagcaatggtggatacaggaaaggggtgaccgaggccaagataaaggtagccatcaatgggttcggtaggattggtaggaacttcttgaggtgttggcatggtcgtaaggactctcctcttgatgtcgttgtcattaacgacactggtggtgttaaacaagcatcacatctcctcaaatacgactcaactcttggaatctttgacgctgatgtcaaaccttcaggagactcagctctctctgttgatggaaagatcatcaagattggatctgatcgtaacccatctaatctcccctggggggaactaggcattgacttagttatcgaagg

SEQ ID NO: 18547 - DNA, 2445 bp, Zea mays
gtcgagggtcgaccggaggggcaagatcaatggtgcagtggtgttctcgatggaaggggaaacttcggtgagcaattcacgatttcctatcatgtgaccgggtcagggaatgggcgcatggggtttggtaccttctggtgcacatcatgttgctgtatcgatgtcaagggagcattagggttcaccggtcagtgatggcgggcatggtgggactcgtgtcaccatggttcgatcaactagggacgatagagctctatgaagtttcacaacttcctcacactctagggatcatggtgacaaaggtggggaggacggggcgtctctagtgagggtggaatgcagttctgtcacgtgggaatagtggcggcatcccttgtagtgagtaagaggtgcttgggtggctgggagtgcaatatgagggaagtagttggtgcgggggtgttccttttataagggagcaccattgattaatgggagacaatgacagagagggtggtgcgaccatttaaagctcgaatgccgctaggggtgctcagggttaaatgatcaggcatcagggaggaaaggaagggataaaatttctttactctagttgtggggtgatggggacaagggcagtgctcaagcaagggagggcgagttcagcgcagagatgcctgtcgtgacacgtggggggtgggagtgggaggttgaggttaacaggtggggttatggcgtcagcgagagagagagcgactgagggggagagaagtgccaacaggtggggacgaggtgtcagtgactcacgagcacatgttagtggtaagtgaggtcgggaatggtttgggctgagtggatctaggctggctcggacactgtgctgattcttttatttttctccatttcccaatttaagtttgaatttttaattcaaatcaaatgaactccaaatctctccaaaaattacaaaaatctagaatatttagatgaatatgttggtggagtttgggctccgcttttggttagtatgtttgtataaaaataatttctctccttttgtcacttccaatattgacttaaatttttatgtagcaatgccaactttttttagtagtgtgccacttatagcacaaaaactatatccattttctaataatccttgaaatccacattctatttttagccattcttcaaaattggcacaaaactaggaaaatttaatacattcttgccataacatattctagtgcaaatgttaactagattgctcaatattagcaaacttcttttggaagattcattaatattgctacattgcatacttttttagaagttcatcaataatgcctcattatcatacttcattttaggaacttgattaaaaccgccttaaaatagagccaagtgacggatccactttaaaggtgattcttaatttcttacttcctatctttggtggcttatgtttatatatgtgtgggtggttgaattacgcggggacaccactacaccacaccttggacatatatatggaaaatagcttcacagtctagattccatggcatcaaggatggggatggtggctattctgtccttgtttgtttgtgctcttgttgcttcaacatctgtcaatgctaatgtgtggcagactgatgaggatgctttttatagtacaaataaactgggagtcaatggcaacatggagatggcacaacaacaaggtggatttattggccatcgcccaagacttgcattattcaatagggcatcaaaacaactggaccgtgaaaaaagacctgtgcctagcgggccagaccccatacatcacagcatcccatcacatgctcctcagcatccaccatcatatggcaaagctccttatgaagatgacaagagcatagcatctcctggtctgtccaacccgataggtcctccaccatttttagatagatactagttcatgcaaaagtagtgagtatttatgcacctatgccaatgaataacctctaattacctacatgtattggcctggtgtttggtaaacatgaagcaataactttctcttatcgaaaaactggtctcaactccgcctatgttgtctcagcatatgttagtgcagcatagtctggccctaagtctaggtactaggaggagggttgagttaggcacggtgagctagctataaaaaacttagccactccaatggagatgaaacccaataaaacagttggaggtgtaaaccccatagagacgcgctataccggaatccacgtatggtgttaaatgggcaagggccgagctgccaccccttggtggcgcaccgtgtcttgatatggatgcagtgtcaaataagcaaggaatgggtcgtctcttcctttgtggcgcactacatcgacgtcttggtgtagtgacaaatgtgcaagtgtaacaccctaaaatcttaacttgtgatttaaataaatcatt

SEQ ID NO: 18548 - DNA, 2432 bp, Zea mays
ggtcaattctgcctaaatgtatctcctgcatatgcagaccagttcagtagagatagaacgggtgtgcaacagagctgacgagtgtctgctagaaacagcagcagttagcatcaaaccttccggtgggggaccagaacatctagccatcttggcggtgctaaaagatagatcggcccagtacgacgtgaatcttctcaagaggaagttccagactgccattcagaagaacctcaatcctctcttcaaggtatacatacgaccttcttcccctttctgcccccccccccccccactgacgtcaaatgatctgacgaacatgtgtaccactggaaccatcaattgatcctttacatacaggtgagctatgtcaaagtcgtcgctgagttcccgagaacggcttcgaacaagctgctgagaagggttctgagggatcagctcgcgcaggaactctcaaatcgcagcaagctatgacctttgagaccgttctgcctttgtttcagcatcaaagctatcgattttcttgttccatttcaataaagcactgcttcaatgaaggaagcataccaagatgatcctacaaatcacccccgcccatgtaaaacttcaaaccttgttgtccttttgaaaagggaaccgtagtttagagaacgtttgtaaaggtcagtacattttatctgatcattacagtgctgatgaacaaactaggcgcatgcatagttgtgtcacttagtatgtaccaatcggtggtaattgcatcgaatcatttgctgcgatttttttttatcttgcgagacaagtgggagtcagtgcttcgttgtatcgtactgtttgaacgtctatcacctagttaacctcgtttgtgacatgtgagaggatataggttctggaatgcagagctgctgtgagcccttcttctctaacatgtttatcagaacacgcatggcgtgtccaaggagcaactcgtagctactgtcttggaagatgcaggattaagtgactatcaaacaactgtcactgtcagccaggcaaccatcctagctgtaggaagcgttgggtggggcaggtagctagccaaccaacgcagaaagccccgtccgtaatgttagggagagggttcggctgccgctggtatcattcacagtggctgctcatttccataggcataaaacactgatgatacagtagataggattgttttggtcagtgtttttctttcactaactagtgatcttcaaacatatcgtatttcttgaaaaaaaaagaaaaaaatgcatgtccaattacttatttgctacccatacttatcctgcagttattttggtcagtctcagtggacgtcgtgtgtaaatttcatttgtactaaataaatcatgtaaattctatttgtgctgaataaattgttgtgtatgcattttttatgatataacagtgtatttaagaagagaatgaaggagaatgagcttcatttagatgaaacattcgtgacatggttaccaaccacgtgtgagtcataaatttaaatgtctataaaactatataatgaaactttatgtcataatagtcttagaagcaacgtcatgaaactaaaatgtaataaaactgtagggactaagaattagtcaaccaagcacccgggtacgcgggcaatttcttctctagacctctagtcctgcagcgtactcctacgtacacccaaacgaaaatggcatttgcatcccttacgtcatcacaaaatcataacgcccgcccgaccctttccagcaaaagaagtagtactggcccgtatactcttcttctacaaagaaatgcgcatctgcatctacctacgccatccaaaatccataacaaccagtcattctcgtgaccgggagtcaagcaaacttaacacgcaaatggccaggcaattttccccctactagcagcacgcctcaattgacgaatgggagacttgacagaaattcttcggcatgtacatcagagagacgacggagtcaacattactgcacaagacgcacacagcgcactgttttttttttcattttccattttttttcttgtgcaaaactaagcccggaaaaagagcttgagactcgcaagccgcctctcaggcttaccttgaagaggctcacaagcctgcgacaagcctagttttgtaactcgctcaaataacgagctgagccagctcgcgtgcctactatatcatgtagtgtcatattataacactattacattattattacattattatgttatttatttattttcttatttttttataaatttaatgctatatatagtttaaaatatatttctaattttctgtacatatttttattttatatataataaaaatatacaattttatattttgaattggatttggtgtgacaactcgcgagcaggcatgcgagcctgaacaaccttgagccgag

SEQ ID NO: 18549 - DNA, 2883 bp, Zea mays
  misc_feature (1343)..(1343): n is a, c, g, or t
gctctggtaattaatctgcccattttttttaaaaaaaggagaacttgtgttttcctatacaattttgtagctaatatgtaatttttacagtttgtagttaaataagatctagtcctatggaaccatctgcttacattagttggacatctttatatataccttatccttaactgaactaacgtactttgcataataatcatcaccacacatctgagcagttcataataattccattcttcaagccgtgtcatacaagggccttcatctaaagctgttgtgattcctgcaattggagattctcttggaattatgctaagggatggtgatatgtcctggaaagattttctttctcacgctgctggaaggtaggtgctcaattttctgtctctttgtcacacatgaatagatggatatttgagctttggcgatcctgaaattcttatttcataaaattgagcacaatttcattgcaaaataaaggcgatctcttcatataaggtacatatatctattgggtttgcaggtcatcttcatattctccagtttatcaatctgtggatgcactaactaatatactattttcttcaggaacaaccggtatgtcctagaaccctcttccttttcccttttctgcttgccggcttgctcgcttttgaggttcacatttgatattttatgttccattttttccttgtgaaggggagccaaaagcaataccgtggacacaactttctcccataagatgtgcatccgatacctgggcacatttggatgttcgtccgtgtgacataggttgctggcctactaatctgggctgggttatgggaccaataatcatctactcatgctttctgactggggcaactttggctttataccatggatctccacttggacgcgatttctgcaaatttgtacaggtatgtttggcatagtgtgcaccatcatctgtttttcagcggcccgagcggtccacccttgccaatgccacttgcatatattgtagttctgtaagttttgaggttcaatatgttatgttccattagtcaccttgcacgtagcatggacatatcttacttcacatttgtttgttgacagatctagcatacctctactggataaccacccaaccttaaaccttgacacactactatgttttttttaaaaaaacttgacatgcctgaaaattcttttttcttcaatgctatatgctgttttttttttaggatggcttttagcaaatgctgagcgatgaattcctccaaaatattttgcaggatgctggtgtgactgtattaggaagtgtgcctagcttggtgaagtcatggaaagctgggaactgngctgaagggcttgactggaccaaaatcaggtgagtggcccaatcagaatatatccatcttcatcacaacctggtagaaggacaggtaaattattattcttgcagagtactaggcacaacgggggaggcttctgatattgatgacaacctgtggctaacttcgcgtgcctcatacaagcccattgttgagtgctgtggaggcacagagttggcatcctcatacattcaagggagtcttctgcgaccgcaggcctttggagcttttagtggcgcatcaatgtccactgggtttgtcatacttgatgaacagggaactccgtatgtaagtattgtcccttaaatttccgttttgtttaatgcgttcgaggcataaccagctaaattgactatgatagcctgatgatataccttgctctggagaagtgggtctcttccctttgtattttggtgctactaatcggcttctcaacgctgatcatgacaaggtttacttcgatggaatgcccatttataaaggaagggtatggacttgcatatcttcttgtttgtatatttattaagtaagtgtttcctatttgattttattacaaaaactgtggatatgatgctacttgcctacttggctatctagtatatactacagtctgtcatgaattttctttcacagaacgtatacaatatcagcattgttcacttgtatatttgtttgctggactaaattgaagtactaaattcaatgcatcccattgaaaggtattagttatgaaacaaactggtgaaataatctttctttccaattgtgttatagcaactcagacgacatggagatataatccagaggacagtaggcgggtactatattgtacagggaagggcggatgacaccatgaacctcggtggaattaagaccagttcagtagagatagaacgggtgtgcaacagagctgacgagtgtctgctagaaacagcagcagttagcatcaaaccttccggtgggggaccagaacatctagccatcttggcggtgctaaaagatagatcggcccagtacgacgtgaatcttctcaagaggaagttccagactgccattcagaagaacctcaatcctctcttcaaggtgagctatgtcaaagtcgtcgctgagttcccgagaacggcttcgaacaagctgctgagaagggttctgagggatcagctcgcgcaggaactctcaaatcgcagcaagctatgacctttgagactgttctgcctttgtttcagcatcaaagctatcgattttcttgttccatttcaataaagcactgcttcaatgaaggaagcataccaagatgatcctacaaattccccccgcccctgtaaaacttcaaatctggttgtccttttgaaaagggaaccgtagtccagagaacgtttgtaaaggtctgtacattttatctgatcgttacagtgctgatgaacaaactgggcgcatgcatagttgtgtcacatagtatgtaccaatcggtggtaattgcatcgaatcatttgctgcgatttttttt

SEQ ID NO: 18550 - DNA, 612 bp, Zea mays
  misc_feature (17)..(17): n is a, c, g, or t
aatcaacccccaatttncataattaaacttaaaaaagctagatttttctacatatgcattcatccccggatcccaccaccacgaaccaaacaaaagaaaacatgttatagatttaagccttcttaggagacttggctggtgacttggacgcaacatcctcggtcgacttggcagacttcttaggcaaaagcacagagttgatgttaggcaacacaccaccgtgagcgatcgtgactccgctcagaagcttccccaactcctcatcgttccttatcgccaagagaagatgcctcgggatgatcctcgacttcttgttgtctctcgccgcgttaccagcaagctccaaaacttcggctgcgaggtactcgaggacggcggccatgtaaaccggggctcctccaccgagtctctgcgcgtaccgtcccttcctcaggaaacgagtgattcttcctacggggaattggagaccggccttgatcgatttcgaaaccgatttggtttttgggccgccggctttccttcctccgaatgccttcttcacttttccggtggtttccatcgcgacgagagagagatttataatgcaattaaagaggttatgagatttgtgat

SEQ ID NO: 18551 - DNA, 961 bp, Zea mays
tcaaattcaggccaaaggaactggaagattgcatgctaaggcttgacccagaattgattggtctgaatactaggctgaaagagatgaagaaacaaaatgccagcatctcggaaatggagaccatacggaggagtatgactattcggatgaagcagttgatgcctatttatactcaggttgccacacgatttgccgaattgcatgacacctctgctagaatggccgccaaaggtgtgatcggtaaggttgttgattggaaagagtctcgggccttcttctacaggagattgcgaaggagagttgctgaggatgccctggccaaggaagttaaagaagctgctggcgagcagctttcccacagatcagcattagactgtatcaagaaatggtatctagcgtccaaaggaactgaaggtgatggtgaaatgtggaatgatgatgaatctttctttgcttggaaggatgatcccaaaaactatgagaattatcttgaggagttgaaggctgaaagagtatcgaactggttctcgcatcttgctgaaagttcagacgtgaaagctctaccaaacggtctttcgctgctccttaacaagatgaatcctttgaagagggagcaggtcattgatggcctcaggcagcttcttggttgatcgatggtggcaaagtggagcatgaagccctgtttagttgggaacggattgttctggttgtagtcatgtatttagctgtttaacatgtatttaattgggtggcgttactccacgtcatacggtacaacagcaatcctgatcaagtgattatttattcttcaatcgaagtagtacatgattttcatcagtaagctttgtgcttgcaattagggataaaatcggatggaaatgaactgaaaaacactcattttcgtttctatattttttttataaaaatggattctaatgcaaaaaaaaaaaaaaaaaaaaaa

SEQ ID NO: 18552 - DNA, 1066 bp, Zea mays
aaaacctacatgcagaaattcgtacccagactccatagaaacactgctttggtgccaaatccaaaacacaactgatatgtgcaccatgagaatcgcagttcctcaaggccacatccatatcaatgcgcagagtccgggctggtgggttcctctaccatcgaggggacgcaaagcagtaagccagcaaacagatggatgggatgggggaggggcgcaggtagccagacggtgtgggactggatgctgagaacgcggccggtgtcggacggcagcgcgacggacaggatcggcggccgcgccatcttcgggtacgccgccgccgccctcgtccggcccctccgcgtcagcagcagcgaccaccacccaaacgcctccctgtcggcaggtgaggtcaggcctgctgcgcggctgcgccagcagcggggcacggcggccctcccacgaggcgcgcgcggcggcagtcatgcgacgcaacgcacggagcggcgggcggtggaaccgtacggtcgggacggaccgcttggcgggatctgtgccgtgcgttacagaagggacggatccgatcctcaccgtgctcgtgggggcgccatggcggcgggctcgacgggatggccttggagattttaggctcgccagacagatccggggctccctgaaaggccttagcccacgtagagggtgatgggctcgtcgtcgtcacccagatgttgagcggaatgggagggatggcgccggagcgctagcacgcgttgggctcgcatggcagtgtcacgcacgcatcgcatgctgctgtcctcggcccggcaacagcctaccgacgactcctgtgggctgtggctgtgggagtgagtgggactgggtcacccgtcactgggggctgggctgggcagacgcggtcgtcgctgaccgtgacgcagacggcggcatgtgctgcctgtggctgtgtgcgcactgcatgctgctgcgcacagtacgttgcagatacaacacttttgatggaaatacgaaacgcccacagacgcgacagattcgaacgtcacgccaaaaaaaaaaaaaaaaaacgagc

SEQ ID NO: 18553 - DNA, 1102 bp, Zea mays
ccttctgatccttattagtccacctgcagctgttagcgtttttgggtataaaatacttctcaattgtggtgttttggattgttctcaacttctcatataatggccgatctagtcataccgtacaatgtttgagttcatatccttactattttcctggccgcgtgggatccagataatgggtgaaagagtaattgttgaaggttcagtccaacacaaccccctgaatgagggttcaattctctggataacagaaagtaggatgccgcttggtatagttgatgagttgtttggacctgttaagaacccgtactaccttgtgcggtacaactctgaggaagaggtacctgctgggatcagtgcaggaaccgatgtctgttttgtagcggagtttgcagaccacatcctgaatatgaaggagctctatgcaaaaggctatgatgaatctgattctgtagacaaagatgcagaagatttacctgatttctctgatgatgaaaaggaggctgagtacaaacggtcattacgtcaagcaaaaaggcagactgatagacagcacgagcctatgaagacttcttgttacatgaagggatcacagcctagaggtggcggaatacggaagcccatgccgccaaggaacctggatacatcaacacgaggtcaccagccacagcctcattttcgccgctcagatatggctcctgcaggtactgaaaatacagcacgttcattgggtcctcaaaatgcacctatgattgctccaacaatgttgcagcctggcccaatgaaccctgctgtgccaccacctgttcctcttgcaaatcagatgggtggctgcttcatgaacctggcacagcagcagctcttatcgcagcagcctaatatggtttggcctggtggatttccacagcctcctcttcccaacatgggggtagatggagctgcactcgctgccaacatcatgcagaacctcctcacaggagccagccaattccagcagcagtttcagaacctgaacttcagtggtgcaggagccaaccagttcccgcagcagtttcagaaccagaacttcagtggtggcgcaggagccaaccagttcccgcag

SEQ ID NO: 18554 - DNA, 2382 bp, Zea mays
gctatctattttttttattaagtaaagagcagtattaacaagcagggaaaataacactagttcttatgtgcagattcctcctatatcagggaagggggttgatcctgttgaaaatcctggaccctccattgcatcatttcaagggaatctgggtcttccaaacttcagtctggaagacaacgctccacttaagcatattaagcctatacctgatatatttcctagcctgtcactgggtgctcataaggattatattcgtagttctgtcccagagttgccagatggttcattgctgccaaacttcatggcagatattactggtacttcgaagcaaaagtcatttatgtctggtctacttcctgggctgggtcttagcccagggcaaccaatacattcggctatgcctgataatcacaagaaagtcttggacaatataatgatgcgtgctcagtatgcgtcaaacaaattcttgaagaagagatcaaaactagattattggtcagaggatgaacttgatgctctgtggataggacttcgtaggcatggaaggggaaattgggatgctatgcttagagatccaaagctgaagtttttgaacaaccgaactagtgaggagctggccttgaggtggattttggaggagcaaaaaattatagatgaacctatgtctacatccaccaggcgttctaactcagcagcatttcctggaatatctgatgcaatgatgtctcgggcactgaatgaaagtaatttctctaaaatgaggatggagcagcctaaattgcagtcccacttaactgatattcagttaggttcgagtgatatcctatccacatttcctcatgttgacgctgctagttacattaactcaggggagggtggcccatctcaaataccatggcaggattttaagcatagatcaagttatgctggagattttcctgccggtgcatttgacaagttggagaaacctgatgttggaccgatcccgccatttatgccaaatcctttcatgactgacagcattggttcacttcccataaacagaaaaaacaatagttccatcccgcatagtgaaatcaggtcaagttctcgtgagaacattctttctggtgtttcggatggacagatcaacttgcttcatgagatgcagcgtcgtcgtcgtgtgaggtcaggcaaagaacccattgagatgaatctcaaccacatagaccactcaaatctccagcttgataatactagtgaccttggaggtttaaaaccaaacaagttacctcattggcttcaggaggctgtacgtgctccttcatctaagccacctgaacgtgagctaccagcaacagtttcggcaattgctcagtcggtctgccttcttcttggagaacaagaaccatcaatacctccattcttgatcccgggaacacctctttctcgcccaaaagatccaaggattaattcaaagaagaaactccgcaaggctcagcaatctaactctcatgtagagcattcaaaaattggatctggtgagggtgattgtgtcactaccccagcacccccatccattgaagcttcacctgcacttcctgtcgattgcgatgatggtgagccttcactcaacttgaaatctgcatcgttgtcatcttcagctggcagcaaggggctagatgaattacctcccacatttaaagaagcaaaccaaaccgtggatggctcagaagctgttgcggccaagtcagatgctcctgaaattggttgtcaggtacctggttcctctccattacatgacaaaggtagtgaatcctcggggtcgccagtgaaggacactcctgacgctggaatcagattgccaggatcagataactcagttatggcattttctgcactcccacttgttgatgaagcacctgggacaagcagcagagcagctgacacgcctgtgccatgtgatggcaatgagtcgaaagaggatgttccactagacaacgctgaaagcaccaggaaactggagccgaacggatgaactggctcctcttgcgagcatggatgcatcgcatcgagtttctgctaatacagccgacgaagatgggtggatgaaatgatcattagactcgagctagttagctcaacattcctttcttttgcgttcagcataacactgggattttccctctcccaatgtttccagtgttgatctcgtgttgtgtaatgctttagtgcaggtctcgttgcagataggatgaaacgcaaagggctagtggtacttagcagtagttgggcactagtccgtcgggggagcaactcgtggaaacctgtatacaagaaatgtatattttgctaaaaaaaaaaaaaaaaggtgtgtagaacgtagaccgctattcgtcc

SEQ ID NO: 18555 - DNA, 1393 bp, Zea mays
  misc_feature (1348)..(1348): n is a, c, g, or t
cattggtacctcgagccggccgggacacctgggactgggaggctgggaatcccggcaggcaaagcgaaagcatccgcgcgagaggcgtcgcgtgttccttgcttcgtcctcacgtgccgtggcccttccgcttcccccgtatccgcccgtcctgttcccgccccgagcgaaccggcggcggcggaggcgatgcagcacgagccgtggcggcctggcgctgagcccgccgccggggctggggcgggccctgctcccaccaccgtcgacgaggcatccatggagcggagcatgagcttcgtcaaggcgcttcaggagctcaagaacctgcgcccgcagctctactcggcctccgagtactgcgagaagtcctacctccgcagcgaacagaagcaagtggtgctggacaacatgaaagattacgctgtcagggccctggtcaacgctgtcgaccatcttggcacagtggcctacaagctgacagacctatacgaagagcaggcttcagaaataacaaccctcgagttgaaagtagcatgcttgaaccagcaagtccgtacctgccagacatacacggacaaagaaggcctcagacaacagcagatgatgggggctgccagaagacaccataaccattacatcgtaccatatgcgggaaacaaaagaatgcaggccttctctgttacgcaagccgatgctgatttcgacccaacgccaaggcctttctcttcagcaaggacccttgagtggcatttggtttccgagaagaattccaaaaccagtagaccagatcagtctgaaattgccttaggagaaacaaaaactactaaggcttcgtcaagtggtttccgccttctcggcaaggaatcatctgcatctcccttgtccaggaatgtgcagtccaacataaccagtttggatattgtcagtgccggcatgaaggatcagcccacgaccaggcacttgtcatcgttcagttctttggacaaccccaggggccgacaaatccagaaggctccgcttcgcacaaaaagtatgctagccgctttctttgtcaaacacagatcagcaaagatgaaaaacgtctctgtgcgttgatcaactgcaagccaagcctgtagtttgctccagccaaaccgacgtggaagtgttaagggcatgagatgtatacatgtttgtatatggtatttgggtcttgtatgctagtgctctagagataaacctttacggatgcgctttcaatctagagtctttggcatcttgctcatgaccttaatgtaatgatttatatggatatatattactagttttataatctaaaaaaaaaaaactagccaaaaaaatacagcanttgtagtcgtgttgcgacatcaaaaaaaaaaaaaaaaaagcggcc

SEQ ID NO: 18556 - DNA, 2412 bp, Zea mays
ttgggacctcggccggcctggtcctccattcaagctccactactccacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaaccaggagattgcgtgcgcgcaggacgcgctgagacacaaggcatcatcctatcccacggtgaccgtggaagccctaggagtgcaggggtcgtcgttcctggtgaacgtgttctccgacaagagctgcccggggctgctcgtcgccgtgctggaggccttcgacgagctggggctcagcgtgctccaggccaccgcgtcctgcgccgactccttccgcctcgaggccgtgggcggagagaacgtggcggacaacgtggacgagcacgtcgtgaagcaggccgtcctgcaggccgtcaggagctgctccgagggcggtagcgagcacgacgacgaggagtagtagctagctatagctagaggctgagcgcgcgtaagcacacacgccttctgctacttgcatcggtcgatgtcgtccctgctgctggtgcatggctgcctggacaaccgcgcatgtactcgatcgatcgtcgaccggccggcgccctctatgtgtatggtagtagcagtagctctggctggacaaccgcgcatgtactcgatcgatcgtcgaccggccggcgccctctctgtgtatggtagtagcagtagctccgtttctcagctagctccccctctcgatctttaattcgattttttttactcttctctgtttcctctatctatctatctatctatcggtggcaaagatgaaacagagccgctgctcctagctgctgatggtccggtgaattcgttcgtagcagcgccaccgtttcctgtgtaatagtattggccggagggcacgccgtgatttacatatttactatatatgtcaatgatgcatgcgtgataataagatcgatcatgcctgcacgcacgcacgcatgcatgatgtaagaatgacgacgacaacgacgacgatgatgatcatgcagctacccttcatacattaatgctgacgatggtcattttggttcgctgctaattcgatcccttccccctaaccaattgctcctatttgtggaataatctcatgtacgtacgcggtgctgaatcgctccagctgctaagtcggcagctcgacctgcctgctactccctgaaacatagtatacagtgcctgcacaagagcagcatcgtcgatttcgatgagataatatgctgctgtgctgtacgtgggggttttactgattgatctgcccaaaacaaaacacgcttgtgatgttgtgcacgccgtgaccgtgtttattactactactgtactcgagaacggcagtcacgagctccaaaaacacaggaaggcagccaatgggatggatggatggggtgggtggcccagacggatcggacatttattccgagcaagagaggccgcgtcgtagtagtagtagttattttaaaaagctgcagcagccacacacggctggggctactcccccggccggtcagggtccggctccggagccagcaggcatatccatccatccatccatcaaccacacccctgatgaatgatctgaccctgatcctcatcctggggcgcggtggcagccgcatcgatcgctacaacgccctcgtgacacacggctccgcgtcgcctgtgacccgtgtgtgcatgcgcgcgcgcagcaagctgacgaccaagccacggacgacggacggatcgatgggggcggcagggcgtcgtgccaccatcagccatgcctgctccctccctccctccctcccgcgcgcggcctacctagctagctagctacttcgccgtccaccacgcacgcacggtgacatgtgcccccccaagccgcgcgtccggccaggtgccgtacgacggtggcagggccagcgctttgtcgcctccccgcacgggagcgcggtgcctttgtttttcacctggcccctgtctgtcgagcgaatcggacgagaacccggtaggccgggagcacggcgcggcgtgctgcacagcctacgggctataggaggggccctggctggcagccaggcaggcacaggtcgccgctgctctgctctgctctgctctccccttccccccctgccatgcgggcctcatcacgagagggatttcgcgcgcggcgcgaggctttggctcg

SEQ ID NO: 18557 - DNA, 1276 bp, Zea mays
ctccactactccacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaaccaggagattgcgtgcgcgcaggacgcgctgagacacaaggcatcatcctatcccacggtgaccgtggaagccctaggagtgcaggggtcgtcgttcctggtgaacgtgttctccgacaagagctgcccggggctgctcgtcgccgtgctggaggccttcgacgagctggggctcagcgtgctccaggccaccgcgtcctgcgccgactccttccgcctcgaggccgtgggcggagagaacgtggcggacaacgtggacgagcacgtcgtgaagcaggcagtcctgcaggccgtcaggagctgctccgagggcggcagcgagcacgacgacgaggagtagtagctatagcaagaggctgagcgcgcgtaagcacacacgccttctgctacttgcatcggtcgatgtcgtccctgctgctggtgcatagctctggctggacaaccgcgcatgtactcgatcgatcgtcgaccggccggcgccctctctgtgtatggtagtagcagtagctccgtttctcagctagctccccctctcgatctttaattcgattttttttactcttctctgtttcctctatctatctatctatctatctatcggtggcaaagatgaaacagagccgctgctcctagctgctgatggtccggtgaattcgttcgtagcagcgccaccgtttcctgtgtaatagtattggccggagggcacgccgtgatttacatatttagtatatatgtctatgatgcatgcgtgataataagatcgatcatgcctgcacgcacgcacgcatgcatgatgtaagaatgacgacgacaacgacgacgatgatgatcatgcagctacccttcatacattaatgctgacgatggtcattttggttcgctgctaattcgatcccttccccctaaccaattgctcctatttggggaataatctcatgtacgtacgcggtgctgaatcgctccagctgctaagtcggcagctcg

SEQ ID NO: 18558 - DNA, 1164 bp, Zea mays
gtttttttggttcacagacttattattaaaatctaacagagaaaagcggaacaagcctccgcaatcatagcctttaccaataaattgtccagacttagacacaactaatttattggactccaaaactaccttgaacccatgtctacacagaagggttccgctaacgagattcttgtgtatagaagggacatgatgcacgttcttcagctacacgatctttcccgaagtaaacttcagatccaccgtgccaatgccatgaacagaagcatgtgacccattccccattaggacggaagaatcccggacagccttgtagcaggcgtaggagcacggtcatgctgcagttgatggtgggcggaatcatggggcccatggcagtcaccgggttgacgacaaccacgtctaccccgttctcctccgcaaacctccacgccgccttctctgccagcgtcttggaaacagggtaccagacctcgttcttcttgcagtagtcgacgtcggcccagcaccgctcgtcgcggggctcgccggcgggccacgcggggctgggtatgatggcggagctggacgaggtgaccaccacccgccgcacggtgcgggcctccttggcggcgcgcaggacgttgagcgtgccctccaccgccggcaccaccatctgcccctgcgggtcgctcacggggtagacggtgcagggggtggcgaggtggaacacgcccgagcagccccgcgcggcggccatgagcgcggcgccgtcgaggaggtcgcccgggaagacgcgcagccggccttcgccggcgccggcgcccagggcgaccaggtgctccgtctccgccttgtcatcggggttgaggacgctggcgtggacgttgtagccgcggtcgaggaggaggccgacgagggtcgatccgatgaagccgctggcgccggtgaccagcaccgtctccctcttgccctccacgctcgccatcgcccggccgcagtgtccttcctctctgagagctgaggtgaggagagtgagatctcgagctcttaagtgtgtcactgtctgtgtgtgtggctatcttgagctgcagcagcatctgccctctaaggataaaactgggaaaaaaagataagaactagtttagaaactccattttctcaaggaaaaatgaactaatttaa

SEQ ID NO: 18559 - DNA, 849 bp, Zea mays
  misc_feature (504)..(504): n is a, c, g, or t
  misc_feature (540)..(540): n is a, c, g, or t
  misc_feature (578)..(578): n is a, c, g, or t
  misc_feature (607)..(607): n is a, c, g, or t
  misc_feature (677)..(677): n is a, c, g, or t
  misc_feature (692)..(692): n is a, c, g, or t
  misc_feature (701)..(701): n is a, c, g, or t
  misc_feature (711)..(711): n is a, c, g, or t
  misc_feature (716)..(716): n is a, c, g, or t
  misc_feature (718)..(718): n is a, c, g, or t
  misc_feature (721)..(721): n is a, c, g, or t
  misc_feature (731)..(731): n is a, c, g, or t
  misc_feature (739)..(739): n is a, c, g, or t
  misc_feature (748)..(748): n is a, c, g, or t
  misc_feature (754)..(754): n is a, c, g, or t
  misc_feature (758)..(758): n is a, c, g, or t
  misc_feature (760)..(760): n is a, c, g, or t
  misc_feature (766)..(766): n is a, c, g, or t
  misc_feature (781)..(781): n is a, c, g, or t
  misc_feature (797)..(797): n is a, c, g, or t
  misc_feature (815)..(815): n is a, c, g, or t
  misc_feature (827)..(827): n is a, c, g, or t
  misc_feature (830)..(830): n is a, c, g, or t
  misc_feature (832)..(833): n is a, c, g, or t
  misc_feature (836)..(836): n is a, c, g, or t
  misc_feature (845)..(845): n is a, c, g, or t
  misc_feature (847)..(847): n is a, c, g, or t
gacaactttgcaataatacactcaaccacaaatcggtcagggaggacaatcttaaggtggtcaagctccttggcaatacattgtatttcatgagcttgctctacaatatagcgattatcagccatcttgtaatcatgaaagctctccatgacatataggtcactgccagtatccgatgcaccatacttagtagtaagtgcatcccacaattccttcacgtttgtgtattgcatatttgcatcaatcagacgatcaacaaggacgctaagaatttctcacgtaaaggtagtattgacatcctcatactttttctcctcttcaggagtcaacgccctcaggtttacttttactaacatggaacacattcatagcagtaagccagagagtggccttgacttgccacctcttgaagcgcataccagagaatttttctggcttcagcgcatcggcaaaaccagccatacttaaaccaggaaattgtctaccataaggtttcggattgtngagaaattagacatttttcagattacattccaaatntatataatgaccaaccattaaattaaactactaagttngtccctaacaggctgtttacaaggctaanaagcgtaccaagaatgcatctataccgatagataaccggaggttgagaccttttaaatgatgcgtctgantaaactactattganatggtgctncaaggggganaacgntnggngcatggcatngccacgtngacacaggnccgacnaaanancggganagtccggtgaggacnttcagaaaccttttanccttttacgggttaactntagggggggtanggnanncanccagtgttntnct

SEQ ID NO: 18560 - DNA, 1794 bp, Zea mays
cttttctttgaggtgaaaagcgaccggcaacaatctctatcttttctgacaaccagctgcccccacccacaggcacaacacacacacagcattatcaaatcccagatgcctccttgcaaaaaaaaaaaaaaaaaaaaaaaaaagcagcatgtgtctgcattgcatctatctcttgtctaccaccaatagctagcattagcagatccatgaccaccaccagcatgtgtctgcattggccatcgcacacctcgtctctcttctcctcgtcctgacttcccatggcctaccatcccctctcctccacatataaaaccctctcactcactccatcccatcgtctcatgcgttgtggcctctagagcggtagatacagccaccccccctgaagcagaaggtctttctctctctgtacatacattcttacccactgttcaactggtgtctgtgtcgcaaccgagcccatcagcatagacaagatcagggccatgaacaagtacagcaagggcaggaggaggcagccgcagcttcttcctactctctcactctacttctacctggccgtcgccacctttgtcctctgcctgttgctcactagccctgcctggttccccgggctgtgctcggccctcgcctcctccttcctcaccaccctccctggcttgttcacggccttcctgctcagccccaggtgcctcttcgtcgtcggcaacctcatcatcgccttcctcgtcggggagtctaggctggcaccaaggaggagggacgacgacgcccagccttccttggtgaacgagatacacgaggagcatgtgaagaacaacgcggcggtggctgaccacagctccttcgttggagcagttgttgggaaggaggtgcaggtgcaggtgcaggtgaaagaagaggaggagcaggaggaggaggaggaggaaggaaacgaggaggagctgcacacgagagtggaggacttcattgcgagggtcaagaggcaaaggaagctggagctcaagagcttcttcgatgttgatcgatgatgactatgatatgtttggcaggtgcaaaattacagtaaggttgcgggcgccctaaaaaggatctgtaatggtttgtgctgctagctatccttttgattaattctgtcacttgtagttgtagtaggttaaaatgtcgaaggtaaaacgataaggagacgaacccattccactgtaggatcggatttgcagtgtaactgaggtagagtcatggcaagtaaggaaaaggagaggaggcaatggatgtgtgtgatctctgaaaaagggtaagaaaaaagtgtgtttctaaaaaaaaaaaaaaaaaatgctcagttggcatgaaaccatgttgatgatgatgatagcacttgtgtactggggaacaaagagatcctgtaccctcaacctgatgctacaaagttgtcgggataataatagtgaggactgaggaacgatcactagttatatactcaaatgatacagcaacttattcatcactgatacttgattcagcaaccccaagagagattataaaaattaaatcctgaaatcagtgcaagaaaaaaaaaccaaaaaaaagcccaggcaaaacaaactatatataaattgagaaaaaaaatctcatgccactgcagttttgagttttgtccagtaccttatttggcatcttaattccttttatcccacttagatgtaatttcttcattaaactctcaaattgatcataggtcctcactaccggaatccgagcctttgccgagtgccagcggcttttgccgagtgcttt

SEQ ID NO: 18561 - DNA, 3077 bp, Zea mays
gtaccgggcccccccctcgtggtttttttttttttttttttttttgcaacagaaaatctgctttattttatcacaacgttctttatttattgttcatattggcgaactcgttttgcagaatttgccacttgggaatcgaaattcgacaggcatactactccactatagctgccgtcggtcggctagctacgaaatgtagcctctgctcttgagggcctccacagcgtccctgatgatcttctccagagggctgaagtgcagccccaacgcgacgagcttcttggacccctcctcggctccctgtcgcaccagcccaggctgggtatccttggggaacttgggcaccttgtactcagggtacagctcggcgaccttggccgcgaagtcgctccagtgggagatggactgggcgcagatgtgcctcccggacgctgccgggctctcgaacaccaggatatgcgccatggcggcgtcgtgcacatgcaccgcccccatccagatgtccctgtactcctccgtgcaaccttgtagcaggcgtaggagcacgatcatgctgcagttgatggtgggcggaatcattgggcccatggcagtcaccgggttgacgacaaccacgtctaccccgttctcctccgcaaacctccacgccgccttctctgccagcgtcttggaaacagggtaccagacctcgttcttcttgcagtagtcgacgtcggcccagcaccgctcgtcgcggggctcgccggcgggccacgccgggctgggtatgatggccgagctggacgaggtgaccaccacccgccgcacggtgcgggcctccttggcggcgcgcaggacgttgagcgtgccctccaccgccggcaccaccatctgcccctgcgggtcgctcacggggtagacggtgcagggggtggcgaggtggaacacgcccgagcagccccgcgcggcggccatgagcgcggcgccgtcgaggaagtcgcccgggaagactcgcagccggccctcgccggcgccggcgcccagggcgaccaggtgctccgtctccgccttgtcatctgcgccgcgcacacaaaccgtacagtagccggccagtagtaggtcgggccggtgcagtgtagagtctagtgctagtctgcttattgattatgttactgaccggggttgaggacgctggcgtggacgttgtagccgcggtcgaggaggaggccgacgagggtcgatccgatgaagccgctggcgccggtgaccagcaccgtctccctcttgccctccacgctcgccatcgcccggccgcagtgtccttcctctctgagagctgaggtgaggagagtgagatctcggcccctgaggtcgcgcacgcgcggtgtgtgtggctatcttgagctgcagcagcatctgccctctaaggataaaactgggaaaaaaagatatgaactagtttagaaactccattttctcaaggaaaaatgaactaatttaactttagaaaatgtaaatcatttgagaaaatgaagttcttaaactaggcctaaaactatatgtgacggtggcaaaacatgggcgctgacgctggtggttggtggtccccgaatcaatcacagccacaacttatctgatatctgtgtttaaagtagcgtctcgtgtctttagtgtaaataaaggatttggggatattatgtacaaccctatatatttaattcggaccatttgaggattctctacagattaattggaaaaaaacaaaaaaaattatggtttttatcaagagtctgtctctttgtacatattacatcttaattgtatctatgatccaaacttctaaagacctaaagttatatcatgaagtcttttagttgtctcttatacttcaaaatctaatagattatatatgccccaaatgatataatataaactgttattttttattggtatgtgtctatagaaatatatacaccatggaggatagcgttgcatatgatcaaaaggcttccaaatgggtgtctcttcgcataatgcgattcataaggcaatctcatcctcatctcctatttcaaaattcaaggtgaaggggtggaagattgtctcttcgcagttagaaccacatagtacacagtgtaacttactagcagcattcagaaagcctttcctcttaagcaaattcttcgatgacgattgacgaggcgaccgctatccagttgcgaaatttgaaccttttcgaatcatcaaggtattcaggttccatagttgcaactccttataggagatatctaagtttcgacctcactttccagaattacaaattgtcaattattaaggttcatgaaagacatctttgttactagttacaactacaaatcatataatcaaaaggttcatgaaaggcattatagcaccctcacggctagctacgaaatgtaccctttggtcttgaggctctccacggcatccctgatgatcttctccagagggctgaactgcagccctagctcgacgagcttcttcgacgccactcccgcctccgctcttaccagcccaggctgggtgtccttggggaacctgccacggagcaacaccacaagcctcaggcatgcacaccgtacccggagatcattgcaaaaccaacagagaggaggcaagcattcccagagattgctgtctagttcactgtacaccaaatttcatacagttttcattgaggggagaagctagaaaggttttggatggtggttttctcacttgggcactttgttgttggggtagagctcggcgagtttggccgcgaagtcactcaggtgactgatggactcggcgcagatgtgcctcccggaagctgatgggttctcgaacaccaggagatgggccaaggcgacgtcttccacgtggactacccccatccagatatccttgtactcctctgtgcagcctgcatgtggtggatggccaaaattacagcatgtcaaatttcatatttggatgtactttcggtgttctagaaagcttttaccttgaaggaggcgtagaaggacggacatgctagaattgatggtcggtgggattatctggcccaggacagacat

SEQ ID NO: 18562 - DNA, 6096 bp, Zea mays
cctgcagcacatgagcacataaatgggcatggtccattggtccgaggtacccatcacgtacggctgcgacggcggaggtatcagctttcttttaaggcatccactttcgcggtgctcggtaatgggaggagcaccaggttctgcctctggacaggagacgctgccaccgtaccagggctgttgggacatccaagacttagcaccgacgacactctactactctagtatggtgatggtctgcggacggagcgtactactctacgggttcagcatatataaggctctccactcgacatcgcaccccatcgatccccggttgcaagcgcatctggagtccgagtaattaactagcgccactacggatcaagatttctctctggatagcaagcagtgcggcaaaggcactggacgatatagagaagaggctgagattcgttttcccgatcttaatacaaagctgtgcataaaccttttatttgcatatttcgagaaaaaaaacttggcactctacatgtaaaaggagaataattttacccggtgccggcgaagaacgccaacggaatcatcatctgccacccgttaattgacatgctggatattaagtaaaacgaaaacattgttactgagtagattataactggagccgggcgctcgtattattaattctatgattctatcgtgtattatttgcagttgtgaagtgaaaccatgcatagaaaggaaggataggaaaaaaaaaaacttaccatatggacagagcgtcgacggcaatggctgcatcttttaggtttcccgtcaacaagacgaggatccggtagtaccagttctccaagctgcagacatatgtgcatgcatgaataaacatgtgcaattaccatcccacgacctccaccacctgctagctagtcaaaacacgtcgtcgttcgcatgcagcctgagcctgcatggtcgcatcgtatgtatagtggcagtgcaacgtgcaaaggcgcaaacgtacgtgcgtaccatagcatgacaccggacgcggaggatagcttgacgaactcccacatgccggcgaaggcctcgagcgagaagccgtgccaggtgtcggggcagccgccgcatgcgacgtaggcgaagagcatggcgccggtggcccaccatgagaagttgagcgtgagggcgatgcccgcgaggccgaagcggagcctggagacgaggagccagcttgcgaggaggtggacgcagaagcgcggctgcggcggcggcggcgttggcggagttcctcatctggcactgcaggaagcgctgcagcgggaagaggaaggcgaaggagaagtgcagcgggatgaaccacacgcacaccttccccgccatcgccgccagctccggcggctgccccgtcagcagcagcacgtcctccgcgaagaagtacatgggcagcagcagcaccgcgcacatgaacagcacgatccacgaccgctgcatgtacacgcccatcatgtggaacttcttcgcgccgaacgcctgcccgcacagcgtctccagcgcgctcgccatgcccagctgacatgccagatgcagagtgtagtattaattaattaattaattacccggccatggaataataatcatgattacacacgacggtactgtatgtattactatatatcactactgtgtccacaggtccatgaatgatgcagcggatacatcccagacaattgaagatgagatgtgtgtaaattaaattaaaggggacaagctaagattgtgtaatcggaattcatccggacgtgacagcaacaagtgtcacatatacgagcacggcggccctgagcatgagatgccaaggcgtggagagcgaggattcgatggaagaagaaccaatcactttcgtagcgctctgatacgttctctacgtcgtcgaccattgatggggttggatgcagacgggcttggtggcttccatcagcatcgtagtttgggaccgaggccaatctacaccacacaaatcaactttctcttgcgcattgccatacaagtaggggcatactgtttcagttgctgctgtagagtctgcatggaacttgtgccgtggggtccttgtccggcgaacggcaacttccctcactggtaccaaactaccaatccaagctagtcactcacacctcgcatgacacgactttttctagaagagtaggactgtactccctccgtccttaggccatttcaattttttgtgatagtcaaaatatatcaacaagtccaatcaagtttatataataaaataatagtaatttatgatattaaatgaattttattagattctttactgattatttttcatggtatatttatttgacattataaattttttaaattctctcttaaattctggttaaaaccgagatactttaactctcttaaaaagttagaataatctatatcgtaacttaaaatataggaagtagaattttgtagtaatattttttaacatggcaacattcctgtcctagtgaggtgacagtgacgagtaacgacaaatgaaattattgccatgattgacctctcgcggggcccggacttgtccggctcgtcaagttttggcctggcgggtggcggcggatgggaccgacaaactactgacgcggatccggaagaggaggctggaggcgcaaggacggcagctgtttgccactcgagtactcaatccccacagttgtactccctccgtctcaggatataaggcgtaaccactttttattcttgtcccacaatataaggcgtgctctctctatgcatacgcatatcgatgcagtggtatagagacaattaaatgcatttcttggtctttgaaccagaggtggttacgccttatatactgggacggagggagtactgttgtagcactgctcctccagtacggctggtagtaggatggcaacccacgtcgggttttagctcttcatccttagttcctgggcgaattttttttcctacgtggatcctcacaaaagtttgtagaagacatttttttttcacattctcattttcagcagagataaatcttcatcggagatcccgatcccgggttaaattttaattagaacgtacttcatatgttattaatataaaacattaatacttatacatattatatgatgtaagaaattattatgtgtatatcaaaataaacatatttatacatttatacaggaggatctaaagttagatttaaagtctagccatattagagcttcagagctcaaaagtaagtgaaattgctctaaagtttttagagctgagggaacggtcttttatagtttggaacagagaggtgggtacatctgcatcaacaaaaaaaagggcactctattcgtttaccgaaaatgacaatgtatttgcgatgcgaatagttttgagacagacgtctgaacctagaattgccctggatttaacgcaactggtttttggaaccgtgtattttaaagtttcagccgttcgatcggtcttcttgacagctagctgacctttggacccccgctcgagaaaatcagaggaaagagccaatttcggtggtgcgcggctgtctgtctggacgcgaaacgaaaggagtaccgcccctactatatcttatcgacccaaaccgccaaacagatgtccggaccaaggctccaaggagcacaggcacagcacagatggggctcgaccacgcttggcgttaccttcgtggcttcgcatctggaaatatctcctgcagggcatttgctgaggcgctgctagctgagttgccatggaaaacgaaagcgcggtagtcacttcttttcgttttagttgtcgctggatagtgcaaaattgaactatccagtgacaactaaaaaacaacgaagagagtattgttttgggcttttgggggtgagttggcatgcatgtattgtcgtcggtttcgtcttatggatggacgtccccttttaaattactggtacttggtagcatcatgtggatgggattgagacaagatgtagctagctagctgacagtactacacaatactacacacgcgtacattaggtcacgtgtacgtggtacagcctagctcagctctggaaatagctagcaggcggcgggacgcattatcacgccttcacgcgcgactcacgagccaaatctaacggagctggctttctcgatcaatcggtcggccggagcgatcgagagagcttgggggacgggcaaacgagagggagggagcctgcgtatagcgatagcgtacgtaccatgaggccgaagttgaagccgacgacgacggtgttggcgatggagatggcggcgagctcgaggtcgccgagggggccggcgaaggcctgcgtgatgacgttcatgctgtaggtcacgacgcggctgaaaatggccggcgccacgatgtcccacagcttcctcgactcctcccacacccgcgccgcgagctgctgctgctgcttcttgccgccctcgccgccgccgccgccgtcagcgtccagcagcgccacccggcacgcgtcctcgtccgctcgctccatcgtcgtgtgcgtcttggttgctctcggtttcccctcgatctccctctctctctctccaaatcctcgtgccgttttcgcggagggaagggggaggaggaggagtcctgtctggctttctctcccgtatacaaaagccagcgaggacgccttttaataggcagatgcaagctaaggcgttcggagtagcgtggctgggttggcgagtcccaggcagcagccgcagctagcgtcatcgacgacggaagggcgacgggaacacatacgttgcgtttcgatcggcacgtgtttgttggtggcgatcgagagttgctcgcgttcgttgccgcgggggacgacagatcgatgagccgagcgccggcccgaccaccatgcatgccgcgcccgatgcatcaaggttccagcagccgcatgttccacgagacgacctcgcctttaatttgcagaaggcgactcagcgaaaggtcgtagccccatcatgatcgttcggcataggacggacttgggttcaccgacacccacgtcaactgaaaccttttaggcccagtttaagttgagaagaataccacatcagtatgatatattgtagggtcggagtcgttacaagttaagctctagtttcaggggttatgttgtgcaatctctagttgtctcttgtattttgaaaccgaatacatgcccttaaactatatatgatcacatatgtatacaggaaagggacacgaggttacaacaaactctatccatatactatagtaccctgctaatcaggtctcagacgtaaccgaactctttagtatgtgtattttttagttttgacgcaagctctaattgtgggatgcggcgtgcgcgcgtgcacacctgcgagctttgcggtacggcagcacagcaataatggcctgtcctcctcctcctgctgaataatataaaactcgcccacggcctttcgccaatcgccatgtgcaggtcgcagcaaatgcaaaggcacccttgcagctgcatgctccatcgatgcgcgcgcgccgcagcctggaaaagcgattcggttccggcacacactcagatgtctgtaaaggccggagtatgtaaacgcttatctcctctcgagatttcgagtactaagactatctccagcgacgttctttatattcatattctatattcgttatttatagtcttctctaaaagatttttttaaaggaaggggcaaaaggcttgctgctccgtctatattagatgaggaagaaaaacaaagactcgaagaaccaaagtgaagaagaaaaaggaacaacaagagaacaagaaagaaatcaaaaaaaaaggggaaaaaacagggtaaaacaaaaacaaaaaaagccactaggaatactcctaacaagacctcagctactagcaatgcccaagatagccatagtaacttggtctacacccctatgctgtccttgaaagattctgaaatttctttctagccatagattccaccagaattgaattagcaggccgtcgaagtcccttcttatctgtctgctgcaaagactacgcagatctgtccacc

SEQ ID NO: 18563 - DNA, 1303 bp, Zea mays
gcaacagaaaatctgctttattttatcacaacgttctttatttattgttcatattggcgaactcgttttgcagaatttgccacttgggaatcgaaattcgacaggcatactactccactatagctgccgtcggtcggctagctacgaaatgtagcctctgctcttgagggcctccacagcgtccctgatgatcttctccagagggctgaagtgcagccccaacgcgacgagcttcttggacccctcctcggctccctgtcgcaccagcccaggctgggtatccttggggaacttgggcaccttgtactcagggtacagctcggcgaccttggccgcgaagtcgctccagtgggagatggactgggcgcagatgtgcctcccggacgccgccgggctctcgaacaccaggatatgcgccatggcggcgtcgtgcacatgcaccgcccccatccagatgtccctgtactcctccgtgcaaccttgtagcaggcgtaggagcacggtcatgctgcagttgatggtgggcggaatcatggggcccatggcagtcaccgggttgacgacaaccacgtctaccccgttctcctccgcaaacctccaagccgccttctctgccagcgtcttggaaacagggtaccagacctcgttcttcttgcagtagtcgacgtcggcccagcaccgctcgtcgcggggctcgccggcgggccacgcggggctgggtatgatggcggagctggacgaggtgaccaccacccgccgcacggtgcgggcctccttggcggcgcgcaggacgttgagcgtgccctccaccgccggcaccaccatctgcccctgcgggtcgctcacggggtagacggtgcagggggtggcgaggtggaacacgcccgagcagccccgcgcggcggccatgagcgcggcgccgtcgaggaggtcgcccgggaagacgcgcagccggccttcgccggcgccggcgcccagggcgaccaggtgctccgtctccgccttgtcatcggggttgaggacgctggcgtggacgttgtagccgcggtcgaggaggaggccgacgagggtcgatccgatgaagccgctggcgccggtgaccagcaccgtctccctcttgccctccacgctcgccatcgcccggccgcagtgtccttcctctctgagagctgaggtgaggagagtgagatctcgagctcttaagtgtgtcaatgtcactgtctgtgtgtcccccgcccgtagtggtatttcacttgcgcccggaggctcccacttatcctacacctctcaagtcatttccccg

SEQ ID NO: 18564 - DNA, 2021 bp, Zea mays
gagccaaaattaatatgacacaaacgagaatgccaaagaccccttttttttttttttttagcacaaatatggttcacagacttattattgaaatctaacaaagaaaagcggaacaagcctccgcaatcatagcctttaccaataaattgtccagacttggacacaactaatttattggactccaaaactaccttgaacccatctctacatagaagggttccgctaacgagattcttgtgtatagaagggacatgatgcacgttcttcagctgcacgatctttcccgaagtaaacttcagatccaccgtgccagtgccatgaacagaagcatgtgacccattccccattagcacggaagaatcccgggcgcccctttgtcttcctcattgctagcgaccactgtgttgacattgccctttttgccacggcgatccgctcgatcaggacaatccttggcaaaatgacccgcctcgccacatgcgaaacatgtcaattcagccttgttcttcttcttcttgaagttggtagttttgttgggcttgttagattttggctttcctttgcccttgttgtggttcttctgaaccatgttggcgctggagtggccctcgcctcctttagatcccgtgtccttagcccgagctttctcctcaacatccagagacgctatcagattttcaactgatatctcctgtctcttatgtttcagagctgtggcgaagttcctccctgtagaaggcaactttgcaataatgcacccggccacaaatcggtcaggaaggactatcttaaggtggtcgagctccttggctatacactgtatttcatgagcttgctctacaatagagcgattatcaaccatcttataatcatgaaagctctccatgatatacaggtcactgccagcatctgatgcaccatacttagtagtaagtgcatcccacaactgtttcccgtctgtgtaccggtgccggcgaagaacgccaacggaatcatcatctgccacccgttaattgacatgcatatggacagagcgtcgacggcaatggctgcatcttttaggtttcccgtcaacaagacgaggatccggtagtaccagttctccaagcatagcatgacaccggacgcggaggatagcttgacgaactcccacatgccggcgaaggcctcgagcgagaagccgtgccaggtgtcggggcagccgccgcatgcgacgtagccgaagagcatggcgccggtggcccaccaggagaagttgagcgtgagggcgatgcccgcgaggccgaagcggagcctggagacgaggagccagctggcgaggaggtggacgcagagcgcggctgcggcggcggcggcgttggcggagttcctcatctggcactgcaggaagcgctgcagcgggaagaggaaggcgaaggagaagtgcagcgggatgaaccacacgcacaccttccccgccatcgccgccagctccggcggctgccccgtcagcagcagcacgtcctccgcgaagaagtacatgggcagcagcagcaccgcgcacatgaacagcacgatccacgaccgctgcatgtacacgcccatcatgtggaacttcctcgcgccgaacgcctgcccgcacagcgtctccagcgcgctcgccatgcccagcatgaggccgaagttgaagccgacgacgacggtgttggcgatggagatggcggcgagctcgaggtcgccgaggtggccggcgaaggcctgcgtgatgacgttcatgctgtaggtgacgacgcggctgaagatggccggcgccacgatgtcccacagcttcctcgactcctcccacacccgcgccgcgagctgctgcgccccgcctgcccccccgcgccgccggccgcgtccagcagcgccacccggcacgcgtcctctcgctccatcgtcgtgtgcgtcttggttgctcggtttcccctcgatctccctctctctctctctccaaatgtttttagcttttagggggagggaagggggaggaggagtcctgt

SEQ ID NO: 18565 - DNA, 3635 bp, Zea mays
gtgtcacactgggatcataaggtgttggagaaggtttgcactcagagaagccaaatcgcttcaaaaccttttcaacatagtgagattgcgagagagtaatcccaccatctgccttaatcagcttgatgtttagaatcacatcagcttctcccagatctttcatatcaaaactctttgatagaaaggacttgacttcattgatcacatcaatgtttgtgccaaatatcaatatatcatcaacatataagcacaatataactcctttcgcccccaccacagcgataatatacacacctgtctgcctcattaatggcaaagcctgcagacgttagagtagtgtcaaacttctcatgccactgctttggtgcttgcttcagaccatacaaagatttcaataacttgcacaccttgctttcttgaccctttactacaaatccatcaggctgttccatatagatttcctcgtccagctctccattaagaaaagctgtctttacatccatctgatgaacaaggagaccatacgaggcagccaaagaaagtagtactcgaatagtggtcattctagcaacaggtgagtaagtatcaaagaagtcttctccttctttctgagtatagcctttagccacaagcctagccttgtacttttcaattgtaccatcaggcttgagcttctttttaaacacccacttacaacccacaggtttgcatccatagggtcgatcagtgacttcccacgtaccatttgaaagaatggagtccatctcattatgaactgcttctttccaatcatctgcatctggagatgcaaatgcttctgcaatggtagtaggagtatcgtccacaaggtacacaatgaaatcattaccaaaggatttttcaaccctttgtctcttgctccttttaggagcatcattgtcatcctcctctaggacaatttcatgtggctgttcaaaactctcaataggtgtactatgttcaggagttatctcagaagagtatctagaattgctatgaatgtctttcattggaaatatatgttcaaagaaagtagcatcacgtgattccataatagtatcaacatacacatcaggaacttcagatttaactactaaaaatctatatgctatgctacacgaagcatatccaagaaagacacaatccactgtccttggaccaagcttgcgctttttattaattggtacattgactttcgccatgcacccccaagtgcgcaagtatgaaagtgatggttttctcccaacccacttctcataaggggttttctcttctttgcccataggaattctattcagaacatgacatgaagtcaggactgcctccccccaccatgccttagataaaccacaagtgtctaacatggcattcaccaggtcagtcaacgtacggtttttcctttcagcaatcccgtttgactcgggtgaatagggaggagtcctctcatgaataatgccatgttctgcacagaaatcatcaaagactttgggaaagaactcgccaccacgatctgatctaagacgtttgatctttctctctagttggttttcaacctcagccttatagattttaaagtagtctaaagcctcatctttagtttttagcaagtatacatagcaaaatctagacgcatcatcaatcaatgtcatgaagtatctcttaccaccttttgtcaacacaccattcatctcacaaagatcagaatgtatgagttctagaggtgccaggtgtctctcctcagcagccttgtgaggctttcgaggttgcttcgactgcacacaactatggcacttagaacctttgactatggtgatattcggaattaaactcatggttgcaagccgagacatagagccaaaattaatatgacacaaacgagaatgccaaatactcgcaagatcatcaacattagcgcaaatatggttcacagacttattattgaaatctaacagagaaaagcggaacaagcctccgcaatcatagcctttaccaataaattgtccagacttagacacaactaatttattggactccaaaactaccttgaacccatctctacatagaagggttccgctaacgagattcttgtgtatagaagggacatgatgcacgttcttcagctgcacgatctttcccgaagtaaacttcagatccaccgtgccagtgccatgaacagaagcatgtgacccattccccattagcacggaagaatcccgggcgccctgataagaagagaacaagttaatgtcagaacacacatgaacattagcaccagtatcaagccaccaactaggtgattgaaatactgagaagatgaaaggtaaattaccataccctttgtcttcctcattgctagcgatcactgtgttgacattgccctttttgccacggcgatccgctcgatcaggacaatccttggcaaaatgacccgcctcgccacatgcgaaacatgtcaattcagccttgttcttcttcttcttgaagttggtagttttgttgggcttgttagattttggctttcctttgcccttgttgtggttcttctgaaccatgttggcgctggagtggccctcgcctcctttagatcccgtgtccttagcccgagctttctcctcaacatccagagacgctatcagattttcaactgatatctcctgtctcttatgtttcagagctgtggcgaagttcctccatgtagaaggcaactttgcaataatgcacccagccacaaatcggtcaggaaggactatcttaaggtggtcgagctccttggctatacactgtatttcatgagcttgctctacaatagagcgattatcaaccatcttataatcatgaaagctctccatgatatacaggtcactgccagcatctgatgcaccatacttagtagtaagtgcatcccacaactctttcccgtctgtgtactgcatattcgcatcaaccagacggtcaacaagggcgctaagaacggctcccgtgaacatagtattggcatggtcgtactctttctcctgttcaggagtcagtggaccctcaggtctgcctttactaacatggaagacattcatagcagtaagccagagcgtggccttgacttgccatctcttaaagtgcataccattaaacttttctggcttcagcgcgtcggcaaaagcagccatagaaaaactaggaaattgtctacaataaggtttttggattgttgagtaattagacaatttccagattaaactccgaatacaaatcatgaccaaatcagaagaactgaaataaaaagtcaaatcagatgatgcgtactgattagacatactgatagatggcgtaggccggaatcagtagggtcggtgatgtcgaagcagcggggttgatgatcagcggaatcagcgagcagtcgcgtgaggatgcttcccaaaaaccttattcgccctctcacggtgcaggatctcgaagggcgaagggttccgaagacctgctctcccgatcgcagatgcacgtcggcggtcgagatgaagggaactgaaggcgactcagttgtgaagagaggcgaaagcgaaaactgggatgatttggatgatggctgccagacgccttttataggaccgagtccgcgacca

SEQ ID NO: 18566 - DNA, 950 bp, Zea mays
  misc_feature (17)..(17): n is a, c, g, or t
  misc_feature (26)..(26): n is a, c, g, or t
  misc_feature (155)..(155): n is a, c, g, or t
gttggggtagagctcgncgagtttgnccgcgaagtcactcaggtgactgatggactcggcgcagatgtgcctcccggaagctgatgggttctcgaacagcaggagatgggccaaggcgacgtcttccacgtggactacccccatcccagatatcncttgtactcctctgtgcagccttgaaggaggcgtagaaggacggacatgctagaattgatggtcggtgggattatttggcccaggacagacattggattaaccacaaccacgtccagcccgttctcctctgcaaacctccacgctgccttctctgccagcgtcttggaaacagggtaccaaaccccgttcttcttgcagtagtcgatgtcagtccagcagcgctcgtcgcggagctcgccggcgggccacccggggctgggcatgatggccgagctggacgaggtgaccaccacccgccgcacgctaccggcctccttggcggcgcgcagcacgttcagcgtcccttccactgccggcactatcagttgcttctgggggtcgctgacggggtcgacggtgcagggcgacgcgaggtggaagacgcccgagcagccccgcgcggcgtcggtcagcgcggcgccgtcaaggaggtcgccacggaagatgcggaggcggccctcgccagcgccagcgccagcggccatggcgagcaggtgctccgtctccgccccgtcatcggggttgaggacgccggcgtggacgttgtagccgcggccgaggaggaggcggacgagggtcgagccgatgaagccgctggcgccggtgaccagcaccgtctcccccgccatgctgactagctgagccggccgggtgcgggtctcgggagtcactccgagtgtgctgcgactgtcccggcggcttcctgacagcccgattttatgtgtgtgtcccggccggcctcgaggtacccaatg

SEQ ID NO: 18567 - DNA, 1822 bp, Zea mays
agcacagcggcacagcgcagacgcggcggcggcccaatccggagggcgcgaccgttcgcacgagaccattacctagaacatcctaatcggttcgttggcctcctcctcctgttcctcttcttggcgcggcaagaggaggaatagcaggagaggggcgccccgatccatagggcaacgaccaacggcacgccgccgccgccgctgccacgacaagatggcgcggttcatccttagcctgatggagctcggggtcagcgccaccgtgcacatgctcttcggcctctacgtcttcagcacggccgtcgccgcagacatctcgcaggcggccgcggcgtcggggtgtctcctactgcgccggccaccccccgcggcggcgggctcgaccgggggagcgctcgtcgacgtcgccgcggcgggtgagagcgacgagctcaggggcgccgcgcccgtcatcctcgatgcatcgccgccgcccatcgtcctcgtccacggcatcttcggcttcggcaaagggaggctcggtggcctctcctacttcgccggcgccgagaagaaggacgaccgcgtgctcgtgccggatttggggtcgctcaccagcatccatgacagggcgcgtgagctcttctactacctcaagggtgggcaggtggactacggcgaggagcacagcaaggcttgcggccacaacaggtttggaagaatatatcacacagggcactatcctgtgtgggacgagcacaacccagtgcattttgtggggcactctgctggcgcgcaggttgtgagggtgctgcatcagatgcttgccgacaaggctttccctggtcatgatacttctgaagattgggttgtaagcctgacttccttgtcgggtgcacttaatggaaccacaagaacttactacgatggcatgctggtcgtagatggtaggtccatgaaatctatctgtcttcttcagctctgccggctcggagttattgtctacgattggctagacattccttggctgaagaattactacaattttggttttgaccactatgagatgtcgtggaggaaagtaggcttttcaggtctaattaatctactgctggggcacacgggcccatttgccagcggggattggattctacctgacctcacaatccaaggatccatgaaactaaactctacacttaggacctttcccaatacattctacttcagctatgctacaaagaaaacaagaaaaatatttggaattacagttccttcaagtgttcttggagtgcaccccattctctttctgagagtcctccagatgtgtatgtggcggcaccctcaaaatgcacctctgccttacaaaggatacagggatgaagattgggaagacaacgatggggctttgaacacaatctctatgacacacccccgcattcccatcgagcatccacaccattttgtagtcgatgattctgactgccatcctttgcaacctgggatatggtattacaagattattgaagctgaccacattctattcattgtgaaccgggaaagagctggagtgcagtttgatttgctgtacgatggcatttttcagcgctgcaggaaacatgcctttaggaagagcccacctactgtaccaaacgaaacgagccgatagcaaaactaagctgaagtatgtgtaggtagtacataggaagaaacaaggtgccacgacattttcattaactgtaaattacattgttgattgaacggcaataacatatttgcttctccaattttcggaaaaaaaaggccgcccgctcgcggcgagcggctgctcgcgatctagaactag

SEQ ID NO: 18568 - DNA, 1513 bp, Zea mays
  misc_feature (12)..(12): n is a, c, g, or t
gtatatttgtangatcctttaaaatttataagagaactgtcgcacacgtctacacgtgtttgtacgacgtatgcgagcgttttgtggaaaaaaaacaaatttgttggacatcaaccaatctctgatttgaaaagtttttttttttttttgattggaaaagatgaaaatatatagatctcttttgggttcattcatctcgcacgacggagatgatacgagtagatgacaccgaaaaaacaggtccacatacaggtagagagattttgcaacagaagaaacacgcggagaccgacacaacccagccaggcacgacgacgccagaatcacgccccctgcatcatcatgcgcgagaagtcgtggaagcagacgaagccgtcgccatcgccgtcgacgcggccgatcatgcggcggcagtcctcgacggagcaggcggcgtcgccgagcgcggcgagcacggcgcggagctcctccgcggagatcctgccgtcgccgtccgcgtcgaacaccgcgaacgcgtcgcggagctcggcctcgtcctccgcctccgcggacgcggcctgctcgggcgcgagcccggcggcctccgcctcggccagcaccgcggccagctcgtcctcgctgcggaccacccggcgcagcgccacctccaggtcctcccgcgtcacggcggcggctactaccgccggaggcttcgggttgggggcggacggctgggattggaggacggtgcgtggcgtcgtcgtgacggctgacggcgatgcgcactcgtcggacgaggacgacgacgcggtggagacgaaggaagaggagccgccggtctttgaccccttcctcttcttgccggaggaggaggaagacgagccgaagaaaggcatgctcagcttcatggcgtatgtaccttgcagtgcagtgcaggcgagcgattcgaggatcgatggactggtgaccgaggttgggagggaaggagaggaagatgaggggtcgggccgggaagacgaggctcggagttatagaggggtggcgaggggtaggggagggagcttccgcgaagcttcgttctttcgcgccccggccggcgcgggaaactaacgaccggggcggggcctacctgcagactggcctcaccgaaaacccaccccgacccagacaagcgatgcgattctctcgctcgtctccgtctccaaggctcccaccctcaattcttcctcctcttcgtcagtccgtcgtcgtcttctgcatggtgccaacgacggcgatcctttacataccactgcatcatgcagcaccgccgctcctgctaacgcttgggcgtgcattcagtctcgagcctgttcgggagcaaagctttttaataccgtaattttacaatactatatattatttgaatggtaaagcacaactaaaatatttcgataccacagttttgcaataccaaagtttcgcacgcatgacaagggaaaactttggtctagatcaaagttcttaatattatggttttactaaattttaaaca

SEQ ID NO: 18569 - DNA, 2096 bp, Zea mays
aaaacgcgaaattccagcaccattgtaagagatggctgagctgaactgaatctgcgacggcgcctctgcactttcatctgattccggcgaattaggagacagacacagacgcgttgttttctgtagtcgagccggtttccccacgttgacaagtggtcgcgtcagatccgatcaggacgtcgccatggccgccaaccaggaggagcaggagcagcgccgccgccttatcgccgccgcgacccgcttccctctcccaagcggctgcaggttctcctatggcacggcgggcttccgcgccgacggcgccaccatgggcctgccgtttgccgcgccggcatcctcgccgcgctccgctccgtcaagcttgcaggcgccgccgtcgggatcgtcatcaccgcctcccacaaccccgtcggcgacaacggcgtcaagatcgccgaccccgacggcggcatgatggcccagcactgggagcccttcgccgacgcgctcgccaacgcccccgaccctgacgccctcctccagatggtgcttcagtttgccaaggacgagggcattccattgggaggggaagacacagcgcaagtgctgcttggcagagataccagacctacaggagcttacctcctcgacgctgcactgcagggaataaatgctatagttggcgcacgcgcagtcgatatgggaattttgaccacccctcaactgcattggatggtccggagcaaaaacaaaggtgtcatggcttccgagtcagattattttaggcagcttattggatcgttcaggcgtatgttggaattagtgccaaaaggtaaaggtggggatgaggttgccaagaaacttattgtcgatggagcaaatggcattggtggggtgaagctcgaacaaataaaggtggagctttcaggcatagatattagtgtgaggaattcgggcaaggaaggagaagggatactaaatcacatgtgtggcgcagactttgttcaaaaggagcgagttactccacatggatttaaccctgaagatgttggtgtcaggtgtgcaagtttggatggtgatgctgatcgactcgtctacttccggttgtcatcagctagtgacaatagggttgatcttgttgatggagataagatactatctctgtttgccctatttatcagagagcagctagatatcgttaataacaatggtggccaagcaaacaagtcattgtctgcaaggcttggaatagttcagacagcttatgcaaatggagcgtcgacgctgtttctgaagagccttggcctcgaagtggtattcactcctacaggagtgaaatatctgcacaaaagggccttggagtatgacattggtatatactttgaggcaaatgggcatgggactgtggtattctcagaggatttcatctctcaactagagtcattaagcaatgagctctcctctcaagctgacattggttcagcacagtaccacgctgtaatgagattgttggcagcgagtcagctgatcaatcaggcagtaggtgatgctctgagtggtttgcttttagtagaggctattttacagtttaagggatggtcatttcaggattggtgtggactatatagtgatttgcccagtagacaactgaaagtgaaagttaaagatcgaagtgtgattgtcacaacagatgcagagacaaaagttagccaaccttctagtttgcaagaattgatagataaggagaccgccaactacacccacgggcgatgctttgtgcgtccgtccggtacagaagatgtggtacgggtgtacgcagaggcatctacgcaggtagaagctgacggtctcgcaaaatccgtggcacaccatgtggaacgcctccttggataacaatttgcagccttgtttgcgactcttgagtagactacatcctctaatttcatttctcttacattttgacctgtaacttatacaaaacgtgagtccaattttttgaattttgtgattgatatgcgctgaacagagatcttgtatcgagacatgatacaagatatttgaacgggtgtaaatcattccgtcgcaatactcattcttcttgattggttgccctc

SEQ ID NO: 18570 - DNA, 2951 bp, Zea mays
ctcacgcgtccggtgggacagccacaacagattcgaggccggccgggtttctttctcgctcctatcatttcgttccgttcctgatacaggcgagcagggacgactgcaggcctccccctctttctcggcttccactcacccgccaccactggaccacccccaacggcgagggagtgagagagatcggcagcagctcgggggcctggcagggcagctgcattgcgctgcggcgggcggcggccatggccgattcgtacggcgacggcaagggcccatcactcaagagccagagccagaaccagcagccgcgccctggcccccgcctcaagcccgccatcgagatggaggatctcatcaacctcctccacggatccgatccagtccgggtcgagctcacccgcctcgagaacgaactgcagttcaaggagaaggagctgggcgatgcgcaggcggagatcaaggctcttcgcttgtcggaccgcgcgcgcgagaaggccgtacaggatcttaccgaagaattggcaaaggtggatgggaagctgaagctcacagagtctctccttgaaagcaaaaaccttgaagcaaagaaaatcaacgacgaaaaaaaagcagcgcttgccgcacagtttgcagctgaggcaacactacgaagggttcatgcggcacagaaggatgatgacatgcctcctattgaggccatccttgcaccactggaagctgagctgaaactggcccgtcaagagattgcaaaattacaagatgacaacagggcattggatcgtcttacaaagtctaaggaagcagctctgcttgaagcggaaaggacggttcagatggcactggcaaaagcttccttggtggatgatctgcaaaacaaaaaccaagagttgatgaaacagattgagatatgccaggaagagaacaaaatcttggatagaatgcaccgccagaaagttgctgaggttgaaaagctcacgcagactgtcagagagctagaagaatctgttcttgctggtggtgcagccgcaaatgctgtcagagactaccagcggaaagttcaggagatgaatgaggaaatgaaaactcttgatcgtgagctagctcgtgcaaaggtttcagcaaatagggttgcagtagtggtggcaaatgagtggaaagatggcgatgataaagtaatgcctgttaaacgatggctcgaggagcgaaggattctgcaaggagaaatgcagcaactccgggacaaacttgctattgcagaaagggctgcaagatcagaagctcaactgaaagagaagttccagctacgacttaaggtactcgaggaaggattgagaatgtctacatcgagaaccaatgtcagtggcacacgccgccagtctattggtggtgctgatggtttgtctaaggccaacggcttcctgtcaaaacgcccatcattccagatgagatcaccagtgtctaccacaacgactctagtgaaccatgcaaaaggagcgtccaagtcgtttgacggaggctgtagatcacttgaacgctataagggccatgtaaacgggaatggtatgaacgtatctaccgattccagtgaagataaagattcaaacaactcagatgagaagtgtaacgagtttgcatctgctgagtcggaggactcggtgtcaggtgttctatatgatatgttgcaaaaggaggtcatttctctaaggaaggcgtgccacgaaaaggatcagagcctgaaagacaaggacgacgcagttgagatgttggcaaagaaagtagatactttgacaaaagctatggagtcagatgccaagaaatcgaggcgcgagctagctgctatggagaaggagctggcagctgtgcgcttggagaaagagcaggataacagggcaagacgttttggtagttcaagcggttctgccagcagttcgcagctcccacctggcaggactttacctaggagcggctcggcgcgcaacatgtgaaggcatgtaggaattgaccgaatatggctttgatgatccttacttggattaggactggtgactgggaaggaacctctcattgtcctggagaagatggcatcagcggaagagcctcttctgcctacatctcgtggtcgcagggatgaactactttgtgtctaacatctccggctagtgttttcttttcttttgttttgacgacgtgtcattcggtggtgattgctgttgtttcttttcttttggcagtttgatgatctttgttggtgctgtataggtttggtgaggcgttgctcctttttcttctttggtttgtttgttcgacatatccgtcggtctggttgtttacgatgtaaaatgtacgcactgaagagttgcttatggtttgcctgatattcccccctgtttctgtcagtgttgggcaagttgatgataaccagcatgatgaatgactcagctggctgttgtaaccatgtgccgaatgatgaagaaaccgctttgcatatgtctgatgatcaccagatgaatggagttagggcaagttcgaccgctttgcatatgtctgatgatcaccagatgaatggagttagggccagtttggtgcggcggcgcgtctaagccgcggcggctgaatcggccgccatacctgcggcggcaaaactacggcgcgccgtggcggcttaggccacgcacccaacagccccttaaactgctgttacttttttttttgttttttttgtcagattataaagtgctggatttggcttggcaaggtgagaatgagagtaacctttactagcgctcgctgttgctgtgcgctgtgcagggcgcatctatccgcatctccgcccccccccacggtggcatcgcctcgcctcgcgtcggatcaatccatcccctcgccctcgccttcacgccctgcctacgcaccctgtccccaatccctccgtgcacccccacttcgctcgc

SEQ ID NO: 18571 - DNA, 916 bp, Zea mays
tgcagtagtacgtaaatgctaaaattggttggttttttggccgtaaataaaagtggaggacacacactgcacactaaaaataggaatgcggttgcgcaggaagcggccgaccgtcgacctgcgtgtgcttgtatatatcatccacggaccggccggatttgcttgtttccacgcacccacgcgcgtacttgtattctagcagcaaagcaaagaggatcggatcagaagaaaagaatagttaggtcccggtggtcgatcgaacgaagctgctgctgctaccggccggccgggcatgacgatgacacggacgatgtgcctaggcctgctgcttctactactggcggcggcgtcgacagcgacggcgcatttcacggtcggcgatgtggatgagtacgtgtccaagcgcacgcaggagtcccgccacaggaacaacggtggcgcgggcatcgatgacctcatctccagtgcggcgcgcttccacgccaacgtggatgcacgcgcctatggccgtcgatccgacctgcaggaggaggcaacagctaccgtaataaccaaagcggaagcacaagaggcttcagctgaaggtggcgattaacctacctaaccatattatttattcattcatatgcatgcatccttgttgctatgccagccattcttctatcttcttctattttaagcatccttgctggatttccctatatattaagcattcactatatgcatgcatgtgtaagcaatcgaccatatattttataatatgtatacggtgtattatcaataattgttctacgttttcttgtttgtagcaaaaaaaaagaaagatgaaaacaacttgtgttctgtgacaccccttatcaatttaaataatcgtccacctttgtgaggcaaaaaaaaaaaaaaaaaagcggccgcc

SEQ ID NO: 18572 - DNA, 3090 bp, Zea mays
gtacgctttcattactacgatgccggcccgcccggcaagcgctttcagttgcgttctcgcttctcttctcgtggatccccaaatcctctccggccaccggcatcgctcctctcccgcccgccgacgccgaccgctcctatccacgccaccgcgtcggtgctcgagttgcctcagagagggagagagagagagagagagggagggagggagggaacggcgctcacgctgttccgattcgaacgagctcgcccggcgatttttttccctggaacgggctggctccgaatctcggcgaagtgtggggagcggctccaccctccaaccaagcaccgcaggatcaaccaaaaggcgggcgcgcgggcggcaggcggcggtgctgagaacacgggtgtcactgtttggacggacgctgtggatctcggcgatccttcgcggcctgcgtcaagggcggatcggcagcgatgagcggcggcggcggcgggagccccaataacacggagtggcgcttcaaccagaccctccgcaacgtgcaaggaatgcttaaaggacgcagctttcctgggaaggttttgctaacccggcgatccgagcctctctcccctcctgattattctccaagctttgagagcgagcacgatgaagatgagcgcaaggagggttctcgtcaggagggagaaggtcaagcatctggaaactcatttgacaatgcaagttcaaagaaatcaaatattctatcaacaagtagttcaaattcattgccagatgctcaggggctagtttctggggctagagctactgattccgcaagaattgctaaattcacaacggaactatctaggccagctgttatattagacaaattgcgtgaactatcttggagtggtgtgcctccatatatgcgacctaatgtatggcggcttcttttgggatatgcaccgcctaataaagatagacgagaaggtgttctaacaaggaaaaggctggagtacgtggaatgtgtttctcaatactatgatattccagatagtgaacgctcagatgaagaaattaccatgcttcgccagattgcagttgattgcccaagaaccgtacctgatgttacattttttcagaatcatcagattcagaaatctcttgaacgcattttgtatacatggggctattcgtcacccagcaaggggcgtcgccctcggaataaatgaccttcctccgccgcccggcccgggcttcttatccgagcacctagatggcaacatggatacttggtctgtggacaatctttcagcgcaggccatttccaacatagaagcagactgttattggtgtctctcgaagttccttgatggaatgcaggatcattacacctttgcgcaaccaggaattcagcgcctcgtttttcgattgaaggaactagttcgtcgtatagacgaacctgtttccaagcacattgaagagcaaggattagagtttcttcagtttgccttccgctggttcaactgccttctgatacgagaggtacctttccatctcgtaacgcgcctgtgggatacataccttgccgaaggcgactatctgccagattttctcgtgtacatatcggctagttttttgctgacgtggtcggacaagctgcagaagctggattttcaagagatggtgatgttcctgcagcacctccccacgaggacctgggcgcaccacgagctggagatggtcctctcgagggcatacatgtggcacacgatgttcaaaagctctcccagccacctcgccggctaggacccacccaagtccaccatgcctgtaagcggcagtcagttccttctgttttttttttgttaagcgcgtgcatactatactatcggtcgcgtcgcaccgatttgtatattttccgtttcctaccgaggaatgcttatctataatgaacaccagaggacaagtattagtgctcaatttgatattcagaccggtagttgtattgtattgtttgccgcgctcttggtggcgcaaggccttttttttttcccccaacaccatgagatgctcgttccctgttttgtgaaacgcagagaagcgctgtggcttgtgaaaattgtgatggtccatactgtcctttttgttttcgtttgatgcattgtatagtatagcatgtgatactgatgctgagtggtggtagcactagcacatagtacatcattgcctgctccctggcagcgagacaccgcccatgccttccgggcatggtcatggccttctattgccatgagcaagtcctctcgtaggccattgaggaggagtcactacgtagtagtagatgattgttaaagggtgacacatacttcctcttcaagcacaagcacacttttgcctccaccacgatgctctccttccatcaactatgtggatgtctttttcatagtgtgtgtactattaggccattaactttattcttcagataagatgcttcaatgatttcgactcttgagcttaattagctgccaggtggaggttgaagccatatccatatggcaatttatctctaagaccatgatacttattggatgcatgctaaaagtagtcggtgtggatcatgtcaaacatgtcaggctggtttggtgacgagggaattgggaaggaattctcgtctattcaaaattgaatagcaagaggattttttccttatggattccttccatttctctgatcatcaaatcagcctggatagggaaattgtaagctaggcagctagctaataactaaagactatggaaagaaatttttgtcctacccatacttgtatccatgtgttttaacggtagcctacaaaatgttattggtattataaacaaaatcatcaacatatttttgtctcgatccggtcataacaaactcacattcataatcatgttcataaaaccgaacttgctagactcagttatgttctagcggacagttgtcttcgttaatgggaacatgttcaaagacttagagcatgtccaagagatccttaaatcgctgattctaatccttattttagaaaaaaaaaatgcttccaataataacgtatatagcatccctaaactcctgcag

SEQ ID NO: 18573 - DNA, 2280 bp, Zea mays
  misc_feature (2242)..(2244): n is a, c, g, or t
  misc_feature (2249)..(2252): n is a, c, g, or t
  misc_feature (2260)..(2262): n is a, c, g, or t
  misc_feature (2264)..(2265): n is a, c, g, or t
  misc_feature (2272)..(2273): n is a, c, g, or t
ccgaaacaactcccccaatccgtcccgtcggccggacgagcagggcccaagggcccaccttaccatggcgaccgccactgccgcccccgtccccgccggcggccacccgtaccgccgcgcccgcactcgctgcggcccaccgcgcctgcaccgcctgcgcttcccggccgcagcagcagccgcttcgtcttccctgcccgccccgtcgtccatgctgccaccgctgccagatggaggcgggcggctggtggcggagctggtgtgcgcgttcaacgagctcacggagcggatgggggaggacctggcgacgtcctcctcgtcgagcctgctcttccgtgtgctgaagctggcgctccccgccctccgcgacgtggagggcggccgggcactcgcacgcgcgctcgccgtcgccgcgaccctcgctgacctccagattactctgttcacttaacaaagttaacatacttacatttcctaatgataacggacctctcttgaatcagaactttcctgcatttcgtaaattgcacatttttgccccatcaagctctcaaagtttaccaggcttttgaattgaatgctgaacacagatggatgctgaagtcatatcagccggcatactaagagaagcattagatgcaggagctgtaagaatgagggatgtaaaaacacagattgggatcagcacagctcatttgctgcatgacagcttaaggattaagcatgctccttcgaagcttgacgtattggatgatgaaggtgcaagcacattgagaaggtttattctttcatactatgatatcagggcagtcatattggagcttggaatgaagcttgatatgatgagacaccttgattacctccctaagtatttgcagcagataaaatctctcgaagtcatgaagatatatgccccacttgcacatgctgttggagcgggtaatctgtcactagaattagaggatctttcatttcgttacttgtttcctcattcctatgaccatgttgatcagtggttgagaagccaagaaggtgactgcaaggctataataaatttgtacaaggagcagttgcttcaagcactgcaggctgataatgagttgaggaggattgcacaggacatctcaattcaagggaggtataaaagccgtttcagtactatgaagaagctagtaaaagatggacggaagccagaagaagttaaagacattctaggtttgagggtaatcttggagcctcggtgtggtggcaattcatctgattggggccctagggcttgccacaggacacatgaaattattcaagctatgtggaaggaaatcccgggtagaacaaaagattatataactcacccaaaacgaaatggttaccagagcttgcatgtggccatcgatgtcagtgaacctgggaaggtgaggccattaatggaggtacagatacgcaccaaggagatgcataggtttgctgttggtggagaggcatctcactctctctacaagggtggtcttactgatcctggagaggctaaaaggctcaagactattatgttggcggcagcggagttagcagctctgcgcctacgagacctaccaggcagtgaccacgtagttgggaactgcaagaacccggctttctgtcagcttgacaaaaatggggatgggagaatcagcatcgaggagctcactgaggtgatggaggatctaggtgctggaggcgaagacgcaacagagctcatgcatcttcttgatgcaaacagtgacggctccttgagctctgacgaattcgagtcattccagagacagatcgaagtgatgagaaacttggaggacgatgataaccactataggaagatcttgaaggagaagctgcacacgatcgacagtgcaggtctcatccatgtgtaccgcaaggagctcagtgacaaattgcttgtgggctgacctggcagccatcttattgttgttttgtatgtataccacactgagaggtgactccagcactgatctgtaaatagtcgttgaacgtacgtggtatccagcaatattacggtagtgaatttatagggtggattgcgagatcaagaaatgaaggtaaatatataagagattcaaagatttagaggtaaatatataagaggttcgaagatttagacaggttcgaaccatataacaccctatgtccttttagtgttcattgtctatatacaatgtgatcagatgatttgtcctagggggaaaaaaannnaaaannnnaaaaaaannntnnagaaaannaaaaaaa

SEQ ID NO: 18574 - DNA, 969 bp, Zea mays
  misc_feature (920)..(920): n is a, c, g, or t
  misc_feature (954)..(954): n is a, c, g, or t
cattgggtacctcgaggccggccgggaacaactcccccaatccgtcccgtcggccggacgagcagggcccaagggcccaccttaccatggcgaccgccactgccgcccccgtccccgccggcggccacccgtaccgccgcgcccgcactcgctgcggcccaccgcgcctgcaccgcctgcgcttcccggccgcagcagcagccgcttcgtcttccctgcccgccccgtcgtccatgctgccaccgctgccagatggaggcgggcggctggtggcggagctggtgtgcgcgttcaacgagctcacggagcggatgggggaggacctggcgacgtcctcctcgtcgagcctgctcttccgtgtgctgaagctggcgctccccgccctccgcgacgtggagggcggccgggcactcgcacgcgcgctcgccgtcgccgcgaccctcgctgacctccagatggatgctgaagtcatatcagccggcatactaagagaagcattagatgcaggagctgtaagaatgagggatgtaaaaacacagattgggatcagcacagctcatttgctgcatgacagcttaaggattaagcatgctccttcgaagcttgacgtattggatgatgaaggtgcaagcacattgagaaggtttattctttcatactatgatatcagggcagtcatattggagcttggaatgaagcttgatatgatgagacaccttgattacctccctaagtatttgcagcagataaaatctctcgaagtcatgaagatatatgccccacttgcacatgcctgttggagcgggtaatctgtcactagaattagaggatctttcatttcggtacttgtttcctcattcctatgacccatgtgatcagtggttgagaagccaagaaggtgactgcaaggctataataanattgtacaaggagcagttgcttcaagcactgcangcctgataatgagtg

SEQ ID NO: 18575 - DNA, 2392 bp, Zea mays
gcatgcctgcagttaaagccctatataatgctcttgactttgcggagagtaactttgcaaatgaaatggagaggaattatataatgaaggtggtttgtgatactgctgtgtctaaagaagtggagatcagacaggctgcatttgaatgccttgttgcaatagcatccacctattattcacacttagagccttttatggaaaccatattctacctgacagctaatgcagttaaaggtgatgaggaaccggttgcacttcaagctgttgagttctggagcgctatctgtgacgaagagattgcactccaagatgaatatgagggatctgaggatggtaactctgctatacacttccgctttattgaaaaggccctccctttacttgttccgttgctgctagaaactttgttgaagcaagaggaagatcaagatcaagatgataatgcttggaatatttctatgagtggtggaacatgccttggactcatttctagaactgttggtgatgcagttgtccctcttgtgatgccatttgtcgagaccaacatcacaaagcctgattggcattgtcgtgaggcagctacctttgcatttggttctatccttgaaggcccctctgttgggaaacttgctccacttgtccaggctggtcttgatttcttgctcaacacgatgaatgatgcaaatagccaggtaaaagatactactgcttggactcttgggagagtatttgagctcttgcattctccagctggtataaactcaatcataaatggttcaaaccttccccgtatcatgtctgtattgccccggagtactaaagatgctccaaatgtagccgagaaagtctgtggagctatttattttctcgcccaaggttatgaagatgcagagtcaacgtcttctgtcctcacaccttatctatctaatacgattgctgctcttctttctgccgcagaccgtgctgagaccacccatttcaggcttcgtgcttctgcttatgaagcactgaatgagatcgtgagggtcagcaacatacctgaaacttcaggcatcataggccaattgttgcaggagatcatgagaagattaaaccttacatttgatctccatatactttcttctggtgataaggagaagcaaagtgatctgcaggctttgctatgtggtgttctgcaggtcatcatccagaaactgagcagcacagatgcaaagtccatagtttctcagactgctgatcagctgatgatgctgtttctgcgtgtctttgcctgccacaattctactgttcatgaagaagcaatgcttgcaattggtgctcttgcatatgctactggtccagattttgtgaaatacatgcctaacttcttcacatacctggaggctggtttgcagaattatgaagaataccaagtgtgttccatctctgttggggtggttggtgatatttgccgtgccttggaagataaaattttgccctttctgtgatcgcattatgactgttcttcttaaggacctatcaagctctatgctcaatcggtctgtgaagcctccgattttctcatgctttggagacattgctcttgctattggtgagaattttgagaaatacctaccatatgccatgccgatgcttcaaggagctgctgaacttcttggtactcttgatcagagtgatgatgatatggttgattatggcaaccagctcagacgtggcatttttgaggcatactctggtatactccagggcatcaagggcccaaaagctcagctgatgatcccatatgcaacacatctactacagttcactgaagctgtcttcaaagataggagcagggatgacagtgtgacaaaggctgcagttgctgtccttggggatcttgcagacacgcttggccagagctcaaaggatctgttcaagacccacctattccatgttgagttcttgagggagtgccaagcacaacagttggatgatgaagttcgggagactgcacaatgggcccaggggatgataaaccaggcggtggtctcctaatgtaggttgattttggtttgtttgttatgggaggtttcttgtggttgtgccaagttcatttgccacagacgaaagaaaggctaccaatatatatgtagcgtcagtcgtaggatcctggtagacatatttgtgcgttgttggtctgtcaagtcggtgcgcgtcacattgtaccgggtggtttctgtccgagtatgtcttgaacagcaaaacttggttcatttatcttggtatttttcaatgctggtcaaaaaaaaccggcggccttcgcggcctgtccagctgatcaagtttatatatgatacacacgcagactgatacatttaatcaaaatttgatctgcttgacatggtttgtt

SEQ ID NO: 18576 - DNA, 2102 bp, Zea mays
gacctcctaaaccctagccgcctctgcttctctcctccgctccgcaccctctttttcactccccctcccccgccggagtttcgtttcatttgaataggcgagcggggaagcatctcgtaaaccacctccgcactccccaaccgccccgaacactcgcctccattccgcgccgccgtcacctcgcgtcgccgtccggatctcttgggctcgtgtgcggcagggatccattgatttctcctctgcgaggatacaaccatggatatcactcaggttctgctagccgctcaatctccagatgctaaccttcgaacagtagcagaaggcaacctcacacagttccaggagcagaatcttcctaacttcctcctctccttatcaatagagctctcgaacgatgaaaaacctcctgagtctagaaggcttgctggtattatccttaagaattctttggacgcaaaggattctgcgaaaaaggaactactgactcagcaatgggtaagcgtggacccatctatcaaattgaagattaaggagtcgttgctggtgacactaggatcttcggttcatgatgcaaggcatacctcttcacaagtcattgctaaggttgcttcaattgagataccacgtcgagaatggcaagatctcattgccaaattactggagaacatgacttctccaggtgcatctgctcctttgaagcaagcaacactagaagcattggggtatgtgtgtgaggagatttctccacaggacttggagcaggaccaagtgaatgctgttctgactgctgttgtccagggaatgaaccaggcagagctcagccctgaagttcgtcttgctgcagttaaagccctatataatgctcttgactttgctgagagtaactttgcaaatgaaatggagaggaattatataatgaaggtggtttgtgagactgctatgtctaaagaagtggagatcagacaggctgcatttgaatgccttgttgcaatagcatccacatattattcacacttagacccttatatgcaaaccatattcgacctgacagctaatgcagtgaaaggcgatgaagaaccggttgcacttcaagctgtcgagttctggagcgctatttgtgatgaagagattgcactccaagatgaatatgagggatctgaggatggcaactctactgtacactttcgcttcattgaaaaagccctccctttactcgttccgatgcttctagaaactttgttgaagcaagaggaagatcaagatcaagatgataatgtttggaatatttctatgagtggtgggacgtgcctcggactcatttctagaactgttggtgatgcagttgtccctcttgtgatgccatttgtggaggccaacatcacaaagcctgattggcattgtcgtgaggcagctacctttgcatttggttctatccttgaaggtccctctgttgaaaaacttgctccactggtccaggctgggcttgatttcttgctcaacacaatgaatgatgcaaatagccaagtaaaagatactactgcttggactcttgggagggtatttgagcttttgcattctccagctggtgcaaacccaatcattaataattcaaaccttcctcgtatcatgtctgtgttgcttgagagtagtaaagatgctccaaatgtggccgaaaaagtctgtggagctatttattttcttgcccaaggttatgaagatgcggagtcaatgtcttctgtgctcacgccttatctacctaatatcattgctgcacttctttctgctgcggaccgtgctgattccacccattccaggcttcgtgcttctgcttatgaagcactgaatgagattgtgagggtcagctacatacctgaaacttcaggcatcatagcccaattgttgcaggagatcatgagaagattaaaccttacatttgatctccatatactttcttctggtgataaggagacgcatagcgatctgcaggctttgctatgtggtgttctacaggtcatcatccagaaactgagcatcttagatgcaaagtctataatttctcagaccactgatcagctgatggtgctttttctgcgtgtctttgc

SEQ ID NO: 18577 - DNA, 1981 bp, Zea mays
ttttttttttttttttattttttttttttttttttaccatgcacttcaaagatagcttataccacagataagtattgaagtacaagtataaaaacaattaagacagagagatagcacacaacacagagcagagcatcaagtataaaaacaattaagacagagagatagcacacaacacagagcagagcacattgatgctggcggcggctgctgcctggaggcagcggcagagcttatgatcatcgagacctttgataccagattggtaggagttgtgtttcctatactgacgatatgtttccgttgcaacgcacgggcatccacctagtataaataaagtattcaacgcagatagcagatccaccaacgctgaaacgcatgctcagcctccattgaccaaagcctgcctcggacctccactttggaaaaatggagaaggaagaacatcgctatcaacatcatcttccatttcatcctgtatctaaactttgtcaaccatttgcgcaggccgcagacacactcatacatcagtcccttttgattagtccatatacacccactaccagaaaagcagcagcccccccaccacaaagtgtatggctagctagtgcactacagacccggaaagaaacattatgagagcatgccagactcttttagcagctccctctctccatcactcacactcatagggggcattgaaagatggaggagcatgagcaggttattgcttaccatatccttgcaattaaagcacctttgaacaaaagatcagaaagggaaaggcgatatcatataccatttggtacaacttcaagtggagaggatcttttaggtcttttttccctgcctcctccttgttagtgaatcgaagccggcatttctatcttacgctttgattggtaggttaacgcctgctaacagccccgaaaggatgcaagttacgcttgctgccactatactaggaaggagtgttgggttctggttttactggttgtccgtcctgcgaatgttgcgtgtcatagattgccatggcgagcgagatgggcatcatgcagagtgctttggactggaggaattgcatcgctgccccaatgtcttcttccatcagctttgcgacctgtctttctgtgccgtccgttgaccacttctcccaaatctgctgtttgctcccactatcacttgcttcccccttaactgaaagtgggatatcagcaaccagctgtgccacagcaccagcaccacccagcctgctcatgcttagaaccttgacttgaagcctcagaaacttcacataatctaggatctcatctagcatagctgctctatctgtcttgtttgtattgggcaccaattcctgtagggccctcatcctttctgctattctctctcttcttagcctctccgcgatgctgtgggggtcggtcgcctgcccacgccgcgcccgcacctttggcctcggtgccggcggttgtggcccgactgccgcaccgccttgcttcggctgctgcgcgtggaacacctgtgtaggcggggtggcgcggaggtggggtggctgcacaccgccgccgaacgccggcgggaagagcccagggagctgtatagcctcccggtccgccttgccaccgtcggcgtgcttcccgcttccggaagcctcagcggccgcggcgtcgaggctgagcgcaagggaaaacggctggtcacccggtgcgcggccgccgcccgcggttgcgccggggtaggagccgccggccgtcatggagaagaactggtcgaagaaatcgtcttcggggccctgcggtggcggttgcccggccatgtcctggcaccaagtggcccactttgcccgccggcaactgtaactggtcgctcggcctcgctctccagctgccgccgacggctcggaacggaggccgtttgctcgtcggcgagtgaagtagggggatcgagttttcgattaggatgttctaggtaatggtct

SEQ ID NO: 18578 - DNA, 1847 bp, Zea mays
ttttttttttttttttgattaatctcatcccaactttatacgaatgttcttatcaagagtgtggatccatatataaataaagtattcaacgcagatagcagatccactagcaacgctgaaacgcacgctcagcctccattgaccaaagcctgcctcggacctccactttggaaaaatggagaaggaagaacatcgctatcaacatcatcttccatttcatcctgtatctaaactttgtcaaccatttgcgcaggccgcagacacactcatacatcacagtcccttttgattagtccatatacacccactaccagaaaaagcagcccccccaccacaaagtgtatggctagtgcactacagacccggaaagaaacattatgagagcatgccagactcttttagcacctccctctctccatcactcacactcatagggggcattgaaagatggaggagcatgagcaggttattgcttaccatatccttgcaattaaagcacctttgaacaaaagatcggaaagggaaaggcgatatcatataccatttggtacaacttcaagtggagaggatcttttaggtcttttttccctgcctccttgttagtgaatcgaagccggcatttctatcttacgctttgattggtaggttaacgcctgctagctagtagcccgaaaggatgcaagttacgcttgctgccactatactaggaaggagtgttgggttctggttttactggttgtccgtcctgtgaatgttgcgtgtcatagattgccatggcgagcgagatgggcatcatgcagagtgctttggactggaggaattgcatcgctgccccaatgtcttcttccatcagctttgcgatctgtctttctgtgccgtccgttgaccacttctcccaaatctgctgtttgctcccactatcacttgcttcccccttaactgaaagtgggatatcagcgaccagctgtgccacagcaccagcaccacccagcctgctcatgcttagaaccttgacttgaagcctcagaaacttcacataatcgaggatctcatctagcataactgctctatctgtcttgtttgtattgggcaccaattcctgtagggccctcatcctttctgctattctctctcttcttagcctctccgcgatgctgtgggggtcggtcgcctgcccacgccgcgcccgcacctttggcctcggtgccggcggttgtggcccgactgccgcaccgccttgcttcggctgctgcgcgtggaacacctgggtaggcggggtggcgcggaggtggggtggctgcacaccgccgccgaacaccggcgggaagagcccagggagctgtatagcctcccggtcctgcagaggcgagcaaagagcttaacatgcagcactcagggacgcgatcgtttggtaggtgcaacaagtgcaaaggcgaaaagcgaagcaaaggggaaagcgggcacgatggaagggcgctcaccgccttgccaccgtcggcgtgcttcccgcttccggaagcctcggcggccgcggcgtcgaggctgagcgcaagggaaaacggctggtcgcccggtgcgcggccgccgcccgcggttgcgccggggtaggagccgccggccgtcatggagaagaactggtcgaagaaatcgtcttcggggccctgcggtggcggttggccggccatgtcctggcaccaagtggcccactgtgcccgccggcaactgtaactggtcgctcggcctcgctctccagctgccgccgacggcccggaacggaggccgtttgctcgtcggcgagtgaagtagggggatcgagttttcgattaggatgttctaggtaatggtct

SEQ ID NO: 18579 - DNA, 2687 bp, Zea mays
ctgtatggttattccatcaaacaaagagtctgctgttgccaacaaaaaccttgaaggtgtcgcagaaagtgatgatgatcttattgatggtaccgctgataatgttgtatcgggacctaagattgccaacatggtagttgatgaggtgggtttcaagatggcacctgctaatagaagttcacctggtgacccctctgatgactcatgtgtcattcctgaaagtaggcctcaggattatgctgtaaagagctatgagggagttggtgattgtggtgtgactgaagtgtctaagttatgtagtgagcctcttaacaaaccatcagataatatatgtgcaactcaagatgttcctacaaatacctctactatgtctgctggtgccagtgaagtgtctagttcgtggagtgagcctgttaccgaactgatcgatgacagatgtgcaactcaaggtgttccagcaaatgcctctaccacgtctactgttgtaccatctgttaaactctggacaaatgctgggctctttggacttgaaccatccaaacctccagtatttggtaatggtccaagggaggatactccacctggttttaaagaagctcaaccagtccattcaactgaattcacagaagtgcactgttcaaagccaactgaatcagcagctgtagatgtcccaaatggaaacacatccattaccagcagctttgtggaaaagcttgttggtattcgtcctggttctgcaaacctcaatagctcaggggcaaatcaatcagcagccagaatacctgatccaattcatagtcatacagatgggcactcagatttttcgtcatcctctgtgcgcacctccaggccggccgggcatacttcaataaacgaacttctagaatttgaggggagtgctgatactggcaccaaaatatactcaactgacatgagaaataacgctgtgtctgcatcaagcttttcaagcattgcacaaaggtttcttgctaatacacttcagagaagaacttccaaatatactgatcttcctatgtcttctgagagggcaaatgctgatacaagtgcaaaatctgaatctactctaaatcctgttgtagaaccaagtgaagcggtatttgcagaggaaactaagtttgagaacaaaacagaaaatggaatggatggattgtccaaaacatcaatattttctagccgccattactctgagaaatcgtctccgccacttgagtacatgaaaatatcttttcaccctatgagcgcatttgagatgtcaaagctgaacctagatttctgtgatggaaatattcatgaaatttctgatgatatgatgttaccgacatttcagttactttcagagtcttccattccacagccaggcagtggttctgagtctgaagatgacacctttggtaggtcatatagttattcttcatatgatgatctgagtccccggctatattcaaactctgaggcatgggatcaagatgatggaactggactggaggaacatgagttatatgatgattcaaatcagataggatcctcaacagcacctttatctagctacatgggattcgagcagatgaacttatctgacatgaagtcagatatttcacttgcaaacgttggggatcagaatgtaataggcactttacaatcctgtactgttgaagaacttccaaactttgatacattgatgtccagaagtgatgatcaaaatggtgaaacccccattccacataatctggggaatatgacaccagatgaagatcagttgccaccaccacctcctctccccccaatgcagtggaggatgacaagacaaacaacttcactagaagaggaaacttgcattacaactaaagatatgcttagaaaaacttctagcctaccacatatacacacctctgcccaggaagaacactgtcctccaactgcaccattggatctacaagggcatgctggggaagtgggtgtccagaaaactggtggggtacgagaaattactaatcctcctagtatcatcgatataaaatcaagtttgcttcagcagatcagggataagtcagagcagctgaagcttaatggacatgaaaggtcaaaaaaagcagtaggcggtgacattaaaagcttagacgaaagggaggagttgcttcagcaaatcaggagcaagaccttcaatttaagacgcacaaacgcatctaaggcagatggctcatcacaatctacagccagttccaacgttgcagcaattttggagaaagccaacgctatccggcaggctgtggccagtgatgagggtggcgatgatgatacatggagtgatatatgaccacctaattgcagacgttcatggtagtcttttcctgtatattaagctattacaagatgaagtgattaaatgtgaataccatccttttcttcattgtaattagattttgcaggtcttgttttgtaccttccttagttcatattagtgaatcctaccgtaggtcgctgtggtcgtggaaatgtcagagcatttccacattatgtaaatgcatctttattatttatttatgatagtgagaacagctgaatagctgataaaaataagcatactaatctatctttttatcattgtattgattttttttgcaatgataataagatggagcatgatgttgcaaaaaaaaaaaaaaaaa

SEQ ID NO: 18580 - DNA, 1260 bp, Zea mays
gagctcggtactcctgcaccattaggatctacaagggcatgctggggaagtggtatggattgtttatttggttaaccctgctttgaataattacagtaataaataattacttctgttatatattgttaatgaaattatgtacttgatatatgtagggtgtccagaaaactggtggggtacgagaaattactaatcctcctagtatcatcgatataaaatcaagtttgcttcagcagatcagggataaggtttgttctgccttttgaattgggaaaaaagaccaatatgttcttctttatgattttatagtgctgttttacttttactataaaaaagtagcctacaagaaacaaatgtagaccatctttggatgtgagagatctcacttttttataaagtatattcatatagctgttgacttgacccataaggataacaagatggaatgcttaccgtgaattttatgaactgtgattcaaaaaagctatctgacccaagacactctgtcacatgctaaccatgtccagtacagaattcttgtggccatttattttatcaactaaaacaaatacaagtcccagtaatggccattgaccagttgattcttgaagtcaggaagctcattaccagttttatagtttctgatcgttgcataaaatttatgattattttatccatttcgcctaatgaattatcacagtcagagcagcgggagcctaatggacatgaaaggtcaaaaaaagcagtaggcggtgacattaaaagcttagacgaaagggaggagttgcttcagcaaatcaggagcaagaccttcaatttaagacgcacaaacgcatttaaggcagatggctcatcacaatttacagccagttccaacgttgcagcaattttggagaaagccaacgctatccggcaggctgtggccagtgatgagggtggcgatgatgatacatggagtgatatatgaccccctaattgcagacgttcatggtagtcttttcctgtatattaagctattacaagatgaagtgattaaatgtgaataccatcctttttttcattgtaattagattttgcaggtcttgttttgtaccttccttagttcatattagtgaatcctcccgtaggtcgctgtggtcgtggaaatgtcagagcatttccccattatgtaaatgcatctttattatttatttatgatagtgagaacagctgaatagctgttaaaaaaaaaaaaaaaaaaggaaaaaaaaaaaaaaaaaa

SEQ ID NO: 18581 - DNA, 663 bp, Zea mays
ggatactccacctggttttaaagaagctcaaccagtccattcaactgaattcacagaagtgcactgttcaaagccaactgaatcagcagctgtagatgtcccaaatggaaacacatccattaccagcagctttgtggaaaagcttgttggtattcgtcctggttctgcaaacctcaatagctcaggggcaaatcaatcagcagccagaatacctgatccaattcatagtcatacagatgggcactcagatttttcttcatcctttgagcacaataacatgactggcaaacatacttcaataagcgaacttctagaatttgaggggagtgctgatactggcaccaaaatatactcaactgacatgaggaataacgctgtgtctgcatcaagcttttcaagcattgcacaaagatttcttgctaatacacttcagagaagaacttccaaatatactgatcttccaatgtcatctgagagggcaaatgctgatacaagtgcaaaatctgaatctactctaaatcctgttgtagaaccaagtgaagtggtatttgcagaggaaactaagtttgagaacaaaacagaaaatggaatggatggattgtccaaaacatcaatattttctagccgccattactctgagaaatcgtctccgccacttgagta

SEQ ID NO: 18582 - DNA, 1946 bp, Zea mays
cctcgagccttggggcactgggtacccggccgggggagaggagctcactcccgctgcccagtcctcgccaccgcccactccgtcgccaaccaatggcctccgccatggagctctcgctcctcaaccccgccgcgacgcaccgccaccgcggcggcctcgccggcctgcccctcgcgcggcgctccgtggtccgcttccgcgtgtccgcctccgccgcggccaccgcgccgcccaagtcctcgggccccaagaagcggggcaagacggagatccaggagacgctgctcacgccccggttctacaccacggacttcgacgagatggagcgcctcttcaacgccgagatcaacaagcagctcaaccaggcggagttcgacgcgctgctgcaggagttcaagacggactacaaccagacccacttcgtgcgcaaccccgagttcaaggccgccgccgacaggatggagggcccgctccgccagatcttcgtcgagttcctcgagcgctcctgcaccgccgagttctccggcttcctcctctacaaggagctcggccgcaggctcaagaaaaccaacccggtcgtggcggagatcttctcgctcatgtcaagggacgaggcgcgccatgctgggttcttgaacaaggggctgtctgacttcaacttggcgctggacctggggttcctgaccaaggctaggaagtacaccttcttcaagcccaagttcatcttctacgccacctacctgtccgagaagatcgggtactggaggtacatcaccatcttcaggcacctcaaggcgaacccggagtaccaggtgtaccccatcttcaagtacttcgagaactggtgccaggacgagaacaggcacggcgacttcttctctgccctgctcaaggctcagccgcagttcctcaatgactggaaggccaagctctggtcacggttcttctgcctctcggtgtatgtgaccatgtacctgaatgactgccaacgcactgcattctatgagggaattggtctggacaccaaagaattcgacatgcatgtgatcatcgagaccaaccgcacaacggcgaggatcttccctgctgtcctagacgtcgagaaccccgagttcaagaggaagcttgacaggatggttgagatcaaccagaagatcattgccgtcggagagtccgacgaaatccccctagtgaagaacctgaagaggattcctcttgtcgcctctctggtgtccgagatcatcgccgcatacctcatgccccccatcgagtctggctcggttgatttcgccgaatttgagccccggctcgtttactgattctgtacaaagatttatccttgagttattcaccctgaaagacaagctgctggtgctttctgccgaaggggccttgaatgaatggtgaaaaccgctggatggttagaggatctgcatcttcttgtgttcttctgtaaaatactgagacttgggcagcataaaaagcttggcaaatttctgttgtgtggcatctccatgtaagtaacagtggactgcatcagaagcgagcgttccagttttgcgacagaagggggcgtccgaagttgttgtactgctaatgaacgtcgaactagcatgataaatgtatcccagcacatttggttgattgtgtaacactagaaagccattgaacagcgtttggctatgatgctgtaccatctgaatttacatagctccttttgttttagcaaaaaaaaaaaaaagcatccggcgtgacgtctacaaacatttgtaagaaaatcgtggtagaagattgtcagtattgcatggtcctttcatcacaatcatactagtgcggaaactctcccacttgcgttgttgttaaaccacacacatttttagaagagggaaacaacacgtatgttcaatgtaacaaattgaattcatatacatggttatctatactat

SEQ ID NO: 18583 - DNA, 3429 bp, Zea mays
gaaaaaatgagagacattttcgaacttaagaaatgcttgcaaatagaaaaggctttcaaaatatttcaaaactttgcgaaataaaaaataccaagtgatacaaatgtggtcaaatatgttaaaattacaaacaacgcatattcagcttagaactgagaaggcgtgaacggagaacggcggcaccggcacgcagggtctacgaattaggttaattggcgatttggtgaagcgtatatggtacacggacgtgaagtcgtgatggccgtaggctcgtagcacgactgcgtgagttgtggcctgtacgagaggctgggctgtccatgttttgagccgatcaactaatgaaacatttgagctgattaaattaatcaatactatacttaactacatacttgagggaggcccaacaatttgggggccagagcggccgcccagctcatcccaaataaaataggttctattgttgcctggagaaatgaagaataggaaaatcacggagagggagggaaatagtgcgagaagcgtgcggctagaatggttgattgggctccctctcagacccccacacagtcacacatggcgcgcggcgattagaagccccggattacacctcatcgccattcgccactttttttatctatcctataccaactaccacatattatatcatttttctcacacttttttatccaaaaaaaatccatcatcggcgggtcgctgtcgcgcacagtggatagaccattcacccagtacgcacgctcgtgcatgcatgcatattctatcggtttagcgttacgcacgctcgaagtagcgttcactcgtacgctacagtgcatagagtatctcgtccagtcgcccgctgcagcaaaaatttctacgctatgctttagcgttcgcgtgtccggtagcaagtgcggctagccttatctagttatctgtcaccgctcgcaatccccgctgccatgtcaccaccgcccagctcgtcgccatcccgcagcatgacttcatgagcgcaccgcatatacgcctactccccgaacagctcgctccggctgcccagtcctcgccagtcaccaccgcccagctcgtcgccagtcgccaccaatggcctcctccgccatggagctctcgctcgtcaaccccgccgcgacgcaccgccaccgaggcggcctcgtcggcctgcccctcgcccggcgctccgtggtacgcttccgcgtgtccgcggccgccgcgccgcccaagtcctcgggccccaacaagcggggcaagacggagatccaggagacgctgctcactccccgcttctacaccaccgacttcgacgagatggagcgcctcttcaacgccgagatcaacaagcagctcaaccaggcggagttcgacgcgctgctgcaggagttcaagacggactacaaccagacccacttcgtgcgcaaccccgagttcaaggccgccgccgacaagatggagggcccgcaccgccagatcttcgtcgagttcctcgagcgctcctgcaccgctgagttctccggcttcctcctctacaaggagctcggtcgcaggctcaaggttccttcatgtttctttgccttgccttgcctcgtctggagcatttcatcgaccatctggtgggcgtgtgctgataccctgcttttcttctgcagaaaactaacccggtcgtggcggagatcttctcgctcatgtccagggacgaggcgcgccatgctgggtacgaaccttatctcttttcatgcaatccaataacaatgcgtgcaattagtagccaaaaaaaatgcatccttataaagattaggaaatataattgtttgcctgtcccatgaacacttatgtcagtgttgctacctcaatttgacaaggaatgcggatattctaagtttgcagaaataatttaaacgagcctggttacatgagcaaacaaaatactcatttttcaatgtagtcggtagtattaattatgtcaatgaattgggggttgcttccagcaactgcccataagaattcaggcatgcatgttttcctgattgtgttcaatttgaggctctagggtaatgatgagggcatggagaaattcagctgaaagtttcatgtgatttgcactgtgtaggtttttgaacaagggtctgtctgacttcaacttggcgctggacctggggttcctcaccaaggctaggaagtacaccgccggcctgcccgggttcatcttctacgccacctacctgtccgagaagattcgggtactgggaggtacatcaccatcttcaggcacctcaaggcgaacccggagtaccaggtgtaccccatcttcaagtacttcgagaactggtgccaggacgagaacaggcacggcgacttcttctctgccctgctcaaggctcagccgcagttcctcaatgactggaaggccaagctctggtcacggttcttctgcctctcggtgatttgtcgacctatgtacctttgctatgtactgccgacccactgcattctatgagggaattggtctggacaccaaagaattcgacatgcatgtgatcatcgagaccaaccgcacaacggcgaggatcttccctgctgtcctagacgtcgagaaccccgagttcaagaggaagcttgacaggatggttgagatcaaccagaagatcattgctgtcggagagtccgacgaaatccccctagtgaagaacctgaagaggattcctcttgtcgcctctctggtgtccgagatcatcgccgcatacctcatgccccccatcgagtctggctcggttgatttcgccgaatttgagccccggctcgtttactgattctgtacaaagatttatccttgagttattcaccctgaaagacaagctggtggtgctttctgccgaaggggccttgaatgaatggtgaaaaccgctggatggttagaggatctacatcttcttgtgttcttctgtaaaatactgagacttgggcagcataaaaagcttggcaaatttctgttgtgtggcatctccatgtaagtaacagtggactgcatcagaagcgagcgttccagttttgcgacagaagggggcgtccgaagttgttgtactgctaatgaacgtcgaactagcatgataaatgtatcccagcacatttggttgattgtgtaacactagaaagccattgaacagcgtttggctatgatgctgtaccatctgaatttacatagctccttttgttttagcgatgtcattgtcatgcatcatgagtgacgtctacaaacatttgtaagaaaatcgtggtagaagattgtcagtattgtcatggtcctttcatcccaatcatattacgttcggaaactctaccatttgcgttgttaaaccacacacatttttagaaggtaaaacacgtaagtttaatgtaacaaagttgaattcatat

SEQ ID NO: 18584 - DNA, 1616 bp, Zea mays
ggaatttacatgaaactctgttagaaatcctgaaagcttaggagaatatatgaactgcttctagaaatgctggtgtgaactaaggctgctactgacaatgtaaaaatatttcatacctgtgcagaccaaccgcacaacagcaaggatcttccctgctgttctggatgtcgagaaccctgaattcaagaggaagcttgacaggatggttgagatcaaccagaagatcattgctatcggaaaatcagatgacattcccctagtgaagaacatgaagaggattcctctcgttgccgctctggtgtctgagatcattgctgcatacctcatgccccccattgagtccggctcggttgattttgctgaatttgagccccagcttgtttactgattctgtagaaagatttatcttcggattattctctccgaaagacaagtcggtgctttctccctaaggggccttatggtgaaaaaaactgggatggtcaaaggatctgcatcttcttgtgtccgttcgtctgtacagtactgagacttcggcaacataaagcttggcttggcaagttcttgttgtgtggcatctccatggaaatgacagtgaactgcatcagaagcgagcgttccagttttccagcagaagggcgcgtctgaagttatactgatatgaagcaatatcatacatacctttatggtcaactgtaccacatggcctccgcgcagagttgttgagcatattttttagcatccatgtcaacatcggactagcatgatgcatgtatccagatccagcgcatttggctgattgtgtaacactagaaaccatttaacagcgtttagctatctcatgtattataagtgtcaattatctagatgaatttggtagatgattgtccatattagcacggtctatgcttctaatctcctttcatcattgtatcgtaaaaacccgccaagtaaaatgtgaaacactaaaaaattgtttcttgagggactgccgtgaagcaaaacctcagccctttccgctatgtctccatcaacttggttaaatagtttgatacattctttttttattcattttagtgaatattataatacatattgaagaccttaaataatctcaaacaaaaaatagattgaaaagttttcgttctctttgaatattataactttaatttaggccatttcttcgtccagaatcatttgaaaaatcataaaaatattaatgttttgaaatggtgcttttttgcctcacgtattcctcctgggccctttgccgctcgctgcacgctaagtttacctagcagtcgcttcacttctgttgtatctgagtgtagcggcgggagctacgagcagcatacctcgatgacccttctctctgaaccgtcacttgactcgagtcgatgacgttatcgaacattgggtacctacaaagaagtaacatcacgaaaaagatatatacaatatgcacctttcatgaccattgcctcgccatatgcaacctgaatacaaaagaacaatgcaatctcatatacaaagtttcatagaaatagcatctaccaagttgtgcaaaaaaattcactagacaatctgatgccacctaactgcacaacatatatgtg

SEQ ID NO: 18585 - DNA, 1604 bp, Zea mays
tattcggcacgagggcctgcccctcgcccggcgctccgtggtacgcttccgcgtgtccgcctccgccgcggccgccgcgccgcccaagtcctcgggccccaacaagcggggcaagacggagatccaggagacgctgctcactccccgcttctacaccaccgacttcgacgagatggagcgcctcttcaacgccgagatcaacaagcagctcaaccaggcggagttcgacgcgctgctgcaggagttcaagacggactacaaccagacccacttcgtgcgcaaccccgagttcaaggccgccgccgacaagatggagggcccgcaccgccagatcttcgtcgagttcctcgagcgctcctgcaccgctgagttctccggcttcctcctctacaaggagctcggtcgcaggctcaagaaaactaacccggtcgtggcggagatcttctcgctcatgtccagggacgaggcgcgccatgctgggttcttgaacaagggtctgtctgacttcaacttggcgctggacctggggttcttgaccaaggctaggaagtacaccttcttcaagcccaagttcatcttctatgccacctacctgtccgagaagattgggtactggaggtacatcaccatcttcaggcacctcaaggcgaacccagagtaccaggtgtaccccatcttcaagtacttcgagaactggtgccaggacgagaacaggcacggtgacttcttctctgccctgctcaaggctcagccgcagttcctcaatgactggaaggccaagctctggtcacggttcttctgcctctcggtgtatgtgaccatgtacctgaatgactgccaacgaactacattctatgagggaattggtctgaacacgaaagaatttgacatgcatgtgatcattgagaccaaccgcacaacagcaaggatcttccctgctgttctggatgtcgagaaccctgaattcaagaggaagcttgacaggatggttgagatcaaccagaagatcattgctatcggaaaatcagatgacattcccctagtgaagaacctgaagaggattcctctcgttgccgctctggtgtctgagatcattgctgcatacctcatgccccccattgagtccggctcggttgattttgctgaatttgagccccagcttgtttactgattctgtagaaagatttatcttcggattattctctccgaaaggcaagtcggtgctttctccctaaggggccttatggtgaaaacaaactgggatgggcaaaggatctgcatcttcttgtgtccgtctgtacagtactgagacttcggcaacataaagcttggctgggcaagttcttgttgtgtggcatctctatggaaatgacagtgaactgcatcagaagcgagcgttccagttttccagcagaagggcgcgtctgaagttatactgatatgaagcaatagcatacatacctttatggtgaactgtaccacatggcctcggcgcagagttgttgagcatattttttagcatccatgatccatgtcaacatcggactagcatgatgcatgtatccagcacatttggctgattgtgtaacactagaaaccattta

SEQ ID NO: 18586 - DNA, 1391 bp, Zea mays
cctgcagttccgggccggacttcccggggtgagagctgatttttctcgcagcggcagcgggtagccctgtccctgacctgatcctgacccgtgcgggcgtgcggctcctcgcggacagctccagactccagagccgcctcttcgccctctcgccatcggcaggctacggtggctgcttccccgagcctgcaggtagaccaccttgtgttgattcctcgagtcttcacctggtgcttccgtttgcagcttcatttttaactaagatgtcacaagccaaggaagtgaggtacactgcacggtctattacacctcctgctgatagaaatggcacttcaaggtcgcctcctccaaagagacgcagcccttcaaggtcacctccaccaaagagtgcttcacggtccccacgtccaaggagtccaaagagacgcagcacttcaaggtctcctcctaggagacgtggtagatcaaggtcaagggataggagtcggtccaggagcccagatgatagaaatccagggaataacctttatgtaactggattgtctactcgtgtaacggaagatgatcttgagaagttctttagtaaagaaggaaaggttaagaactgtcatgttgttcttgatcctaggacaaaagaatcccgtggctttgccttcgtgactatggatactcttgaaggtgcaagacgctccatcaagtatctgcaccgcactgtacttgaaggtcgcctggtcactgtagagaaggctaaaagaactcgtgaaaggacccctactcctggaaaatactgtggtcgaagaggaggatctcaaaggagcccatcaccttaccgccctcgcagaagggagcgttcgcgctcaagggaacgcagaagggagcgttcgcgttcaagggatcgaagggagcggtctcgctcaagggatcgaagggagcggtctcgctcaagggaacgccgaagggagcggtctcgttcaagggaccgcagggagaggtctcgctcaagggaccgccggagggagcgctcacgctcaagggaccgcagaagggagcgctcacgctcaagggaccggaggggcagttcaccccatggcagaaggcatagagatcggtccaggtcacccaccagcaatgggaaccataaggcagactaggaagcgcttttatggacttgtcgttgattgcgtgaacaaaggaacttgtaacactacctataaactggtcagactgagacggttagcatggatttttagtagtgttgctgtattttgttgtttcatacaagtactctattctgttagctttcggatcgaaatgtcggatgatgatggttgttattgttctggaaatcgtagacatgtcctccagtttacctttttttttttttttaaaag

SEQ ID NO: 18587 - DNA, 1505 bp, Zea mays
  misc_feature (1263)..(1267): n is a, c, g, or t
  misc_feature (1272)..(1293): n is a, c, g, or t
  misc_feature (1462)..(1500): n is a, c, g, or t
agatttttctcgcagcgggtagccctgtccctgacctgatcctgacccgtgcgggcgtgcggctcctcgcggacagctccagactccagagccgcctcttcgccctctcgccatcggcaggctacggtggctgcttccccgagcctgcaggtagaccaccttgtgttgattcctcgagtcttcacctggtgcttccgtttgcagcttcatttttaactaagtctgtaatttattggctgtttatctgagtgacactacactctctgttttttcttattagatgtcacaagccaaggaagtgaggtacactgcacggtctattacacctcctgctgatagaaatggcacttcaaggtcgcctcctccaaagagacgcagcccttcaaggtcacctccaccaaagagtgcttcacggtccccacgtccaaggagtccaaagagacgcagcacttcaaggtctcctcctaggagacgtggtagatcaaggtcaagggataggagtcggtccaggagcccagatgatagaaatccagggaataacctttatgtaactggattgtctactcgtgtaacggaagatgatcttgagaagttctttagccacgaacgaatgccgctcgaccggtcatgcgcctcttcctccttggacagaagaattccgtgtctttgccttcgtgactatggatactcttgaaggggcaagacgctccatcaagtatctgcaccgcactgcacttgatggtcgcctggtcactgtagagaacggctaaaagaactcgtgaaaggacccctactcctggaaaatactgtggtcgaagaggaggatctcaaaggagcccatcaccttaccgccctcgcagaagggagcgttcgcgctcaagggaacgcagaagggagcgttcgcgttcaagggatcgaagggagcggtctcgctcaagggatcgaagggagcggtctcgctcaagggaacgccgaagggagcggtctcgctcaagggaccccagggagaggcctcgctcaagggacccccggagggagcgctcacgctcaagggaccgcagaagggagcgctcacgctcaagggaccggaggggcagttcaccccatggcagaaggcatagagatcggtccaggtcacccaccagcaatgggaaccataaggcagactaggaagcgcttttatggacttgtcgttgattgcgtgaacaaaggaacttgtaaccctacctataaactggtcagactgagacggttagcatggannnnnagtannnnnnnnnnnnnnnnnnnnnncatacaagtactctattctgttagctttcggatcgaaatgtcggatgatgatggttgttattgttccggaaatcgtagacatgtcctccagaatacctatgaaactatggcatactcgtgtgtttgcttaaggttgctgtggtatgttctgatcttaagattgacacgnnnnnnnnnnnnnnnnnnnnnnnnnnnnnnnnnnnnnnnacttc

SEQ ID NO: 18588 - DNA, 3635 bp, Zea mays
  misc_feature (2002)..(2002): n is a, c, g, or t
cccgtggctttgccttcgtgactatggatactcttgaaggtgcaagacgctccatcaagtatctgcaccgcactgtacttgaaggtcgcctggtcactgtagagaaggttagatgctgactgtactgattcattccattatgcatttttctattgtattttttgttgaatagtgctagttttgtcatgttatcgttgtatagtaatgtcaagtagtctaatactagcagtagtacagttaaaaatttaaagctactatacggtcatgcatgttttttgtcttatgcttgtccctccccttcccactttagccttgaaatcactgatgtcttagtaacataaatgcattaatcttgtgcactggaaattatattccattacattaagggggtgtttgaatgcactagagctaatagttagttggctaaaaaattgctagtgaaattagctacctaactattagctaatttcctaaaaatagctaatagctgaactattagctagactgtttgaatgtcttcagctaattttagcagctaactattagctctagtgcattcaaacaccctctcccacgcctctgatgctatgctctgttcagtttaaaactctggtgaaggtccttgaggtgaggtatgttatgacttatgagtagaagattacaaatatgctctttccctatgatggaagagtatattctgtaacagacaagcctggaaaccccactcaggtgaaatgtgccagagtaaattgaaaggggatcatttatgatgtgttctgatgcaatcctaatgtggtgaatggggaaaacctcttctgtggctcttcaactggggtcttaactctcatctcgtgctgacttcctgaccttccagtttaacatggtgctgggctgcctctacgtcaacctggttggtccaggctgtgcagtctccaaccatggttgtctccaaaggatgtgcagctgacgtgatggtgcttatcaccacaccctcagagctcatcaccacttgccgtcttcacctcgctcaccgacaatgcatacatgctacatcaacacgacggctgtcgccatagagcgatcttggagtcttgttgtgcatcgcgtcaccaccatcgccaccgcaacttctaccacaaccgccatcgtcaacatcacgctcgtgatccaacaggctctacgatttgtctgcttcgactaagcttacatggtgcatgctgctgccatgtcacgacaccaaccaccaagtctgatgcgaacttcatcgaccagtatcttgatttgatggacatcacgaggcgcataatctggcgcttccttggaccatggctacaccgaccacggaacaagtgcacaaaagtcatctttggtttagttggcatgcaacgtaaagtttaatctacctatatcacaagattttgatcaagagttgacaagcttaatggaccatgactatttttcaccaaaagggcaaagtttagtttcattatcaattatattaaccactctgttcaaatttaagatcgaattgggttcttcctttatttagcatacttgaagttcattgcttgtttcattcgtaccaactaatacatttgttcacgattttattccaggctaaaagaactcgtgaaaggacccctactcctggaaaatactgtggtcgaagaggtaggatctcaaagttgagccaattttgcacctccacatgatatgaccacaacgctttctgtattaagcatcgtttgacttgcttctttatgtgttgttcagcttgcatacattgttgttgaatggatatcactttatttgtttgcagttgtcagatgtgctatgctgtttttttaatacataaacatgaacttagtctaaatattctgtgccactcatagggtatttgtgtgcttatttgttttatatattgatctttaatattctaatgattgacctcgatgggggtgttatgtttagttgtttattacaacacataaacatgaactcngtctctaaatattttgtgccactcataggtttgcttatttgttgttttagtgatcttaatattctaattatcggccttaatggggtgttttgtttctacaacctgtgattataattgtagcttttatggtgttctctatttttagctggcataattccacactattgaagccctggtagacatctatggtctaggtggtgttctatatttttagccggcataattccacactatcaaagatttgagcacacatctatggtctaggtcattgttttccttgattgaaatcacactttcgaagtagatcacacgcgtagccatgggaaaattgtgacagttattatgtgcaaatttggttgcatatatctttttataggcttgtgatccacgtgtgctcttgaagcatttgcaagacgctccatcgagtttctgcaccgcactgtacttgaaggtcgcctggtcactgagaaagctaaaagaactcgtgaaaggacccctactcctggaaaatactgtggtcgaagaggaggatctcaaaggagcccatcaccttaccgccctcgcagaagggagcgttcgcgctcaagggaacgcagaagggagcgttcgcgttcaagggatcgaagggagcggtctcgctcaagggatcgaagggagcggtctcgctcaagggaacgccgaagggagcggtctcgttcaagggaccgcagggagaggtctcgctcaagggaccgccggagggagcgctcacgctcaagggaccgcagaagggagcgctcacgctcaagggaccggaggggcagttcaccccatggcagaaggcatagagatcggtccaggtcacccaccagcaatgggaaccataaggcagactaggaagcgcttttatggacttgtcgttgattgcgtgaacaaaggaacttgtaacactacctataaactggtcagactgagacggttagcatggatttttagtagtgttgctgtattttgttgtttcatacaagtactctattctgttagctttcggatcgaaatgtcggatgatgatggttgttattgttctggaaatcgtagacatgtcctccagaatacctatgaaactatggcatactcgtgtgtttgcttaaggttgccgtcggctgcgccgaccgcaacgttgacacgttgcacggtagatggatgcctctgttcaatctcgggtggtctccggactatttttagtccctccattttatttcactatagtctataaattgcaaaatatggaaactataactctattttatttttcatatttgacaatttagtgactaaagtggaataaattggagggactaaaaattagtctctaaaaccaaacacccctaagttgcctaagttttcaatgtttcattagccatcagtaggctcgagtcatgcggcagaggcgatccgtagtactacttgcatacttattggaccaggaaggaaatgttacgtgcgttacggttgaatttccagtcaaactcggaccaactttccagggtcagaatcaaacgggcgtactgtttgtactcgaggattccattatacaatggcacactcatgccgtgaaaaccatggaaactgcccacaagcgatatgtcaaaca

SEQ ID NO: 18589 - DNA, 3463 bp, Zea mays
gaacatcatccctatgtattgtatggaattggaccacaattccaaactgtaattcaatgacatacaaacaatagaattaaaattacatctcatttttaatatcatgattggtttagtattaaaaccaattcaattccataacttctaatatcgacatcaaatgagtattattattattttccttcatcatcttttccacgttaggtcttgttctgttatttttaatccatatagattagagaggattgatacagattaggagaacttttgacttactaggaattgaaatctactcaatccttctcaatacatatggattgatgtagaaccagccttagactgactccaacagaggccatgcaaatcgagcagccattcaagcctttggctagcgtctctggtttgcctgtccagccatatagcacacgctttcaacagcacaggcaaaaagacagcaatagtatattccaacaaatagagcatatggttgggtcatgttctcagacacagaaaaaggaaatgactgtcagctacagtaaagctattatggatttcctctctccttccattcttttgcctggctcgtttggctggtctattagaaggtgttttgtactactaaagtagctcgtgagcagcttttttagctttgccctatctatttagctcctctgttggagtccgtcttagacgccgtcacagctaacagctgaaggcctgaagcaccctcactttccccactccggagctgcacgggcacgcacgcagtttatccaacgccactgggcctcaacaacaacaatctcccaacgccgccgcttccgccgcatcaagcgctagaactaggaacccctcccaaaggatctcaagaagacaaggacaccgtcgagtcgccgccagtcgctcgatggggtgcgggcagtcaaagatcgatcaggaggaggcggtgtttcgatgccgggagcggaagcgtgctgatggctgacgccgtggcctcgcggaacggttttgccgccgcccacactggctacactgtccgcctgaagagcaccggcggcgcgctatccgatttcgcccaaggcgaggcgccggaccctagcctggtgtcctcccatacccaccacgctccggctgtggcgacgtcatctgtctcgactccgccaggcccctccgcagcttccgtcaacagcccctccccgccgccgccgccattcgccgacttctctcattctagcctccaaagatcctcatccacccccaacattcctatgccggagccgagggccgcagccaaaaaccgccctcctgccgatgcttctatccgagaggaggatgaggatgaggatgaggaggaacaggatggacatatcaagatcgatagcgatgacgacagtgacgacgacagtgacgaagacgacgatcaccatgagcatgacgatgttagtgtggatgacatggtgcatggacaacaatcaaagcggattttgatgagtagtgtgggatcttctccagtaacaccacctccgcctccaaggttgaaccacaccccaccaacgcttgccacagcaacgccaccgcccccggtgctggagtcacagatggctacctgggactacatctttggcccaactcccaccccaccacccaccctagagcagcctgctgctgatactttgtggatggaaaggcgtgataaggagccagtggctgaggtgaaggcacctgtggcaaaaacagttgttagtaagccagctgctactgaggaaaggccaccagagacggccgtagagaaggataaagcaattgaggagatgatggctaatctaccgccatcaaaacctattgtgaggaagccacccaaagcacctggcccatcacaagaagcagcacactaccagcatgcctcttcgatgggtgcagttgaaattcggaaggggaaggtaatggtggcatcaggaactgccagcttgctacagattgttacacggcttgatgataactttcttagagcttcagagagtgcgcatgatgtgtcaaaaaaactggaggccacccggatgcattatcactccaaccatgctgacagccgaggacatatcgaccactctacaaaaattatgcacgttatcacatggaaccgctccttcaagaacttacctgaccatgaggacctgaacgataattttgagattgatgatagatttgaaactcatgctgcagttctagatagaatgcttgcttgggagaaaaaactgtatgacgaagtgaaggctggggagcttatgaaaaccgattatcagaagaaggtgtctctattgcagaagcaaaagaaacggggtgttaaacttgaaaccttggagaagacaaaagctgctgttagccaattgcacacaaggtacattgtagacatgcaatccatggattcaacagtttcagaaataaatcggcttcgggatagacagttattcccaaagttaatggaccttgttgatggaatggccaagatgtggagttctatgtaccgccatcatagaagtcagttcctgatcatttctggaataagaggtttcgagattcctcctattccaagggagacaactgattctcattacatccagacttgtgagctacgtgacattgttagggagtggcatacgcagtttgagaaattgatggacaatcagaaagcatacatcagagcactcaatgcatggctgaagctcaatctcatcccaattgagagcaacataaaggagaaggtctcctcccctccaaggctggtggatccacccatcaagcacctgctgcatgcctggcatgacgagctcgaaaggcttccgattgagcttgcaaaaactgccatcaaaacctttgctgaagtcataagcactatcgtgcatcttcaggaagaggaagtaaacctaaggaggcggtgtgatgaaactcgtagggatctgaaccgaaagaaggcacagtttgaggactggcatcaaaagtacttggagagacagacagcagaaactcaaaacatagatcctgtcgaggataggaaacgcaccatcgaggaactagagattcggctgagagaggaggaggggcaccatcttaggcatgccaggcaggtgcgggagaaatcacttgcaaacctccggacacacctgccagaacttttcaggaacatgtccgattttgcttacttttgcaaagacatgtacaacaatcttagaaaaactgctgcgctgtccaaagatgaagtctaaggctgatgatatttgtgcgtgtgtatgtatactcgacaagcagtagaatgtttgctggtaacttgtcctgatgccgtctagaatacataatagtcggcattaattatgtttgtaaattggaatggacattccggactccccattgtttatttccatgctatgtactgcattggtgcgtggataaaaaaaaaaaaaaaaaaata

SEQ ID NO: 18590 - DNA, 2649 bp, Zea mays
  misc_feature (2505)..(2505): n is a, c, g, or t
gttgcctcaagaggttaagaacaatgagagcaaaactttccccgttcatctaggataagctcggccttctcttctatttcatgcaaaacctgatgtgcaagagatattcagatactcgacagtgatttagataaaacagcacatacttttgcacaaaggatctctttaaagggaaagacattgctgtttctgtgatcctgtagaaaaactagcatacttctttttaattcccatcagatgattcaaattactttgctctctagatatagaaatgataactgaaaatagagctccaaatgtccacatggtaatttcttatttgccatagcaaaaaaaatcatcttttattttctattaatattttttttcgaaaaacgcaagagaactgcgcctcgttatattaagaagaagaaaccaaggtctaagcagaccagatacaaaacgaccgacttccttacggaggtcgaaaaactaaaaaaccaaaatagtccatctgaggacagcaacaaactactgaagaaaaaacgtcctccgaggctaaacctcgagaaggggggcagacagataggaaagccctttagctccagccatttcccacatccatctttcctccatagccatcctaatggctaaagtcacattaggaatccagttatcaaagacacatctgttgcggtggttccaaataatgtaagcacccaacgcaatcagagaattcagcccctttctaaccagaccactgaccgaagaagaagcttcctcccaccagctcatgaaggaggtcgaaccaaactgaggggcgagcctatgaaggtcgaaagtcctcagaagctgaaaccagaaaatccttgagaaaacacaggaaaccaggagatggtctaaggtttcctcctcttgatcacacagagggcatatcggagggtggtccagccctcttctagctaatctgtcagcggtccagcacctgttgtgcgcaacaagccaaagaaaaatctgcatttaggcggggcccaagtcctcctcaccctggaatagtggctggaaaaggtagatcccatgaagaatccttcgtaagccacttttgctgaatagataccgtctggggcaatactgaaaacatgtttgccttcaatagtaggctgcagcactatcacagacataaggttccaaatctgaaggtaatccaccaaaactcccaccgagagggcccccttaatatctgagatccatcttctatttagcagagcctcttgcacagttctttttgtgatcctcttgggaatacactgaaaaatccttggagcaatatcacgaattctctgccctgagatccatttgtcagtccagaaaagggtgttggcaccattgccaacttctgaaactagaacagtggagaagaaggcccggaccttacacggcacatgaaaagggagctgcgcccaaggacgagttggatcagttttgtgcaaccacagccatctcatccgaagagcccaacacatctcgggcagactggagatgcccaggccaccgagcctgagcgggcgacaaactctcccccaggacacaagacaatgaccacccttggcctctttgcgacctctccaaagaaagccttttctgattttgtcaatggcatcccaggcccaggaagggaaatcgatagccattgctaaatagaccatcataccagtcaaaacatgcttaacctggatccttctacccgctcttgtcaatagatccgccttccagttagggagctgccttgcaattttatccacaaatggttgtacttggtctttagtaagcttgactagggagagaggaagaccaagatactgacagggaaacactgacagcgcacaacgcagcaggttttgagtaaccgtaatatcctccacagagcattggataggatagacactggacttgctttcattattctgaaggcccgaggaggcaccaaacaaatgcaaaatctccaaagctgctagaacatcatccgccaccgggtgcaggaataatgccacatcgtcagcatacatagagacccggtgcaatctctgagatggtgacaaaggttgtaaaagtcttgcatcttctgctctagcaaataacaaacccagaatgtacatggcaagaataaaaagcatgggagacagtgggtctccttgcctaagacccctccgatggataatgcactttccggggaaaccgttaagaagcacttgagtggaacaagaggagagcagcccacagataatatccctccaaatttgaccaaaatcgaggtgtttcatgacatcaataagaaaaggccaagagaccgaatcgaaagccttagtgatatccaacttgaagagaagactgccctttttctgatggtgaaatagccgcgaggtctgttgtaccaacatgaagtcatcctgaataaatctcgcccctttatgaaagcacttttattgggagagaccatctcatgaagccttacagccaatcgattgncaaggattttagtgatgagcttagcaacactataaaccaaactaataggccaaaaatccttaacctgggcagcatcctcctttttagggatcagagtgatgtatgctgaattgagtttgccaaaagttgttgaattttctgccc

SEQ ID NO: 18591 - DNA, 1618 bp, Zea mays
cattgggaccctcgaggccggccgggaaaattatggtcacaccctaatacattccctcgctcgcggccttgtacagcatactgtccttgcggcgctgctggctccgccgggtgttgggtcaacgttctcccgtccccccgagcgcagtctcgcgtggttctcccgtcccccgaggcccgagcgtagtctctctcttttgccgtggttctccagtcctccctcatccgctctctttctttctctcgtggcgagtggtaacgacgtcaggtgctcaggtcttgttcaggcccttcgccggcgacgagcacacagcaaatggatacaggagctcaagctatgttcatcatcagtcttgtgctctggtgtactacaagctttgccttggatgatgctgctgctacaaggattccaattgtgggcacattacctctgtcaatgaaagaaaatccgcaattatgccaactttgtgaggagtttgcatcagaggccctcttctatttaaatgaaaatgagacccagactgaaatcattgatacactacaccaagcttgttcaaagtttggctcttttaagctggagtgcacgaggttggtggattattatgtccctcttttcttcacaaaaattgcttcattaagccctgaagaattttgtgcatcagcaagtttttgtggggaggtaacattcattcgtcttccaagacatgaagatacttgcaccctttgccatgaggttgtcgatgaggttgttactaatcttgaagatccaggcatggagcttaagataattgagatacttctgaaaggatgcaataatgcagaggattatgtacaaaagtgcaagaggttgataatccaaaatgcacctatcataatggagaatattaagaagttcctcgagaagagagatttttgcaattctatccatgtctgtggaagtaaatccgttcgcgctggatcacaagtcctcagaagcctttcttcagcctgaagccctgaacttgcacggattgttatgatcatgcaacagatattagtgtaaaaacaagtccaggcgccgctatgtgagtcccgtgtgacatcgactgtacagatttggctgtgtacatgttaaaggaaaacacaactgaggcacaaacctcttctgtttacgggtcatgagcagggtgtgtatttgaactgtatatcattataccttggattggatgtcatgttgctctatatttatacgtaaccgagttttgtaactttggagaagtaatgtatatgatgccaaagcttgatcttccatgaatttatgcgtctagagcttcatgaatttatttataatcagagggtgttagacaaaactgattgttagggggatctgataaaacatcttgggatggattcttaagactctgaaatgtgtctataactctacgccctcccataaaaaaatgggcctcaatggatctgttcgagaaaaaaaaagagcaggcaaagaaggcctaaccaaatccaagacatgttttcagaacttacattacatacagtgggattcaacgaaagaaaaagctgaatatatatgatgtcctaatgctagctgtaataaaaaaaaacgggctgctaccaaggta

SEQ ID NO: 18592 - DNA, 1359 bp, Zea mays
ggccggccgggccgggcatgcttgtcctgcgcaggcaggcaggttccttcctgctcacctcacctcactccaccgacaatttcctttgccttctttcgccgttcatatactccgccgcttctactagtggtatcgtaggttaaggccaccccaagcaggagtctgcttccgttccattgcatcccagtcccagccaaagcaggatgccgcacgccaagacggactcggaggtgacgagcctggcgccgtcgtcgcctccgcggtcgcctccacggacccgcggcgccgtctactacgtgcagagcccgtcccgcgactcgcacgacggcgagacgatcaaggcggccacgtctgtgcactccacccccgcgctgagccccatggcgtcgccgcgccactcgcactcccactcccactcgtccatgggcagggactcctcctccagccgattctcgggccacggccacaacaagcgcaaggccgacaagggcggcagcaacaagggcgcgccgggcggcaaggggtggcaggagatcggcgtcatcgaggaggaagggctcatggacgaggaggaccacacgcggatcgtgccccgcaagtgctactgcttcctcgccttcctgctcggcttcgtcgcgctcttctccttcttcgcgctcgtgctctggggcgccagcaggtcccagaagccgcgcatcgtcatgggcaccatccgcttcgacaacttcatcatccaggccggcaccgacgcgtcgctcgtgcccaccgacatggccaccaccaactccaccgtcagattcacctaccgcaacaggggcaccttcttcgggatccacgtcaccgccgacccgttccagctctcctacagccagctcacgctcgcgtcaggagacctccacaacttctaccagcctcgcagcagcagccgcaccgtcagcgtcgccgtggtcggcaacaaggtgccgctgtacggcggcggacccacgctgacggcggcgccggcggccgggggcaaggggcagcagcaggccagcgccaaggtggcatcggtgcccatggtgctgaggaccacgctgcactcgcgggcctacgtgctgggcgcgctggtcaagcccaagttcacgctcgccgtcgagtgcagggtgctcatgaacccaaacaagcagaacaagcccatctcgctcgggaacgcctgccactactcatgatatatttagcctctcatactagctgctcaacatcaccatgcccatgcatccatctcctacctacctctcaattgtactgtaatggagtatttattgatttatttatgctttgcttcgtcttcaaaaaaaaaaaaaaaaaaaggcccctcct

SEQ ID NO: 18593 - DNA, 5365 bp, Zea mays
  misc_feature (38)..(38): n is a, c, g, or t
  misc_feature (1873)..(1873): n is a, c, g, or t
ccgtttttcttcacagttcacaccacaatctctttccntctgggctgtctggctggcctgtgccgtcgcctttccggtgcaaaagattttgttggccttgggaagcgcggagcgtgttttcctccctccgttccggtggggggtggcaactggcaacgcaaaagcctgactccaatcccattgctgctggaaagcacaaagcagcgatggtaagagtgccgttgctgtcgggcgacagagtggccgccgacgctcctttccgtgtagtttaggactgcagattccttcgcgctcctcctgctcccagcgaggaaaagagagcacgaactaaactaggaaccatccctccccggcattcattcccttgccctttttttcaccgaattgtagcggttgttgctttcctgttcaggtgccttgttcttggcctccttcgcacgcaaagaaccgccggtcgtattgctctccgcactcacccaccgcgctgctgctgctcgactgctcgtggaagggttcttattggccgcctgtgcctgctttgcggtttcttgctctgcttttgagtggagccgctgtggagtggacggtgtggtgtgggtcggcggtgaggtgaaaggcttggtttctttctttcttgcgagggaggataagggaaagggaaggcgaagaggaggatggccggaggaggggcggcgccgccgccgaagcaggaggagctgcagccgcacccggtgaaggaccagcttcccagcgtgtcctactgcatcacaagcccaccgccctggcgtacgtctctttcaatatcactcacctcacctgggattgggacctctcgattccaatgctggagtagaactactctgtgtactgacgttgatgtttttccacatggtcgctgtgttgatactgatagtggtcctgatttctacagtactaggttatttttgacttgtttcctgtcgcctgaccttgaacatgcagctgaggctgtcatccttggattccagcactacattgtgatgctgggcacatccgtcatcataccaagtgctcttgttccccagatgggaggaggaaacgtgagtaaaccaatcacctctacgtgttctgaatccaagatttgatagccatctagtctgtgaactgaattgtgatgccaataaagctcaactatctattgctgtgcacctcctttctgtctgctgctaggaggagaaggccagggtgattcagacgctgctgttcgttgccggcatcaacaccctatgccagtcattctttgggactcgcctcccagcggtgatgggtggatcctacaccatcgtcgcacccaccatttccatcatcatggccggccgttacagcaacgaagcagaccctcgtgaggtagtcgagttctccggtaacttacctccatcgtcacggcctctgttccagtttcttggttacagttcacaaggcgctgctcactcgtgtgcagaaattcttgcggaccatgcgaggaacacaaggcgctctcatcatcgcgtcgacaattcagatcgtgcttggtttcagtggcctttggcgcaatgtcgttaagtagggatcttggctctagctttcaccttctgcttaaacatggtacccttgtagaatttcagtttgtgcgtttacagagttctcacctctgccacagattgctgagcccattgtctgctgtacctttggtttcgctagctggatttgggctatatgagctaggttttccaggggtatgcattatcatcatgctactgattcagtatctgccacattgtttctttctttttttaattgttcctgttcctactgactctaagattcgtttggcttcaggttgctaagtgtgtgnaaattgggcttccggaaatcatcctaatgctcatattttctcaggtatagtatagagtacattgtatcatacataggagtacatctgaactcatgtgctaatgtatctgtcttgtgcgcagtacttacctcatgctgtccatgcggcaaagcctgtgttcgaccggttttctgtgattttcacaattgcgattgtatggctgtatgcgtacattctcacggttagcggtgcctacaagagtgcccgaacaaagacacaactccattgccgtgttgaccgctctgggcttgttggtggagctccttggtaaggagttcgttgcaatcgcattgcctcttgcttttgatccttgtcttttgtataatttcttacagaatagaggtacctccatcagttcttggctgtggctgtaacatttttgtgtaccgacaataattatgtttttgtaggattagtgtcccatatcctttccaatggggggccccaacatttgatgctggtgaatcatttgcaatgatggtggccgcatttgttgctcttgttgaggtttgcttgcgcagctttacccaaaactgaaaaaatgagtgtgccataattaatagtgttctaataagcagtttgctaccctttcagtcatctggggccttcattgctgtgtcaagatatgcaagcgcgactatgatacctccttcagttcttggtcgtggcattggttggcaggtaactgacttgttgatttttcgtcagccaaagacatcattttgttactttttccatggccataacttggtctcatcgtttggaattctgcagggcgtcggtgcggttcgcggggcgttttttgggacagctaatggaactgcagtgtcagtgtaagtgtaatagtgaaaccagcactggttgcttggggtactgcttttctctaataatttgttttgatatttgcagtgagaatgctggtctgcttgctttgacacatgttggcagccggagagtagtccagatatctgcaggcttcatgatcttcttctctgtccttggtaacgcacaactcttttgtttctgactttgggtatattttcagtgttgaacaaaagcgatcactagtaaggcacagagttcctgaattcgagtttcatggctaactgcctgtaaatttgtaatttgacttccaacactatttatagggttgctttagtgtttaacatgatttagatactgtcgatcatgccttctttattttatggcatctgcaattgttaggctgaccatattcattttgctaaatcagggaaattcggggcgatctttgcttcaatcccactgccgatattcgctgccctgtattgcattctctttgcatacattggtaagtccttgtaccttatctttcagaagagtcctctggtctgctccctttcatgtacatgtattgattcttgggtctgcaggtgcttgtggcctgagcttccttcagttctgcaacctgaacagcttcaggaccaagttcatcatggggttctccttgttcatgggcctgtcagtaccccaatacttcaacgagtacacgtccgtggctggctatggccccgtgcacaccggcgcccgatgggtacgtgaattggagctagctctgcatgtcattcttctgcactgcaaatgagacttgtaacggctgttcactcatcattggctttggatgtcggcagttcaacgacatgatcaacgtgcccttctcgtcgaagccgttcgtggctgtgctggtggccttcttactggacaacacgatccaggtgcgtgacagcggcgtgaggagggacaggggctaccactggtgggacaagttccggagcttcaagacggacagccgcagcgaggagttctactcgctgcccttcaacctcaacaagtttttcccttccgtctgatcctgcagggtctgcacactcttcctcgcagccgcagtagccctgactggagtcaggcaagaaatgatcctatgcagatgatgctggagcatggactgatggcgttttgtacattcaggggtgaactgaactgtgcaggttgcaggggatagtgctctgggtagcatcagtattccctagtaaccgaaattgaaaaggccgcctgttaaacttctgcaaacactagcatgattacgtctcctagtgctactgttgtttagattggaaaacatggaactcaaccgtaagcatagatttaccttgaagcaacccttttcttttgcttagaaataatttgtgttggggattttttttcaccatgtaagaactgagagcacttagattagaggggagggtgaataggtgagcctccaaaaaatactttaaataatacaaacttggtctaataaaaccgttattgaggactaaaaccaaatttgaatgagaagagtagaggaagatgaactattcacttgattgctctcttaagatgagtattaaatttgaagcaatacggcaagtgaatttgagcactaaagaagataacaattgcaataaagtagataagaaacacgacgatttttcccatggtttggtcaagacctacctccacgttgtggtgaccttctttggtcaaaggttgcactcaacacaagtgatccaaaaattaaacttgagtgccacaattatcttccttatatcttgatcccatttgtatggaatctccataaggagtctctcacgtcttatacaaaatgattacaatcaaaatcaaagtaagagatggagtaagaatatgcacacaagagcataatgtagcaatgcacgcacaaaaggcaaagacaagagcacaagaacaaagcgatagagttccagctcagaaatagcgctcaaatctctctcaaatcactggacagcgtggttgcggagtctcggaattgtagtgtgcacttgagatgcttgggtgtaggtagagggcgcattggggctccttttatagccctaaggagtctaggagctgttagcttctcaacaagaaaacccaaaactttccctgtctacgggtgcaccgaactgtccggtagtgtgccacttgacagtccgttgtgccaccttaaatccgatcagcaacggtcggacgacaatctaattggtcgacctcctttttcggcgtgacataggacagttcggtgccccacccgacagctgacacgtcagctagccgttgtagtgtgggaagggagccgttggtgccgatgtccggtgcacaatacaatgcactattcactgtccggtgaattttataattaagattatcgagagcagtgagttcgcccgtatgcagcatcgaacaatccaaacttctccaacttcttttagctcttctttagagattccttaacacttagaataacataacaactaaaacaattggctaagtggtagaaccatacctttttcacttttcttcaaaaagaatttgcaatatgcttgtaaataagtccaaaagcacttctttcaaaac

SEQ ID NO: 18594 - DNA, 2555 bp, Zea mays
gcacgagcctgactccaatcccattgctgctggaaagcacaaagcagcgatggtaaaagaggatgaaggccatggcgacagagtggccgccgacgctcctttccgtgtagtttaggactgcagattccttcgcgctcctcctgctcccagcgaggaaaagagagcacgaactaaactaggaaccatccctccccggcattcattcccttgccctttttttcaccgaattgtagcggttgttgctttcctgttcaggtgccttgttcttggcctccttcgcacgcaaagaaccgccggtcgtattgctctccgcactcacccaccgcgctgctgctgctcgactgctcgtggaagggttcttattggccgcctgtgcctgctttgcggtttcttgctctgcttttgagtggagccgctgtggagtggacggtgtggtgtgggtcggcggtgaggtgaaaggcttggtttctttctttcttgcgagccacgcgtccggaaagggaaggcgaggaggaggatggccggaggaggggcggcgacgccgccgaagcaggaggagctgcagccacacccggtgaaggaccagcttcccagcgtgtcctactgcatcacaagcccaccgccctggcctgaggctgtcatccttggattccagcactacattgtgatgctgggcacatccgtcatcataccaagtgctcttgttccccagatgggaggaggaaacgaggagaaggcccgggtgattcagacgctgctgttcgttgccggcatcaacaccctatgccagtcattctttgggactcgcctcccagcggtgatgggtggatcctacaccatcgtcgcacccaccatttccatcatcatggccggccgttacagcaacgaagcagaccctcgtgagaaattcttgcggaccatgcgaggaacacaaggcgctctcatcatcgcgtcgacaattcagatcgtgcttggtttcagtggcctttggcgcaatgtcgttaaattgctgagcccattgtctgctgtacctttggtttcgctagctggatttgggctatatgagctaggttttccaggggttgctaagtgtgtggaaattgggcttccggaaatcatcctaatgctcatattttctcagtacttacctcatgctgtccatgcggcaaagcctgtgttcgaccggttttctgtgattttcacaattgcgattgtatggctgtatgcgtacattctcacggttagcggtgcctacaagagtgcccgaacaaagacacaactccattgccgtgttgaccgctctgggcttgttggtggagctccttggattagtgtcccatatcctttccaatggggggccccaacatttgatgctggtgaatcatttgcaatgatggtggccgcatttgttgctcttgttgagtcatctggggccttcattgctgtgtcaagatatgcaagcgcgactatgatacctccttcagttcttggtcgtggcattggttggcagggcatcggtactttactgggtgcgttttttgggacagctaatggaactgcagtgtcagttgagaatgctggtctgcttgctttgacacatgttggcagccggagagtagtccagatatctgcaggcttcatgatcttcttctctgtccttgggaaattcggggcgatctttgcttcaatcccactgccgatattcgctgccctgtattgcattctctttgcatacattggtgcttgtggcctgagcttccttcagttctgcaacctgaacagcttcaggaccaagttcatcatggggttctccttgttcatgggcctgtcagtaccccaatacttcaacgagtacacgtccgtggctggctatggccccgtgcacaccggcgcccgatggttcaacgacatgatcaacgtgcccttctcgtcgaagccgttcgtggctgtgctggtggccttcttactggacaacacgatccaggtgcgtgacagcggcgtgaggagggacaggggctaccactggtgggacaagttccggagcttcaagacggacagccgcagcgaggagttctactcgctgcccttcaacctcaacaagtttttcccttccgtctgatcctgcagggtctgcacactcttcctcgcagccgcagtagccctgactggagtcaggcaagaaatgatcctatgcagatgatgctggagcatggactgatggcgttttgtacattcaggggtgaactgaactgtgcaggttgcaggggatagtgctctgggtagcatcagtattccctagtaaccgaaattgaaaaggccgcctgttaaacttctgcaaacactagcatgattacgtctcctagtgctactgttgtttagattggaaaacatggaactcaaccgtaagcatagatttaccttgaagcaacccttttcttttgcttagaaagaatttgtgttggggatttttttttcaccatgtaagaactgagagcacttagattacaagggagggtgaataggtgatcctgcaaaaaaaaaaaaaaaaaaaaaag

SEQ ID NO: 18595 - DNA, 684 bp, Zea mays
ccgcaaatcggcgctcggcttccgtcctttccgtgcctccgccgatccgccgcaaccgcgtcgtccgtccccccgttcggtcgccgccctctttcccgcctcccttctcggcctccgtcctcctccgcgtccgcggcctcctcctcgtgcttcatgtctgcgctcttcaacttccactcgtttgtgacggtggtgctgctgctgatctgcacttgcacgtacctcaagatgcacttcccctccctcctaatccgccggacagggttccgtggtttcttttggaaggctgctaggataggtgaacgccttagcccctgggtagccattgggtgctctgtgatgggcatatcaattttattttggtgaaattggaagatttgtatggccttctttgctgacgattactccattaagagaagcatcagaattttgcagttacagtctgattctttgagatgtcgtatgcttgtaatcttgtagctgtggtgtattattgtgctatgttatgcattttgactattgggcaccatcatgttatgttgtttcattgtattgtcagcatggttgcttatctcgcttccttattcaggtaacccgttattttattttattgtttgatgtataagaagcacttgtagcaagcttttgatttaaaaaaaaaaaaaaaaaaaaaaaaaaaaaaaa

SEQ ID NO: 18596 - DNA, 639 bp, Zea mays
cattgggagaccggtcgctcgtcggccccggactagatcaccaactggaaaaaataacacgcacgcaagaggagaaaacaatccgcaaatcggcgctcggcttccgtcctttccgtgcctccgccgatccgccgcaaccgcgtcgtccgtccccccgttcggtcgccgccctctttcccgcctcccttctcggcctccgtcctcctccgcgtccgcggcctcctcctcgtgcttcatgtctgcgctcttcaacttccactcgtttgtgacggtggtgctgctgcttatctgcacttgcacgtacctcaagatgcacttcccctccctcctaatccgccggacagggttccgtggtttcttttggaaggctgctaggataggtgaacgccttagcccctgggtagccattgggtgctctgtgatgggcatatcaattttattttggtgaaattggaagatttgtatggccttctttgctgacgattactccattgtaagatagcccgttacttgcttctttcataagcatgtaagaaactgcacactccttaatagtccttttatcacatttcagaagagaagcatcagaattttgcagttacaggctgattccgtgagatgtcgtatgcttgcggcctt

SEQ ID NO: 18597 - DNA, 1997 bp, Zea mays
cgggcacaaggaatatcagcactgcaaacctcatcaccttctcttatttcacaagaagcaaatatgggaaatgataatgtgcaagaacacaagccggtaccctccccggtccgccggccgattcggcctggtggtcatggcagcctcctcaacaatctgtcacaggttcggttgatgaactcaacttctttaggaggaggagctacctcgatgggactgcctaacatgggagcaacaccaatacaagtccacatgtcaaacatgatatcaagcggcatgacatcaacaccctctgtcatctcctctatgtctggacctggacaacctattagtactcaacagatggtacagagcacagctcttggttcctttggctcaaacactcctactgttacaggcaattcaactattgctgtatcatcctctttgactaacaaccaaagcagcatgggcatgggtcaatcagtgcaatctgtggcacagggaggcttggtgtctggttcacaattaggacaaggtggaattgttgcaaaccaaaatgtgatgagcacccttggacctacagctatctcttcaacgcctgcgatgatgccgacacctgggatggtcccacagacaggagtcaattccttaggtgtgaataacaattctgctatgaatatgcctattacgcagcagcatgccaatgcccaacagccgccaccaaagtacgtcaaaatttgggagggaactttatctggccaaaggcaaggacagcctgtaataatttgtaaactcgaaggttataggagtggaacagcgtctgaaacacttgcagcggactggccagaaacaatgcagattgttcgcctcatagcccaggagcatatgaacaacaaacaatatgttggcaaggcagactttctagtttttcggactttaaatcaccatgggtttcttgtacaactacaagagaagaagctgtgtgctttgatacagttaccatcgcaaactctgttgctgtcgatggctgacaaagcaggtcgtttgattggcatgctcttccctggggacatggtggtgttcaaaccgcaggcctcaactcagcagcagctgcaacaacacatgcatatgcagccgcaaggcctcccacttcagcaatcacagatgcaactccagcaacagcagccgcagatgcaaccgatgcagcagcagcaaccttcacagatgcagcagcagcaaccttcgcagatgcagcagcagatgcaatcgatgcagcagcagatgcagccaatgcagcagcagatgcagcatcaacagcaacagatgcagcatcaacagcaacagatgcagcaaatgcagcagcagcagcagcaacaacagatgcagcctcagcagcaacagatgcagcaaatgcagcagcagcagcagcaaatgcagcctcagcagcaacagatgcagcaaatgcagcagcagcagcagcaaatgcagcctcaacagcaacagatgcagcaaatgcagcagcagcagcaacagatgcagcctcaacagcagcagcaaccccagatggtgggtacaggaatggggcagcagttcatgcaggggcacaatcgggcagtgcagatgatgcaagggaagattacgccacaggggccgggcagcatgcctgggggaggcttcctaccttaagcaccttttatcagcaggcatcagatgaattgagggtttacactgaccaagtgtcgagatgtcaacttcatttgacagggttaggaatagtcactcggggagtgttgctaaaacttaatctgaaaacttaagcatccctgtcaccgataggtaaatgccagatgtccatgcataggtgcatactttatgatatggtggtgtactcgtaatcttgagtgactttatggcattgttgtactagccgtaaactattaggtataacagaattattatttaaactacagtaaacaaaaaaaaaaaaaaaaaaaaaaaaggggggtttagggttt

SEQ ID NO: 18598 - DNA, 753 bp, Zea mays
  misc_feature (743)..(743): n is a, c, g, or t
attgggttgcggcatccattccatccgcgttcctattcgcaaccgccgtcgctttcgcccggtcggcccacccaatcccgtccctatcgctctccatcgtctctctcccatcagcacgcagctgtacccgtacgcaactgcgacaggtccacatcgcggcggcccactcacccccccagcgccccagcgactgccgactgctgttccatggcggacggcgacggcgcggcggcgacggggaagctcgcggagctccccagcggcgtcgagaaggggctccccaggaggggcaaggcttcttctgggaggacattaaacaccgcacaaattccgcttgttgcgagccatccagatgtgtatgagccatgtgatgattcctttgcccttgttgatgcactactctcagacaaggcacaactcttgacactacagccaaggttatgtatggaggtagggtctggtagtggttatgtcatcacctcgcttgcaatcatgctcaggcagttaggctctggagcccagtacctagcaactgacatcaaccaacatgctgccgagacaactcaagcgacccttgaagctcatggggtgcatgcagatgtgattgttactgacatcatgtctggtcttgataaacgccttgctgggatggttgatgtggcaggtgttaaccccccttatgtgccaaccactgtggaagaagtcgatgtagaggcttgctttcgtcctgggcaggcggtttnaatggcccca

SEQ ID NO: 18599 - DNA, 1477 bp, Zea mays
cggaccacactagaactagggccccccctgcccccccgcgacgctacgccccaccccgccccgtcccgcccggaccggacccaccttcctccatctctctgcccgccgccggccgacccgaatgggggcgggaaccaataatggcctgagcaacggcgccgccgcaggggagcgcgcggacgacgggaccacggtgttccggggcacggcgtactcgccgctacggaccacggtggcgctcgcgctgtggctcggggccatccacttcaacgccttcctcgtcctcgcctcgctcttcctcttcccgcgccgcgtcgccgcactggtgctggcgacgcagctcttcttcatgttcctgccgctcagtgataagagcagactgggccgcaagatcgccaggttcataagcaagtacgtcattgggtattttcccgtcactttgcacgtggaagactatggcgcctttgatcccaacagagcttatgtgttcggttatgagcctcattctgttttgcccatagctgttgggatcctcggggaccttgttggattcatgccgctaccaaagatgaagattcttgcaagcagtgcggtgttctacaccccgttcctaaggcaaatatggacatggttggggttggctcctgcgtcgagaaagagtttctactcctaccttggagctggttatagctgtattatagtgccaggaggtgtgcaggaaatacttcatatggatcatgattcagaggttgcttttcttaaaccaagaaaaggttttgttaagatagctattgagatgggttgccctgtagtccccgtttttgctttcggacagagctatgtttacaaatggtggaggccaggtggcaagttaattgtcaagattgctagagcaatcaaattttctccaataatcttctggggaaaactggggactcccatcccttttgcaacaccaatgcatgtgattgttggaaggccaattgaggttgtaaagaatcctcaacctaccattgatgagataaaccaagtccacggacagttcgttgttgcgatgcaagatctgttcgagaaatacaagagcagaactggataccctgatcttcagttaagagttctttgatggcgtgctgttccaatgaaaagctcttatcagctaggtttaagggataaaatggctgttcagacccatcgactcaattgatcgtagcatttgggctataatgtttttgggcacaggtccattattgaaattctgtaccccattccaaattagaagacgtttttttaatatgtagcttttctatgcagttgcatacatactatgtctaaaaatataaaaaaatatatgtctagaaagggaatatatcatctgtaaagcaagcagtcatgataattttttaaaacaacccttctatcgtactcagcgaaaaaaaaaaaaaaaaaaaaaaaaagtcgacgcggccgcgaattccag

SEQ ID NO: 18600 - DNA, 1673 bp, Zea mays
ccggccgggacccatatgaaccaattgacctcctcctgatcgtcgtgggccagcgctgggctgacgcccgtgcaccggtcggtttctgttcggttcggcagcagggtgcgctcggtcagatttttagtcccatcggctcggatccgcccgcccgccgtgcgcgcgtgcacgcacgcacgcctcgcgagcagatggggctggcagtggcggtgggcaggcggccgacgcagcggtccggtgtctcccgttctcgctgcgctggcaagagacccactgccgccgagccccgacaccaccggcaccgcacggagggaagaaaagaaagaaatcccgggggatcacgtcgttatcagcgaccagattcagacgcgagccgagcgggggaggcggaccacactagaactagaaccctctctacggctctactacgctacgccccatcccgcccggaccggaccggacccaccttcctccacctctctgcccgccgccggccgacccgaatgggggcgggaaccaataatggcctgagcaacggcgccgccgcagggcagcgcgcggacgacgggaccacggtgttccggggcacggcgtactcgccgctacggaccacggtggcgctcgcgctgtggctcggggccatccacttcaacgccttcctcgtcctcgcctcgctcttcctcttcccgcgccgcgtcgccgcactggtgctggcgacgcagctcttcttcatgttcctgccgctcagtgataagagcagactgggccgcaagatcgccaggttcataagcaagtacgtcattgggtattttcccgtcactttgcacgtggaagactatggcgcctttgatcccaacagggcttatgtgttcggttatgagcctcattctgttttgcccatagctgttgggatcctcggggaccttgttggattcatgccgctaccaaagatgaagattcttgcaagcagtgcggtgttctacaccccgttcctaaggcaaatatggacatgggttggggttggctcctgcgtcgagaaagagtttctactcctaccttggagctggttatagctgtattatagtgccaggaggtgtgcaggaaatacttcatatggatcatgattcagaggttgcttttcttaaaccaagaaaaggttttgttaagatagctaattgagatgggttgccctgtagtccccgtttttgctttcggacagagctatgtttacaaatggtggaggccaggtggcaagttaattgtcaagattgctagagcaatcaaattttctccaataatcttctggggaaaactggggactcccatcccttttgcaacaccaatgcatgtgattgttggaaggccaattgaggttgtaaagaatcctcaacctaccattgatgagataaaccaagtccacggacagttcgttgttgcgatgcaagatctgttcgagaaatacaagagcagaactggataccctgatcttcagttaagagttctttgatggcgtgctgttccaatgaaaagctcttatcagctaggtttaagggataaaatggctgttcagacccatcgactcaattgatcgtagcatttgggctataatgtttttgagcacaggtccattattgaaattctgtaccccattccaaattagaagacgttttttt

SEQ ID NO: 18601 - DNA, 868 bp, Zea mays
cggcgcccggtcgccgtccgtggcctataaaaagcccgtttctgctccaaccccggccccccaccgaatcacaagtcacaactcacaagctagcgatcttcctcgtgcaatcgaagcgagttctcagagctgtctacggaactctgaagctcaacgcagcgttcgcttctgaattcgacccgaagcacagcctcgctcaaggcaataaaagccggtgttactgttgccgcgccatggagccggagatggaggcggcgctgatcaaggtcgggatgttcgtgctggtgcaggcactggtgtacctcatcctgtcgcagtcctccaccgtgttctcgcgcaccaagagccttgccctccgccccgcgcggtcgctcagcgcgcgccgcatgctcgcgctgctctccgacctgccgctcgtcgccggggagccctcgcccgtcgccgccttcgcccggacgcggtccgcgttgtcgcccatgctcgccgccgccggccggaagcaggactgagttcggcgaccgtcgtgtggccacttagctataagctagctcttcctcggtagtacagtattctttaattctttggtttgatcgatccatgtgtgtcggtttggtttggtttggtttggttgtattcaagtatagcttccaaatttcatggaagtttgatttgcgcatcttgtgctgagcctgtacctgcatcatcgcagactattcaaatcgtttttatacgctgtggacatttgttaaggatatctcgtcaaatatgtaacttcgacagtatgctgaatgtgactactcggtgctgatacgatatgaagcaaaaaagtccacatttggttcgcacgggatcttgtgtctatttggca

SEQ ID NO: 18602 - DNA, 1098 bp, Zea mays
cggacgcgtgggattgatgatcttggtgctccgagcatgagaagcacagtggggtgtagtcgattgcccccggctcccgttcgcgtgcagatgagagcacgagactctgcagcttattacagctgtgacgatcactttgttgtggtggacaaaacagttgactatggtcgaggaggatcaccgtcagataaaagcagtgcttcagaagtaagaactcatgttcggccactggatgctagcacagcagcccacgtggcaggtccctcaagtaacaggcgagctacagttgtgcctgaagaggtttcagatgaaggagtgttccgtcgctttgtcagactacttctggccttcattgtcaaagtctttgccttctttcacatagtacgtagtcagcaggaaacgagggtcaacaacctactacctcctgccgaaccagaactgatttctgacgatcatccggcagtagagactttcaatgtagaccacatcagtcctgtcatagagcgccttcagagacttgaagggaaggtcgatgagcttggcagcaagcctccagcgattcctgtggagaaagaacgatccctcttggagtcatgggataggataaaatgcatcgaatctgacctggagcgaacaaagaaggtgctgcaagccactgtgaggaagcaactggaaagcgctgagtccctagaggaagtgattagatcaagcctacctagacgaagattttgtttataacaaggaaccagtactgctgaaatcaagatacatcctgtcgcggagaaaaatatgcacaggaattcgattggtgatgtgatgaaggccgtgcattcagttgtccacattactggcagaaaagatggtgaccacggatagtgaaaaacacggtccacttatttatttttttcttgtgaccctaagaggcctgtgcatttttcatgttaacagaggatgttaggatggatggcattgcaagggctagaaaaataggagatagaaatgtggaaagtggggtggtacccgaacaactgaacaagtgcgcatattgtgatatacaggtccgcgtctatgttatctttgcaaaaaattgtgcgaaaa

SEQ ID NO: 18603 - DNA, 1320 bp, Zea mays
cccgggctctgaatcagtcgattcatctggagaagaagagcttgctattcaaagactagagattgcgaagaatgatctgcaaaacagaattgcaaaagaggctagagggaatgcaattctacaggcgagtttggaaagaagaaaacaagcgctacatgaacgcagattggcttgcgtgctcgcggccgccgggcgccgggaacaactgcaagctgagagggatctgcgagcggcattggaggttggcttgagcatgtcttctggacagttttcaagtgctcgttcgatggacgtgaagacaaaggcagagcttgaggagattgctctcgctgaagctgatgttgcaaggttaaaacagaaggttgcagagcttcacctccaactcaatcaacaacgtcaacaccagtatggctctgtagtggatgcaaatgatcgtcatcaccgcctccctggtcatttctcacagcaaaactttgttcaacaaggatttgatatgaaccttgctttctgcaatcaagagaagcagagaaatgaggagagttcggtggagtcatcacaatggagaaacatcaagcagcatgtgctaccttatggttcttcgaggccactcacacgaaagctttcatttgatgcctcctcaagtgaatcaaggggcacagaaccctcaacaagtatgtcaacagagaacacacctgtgtccatcaacgtcccaaagttggcagagggcattgaatttgggaggcaaccaatggtcacatcctccactttggtagagctaacaactagactagatttcttcaaggagcgaaggtcgcaactgatggaacaacttcatagccttgatttgggacgtggatctgctccgcaaggttttccattcaagccaccctctccttggaaccacccaaggtaggaggatgaccgttcgatttcatgattgtaaattcttcagtagtggttcttttctccccgcctggcgattgcagaaaactgcatatacgagtgtaaatgtattttgctcttcgatatggttttagctttcgtgttgtgcgaggatagctccttaagtgggatgtgtgatatagtcttttctgtataacacgttgtcatggagagatgccttttagacaagtttttccagtgttgtggcggtgtatatgtattttgtgcgacttggcgaagaaattgaataggttgactgcttgtatggccgtttgattcatgcctagggcaaaggacaggatgaggaaaactggggatcaaatgagaacccagcacgagtttataaataattcgggggtaggcttgaggctgtgtttt

SEQ ID NO: 18604 - DNA, 580 bp, Zea mays
aattcgagaaaccatttaaaaaaatgaagaaaatcgtaatacagggataacaccaagaaaaacgaaacaacggacttccaatgagtacagggtataaaatcagaacacaacagggccgaacctttgaccttgacttcgcacaggttcatggttttttgcgcttgcgcctttacttaatacaggtccatgacttcatataccgagaaataaagctgtcaccgaaaacaatgtctaccagacagggatccaaacagctccaatagacgaccatcaccggccactgcactatcatgctcacaaaaagggtttggttcttataatatcaaccatcttacgaagggggttttgccagcagttccgacagtcgttgtttttcttgtttcgatattccaggataaatcttaggaaggttgctaaggaatgatttcgcctctaccatccttccatgtctagagtagccctgcagtattgaattgaaagttttctcatttggcctgcaaccttgggtaaccaaataggggactaaatcaatagctttttcaaacattatggtgggaacatagcttttggtgaaaatatt

SEQ ID NO: 18605 - DNA, 743 bp, Zea mays
accttgctttttgcaatcaagagaagcagagaaatgaggagagttcggtggagtcctcccaatggagaaacctccagcagcatgtgctaccttatggttttttgaggcccctcccccgaaagctttcatttgatgcctcctcaagtgaatcaaggggcccagaaccctcaacaagtatgtcaacagagaacacccctgtgtccatcaacgtcccaaagttggcaaaggggccttgaatttgggaggcaaccaatggtcccatcctcccctttggtagagctaacaactagactagattttttcaaggagcgaaggtcgcaactgatggaacaacttcatagccttgatttgggacgtggatttgctccccaaggttttccattcaagcccccctctccttggaaccccccaaggtaggaggatgcccgttcgatttcatgattgtaaatttttcagtagtggttcttttttccccgcctggcgattgcagaaaactgcatatacgagggtaaatgtattttgctcttcgatatggttttagctttcgtgttgggcgaggaaagccccttaagtgggatgtgtgaaaaagtcttttttgtataacacgttgtcatggaaaaatgccttttagacaagttttttccagtgttgtggcggggtttatgtattttgtgcgcccaaaaaaaaaaaaaaaaaaaaaaaaaaaaaaaaaaaaaaaaaaccgagagaggggggccggtacc

SEQ ID NO: 18606 - DNA, 1097 bp, Zea mays
aaacaagcgctacatgaacgcagattggctttggaacaggatgtctccaggttgcaagaacaactgcaagctgaaagggatctgcgagctgcattggaggttggcttgagcatgtcttctggacagttttcaagtgctcgttcgatggacgtgaagacaaaggcagaacttgaggagattgctctcgctgaagctgatgttgcaaggttaaaacagaaggttgcagagcttcacctccaactcaatcaacaacgtcaacaacaatattggttttgaagtaattccaattgatggtattaaccgcctccctggtcatttttcacagcaaaactttgttcaacaaggatttgatatgaaccttgctttctgcaatcaagagaagcagagaaatgaggagagttcggtggagtcatcacaatggagaaacatcaagcagcatgtgctaccttatggttcttcgaggccactcacacgaaagctttcatttgatgcctcctcaagtgaatcaaggggcacagaaccctcaacaagtatgtcaacagagaacacctctgtgtccatcaacgtcccaaagctggcagagggcattgaatttgggaggcaaccaatggtcacatcctccactttggtagagctaacaactagactagatttcttcaaggagcgaaggtcgcaactgatggaacaacttcatagccttgatttgggacgtggatctgctccgcagggctttccattcaagccaccctctccttggaaccacccgaggtaggaggatgaccgtttgatttcatgattgtaaattcttcagtagtggttcttttctccccgcctggcgattgcagaaaactgcatatacgagtgtaaatgtattttgctcttcgatatggttttagctttcgtgttgtgcgaggatagctccttaagtgggatgtgtgatatagtcttttctgtataacacgttgtcatggagagatgccttttagacaagtttttccagtgttgtggcggtgtatatgtattttgtgcgacttggcgaagaaattgaataggttgactgcttgtatggccgtttattcaaaaaaaaaaaaaaaaaa

SEQ ID NO: 18607 - DNA, 1149 bp, Zea mays
  misc_feature (1093)..(1093): n is a, c, g, or t
ataagaggcacccggagcagcgcacagcaacagagcacacgccgcacaccgccgccgcctccgcagcagcagcagcaatggcgcgcgccggcgctctctgcctggtgctgctctgcctcgtggccgtgcactcagccacggcgcagaagtccacgacagccccggccgccgcgccggccgccgccaccaccccgccggcgaccccgaccaagaagtcgcccgcgcccgccgccgcgccgcccaccaccccggccaccctggccccggccgccgcgccgcccaccacgccggccacccccgcgcccgccgctgcgccgcccactacccctgccaccctggcacccgccgcggcgccgcccaagtccgcccccaaggcgtcccctcccgccccgtcgcccaaggccaaggccaccccgccggtggccgagctgccgcccgccgcctcgcctcccgcccccgcccccgcctccccgcccaccaagcccgccgaggtccccgcgcccgcgccgtccaagaagaagaagaagccctcctcgtcgtccaagaacaagaagaagaagtccaaggccccggctccagcccccgtcgccgaggcacccaccagcaccaagcgctccaaggctaaggcaccttcggccagcgaagccgacgcacccggcccggtcggcgatggcgtggccgccgacaccgcgggtgctggaaggaccgtggcaggcggaatcatggcggccgcgctgggcctcgtggccctgctcgcctaggcacgggcgcgcgcgcgagcgggtggcgcctgcacggccgcaccgcacgccgggacggacgacgacaggaattggtgacgcggatgcagccggtgcgcggcgccgcgctgtattcttggccggtgtagttgtagtgcagtgccactcacgttcggtggcgggtggtacgtgcggtgcggacgtaccaccgtcgcctcggattctttctttctcttctctcttcctttttttttgttttgctgtactatattgcgacccccattgagatgctttattttatatatttattttaaaaaaaaaaaaaaaaactcgagggggggcccggtacttanaaaaaaaaaaaaaaaaaaaaaaaaaaaaaaaaaatataaaataataaataaaataa

SEQ ID NO: 18608 - DNA, 1952 bp, Zea mays
  misc_feature (34)..(34): n is a, c, g, or t
  misc_feature (1948)..(1948): n is a, c, g, or t
caacaaccaaatccttcaaatttttcaaaattgncaccatgtttcatcacaccagcatctagtagtgtgctattttttttttttttttgacatatcaaaattaaaactatcatcatgttttatcaccagcatcaagtagagtgcaaagcagagtacaaataggacagcaaaatcagggcacaatcgaccaactacttattgaggctaaagagacgacgaaggagagcattggtctcatctgctcctttttgcagatcattgatcttttctaactccttagcccttgcttcttctgattcttctaccttcttctttagggtatctaactgagctctaacttctaatgagttttgcttctctgattcaagttcagcctcaagttctgccacacatgtaggatcaccaccattgcagcttttctttgtggtgggtacaagaccgatattataaagaaattttgatgaagacaacacttgagcaactgcttctgtaggggtcttagattctttcccttctactccaggctcagccacaagtgcttccattgtgtcaattgcttcctttacaggctcagcaaaaccagtcttcctactacaatggcactctttaaaaagatcaatcgcacttggtggtgcatctccatatttggcttgcttcacgacatgcatatgtgcaatgtaactccgagatcctgtcttttgctggaaccgaacttttccacgaatcactttgttgttcacacatttatccttgtgctttggggtagaccacatattgacgagttgcatccattgctcatctgtcatagtactcaacggtgatgttgttctcactttgtcagctgccacaccattaaagtaagccttcttgagcttatatctcatttgtcgctgattacacctcatcaaatcagcacatgcatatttgacatctttgtttttggtgtctatggcaaattgaccaccaattctaccgacgaagtcttccaaataggatttgtcattcttgtattccttccagtgtgttaggatcggcatatgttgcctaattacaattcctccttctgatgcaagcattgcagcttgcataggaacctcaggacgtctattcccttcagtgatgaccaatgggatcttagtgtttaagcctcgacttatcctttccaattgtttgcccatactttttccccttatccatttatctgtcatgacatctatttgaccttcatcacacatctgaatctcgtcatcatggtgtgcagaaaaattggcagaaatcaatgtgtgctcatctgtatttgcagtcgaaccatgtatatctttctcaactaaggatagttcctttgtcttctgcctagttactctaccaacttggtcttctacattaggtgctaccactctcttggatccttttgttcctccaaaaccagtagacatgttggtggtccttctttcaatgcagaaaggttcatcctgatcagccacatgatgatcattgtcctcactatgatcaggttcatacaatggatcaaagtcttcacgagcgatagagttcttccttgtactacttgatcgaataagtgatgttaatccagttataccaagactactcaacattttgttgttcctcatcacatttaaagccctctccttttcatactcagtaattggcacctcaccaaggtctttgcgtgtccttgccccatccatccttccagggggcatcttgaacacggccaggtagtgaggagcagacacccgtcgaggcagttggatggagcagtggcgccaaggtggggcagggcggtggcgtccaggcagttggatggagcggcggcgccaaggtggggcggggcggtggcgtccaggcggttggatttggtggcgacgttgaggcaaggaagacgggcgtggggtttttcgattaggatgttctaggtaatggtctngtgc

SEQ ID NO: 18609 - DNA, 1595 bp, Zea mays
cgttgctgtcggattgacaacagctcgatccaaccagcccagaaaattcgcagccgccaaccacccgaccccacatggccacatccgcgatgcccacgccgtgagcccgtgaggcgcgccgctggagccgccgcagccgttactatgacctcgccggcccccacctcctggttctccggcctctcgcgctcctcctccaccatggccggcggcgtcgcctcggcccccgcccccgcccccgcctccgcctccggtcccgcctccgcgtttctccccgacgcgcccaagtccgtaatcggcgccggctccggaggaggcaagcggaatcatctctgcggggcgctgttcaagtacggccccaaatctgcgcaggtagcattcaggactggggattttaaccatcaggtgatcttcattggtggcctcacagatgggcttttagctactgattacttggaaccattgtcacttgcattggaggttgagaaatggtccttggtacagccattgctttcttcatcatacactggatatggaatttccagcttacagcaagatgcgttagaactagagcaactcatcagttacctaataaataaggaaaattctgaaggagtaatattgcttggtcatagtactggatgccaggatattgtgcattatatgcgcacaaactttgcctgttcgaaagcggtttctggggtcatcttgcaggccccagtaagtgacagggagtatagagcaactcttccggaaacagctgaaatgatagacctggcagccaaactgattagcgagggtcgtggaatggatttgatgcctagaaaagcaaactcagatgctcctattactgcctacaggtatataatgtttatgattgagttacagaatatagatattgtactgaggttttgttggcattgttggtagcttctcaaaatttttgagttaactgtttctaatttaggtattatgctttttgtgtcattttcccgcttctttaagacagttgtttctgttgctttaattgaaattgggcatgcctggttcaataaaggttgatacagttgtttgtttaacacgcacgccacatttgtatgccaaaatcctacttcaactagcaaaggttcccctaattaaccagatgcatgaaccacagattgactctaatgttataagcaattcatttatccctttttgcaaaagagatactgcttatttgtcaactgtgtccattagtggcatcattggccatacatgccactgtattatcgatcaatgttatcagatcgtggtcaaggctagtcgtaagaccaccaatcagacgagtaatcacgattagtcgtcaatcagggtcaataagttagtcctagtcggctagttggacatttagtcatccatgtgcctagatgggctgatcagctatttatatatggtgtaaatatatgtaaacatgatcataaattggcaaatagcagtggcaaacaatccatggtttgagttgtattcacgcatgctgcaactttaggacagacaatgctccttgactccaggtctaggctataggcgtcggttggggaccaggtggagacagg

SEQ ID NO: 18610 - DNA, 812 bp, Zea mays
aatgtttaaacccctagaaagaaaagaaaaaaagatgctcccctctaaaacccttcttccctagacctggctggcacccaacaatggcgaggccgccgcctgcggcgcccgccccggtgaggctccgtctgatcttcgaaaacagccgtctcctccgacgtgtgcagagggatgaaggccttcggcgctgctggcttctccttagcccagagctcgccaccgtcgccaacctcgctgctcatgtcgcagcccgtttccgccttcgccgcacctgcccacgcggcgttgtgctctcaatggatgggtttaccttgccaccatttgagtcaacctgcatctttagggacaacgatattataagggttaaacaaaaatcctgtacgaagcacatagagcacaatgatgtgcactgtattcaagatcatgagataatagagaagagatcacttccagttgatggcaaaatccttgcaatccaggataaggaggatgtctgtaaacaccaagaagaagaggcacatgacgatcaccagcttgaagaaaatgccactgctagccatagcacagaaaataatggtacaagtttgaagaggaagcggaatgatggggttgcagatatacctgagagctcaaagggacaaaggctgaaggtgacaaattctggaaagcatatagattacagcaagaaggaacaaaatggatctaaaaagttgaagctgtcagttattgatattgaagctaagaaagcaactccacaacatgaaactaccactaccttagtggagcagcaaaaatcagaggggtattatctc

SEQ ID NO: 18611 - DNA, 5695 bp, Zea mays
  misc_feature (1518)..(1518): n is a, c, g, or t
  misc_feature (4742)..(4742): n is a, c, g, or t
  misc_feature (4926)..(4926): n is a, c, g, or t
  misc_feature (4993)..(4993): n is a, c, g, or t
ctaagacaactttatggagagattcagagaacaaaagaaagacctgcttatggtcttcatagacttggagaaggcttatgacaaagtacctaggagtgtaatggtggtgggccttgggaaaaacacaaagtagcaacaaagtacattaatcttattaaagatatgtacactaatgttgtgacaagtggcccgaccagtgatggagacaccgatgactttccaattaacataggactacatcaagggtcggctttgagcccttatcttttcgctttggtgatagatgaggtcacaagggacatacaaggagttttaccgtggtgtatgctttttgccgatgatgtggtacttattgaggagagtaggagtggtgtttctcaaaagttggaattgtggaggcagacgctggaagcaaaaggttttaggcttagtaggtctaaaacagagtatatgaagtgtgatttcagtgccatggggtatgaggatggcgatgttagtcttgatgggcaagtggtacccaagaaagacacttttcgttacttaggatcaatgcttcaaaaggagggagacatcgatgaggatgtcagtcatagaattaaagccggatggttgaagtggcgacaagctgcgggtgtcttatgcgaccaccgggtgccacgcaaactaaaaggcaaattctacaggacagcaatccggccggctatgttgtatggagcagaatgttggcccactaaaagacgacatgtccaacaactaagtgtggcagagatgcgtatgttgcgctggatatgtggccacacaaggagagatcgagtccggaatgatgatatacgagagagagtaggagtggcgccaattgaggagaagcttatgcaacatcgcttgagatggtttggacatatccaacgaagacctgaagaggcaccagtgcatatcggaataattaggcgtcccgaaaatgtgaagagaggtagaggtcgaccaactttgacgtggacagaggctgtgaagagagacctgaaggagtggaatattgacaaagagctcgccgcagataggaaggggtggaagtgtgcaattcacgtgccagaaccctgattgatagtttcgcttttcctccttaatcgtttgaccttttcttgtgcccattttagatcttgctggttcttgtgggttttatctcttttatgtgtttccccgtttcgttgttttcggttctcctttgcctttgtctcccttttctgttctttgggggttgagctctgaggttttcatacggggtttcatctctagcctaccccaacgtgcttgggacaaaaaggctttgttgttgttgttgtggatgtcactgaattggagtttggaattgtgtgatctaattccacacaataccgaggggtgagggtgtgaggctttgtattgggagagggggtttctagttatagacttatagttcaattccatggaactgggcctctgattccaaacctcaattccacatgcaaccaaacaacaaantttaggaaagctgattccaattcccaattttgtgctctaatatctacatccaaatggggtattttaggttctcagctaaattaagacgtgcagctcagcacagcaaccgcaaatatattgaactatttaaactgaagttcattctttcacaaaaaggatgatcaagaaagaagtgcctgaacatggaatgcatgaaagaggattcacatcaacatgtttcttagacctcagatttcggcacccaagaaacaaaggatatcatatagcatgagcagcttcactacagactattgacattagtggggggggtgggtggggggtggggtgggggtgatgcatgagaaccttattgccgattgctcgccctaatccacatggcactgccgcattctcaatgtctccaatgaactgcttaagatttattctcaccctgaaaaacaaaagaatctaaataattcccgtgataacaggatccaacaaaaaaatgatcacaccctactcagattaccatacagcaatgagtaatccagccatctgtcttgaaccaacacgcacaaaggaatgaacctttaaaatctggccaattacatccaaccaccactctccatttgtacttccctctagtcctacctaaagtcaatagaaattttacaaggaattcaacattacaaatagtaaacaattaaaaatggtagccatttttcaatatttatgttgggtagtattctaaaaaaatttcaagggatgaattagaaacaggtaataaacaaaaatcctctttgcaacaacttcatcacagagaatttgtgaaattctgaaaactgaaaagcaagccataattctaagaaaaatctgcagccatgaaggtaaaatttactccaagcccaaaacattgaacaatgaggcaatgacatgtaaccataaaaagaattcaactaactagatgttaaccaaaattcaaactgcatttcacagtattttgatccagcactacaagtttctaggagttggtcgacccagcatataggacatatcttcaatgaatagcataaataaccattatataagaagtaataaaaaaaactaaatttctgaatgtgacatctgtaccgtttctttggctgcagacattgcaagaaaaccagcacccatgtccacctcctgcaatccaagtacaaccaacccaacttctggcgatgggagttttagccaagctcttaaagactcgtaggatgccttttcttgcccaacattccaagaacccactaatactttcatgtattcaaaacttttgtatgatgaatctttctccatcaactctgagcgcaaaatgttgtcaagaggccctggtgatgccaagttccatccacggattcctccatgaccagccagtgtaaagatatatgaacctccaacagccatactcagaattggactactatgtgcaatccatcctcctaacaagttgccttcaaggtccaacagctggatgttgccatccatgtaacccacccatattcttgttccaaaattgtaaatgcattggacagatgacgaatgatgcaggaactcttgcaaacgattaccactgccatcccattgggcaagagagccatttgccgatcctgtccagatcatcccatccgttgacattgtaaatgcttcaattctacgagtgtcatcaccaaaacctgctttaacagcaactctccggactgcatcagctgctcccaacaaagcattccgtgatctctgcaagaaaccaacaggactgcgagctttctctttcctcggagagaacagagtttgctttgtctcatagctatatgaatcctgagcagataagatgtcgaaacgggtatcaacttggccatcaatgtttaccacttttagaaggcctttagtgcgagaatccctgcatagcagaatagataacagtattacacatatagaaatagctggagtgatgtcattcaaatgcaacaagataaatgaacacatgaagtgtaccagagtgcaaatgagaggtaaccagcactccatacttttgatctagaattgtcagacaacagaagttttacatctacagcaggcaaaggacaggcccctccatcactgaccatgtccctaagatcaatagatgatctttcaactaaaagggtcttatgtttttcttctgtttgtgaaacaagtgacttctgaatcagttctgcataccatactttgattgctcccccctcagacccagaccacaaatcacctataagacatccaagaaacatcagtatttcatgggtgcatatggtttgattgaagatgtaggttactgctgataagactacttcctgcattccataatagtaccccaagttccatgtaaatgatcgatttgcaaactaattgtgaatgatctgattcaattctcaataaaaccagcagctaaatatattcactgaaccaatgatagagacaacaacatggtctagaacatttgcagcgcgtggctacttttcagctgatagttagtaggcacacaataggcatcaaactgtcttgtacatatgctcgataggacccagaattaggcaaggacatacaactagcttctggaatgctgagatgaaagatcatttggaaaatccagaataatttatttaacatcacaaaaggatagacccagtgccgaaggctaccatgagtggggactggggaaggaataacaagccttcccccacaaatacggagaggctgtttcgaacccacgacctggtgactcagtgagacagttagcaccacagcaccatacctgcccttcttatttaacatcacagtatgccatatttcatcacactggtcaaataaagggacagcaaatgttactgcagaagaagaatgtaaacaagtaacagaatgtctgtaatttttaggaagcagtcacaaggctggcctagagaaagttcttggaatttagggggaaaatgcagtggttcagctgcagttagaaaggtttttttttggcacttacattattttctcagagtcaccttagttgcaaggacaaaatgaaattttgaaccaactatgcttgtacgttatgtttttcttacagtagttgaggggacaaagctcaaccaaaagttgcaatcaaatttgttggcatctctttagaactagtgattagatattggattattcctacccacaattaagtgtatattttgaanactcaacatctttcacatcattcagagcacaagcaagggctcatgataacctcaatggacatgctgtcatgcaacagagcattggagtgttactagtatgagtgacatgtggatggctgttgccctgctcctgcttgtcagagaaatggtatccttgatcagtgccgccaaacttctaactganaaagcaccataaagggtgcagcagctggtcatgagttgaggagatgccgagatggtggcactcgacnattgcaataaaccgcatttgggctcaaatttacatgatccaccaacttactcattgacgaccgcaccacaaaccaacacgaggaagttgtgtcagttgccaatcagagaagggcaatgaaagacactggttgattaagaaggacaagaaatgaagtcagaggctcagcaaaggaagggacatggggtgatggtgctatttgttgccaatagcttaccactaatacatgaagaaggggaagacgttaatcaactgggcgaacagagatgtcaatgaagttgaggcagtactgacagaaactgggggagtttggaggcaaggagaagaagaattgggaaagaatgcatgggaactaaactaacttatgagaggggtatttaagggtattccacatatgtcaagaaaaaaattatcccaaaatgttagattggaaaaaaaaatacagtggtggcatgacagggaaaacttttggttccatgtactgcaaaaatcagtggcatcttgctgtagtgaaagatccttgagtgctatagtaccacatttccttatttaaaaaacggtagacaccacacttcatttgatgattctcgtggccagttctggacaattcgattaaaagcagttccaaatgctcccaaatagtgattcttacttattacttcacagattcggttatgaaaacatagcagctaaatatattttt

SEQ ID NO: 18612 - DNA, 2718 bp, Zea mays
ctcgttggcccccaccttctggttctccggactatcgcgctgctacttcaccatggccggcggcgacggctaggtcccagcccccgcctgcgcctccgactacggccccgtcttcaagatcctccacgacgcgcccaagtgcgaaatcggcgccggctacggaggaggcaagccgaatcatcgtctgcggggcggctggtcaagtacggccccaaatctgcgcaggtagcattcaggactggggattttaaccatcaggtgatcttcattggtggcctcacagatgggcttttagctactgattacttggaaccattgtcacttgcattggaggttgagaaatggtccttggtacagccattgctttcttcatcatacactggatatggaatcaccagcttactgcaaggatgcgttagaactagagcaactcatcagttacctaataaataaggaaaattctgcaggagtaatattgcttggtcatagtactggatgccaggatattgtgcattatatgcgcacaaactttgcctgttcgaaagcggtttctggggtcatcttgcaggtattttccctgcccatgctcttgctctgaatgcccaggtagaggaataaaagttatttaaattttatgtgtgctaaatctctctctgaatgtaattcttactgatcaactttggaacatgttaagaagacttgattatatttattggtattaactttataatttaatgatatctttgttgtaacttctacaagtactctgaatgttgtgacaagtgtccgaacaagtgatggggacaccgatgactttccaattaacataggactacatcaagggtcggctttgagcccttatcttttcgctttggtgatagatgaggtcacaagggacatacaaggagatataccgtggtgtatgctttttgccgatgatgtggtacttattgaggagagtaggagtggtgtttcgcaaaagttggaattgtggaggcagacgttggaagcaaaaggttttaggcttagtaggtctaaaacggagtatatgaagtgtgatttcagtgccatggggtatgaagatggcgatgttagtcttgatgggcaagtggtacccaaaaaagacacttttcgttacttaggatcaatgcttcagaaggatagagacatcgatgaggatgttagtcatagaattaaagctggatggttgaagtggcggcaagcggcgggtgtcttatgcgacccccgggtgccacacaaactaaaaggcaaattctacaggacagcaatccggccggctatgttgtatggagcagaatgttggcccactaaaagacgacatgtccaacaactgtgtgtggcagagatgcgtatgttgcgctggatatgtggccacacaaggagagaccgagtccggaatgatgacatacgagagagagtaggagtggcgccaattgaggagaagcttatgcaacatcgtttgagatggtttggacatatccaacgaagacctgaagaggcaccagtgcatatcggaataattaggcgtcccgagaatgtgaagagaggtagaggtcgaccaaccttgacgtggacagaggctgtgaagagggacctgaaggagtggaatattgataaagagctcgccgtggataggaaggggtggaagtgtgcaattcacgtgccagaaccctgatttatagttccgcttttcctccttaatcgtttgaccttttcttgtgcccatttagaccttgctggttcttgtgggttttatctcttttatgtgttcccccgtttcgtcgttttcggttctcctttgcctttgtttccccggttttctttgggggttgagctctgaggttttcatacgggggttcatctctagcctaccccaacgtgcttgggacaaaaggctttgttgttgttgttgtttgttgtaacttctatcattttctattcctcaggccccagtaagtgacagggagtatagagcaactcttccggaaacagctgaaatgatagacctggcagccaaattgattagcgagggccgtggaatggatttgatgcctagaaaagcaaactcagatgctcctattactgcctacaggtaccactccctttgttcatatatgggtgatgatgacatgttcagttcagatctaagtgaagatcagctgaggcagagacttggtcatatgtcaaccacacagtgccaggttattttttcaatgggggatgaatatgtacctgaatatgttgataagagggctctagtagacaggctatgtagggcgctgggaggtgcagagaaagtcgagatagaatggggaaaccatgctctgtccaacagagtgcaagaagcagttgtggccattgtagattttgtcaagagggaggggcccaaaggctgggacgacccatggagctagatacagcagttataatctcatttgtaactagtttgtgcttttcctcctctctcttttctccaattgtaacatctttcttttgcattattattggtccatttttcaatagtgatatgctctttttcttataaccccccctcccctaaaaaaaacatgcatcgcgttctcattctggtatggtgtatcacatatgtaaattgcgttcagaatcttgattatcaggctgtctttggtggatcatgtaaaataggggttgtgatagtttgaaacagaggatgatata

SEQ ID NO: 18613 - DNA, 1756 bp, Zea mays
tatagaatgggaaagacacgggtttgtgtatcaattggaaaatgacttccagttaaatggatcgagtgtcagagaactctgcttatatacaccaattacctttcaaatcattgaacagaatgcaagttagcatatttcatttttcgtagaacatctccacttttttgtagttcttacacatcaaaatgaagaaatacagcattgacattttcaatctcagtgtagcctcagaaaccacatcttctgatgcatctggtaaagaaagggtgttgtagagcttcatgtgctttcaggcgctcattaggatcataccgaagaagtccttgaagaagatcaattagatctccagcagaatgatcaacatgttgcatcacaaggttctgcagacgaggcaatttccagactgccttcatgctctctcgtgaggccgctccctctggccagtccaaccttactccgcgcttgaagtacttttcagcacgccgatcagctctgacaatcatatgctttgggagaggccctaagaccttctccatcatagccaaatgctccaagttttcatgtgtttgaaagagagcttcccccgaacaaagctcaactaaaatgcaacccacactccacaagtcgcatggatagttccacccaagaccaaggataacttctggtgcacgataatgtcttgtcgacaccacataattgtggtcttggctctcgaaagttgtactcccaaaatcaatcagcttgatagcactagattttggaaggttcttaaagaaagaaccatcctttggtggtcgtatagaaaccttataatcaggcaccctgatagactctgatgaaacaaggagaatgttctctggcttcagatccgtgtgaataagtcgcaagtcatgcataaatgcaacagactctaatatttgtctggcaaattctcggacaaggtcaataggaaatgaacggtagctattctttcgcagaaagtcatataggcttggcccaagcttctcaaatactatacaaatatgattacgatagtcaaaccagttccgtatttgcacacaacggctgccagtaaagtcatgcttcccaagtctctggagcacatcaatttctatcatagcagcctctcggtatttctgaagggagcgtacaatcttgatagccactgcttcttggttttccaagtcccagcactccaaaacttgtccaaatgtcccttcacccatcttgttaagtatcctatatcttggtgtgagattctctccaaccgcaaaaacatagtgtccatccttgtcatctggtctccaaggaggcgaaatattccgtggcggcccggtgtaataaattgatggtggtggaagaaatgcagtcgtgaaattaccattaattagttcctgcccacaatatagcatcggaattgccttggggggctggaacagcgtgggcgcgacatcccaggcgagccgggcccgtttgcgcggccgcttgtcggccccctggtgcggatactccgcgagccactgcgcctccattgccggcttcggaaccctagctgggtcactccatcggccgggccagtccggcggtgaatttcgggggagggggatttgggaactggagagcggttcggcaagggccgtcgactcggagctcgatttggggttgggggatttgggaggggaggaaacgaagcggttgtagcaggaggtgggatggggaagggggggagggattttcccggcctgccggctcgagg

SEQ ID NO: 18614 - DNA, 1570 bp, Zea mays
cattggtacctcgagccggcgggagtaaaaatgaacccgtttccttcccgctggtcttgattgacaacagcccgtgcctacctcgagccagcccagaaaattcgcagccgccaaccacccgaccccacatggccacatccgcgaccgcgatgcccacgccgtgagcccgtgaggcgcgccgctggagccgccgcagccgttactatgacctcgccggcccccacctcctggttctccggcctctcgcgctcctcctccaccatggccggcggcgtcgcctcggcccccacccccgcctccgcctccgcctccggccccgcctccgtgttcctccccgacgcgcccaagtccgtaatcggcgccggctccggaggaggcaagcggaatcatctctgcggggcgctgttcaagtacggccccaaatctgcgcaggtagcattcaggactggggattttaaccatcaggtgatcttcattggtggcctcacagatgggcttttagctactgattacttggaaccattgtcacttgcattggaggttgagaaatggtccttggtacagccattgctttcttcatcatacactggatatggaatttccagcttacagcaagatgcgttagaactagagcaactcatcagttacctaataaataaggaaaattctgaaggagtaatattgcttggtcatagtactggatgccaggatattgtgcattatatgcgcacaaactttgcctgttcgaaagcggtttctggggtcatcttgcaggccccagtaagtgacagggagtatagagcaactcttccggaaacagctgaaatgatagacctggcagccaaattgattagcgagggccgtggaatggatttgatgcctagaaaagcaaactcagatgctcctattactgcctacaggtaccactccctttgttcatatatgggtgatgatgacatgttcagttcagatctaagtgaagatcagctgaggcagagacttggtcatatgtcaaccacacagtgccaggttattttttcaatgggggatgaatatgtacctgaatatgttgataagagggctctactagacaggctatgtagggcgctgggaggtgcagagaaagtcgagatagaatggggaaaccatgctctgtccaacagagtgcaagaagcagttgtggccattgtagattttgtcaagagggaggggcccaaaggctgggacgacccatggagctagatacagcagttataatctcatttgtaactagtttgtgcttttcctcttctctcttttctccaattgtaacatctttcttttgcattattattggtccatttttcaatagtgatatgctatttttcttataaccccctcccccaaacatgcatcgcgttctcattctagtatggtgtatcacatatgtaaattgcgttaggaatcttgattatcaggctgtctttggtggatcatgtaaaattggagttgtgggaacaaggagctgttggagacggcatcagatcaacttcgtgcaaacttcagttttggaacaaaaaaaaaaaaaaaa

SEQ ID NO: 18615 - DNA, 1315 bp, Zea mays
tctaaaatccacacacaccattcgctctctcgctccactctctctctcgccgagtgagggaaggagggagagagaggaggcagggaagtggggagagcggcgaggacatggcggcgaaagcgagcagagcagccgcctccggcgcggcctacgaggagcagcgcaagaagcgggtcctcgagaacctcaagcatctggaggatttgggtatagcggagatgtctaagagcctgctccaggcggcgcgcctgcagaaactgaacaaggccggcgtgcgcgcgggccccaaggagaggaagaagttcgacgccaccgaggtgcggcgttcttcgagggcgaagaccacggtttcctacaaggacgatttcggtgaactagatgcttttctgcgtggcacaaggcgcagtggtggtaggaatacagaacatggaagagaatacactggaagaattccatcttatgaacagcaacaacgtgctttcagaaaagctgagaaacttcaagacagtctggaccctaataacccatcttttgttaagaccatggttcgatcacatgtgtcaagttgcttttggcttggtcttcctataagcttctgcaaaaataatctgccttccaaagaatttaggatggtgttggaggacgaagagggtcttgaatttgacgctgtctatattggaaaccgaactggtctaagtggtggatggaggggctttgcaatgcaccacaacctggaggaaggggattcattggtctttgaattggctgagcatgacaaatttaagatttatataataaaagctattgatgatgatgtgaaagaggctgagcctgatgacaagaatgacaatggtgttaccaaggaagagcctgaccaggaagaatcacctgttgctgagcctccaaaaggtgccaaaaggagaaaactccgaggacggcggtagtttttctattagtttacatcgaacttttaatattagacactctttgggtaagcgaatgccgctatgctagtgatgcgctctcctgccaggtcatccatttgctcctttttgttgacctgttctttctgaaattaggtgtccaattgcaacccatatattgcggtgaaaagcacatctatcaacgtaggtagtccttgattcatgtaaataagtagtttgacagtggagtacttacgctctcagaaccccctgtgtgctactttagcagagaggcaaattgcttctgtgcatacgaagtgacaatcattagcaaagagataattgcaatgactttctgtggcaaaactgcaaaaataaaaaaaaaaaaaaaa

SEQ ID NO: 18616 - DNA, 2222 bp, Zea mays
tgacaagtgtgcagacacatagagaagtacatgatagcgaagaagtctgcaaagcgagcggttagtagagcccggggtcaagcctatgacgacctttatcaacggttggacacaaagcagggagaaaaggatatctataggacgccaagattcgtgaaaggaagacaagggatgtcaaccaagtcaaatgcatcaaggatgaagcaaaccaactattagtgaagaatgaagagatcaagaacagatggaaggagtacttcaacaaattgttcaatggagggaatgagagttctacaatagaattggacgaaccattcgatgacaacaacaggggttttgtacgaaggatacaataatatgaagttaaggaggcgctaaaaaggatgaaggtaggaaaggtgatgggccctgatggtatccctatcgaggtatggagatgccttggagacatagcgatagtatggctgactaagcttttcaacaccatctttcggacaaacagaatgcccgacgagtggcagcggagtatgttagtaccaatcttcaagaacaaaggagatgttcaaagtggtactaattaccgtggaattaagctcatgagccatacaatgaagctatgggagagagtcattgaacatcgcctacggaagatgacgagcgtgacccaaaatcagtttggtttcatgcccgggagatcaactatggaggccattttcttaccaagacaacttatggagagattcagagaacaaaagaaagacctgcatatggtcttcatagacttggagaaggcttatgacaaagtacctaggagtgtaatgtggtgggccttggaaaaacacaaagtagcaacaaagtacattaatcttattaaagatatgtacactaatgttgtgacaagtgtccgaacaagtgatggagacaccgatgactttccaattaacataggactacatcaagggtcggctttgagcccttatcttttcgctttggtgatagatgaggtcacaagggacatacaaggagttttaccgtggtgtatgctttttgccgatgatgtggtacttattgaggagagtaggagtggtgtttctcaaaagttggaattgtggaggcagacgctggaagcaaaaggttttaggcttagtaggtctaaaacagagtatatgaagtgtgatttcagtgccatggggtatgaggatggcgatgttagtcttgatgggcaagtggtacccaagaaagacacttttcgttacttaggatcaatgcttcagaaggagggagacatcgatgaggatgtcagtcatagaattaaagccggatggttgaagtggcggcaagctgcgggtgtcttatgcgacccccgggtgccacacaaactaaaaggcaaattctacaggacagcaatccggccggctatgttgtatggagcagaatgttggcccactaaaagacgacatgtccaacaactaagtgtggcagagatgcgtatgttgcgctggatatgtggccacacaaggagagatcgagtccggaatgatgatatacgagagagagtaggagtggcgccaatcgaggagaagcttatgcaacatcgcttgagatggtttggacatatccaacgaagacctgaagaggcaccagtgcatatcggaataattaggcgtcccgaaaatgtgaagagaggtagaggtcgaccaactttgacgtggacagaggctgtgaagagagacctgaaggagtggaatattgacaaagagctcgccgcagataggaaggggtggaagtgtgcaattcacgtgccagaaccctgattgatagtttcgcttttcctccttaatcgtttgaccttttcttgtgtccattttagatcttgctggtccttgtgggttttatctcttttatgtgtttccccgtttcgttgttttcggttctcctttgcctttgtttcccttttctgttctttgggggttgagctctgaggttttcatacggggtttcatctctagcctaccccaacgtgcttgggacaaaaaggctttgttgttgttgttgttgttgtttaattacaaaaggtttcctctgtaggtaacatctccatctatccactgccataagaatggccaggaactccttttcatagattgacaacttgcaattggaaacccctaatgtcgtgctatagaaagccactgggtgtcccttttgcgatagtacaacac

SEQ ID NO: 18617 - DNA, 1736 bp, Zea mays
gatacgactctcgctggtatataaaatctgtttcgtagataaacatgaaaccagaatttttgatcaccatatacttgtttcagaagcaaattggggacaccatatacttgttgccttcaaacgaccgtacaataagttcagactgaccatctgaatgtcacaagagctagtttagagcagcaagaaattgtcaagtgacctagacatcccgaaccgacgcttcccagacttagcccgaccttccgggtccttcataagctgactccgtggcccgcccggccggcaacgccgcagccgttgaccttgcggctttttatccccatccggccatccccaacccaactcccaaatccttcgtttcgtcgtctccacacgcaatagcatccgagcaaagaagccaaagagcaactgggagcgaggacgggaggcaacaagcggcggcggcatggaccggaacctgagcgggtttctgatcgggtgcctgggcgccgccgtgacgctgctggcgtaccagcagacggtggtgaccagcacgcagagcgtcgcggcgggcttcgtcgtcatcctcttcgccctcttcgtcaaggaaggattcatttccctctgaatctctggtgcgcgtcagccagccatgcatgaggaggcgtcatcgctccgctgcctgtatttctgctcgctagttcagtcccgcagctgccgctgtgctcgtcaggttcttggaaaaatactgtaatagcgtagtgacttttatgtacgacacggatggttgttgctggctgaagggtctactctgtcgaaatcgatgtatcttagtttatgctacttgaagaacagcagactgcagatcagcagagttcttgccttcttacgctaattaataattattggtacacgaaaaaaaaaaaaaaaaaggcccctacccgttgctcctgcccgccccacatctcggcttgccaatgcccccttgtatgtttgctttgtatattagtgcaggtattaatggccgcctgtaagtgagtttgttctcccttgttgaactaataaaattggcatgaattcaccccaaaaagattgatgctgtttctcactagttttcagcctcagacgactatagatgtccaaacagtgcggaccgtccatttgaaacttgacccgtcacgattttagtccggtccaagcatggccaagcagggttggtaacggcacgacctgtttagcgtgccgggtttgggcagctacagaggcccgcgtgttttggtccgatccgacacgagcaatgggccgacacagcggcggcccatttttcatatggcatatggtgccagcggccacacgcccccccaaccaggccacacacccgaaccctatctctaatcccctcaccccctcgggccctccgtccccatctctagcgattcggcgccgtcgttctcgcccgttgcatcccgtcggctcttgacctcgacggcggacgactctccatcgctgtcgtatgtggtgctccgacctgcttggacttggagttcctccgtcctccctcgtcactccctccgtctgcgactggggactccctaaccctaacccctccggtctccggattcggtggttctagctcctcagctgtgcaaggttcgtttatctcgtctaatcccctccagatttggtgtctagctgatgtctggtgctcgtctgtggtgtctggttgccgttgccggtggtcgtcacctgttgctcct

SEQ ID NO: 18618 - DNA, 743 bp, Zea mays
  misc_feature (702)..(710): n is a, c, g, or t
gatttccaaaaaagggggaaaaaaaaaaaaaaaaaataaaaaaaaaaaaaaaaaaaaaaaacgccgcagccgttgaccttgcgcctttttagttccccatccggccatccccaactcccaaatccttcgtctcgtcgtctccacacgcaacgcaatagcatccgagcaaagaagccaaagagcaactgggagcgaggacgggaggcaacaagcggcggcggcggcatggaccggaacctgagcgggtttctgatcgggtgcctgggcgccgccgtgacgctgctggcgtaccagcagacggtggtgaccagcacgcagagcgtcgcggcgggcttcgtcgtcatcctcttcgccctcttcgtcaaggaaggattcatttccctctgaatctctggtgcgcgtcagccagccatgcatgaggaggcgtcatcgctccgctgcctgtatttctgctcgctagttcagtcccgcagctgccgctgtgctcgtcaggttcttggaaaaatactgtaatagcgtagtgacttttatgtacgacacggatggttgttgctggctgaagggtctactctgtcgaaatcgatgtatcttagtttatgctacttgaagaacagcagactgcagatcagcagagttcttgccttcttacgctaattaataattattggtacacgaaaaaaaaaaaagcggccggggcggccnnnnnnnnnaaaaaaaacaaaaaaaaaaaaaaaaaagcggcc

SEQ ID NO: 18619 - DNA, 1914 bp, Zea mays
ggtaggccctaaaaagcggggcacttcgtagccgcaagcattcttccttccttctccattccatcggtgaccatggattgaagacattgatcggcttctctggaggtgcgtgtgagcagctcggaggtcagccgccgagaagagctcataggcaatggcaaccgcaaggaaggatcctcagcaggttgataaagtcaacctgaaacccagcgagtctggcaaaggggtagtacggcgtgcaaggtctgtcccgacctctccggatcgcagatcgtccccatccccggccccagtctcagacaacgccagccgaccggcatcatcactcaacactcgcacgacctcgtcccggtccacaacaacatctagctcggcggcctcttcaagccacgggaagacgatgcgctccgcttcgtcgtccgtgggtggtgcaagtgcaagcgcaaggcagacaaacgcggcgagaaggagagcagagaagcccggtgccacatccgtgtggcctgcggccggcggcgcggttacgaacgcctcgtcgtctaaggatgtggccagcagggcagcaaaatcgccatccaccgccgcgcagaagacgaggcctgctggtgtcgagaaggcagcagcgtcttcttctgtaaagctgaagacgaagcctcagaaaacaacggcaggagctggaaaaactcaagctgcacctcccgcccgtgctcctcctggcacggtaatagcaaagaagagtacgggagccgagaactatgtccccatccagaggacgacgagcgtgccggcggcgagaccaacagagacgctcaagaacgaggaacaggaggtcgacgagctgctgatgcagttcgacgagaaggagagcataagcacctcctccattgaggagcacctgcaagaacggctccctgaccctgtcgatctgaaatccgtggatctcgacagcagcaagacgacgtcctcctcctccagtcaggaggagtgcaaggatcaagaagagaacacgggggacattctggaggagaagcgtgacgggaaggacagcgaagacctgagcagcacaggcgacaaggcttgtgtcgggctcgggagcagtgatataaacatcccgatggaagaagcggttgatgaacctgttaaaccggcggaagctgtggacgaagctgggctgaagagagatgtctgctgttcaccagctgagccaaacgaagccgttggtcagaacgagctcaatgaggctgctgtcgtcggtgaaacgacgactgaaccgaaggaggctgaggatgaagccaagataataaagcaagtcgactgcgaaactgcatcaaaagaagttgctagtactggggccgagtcaagggacgatgccgctactatggaacgcgagccgctggtagcagcagcagcagcaccacaagaagagaaggccaaagctgaggagaagacgacgcagccaactaaggccgtggaatctgccaagtggaggacgaaggatgaagggaggagcaacgaagccacagaggagggcaggggcaagtctaccactactgctgccacccaggagaggaagaacaaggtgatggccttggttgggaggtttgagactgccatgtctggctgagaagagatcagaacgaggtgatgtcaaaagactgctctggctcatgaaaatgtgtacgagtactactcaactgtgcaggcgtggagggttcgtatgtttcgtttcattaattaatgtggctgttgttgttctggaagcgagtgaagattgctgatgcatattgatggcgcttctcctgtttctctttttaatgaagtgactctcctgcatggtcctgtcacttgaccaaactctctgtaaaatgaaattatgtgatgaaaaaacaaaatcctgtttgaaaattatccaaa

SEQ ID NO: 18620 - DNA, 1742 bp, Zea mays
cggccgctttttttttttttttttaaacgaaaattttgaagtagtttatttgaactgaacatatgtcaagagaatgcacatatagtctatcatccttccagtgcaattatacatttatactctcttaataggcacaagacaaagaggcaccatcttcctaaaagcaagctgccctgtttcttccatatcgatgtcctcctccaccatcccatcagggagctcccaatcaaagcaatgtaacaggttggccaagacaagctccacattggcgacacccatggcgatggcagggcatgaccttcgccctgagccgaacgggaggagctcaaaactggagcctctaaagtcgacatgacttccctcgaacctctcgggactgaactcctccgggcgatcccagatgctagcatcccttcccattgcccaaacgttcacgaaaatccttgtgcctggcagcacgtcgtagccgccaatgacgcagctcctcatggtctcccgtggaatcaacaaggtccccggtgggtggatcctgaagttctctttcaccaccatcttcaggtagctgaggctcttgacgtcttcttcgtccacccttggtttgtttcccaccaaggtgcggacctcggcttgcgctttctgcatgaccctagggttcctcatgagctcggccatgatccagatcattgttacagcacaggtgtcgatgccacctgcaaatgtgttcatgaggattcccttgatatgatcacgcgttaatccatgaggagcctcataaccatccgcctgctcctccctccacatcttcacgagcgcgtcgaccatgtcttcctgcacgccggcctgcagcctctccggctcgaggtgcttatcgataaccgaatcgaagaaacgatcgatctggcggaatatgcggctcctccggccggcggctccggtgaggacgtcggcgaaccgcgcgagcctggacgccgggaagaagtcctcgaacgtgaagctcccaagcacccgcagcgtctcgtccatcacccgctgaaagctgctccgctcgaactgcgctgacccgtacatcttcccgaacgccaccgtgcccacgacgccgtcggagagcgcgtacagcttctcgctgaggtcgacggcggcacccggaggggtgctggcgagggaggagacgaggcggtcgacctcggcagcccgggcgtaggcgaaggactgcacgcgccgcatgctgaggagttccaggatgaaaagcttccgcatctcgcgccagtagtcgctgtaggggctgaaggccacgtccaggaagtcgtagctaagcatccggggacctggtgagttggggcgactgcagcagtgcaggtcgttggtccggaggacctccttggcagcatccggcgaggagacgacgaccgtgcgcacgcgcccgagctgcacctccacgatggggccgtaccgccgcgcgaccgcctggaagtagcggtgcggccggctgcctatctggagcaggttgcctagcaccggcagctgcttcgggggccccgggggagcacgccttcgttctgctgctccttgctctctgctccctcctccgcccggacgacagcaggcagaggaggaggaggagtggcaccaccagcagctgggggagaagaggccatcctgtcgctagctcatgggagcgggactgcgcgtcgtccatgacgctctatgtttgtttccttgctggacttgatgatcagcgtgcg

SEQ ID NO: 18621 - DNA, 4898 bp, Zea mays
ccggccgggaaaacaaacaagcccgattcctctctccgaacagcgcctatgctttttttttcttcttcagccccccccccccccccccctcacctcttcttcttctgctggtatctatcgttgttgttcccttcgttctctctccatctatctccctcagattacttgcgaccagcgacgctctggctggcccctttgagattgacctggggcttccatacaccaagagtgcagcaagaggatagatagcatttgttgcagcgctctctaggtcgtctctctctctctctctctagctagctagcgtcgtctcctccggtgaggtgatgaacagaggagaattccagacctcccttgtccagcagatgatctggagcggcggcggcggcggcaataccacagcggcaggcagcagcaacatcatgagcagcggcttcaagcagtcttgccatgaggatcaacaagaggcctcccgcaacctgcagctgctgccctccctatcgtctccgtcgtcgctgctcttctccaatgcccagcagttcccgcacaccacctcttcgggccagcagctagcccacaccaacgccggcggcgcagcagctggttctctcccaagtctggacgacgacggcggcagcggtcaggacagccacatgccggaatcgtggagccagatgcttctaggggagttcacctgatcttgcgctcttgcttctctatcacatcgatctccttctcctgcctgctaagggttgtttctaaatgtttaagattgatttattattcatccaacagatccacagctacaaataaaaaaaaaagagagagagagagagtgtccgggtctagctccgctccctagctgtatacttaaataaactgtagctctaggtgaaggaataaagtggttaacccactttgtcctatagcggatcaagcctttcccggtgctaatctacctccctgtctctaatcatcatcacactaacgttgcttttactctgacgctaacttgcggttgttctcatctccacggactcatctgtccgtgtgctctgatccgtaactacacgtgcatgcagaggggagttcgctggagagcgctacgccgccaccgcatgtctgctgtcaaagggcgtagaggactggggggatcacgctgcggcagctgcaagcgcgtgcatggtgggtggcggcggcggcgtggaggaggagggctcggccgccatgcctctgtacagcttatatggtggtggtagtcacagtcacagccacctcgctgcagctggtgaccatgagatgccgccggcgccagcagcagcagcagcaggggccaataagtctcagctgagccagatgctcctcgcctcgtcgcctaggtcctgcgtcaccaccagcctcggcagcaacatgctcgacttctccaacaacggcgtgcccccggcgcccgatcagctgaagagccaccaccaccatcaatccgataactcatccgaggtgagatgagctagctagcttgatatatgatccgtgaaagttattcgttcatagttcataagctggttttttttatttttttgctctttccaaatcactttgttttattattccacactattaatttcctagccggccggtttcttttccataagaaataaaactgttgtcaaagaatctcttgtcgactaattgcattcatatgcttatggatgccatgtagtttatttgtttaagctgcgcgatggatatggcatgcattcgttttattgccaaaactttttttttattaacgctacgtttcatctcgatcgccctcgggaagagatggtactttgaaaaggcacactccattattcatcccagttcgagatggaaagatacaccatgattatgttttctctcgcctcatcgatgaccgacaataagctaggatgatgaggggggttatgctggcagtaagatcctcttggtgagggtgcattgtgtaccaagcttccatgaagaactgaaacgaactcattaaaggcacagtagtagtagtcctgttcttcttttcatgaaaagatgctttatttgatagctagtatgtagtacagacatgcatgtttccatgccccatgcatgcatgtgcaaaaccaccagcactttagtcaaccaagctgagagatggtatgtattttcatgcacgctatttcatatagtctattggtcttcttcagagtgttacgggcagctaggcacaaattcaaagggatacctgtttttgttactactaggtattttaattttgttcaagagaagatggtttgagttattattgtagttagaattgcaattgattgaatccatgtcttgttattggcctattggttaattttatttgtatggtcctgatacacatgcatgagccatagcttgtcggttgctagctctgagagaggtagaactactgggaatccactttacgaagagttaggctgtgtgtgttgtttcatgggacaggttgaaagatcatgattgttcttgcttttcttgtgtctttgtctttctctgctagtgcaacagcaccgtaacaggttcggccatcaagaagcctagggttcaggcctcctcttcagcacaatctactctaaaggtttcttctccttcttcttctctcactgctttccataacccgaaccctcctatatatcttctgtgtgcgtctctctctctctctctctctttctgaaaattcgtgcaggaagtacacagagagagaattggcatacgatataatagtgataacttaccatgcatagttaggaacagttacaatatgcttataccctgtgttaactatattttacttgtgtatttgactgacatgcatgcatgcatgtgtgtgcttgtggtttgttgcaggtgaggaaggagagactgggtgacagaataactgccctacaccagatcgtttctccgtttggcaaggttagcaagaacataaaaaaacaaaaactgcacaacatgcttggattggttatatacagtcacttaggttctgtttggaagcaactcagttttaaaaaaccaatttttaaattttacagctaggatatatatatcaactttctggttttttaagaagttagtaatccagtttgtataaactaaaacataaactgatatgtttaattattggaaccacttcaatttatataaaccagtttgttaaaaactgggcgctttccaaaacagccccttagttagtataggctagaaagaaagatacggcggatctgagtgcatgtgtgttgcctcgatccacagtgtagatatagatgggtaatatacacagagctggtgggtctgggtggtggtggcgatgctatatatatttggtgcagttttctatagttttgttgccatgcatatgcatctgctttgtttcgctccttttcactcgaggggttgtgtccaactaaagcatttccctgacacacgtgcctcttcttcttttcttttttgtttacagactgacacggcgtccgtcctgcaagagaccattggctatatcagattcctactgggacaaattgaggtccaacccctctctctctttctctctcatgttggaaaggaaaaactcacacaaggtcatggtcacatagtagctagctagctataggaccatcggaagagtatgggtgagcaaagaaagatgtgggctagagctgccccaccggggccaccggccagtttcaagatgtttctaccacacacgtacacatgcatatatatataaaagcacagtgaaaaatgaaaccctagcttcttgtagtcactgcatagctggccgtcccactgcgctgccccggcccacatggcagtggcagcagcaggcgttataccgcatgggattgggagaggtagtagagagaggggggaaagaaaaggtgggtgcgcgcgcgggaaacaaaaagggaatatgcatgcatgggggagggtagggacgggtgcaagagcacgctgttaaagtcgatcgctttgcatgggcgcgcgcgcgcacgcaggatcagcaaactgcagcgagatggatcaaccgatgcgctgctcgatctgtctgtcttgtagcgtcttgtgtttcagggactgcacgggagcactagctatatatacatatactctctctctctctctctctctctctcatatttcatgaccggtgtggttttttgatcttctgtgacaggctctcagctacccctacatgggccacggcaatgggacctccattcaaaatgtatgtctgcatgcatttctctctctctctctctctctctctctctctctctgaaaaacacgcacaggcacatacacacgatcgctcgctgtggaaagaatcttaggtccgaggttaacagtatgcctatccacgtgcaaccgtattgtgaaattgctagccggggtagactttgacgcactttgtatgtagggagcacacaattaattaatagcgccttagcaaagcctttagctagcaaaggtggcccggaaatatactttgtcaaagggtactctaaagaagccttttaccaattagcagcaggcatcagtacgtacgtagaacactgatcctttggctaacctttgatctgtccaaaaggactagttggatcttttaggctattcaaacaaacgatggtttcttctagttttcacttcaaataaacagtaaacataaataggttctgccagtttctgttaattacccgtagaaattaataccggtctgttcaagtattgactccacgcatgcatgtagtaagagctcacacgtgtctttgacagtggagtgtacgaatctggctaaaaaatataacgaataaatctgtcataaaatatggataacagtactg

SEQ ID NO: 18622 - DNA, 1578 bp, Zea mays
ccggccgggctcacctcttcttcttctgctgctcgcggccggccgggttcccttcgctctctctccatctatctccctcagattacttgcgaccagcgacgctctggctggcccctttgagattgacctggggcttccatacaccaagagtgcagcaagaggatagatagcatttgttgcagcgctctctaggtcgtctctctctctctctctctctctctctctctctagctagctagcgtcgtctcctccggtgaggtgatgaacagaggagaattccagacctcccttgtccagcagatgatctggagcggcggcggcggcggcaataccacagcggcaggcagcagcaacatcatgagcagcggcttcaagcagtcttgccatgaggatcaacaagaggcctcccgcaacctgcagctgctgccctccctatcgtctccgtcgtcgctgctcttctccaatgcccagcagttcccgcacaccacctcttcgggccagcagctagcccacaccaacgccggcggcgcagcagctggttctctcccaagtctggacgacgacggcggcagcggtcaggacagccacatgccggaatcgtggagccagatgcttctaggggagttcgctggagagcgctacgccgccaccgcatgtctgctgtcaaagggcgtagaggactggggggatcacgctgcggcagctgcaagcgcgtgcatggtgggtggcggcggcggcgtggaggaggagggctcggccgccatgcctctgtacagcttatatggtggtggtagtcacagtcacagccacctcgctgcagctggtgaccatgagatgccgccggcgccagcagcagcagcagcaggggccaataagtctcagctgagccagatgctcctcgcctcgtcgcctaggtcctgcgtcaccaccagcctcggcagcaacatgctcgacttctccaacaacggcgtgcccccggcgcccgatcagctgaagagccaccacccccatcaatccgataactcatccgaggtgagatgagctagctagcttgatatatgatccgtgaaagttattcgttcatagttcataagctgggttttttttatttttttgctctttccaaatcactttgttttattattccacactattaatttcctagccggccggtttcttttccataagaaataaaactgttgtcaaagaatctcttgtcgactaattgcattcatatgcttatggatgccatgtagtttatttgtttaagctgcgcgatggatatggcatgcattcgttttattgccaaaactttttttttattaacgctacgtttcatctcgatcgccctcgggaagagatggtactttgaaaaggcacactccattattcatcctagttcgagatggaaagatacaccatgattatgttttctctcgcctcatcgatgaccgacaataagctaggatgaggggggttatgctggcagtaagatctcttggtgagggtgcattgtgtaccaagcttccatgaagaacactgaaacgaactaattaaaggcacagtagtagtagtcct

SEQ ID NO: 18623 - DNA, 1559 bp, Zea mays
aaggatttcccttacttttatgattgaacagctcgtgacttcactatcacttggtgcttcttgtgtgcatgtttctttgtaaaatagatagcttatattctctacatatttggtggaggaattaccttttcggcgtgtttgtgactttgttctctggtcatggctctggccttctaggcatgcaaacgagttttacagataccacgtagcaggcagtgtcctggcctcctggcctcctggccctggggcacctttctctccctgaaactaaagggagagagagtactatgagaaacaatttgccacattgaggtcctttgaggaagttgactcactagaagaatccaatgaaatcaacgaggatgaggagcttgcggagcaaatccagagtgaatttgctatgaagatatcaaattatgcaaacattgttctcttagcgttgaaggtatacgctacaataaaaagtggatcaattgctatagctgcctcaacactggattcactgcttgatctcatggctggtggtatcctttggttcacacatctgtcaatgaagagcatcaatgtctacaagtaccccattggcaaactgagggtacagcctgtaggcattatcatcttcgctgctgtcatggccactttaggcttccaagtatttattcaggctgttgaaaagctggtagtgaatgaggctccagataaactgaaccaagtgcaattattgtggctatattcaatcatgatctttgcaacaatagtgaaattaggtctgtggctctactgccgaacgtctggtaacaagattgtccgtgcttatgctaaggatcactatttcgatgttgtcacaaatgttgtgggtttggctgctgctgtccttggtgatagattctactggtggattgacccaattggtgcaattgttcttgcagtgtacacgatttcaaactggtctggaacagtgtgggaaaatgcagtatcgctggtaggtgaatcagctcctccagaaatgcttcagaagttgacatatctggctatcagacaccatcctcagattaagcgtgttgacaccgttcgagcatacacctttggggtgctttactttgttgaggttgacattgagcttccagaggacttgccacttaaggaggcacacgccattggagaatctctccaaatcaagattgaggagctacctgaagttgagcgagcattcgttcacctagatttcgaatgtgaccataagccggagcattcaattctcaacaagcttcccagcagccagccttgatccgaacgaatcctgtgtggtagattgtcgtgcagaatctgctgcagttcttgcattggcgtcttgtgctgtatgacaaaactaagagttcaattagttttgtggcggtgagtttaagatcaggcgcatctaagactacgagagatgaaggtgccgaatgcagagatttctcgagtgtggaaccctttgtggttctgttggtatggtcttcgttttgagcgaaattaagcattttgctgttggcatcaaaaaaaaaaaaaaaaaaaaaaaa

SEQ ID NO: 18624 - DNA, 1678 bp, Zea mays
attgggtccctcgaggccggccggaagacgcgcgggtacggggcgtccttgccatttcccaccctacttgagctaggcggcaggacggacgcggacgggcgggggaggagaacacacgaccgcgacggaatcgcgaggggtaggcgaggcgaggcgaggcggcgaccgagggaggagcagtcgagcagagcgtagggggcgcgagggatggacgcgaacgggtgcggggagaatgacgacgcgcgggcgccgctcctggccgggcctgggcggcggcgcaactccgtcgcgtccatgcgcggggagttcgtgtcgcggttgcccaagaaggtgctcgacgccgtcgaccccgagcgcccgtcgcacgtcgacttctcccgctccaagggcctcctcgaaggggagagagagtactatgagaaacaatttgccacattgaggtcctttgaggaagttgactcactagaagaatccaatgaaatcaacgaggatgaggagcttgcggagcaaatccagagtgaatttgctatgaagatatcaaattatgcaaacattgttctcttagcgttgaaggtatacgctacaataaaaagtggatcaattgctatagctgcctcaacactggattcactgcttgatctcatggctggtggtatcctttggttcacacatctgtcaatgaagagcatcaatgtctacaagtaccccattggcaaactgagggtacagcctgtaggcattatcatcttcgctgctgtcatggccactttaggcttccaagtatttattcaggctgttgaaaagctggtagtgaatgaggctccagataaactgaaccaagtgcaattattgtggctatattcaatcatgatctttgcaacaatagtgaaattaggtctgtggctctactgccgaacgtctggtaacaagattgtccgtgcttatgctaaggatcactatttcgatgttgtcacaaatgttgtgggtttggctgctgctgtccttggtgatagattctactggtggattgacccaattggtgcaattgttcttgcagtgtacacgatttcaaactggtctggaacagtgtgggaaaatgcagtatcgctggtaggtgaatcagctcctccagaaatgcttcagaagttgacatatctggctatcagacaccatcctcagattaagcgtgttgacaccgttcgagcatacacctttggggtgctttactttgttgaggttgacattgagcttccagaggacttgccacttaaggaggcacacgccattggagaatctctccaaatcaagattggggagctacctgaagttgagcgagcattcgttcacctagatttcgaatgtgaccataagccggagcattcaattctcaacaagcttcccagcagccagccttgatccgaacgaatcctgtgtggtagattgtcgtgcagaatctgctgcagttcttgcattggcgtcctgtcctgtatgacaaagctaagagttcaattagctttgtgccggtgagtttaagatcaggcgcgtctaagcctgcgagacatgtaggtcccgcatgcagagatttctccagtgtggaaccctttgtggttctgttggtatggtcttcgttttcagccacaaaaaaaaaaaagaagggcggccgccgtcaagtgagctc

SEQ ID NO: 18625 - DNA, 3675 bp, Zea mays
ctgcaccgatccgccatagccccgctagcctgactccaacgataccctagttataacatctacttttgcatcatggtcgtagatcacataagagatacaatgtagatacacagatctttgcatatatataaatgtatctgtttcgaattgtccaattttttgaatagcatgtggtttatagatagggttagtttccatgctctactatgattgtattgataacagataaagaggacaaagtgttctggcggtaaataaggccagttttactgagttctgtcctttatgatgcattagctatttgatgatttatcaggttaatttaaaagatataaaaaattttatttggataaaacctattatcataaaagctaatgtgacacttttattattcgatttttaaggtggtgttcttagttttgttggtgtcctcatttttataattagttatgttttttcttattatagatcagaagagtaaaactgagcaaaaaaaatatgactaagagtaaaaacgaggaacgtgataaaactaaaggttttgtgttacgaaagtcaccgataaaaaaaaaagactcgaggcacctctcgataagtgattggagatcccttcatccggcccttctccattcacctacaactttcctcctacagcacgacggttcgcatcgcagcccactgggccacgggccacgacacttgcaaaatgaaaacccggcccacatagtccgaaattgaaaaccacagccgcgacgccgacgcgcaccgaacaacagctccgagaacgtatcgcccacaatcccccgcgccgaccgcaatctgtcactatagcctgcgcattcgcatccgggcatccggcatcccaccccacccacctccttcctcttcccgcccgctaaaacccacgccaccgccgcgcgccgccggcagcgcaagggacgcacgatggccatgcaggtggtgcgcaacctcgacctggagcggtacgcggggcggtggtacgagatcgcgtgcttcccgtcccggttccagcccaagacgggcaccaacacgcgcgccacctacacgctgaacccggacggcactgtgaaggtggtgaacgagacgtgggccgacgggcgccgcggccacatcgagggcacggcctggcgcgccgaccctgccagcgacgaggccaagctcaaggttcgcttctacgtgccgcccttcctccccctcatccccgtcaccggcgactactgggtgctccacatcgacgccgactaccagtacgcgctcgtcgggcagccctccaggaactacctctgggtgcgtgcgaattcctctctggcctccgtccgtctatccctcgccgaatcgtgcctgtctgcctaccaatccccctgtgtttgtgtgtgcagatcctttgcaggcagcctcacatggacgagtccgtgtacaaggaactggtggagcgtgccaaggaggaagggtacgacgtgtcgaagctccgcaagacggcgcaccctgacccgccgccggagagcgagcagagccccagggacggcgggatgtggtgggtcaagtccatctttggcaagtagccttgtggtggtgggtggcagcgcgggtgctgccgtgccgagcaggcgagcgcacgcaagagatgcctgtgaccgtcggttccgcgtgtacattcagcactagctggggattaagttggttcgttgttgctgtcgcgatctgcaaatggcgaaaagtgtgcttgtttcttgcccgtctgtattgtatcgaactttgagcgaatgtttcagtttgctgcatcatttgtttgtcatgtgctgaattccctgcttgaccgagttcgtaggcaatcctccatgtcgttctgttcagttgtggttaacgcagcgtggaaggaaactgaagttttacggagacggacacaattgccggctttctccgcggtgccgcttggtggcagcggccagcgggcagggagcgtggcacggcgtgctcagcgcgagccgagaagccgggaccgccgagggcgcacgcgacgtgtgaggggcactccatgacattcaacaattcggtatccaaattcccgagggcgcacgcgacgtgtgaggggcagctccatgacattcaacaattcggtatcaaaattcttattcacataggtacgtgcccgtgcgttgcaacgacattcagaatatttggcaaaatattagtgcacaacaattatatagtattgtaatgtgatacttctaggagataattcaaaaccttggataacttaaggccaataaataagtcaaaggaataacaaataagttggaaaatttggaaagtcaaagtactccacatacatggtaaaagaatgtttaatgtaacggtgaaagctacttcatcttctggaaatgtatgatgccccaataaactttggaatataagagatttgcacaacgtcagcatcctaaaaattacaccacaaaacacatgcaaagaagcaaatgagctaaaatctagaattgatcaactaaaaatcatggctcagaataaattaaagacaattactgctggtgctgggaagaatgtgtttacgtgctacaaggggaagaaatgcttagttaaggtatgtcactatatgcaagtatatgctcaggatggacaaccagtgtttccttatttcctgcatagtttagggccacacatttcaattatagcggatagtgtttatggcgataatccaatgatacacatataaaatagataatacctttgatttgacaacgcccaaggtcccataagtatctctaacattgtcaatacaatttagagcaaccttcaatagattccagggcacgcaagcctgaacatgggatgacaagttcatgaaaatgtcaacagtcacatttggagcctgagtgttcatatgaaggaagggcaacctaataatttccctgaaagcatctacagtctgtctagctcgagctagcttataaatatggagaatagcttcaagctgtctcagcataatttggtgctcagaaatgagatccttctcttgaatgttgcactcaagttttcacaagacaaattaaaacagattcaatcggcaaaataaccagcattctacctatgctagaattgaagaggaaaataacctggtttcagaagaatatctagttatccccaaaaaattcttggtatctaatatactccatgccatcgcacagactgcataacgtgcacttgtttattgtctgaagagccatggcaaaagctccaactcttttatgaatttccacaacttgtttcatatgaacacaaaccaaaattgaatacggttctataaaatgcatacctgatgtgaggtttcataaagtggtagttatttacaaaaattaattttcatcacaaagcagataatatcagaatatagaggtgagatcctattcgattcactaagcataattaagctcaatagcattgtagcaccttaactgagggtcagtttgggtttcatgtcccgtgaagaactttagaatatatgactgtcatggatccaatacgatagcaaaaaaatgtatttctgaaaagctactactgagccaagtagggattaagttcaactccttcaatcgaacatccagagcacgctcggtctattggacgtctcccatatgcaaa

SEQ ID NO: 18626 - DNA, 1162 bp, Zea mays
cattgggtacctcgaggccggccgggacatgactctcggcaacggatatctcggctctcgcatcgatgaagaacgtagcgaaatgcgatacttggtgtgaattgcagaatcccgtgaaccatcgagtctttgaacgcaagttgcgcccgaagccattaggccgagggcacgccccgggccggggcgtcgaccgcaatctgtcactatagcctgcgcattcgcatccgcgcatccgggcatcccaccccacccacctccttcctcttcccgcccgctaaaacccacgccaccgccgcgcgccgccggcggcgcaagggacgcacgatggccatgcaggtggtgcgcaacctcgacctggagcggtacgcggggcggtggtacgagatcgcgtgcttcccgtcccggttccagcccaagacgggcaccaacacgcgcgccacctacacgctgaacccggacggcactgtgaaggtggtgaacgagacgtgggccgacgggcgccgcggccacatcgaaggcacggcctggcgcgccgaccctgccagcgacgaggccaagctcaaggttcgcttctacgtgccgcccttcctccccctcatccccgtcaccggcgactactgggtgctccacatcgacgccgactaccagtacgcgctcgtcgggcagccctccaggaactacctctggatcctttgcaggcagcctcacatggacgagtccgtgtacaaggagctggtggagcgtgccaaggaggaagggtacgacgtgtcgaagctccgcaagacggcgcaccctgacccgccgccggagagcgagcagagccccagggacggcgggatgtggtgggtcaagtccatctttggcaagtagccttgtggtggtgggtggcagcgcgggtgctgccgtgccgagcaggcgagcgcacgcaagagatgcctgtgaccgtcggttccgcgtgtacattcagcactagctggggattaagttggttcgttgttgctgtcgcgatctgcaaatggcgaaaagtgtgcttgtttcttgcccgtctgtattgtatcgaactttgagcgaatgtttcagtttgctgcatcatttgtttgtcatgtgctgaattcccagcttgaccgagttcgtaggcaaaaaaaaaaaaaaaactcgaggg

SEQ ID NO: 18627 - DNA, 5059 bp, Zea mays
  misc_feature (2275)..(2275): n is a, c, g, or t
  misc_feature (2617)..(2617): n is a, c, g, or t
gatcttcaataggattacgcagaaggatgttgcttcatggaacactatgatcttgggatatgggatgcatggtcaaattgatgttgcatttgaattatttgatttaatgaaggatgatggcatcgaatatgatcatgtatcttatattgcagtattgtcagcatgtagccatggtgggcttgtagacagaggaaagaagtacttcagtcaaatgatcgctcaaaatattaagcctcagcaaatgcactatgcttgtatggtagatcttcttgggcgtgctggacaactgagtgaatctgctgaaataatcagaaacatgccttttcgtgctaattctgatgtttggggagcattgcttggctcttgccgtatacatggagacattgaactagcacgactggcagcagagcatttgtttgagttgaagcctgagaactcaggctactatactctgcttagaaacatgtattctgagtctgggatgtggaatgaagcaaatggggtcaagaaattaatgaaatcaaggaaggtgcagaaaaatccagcctatagctgggtgcagagcggcaacaagctacaagcttttcttgttggggatgaatagtgatttttggatgatttggcattaaatggaggtgcccccgggcttgaccgggcatggtgcgcctatatggaggcatgaaatggataaagtggatacagaaataccatgtgtagcattgttgatagtaacatcatctagcaatattgcagaaaaagggtttgcacgcagaagaccataattcatgcaattttcagtgaccaactaaaatcgtgacatttgacattcatgtgatgataggcagtggggtgccaacccttgcagaatgattaaccctagacaaggatccgaggcagaactcagcatggttaacaccactatcttttcaaggggaatggtaataaggagaatgagccgtttattagtgatgtaaccggcatcactgattctgccattctctcaggattaaagaacgacatgcaccaaatacagaggtacagaacctgcaggaatctttatctgatttccaatacgtatgttttgcatacactgaagcgcgcacagaggcagatgcagcactaatctagccagtaaaccaagcacgcacactcacgcgcacgcacacaccaagtgaccataccatcatacaacatgcagtcagggtttttttatcaacagtatgtcgcctcacactattaacaggcctgtgatctacctgaatgcctgagctgacttctgggtccagccttttcttcacagccttgttccccagggacacagacctcaagtctcaatgagcagagaagaatggacaagctatgtgcagcacatcggtggagtgcagaacctgatgggtgggttctattcagcagtctgagaagcaaggatggtcggcttcttcagccagtactgctcgaacctctgcctagcgtaatccttatagtcgaagtcgatatcgttgacatgatcctgcagccagagcccagaggatgtcagatttagatgaatggctattctggttcctaggtggggcgaataatggaagctatgcatgagcaaaccccccgaaattattccccataggccccaaactaggtggctggcgagggggtacttctcaatgcttttgatcaggttctctacctcctcttcagattcctcacctggtagggattgcaggaagagaatttatttcttcttctaaaactgatatatagacatatcctaaaaatccgtaaactagaggtgatcaggcataaatcaacaaacattagatttacctgaggagctcaggtatgtccgcacaaattgcttccgctcatcggtatctgtcgtgatatgagcagtaaggtaggatgagtgaacaaataacagtgcagaaatccaaaggcttcaaatatgtatatatatcacctggatatttgctgtagtccaatatgtgaggcttttctgaatggtagtctgcggccatttcacagaaatggtttgcgatgtcataagcaactgggttaaaacctgcatactcgtagtcctgcaaaggtggcaggcaagaaattaagcgagatcatagcaatgtatttttttccaagcattcaggataagtcagaaatggttcagaaattaagcatcggaaatgcagcagcgcctatgaaagagcagaatcagtgaaccaaattaacacacgccaaggtagcaagagcttacaatgatggtcagtagcctcgtctcttcgtngatcatgatgttcccatactggagatcgttatggcaaaatcctacgcgctcgcactcccctgagaactcgttctccagcgcagcgatctcctcctccatgctatccaagcagaactcttcggtttcatcagaggaggagtacaggctcttggcagttctgagccagttcctagcggaaacgatgcaactgtggcaatcagcacttcgcttcgacgataagttttgctttacaacatgctgtaccagagcaactgtgtaggcgggaaaaaaaaccagcagtaccttaatctttcccagatgagcacggattttgaaccaggcatgtcgaggctgtgaaattcnctcagtttggaggctatgatggctgaaatccccggatcacgtaggtcaggagctgaaagtgtctgaaaggaatagatgtgtcaacttccaaaaatcttaacaaataaaatgtgatccacttcatactagatatccaattcgcatggtaactaggaatgacagggtcgcaagttttgccttgtattgtatttttaaaatggtacaaagaaatgggaaacgaagacagaatagtgatgctttaacctactttttactcacaccttttcacctgtaaagccaaatcaacttcggcaacgactgttgtacaatcaacccttaaatacaagcatgcaagtgagacttctgattcgttagattataatccaactatatattacattaacataagccatgtcttaacataaaccttgatttataaaaataactttaacatagtgcagttatatctgcgattaaatcatgatctaacgcttgtacgtttgcacctaagatcttattgcacagtagtagttgccattaacttcaacatactgacctagtcttgatgactaattaagcgatgtagatacacagattcgtcaagtgttgacctgttagcatctctgtgccctgaattctaaagcaatttcatggatacagtgatgctacaagtaccgatactattcgcaagaagaaatgtcaacagcgcctagccttgcgaatcagaataaaatatttcagtgttctctgccacggcaagtacgtcagagacgatatcaagcaaatattttaaacaatacaatgcaaatctcaagaagagtctttatcaaacaaacaaaaaaagagaaaaatctaaagaagagtagaaccgtggcactggtatgaattatttagttcgctattgacttcagacctaaatgaataatgatcgttttcggataagattgcaaatgccaaaccgttgaaatttgtcgtagtacagttcatatctacatgatatatgcagggggaggaaggtgtcaaagcaagagaagctcactcaacacgttagttgagacttgagagcatgctggtagaggaatgtccacataggaaacttttaaaagaaatcgcttaatatgatgctggtagtaggctggttttaaacttggggattccaaaggactaggactagagaagagacagattccttcccaaaaagaatttagaaaattaaaagcacacttagaaaacaagaaggatcggagcagtcgaggagacaaagcgatcgatcgatgatgatgaagattaaagaagaagagtgcaagaagcgaatgcgcaccctggcatggatgaactcctcgacgcggccgttggggaagcggccgaggaggcgggggccgtggccatcccgcgacatgaactcgaacgtgcgcacctcgtcctccctgtcgaagaacaggtcgacgccctccccgtagacccgcaccagaaccgtccgcgcgtcactctgccccggcgccgacgagtccccgctgccggtggcccaccgcgcccggtacacctcgttggtcatggcgcccttgagcggcaccacctcgggctcgcgcggcccgcacccggccacgtcctcccacgccgcggccagctcgtgcagcagccgccgcgcctcgtccgggatgctccgcgcggccggcgccgccacctcggccggactctgctgctgctggctctccttcggcgccatgcccgaatcgacggagcggagcggctcggggttggacggcggaatcttcgcgtttcctgaaacgggagggatctgggtgtcggagagagagcgagccgttcgtgcgcgcgcgtcctttgcctggcttattcgtccccgcccccccggcctggcctggcctttataaatagagttgtacagcatgcgtggtgtcattcagattcaccctcaagtattgtctttatttttcacaattcaaaacgataacgattctatcacgtagctttcttgtaaaaaaataatgtatctcaattcccaagtatttatactatcctgatcctacacggaggtttcatacacttctaatataccttcaaagtattctgatattacaataatataataacattctctacataagacatgacattgcgatcatatggtaacacacaatgatcggtatggatgtcttttaaatatatccaatcaacttaaactgagttctacaccaaaccattaaaacaaattggttgatctgaaatcagcattcaaataaggagttaacaacggtcagtcatggcagtacacctatacaaactggattagccaagctaaaaaaaagctctatattttttttagataatgggaaaaagggttcccggcacatcaaagatgacagccgtccaaacaacacaagtctatagtggttgatctgaaaagctctatatatattctggcatgtttatgttatcggggac

SEQ ID NO: 18628 - DNA, 2255 bp, Zea mays
aatcgctcgcctcgtttcatcacctgagctctcctaatctcattcaccgttgcttgctctttgaattgcctttgcccccatttgctttcctgtttcttccatcccatccgtaccagctgacggtgcccgggttccatgcccagcggccagcgccttgtgacctgatccgcggctcgtccattcctccctccgtgaatggctcctccagcagggtctggggcagcgacggagggagggccggcacggcggcgcggcaccggcaccggtaccagccccggccgcaccaaagtgtgggtcgagccgccgggcaagagccaccaccagaccccggcgcggtcgctgcccccgccctcgcccccggccccgtcggtggcggccaagagggtgtccgtggtgtactacctttgccgcaaccgccatctggagcacccgcacttaatcgaggtgccgctcgccgccccggaggaaggtctctacctgcgagatgtgattaaccgcctcaacgtgctgcgcgggaagggcatgtcctccaagtattcctggtcttgcaagaggagctacaagaacggcttcgtgtggcacgatctgtccgacgacgacctggtgctccccgcgcagggcaacgagtacatcctcaagggctccgagcttcttgaccgctcgccgccgctagatcggcagcagaatggcgttagcaacccaaaggtggagggcctcaagccatgcaaggaagagtcccctcagtcgcggggctcgcaagaaggatgctcgtcgtcatcgtcttcgtctgcccttggcaaggagatctcacctccacctgccactcgacggccacagcagcaggcgcaatcagcagtgctgccatcgtcgtcggcttccaccaaccatgaagatgacctgtgcccgaccgcgcattcaggctcgtccggcaaccagtcccctgaacctgcaggaagaaatgctccattgtcagaggctagctccccgggaccttccgaatacagggtctgcagacccatcggagctcaggatgccgcgacacaaacagatgacagtgagagggatgttgctaaaacccatacttgcgtggtcggagtgtccatggatacgacgttagatgctgagattcaggaatgtcatcaaaggagctcactgctgttaccaaaggtacccaagattgttcaggaatcaccggccctgtgttcctctgatgcttcaccgggtgtcagagttgagaccttggagtccctaataagagcagaagcctgtaggagaagtagctttagaacactagaggaggaacacatgcttggcccaattggtgtgaaactgaagccagccaatttgctaatgcagcttatcacttgtggatctatatctgttaaagaacaccgaggctttgggttcatcccaacgtacaggcctcggtttacacaagttgagttcccttcgtcagtgttctccactcctgtggcattgcgacaccttgacaaaatcccctgcaatacaagaacaatcgggacgagagctccagagtctgaacgtttcagtgggagcttggttgagaccaagatgcaggacgagtcaaggagaggaatcagctcactcaaacgctcatcatcttatgacgaggatagagtttatagagcagcacattccaaaagtgatacagaaaactcttgtgagtcaggtagtttcaggtgtcttccgcagactatcagaatcatatcatgtaagcaatcgagaaatggaacaatactctcccctttctctgatgtgagaaacagctctagtcaacaagaatatagtactagatcctcaccactgggttcatcaaagagtgcaagcaataggatgactgatccatcactgggtaaagtagattcattccacaaggaaaaggacatgatcaagatcgaagaaaggcttccttctggagctcgggttataatccaatctgcacctttgtgtgaagatagtgatggcagcaatgaatcactgtaaggggctgtgttacatatgttttttttctttttatttcattttactgagaatgacatttgttggaatttggtgcttgtgtgtggcatagcttttggagtaggttcaaaggtattgattttgtaaactgtgaatgtgatagtcaacattttctcacaccttgaagaagagaatactttatcttgctttaaaaaaaaaaaaaaaaaaaaacgaaaaaaaaaaaaaaaaggtctggttttgatcttaatgcagtc

SEQ ID NO: 18629 - DNA, 2411 bp, Zea mays
ccgaaattcgcctcctctcacgacgcggcccaaccaacctgccaaaaaacctagctagatttagaaaaacaaaaaacctgtccccaacccgaaccgtgagatggctgagtacggcgagcgctaccagggcaacggcgaccaggccacggccgagggtggctatgcgcagaccgagtacgccgccggcgccggtggctcgccgccctccgacagcaatccctccgtgttctccgaccacgccgacggccgctcctcccagccccagcatgagacccaatcacatgacagtggttcctccaaatctcaagaaagggaccgagaacgtgataagggcaaggacagggagcgaggcagagaccgtgtccgcgaaaaggagaggggccgagacagggacaaggatcgtgaaagaggtgacagagacagggatcgtgatcgccaccacagggatcgtcgcgagcgcagcgagataagggaacaccgtgatcgttctgatgatcgtgaccgtcgcaggagtcatgattctgagaggagaagagatcgtgacagagatggccatcgtaggcatcgctcccgttccccttctaagggtcgtgaccgtgaccgcagatctagttctcattcacgctctagatcgaagagcaagcgtgtgagtggttttgaccaagcacctacacaacaggcagttcctattgttgctgctggtgttatccctggtcagctgcctggtgtcaccgctcctattcctggggttggggtgcttccaaacttgtataatttggctgcaggacagttcaacccccatgttattcagccacaagccatgacacaacaggctacccggcatgctcggcctgtctatgtgggcggacttcctccaactgctaatgagcagaccgttgccatattcttcaatggagttatggctgctattggaggaaacacagctggtccaggtgatgctgttcccagtcaaccaccgctatggcctaggggcttcattcagcagcatcctttggattgcaacatgatgagaaacattaatttttctaatgcatcctatggtccaacaacaatgtgggctcccattcagacaggaaatataagttccgaatcaaccatgctaccagccacacaatctgcagtatattggaatcattatatgaactttgtcaggaatcctcttggttcagttcaaggaaatccttttccagattcgttttcaggtacaaatactagtacacctttgcagggttcgaatacaataccttcaatacctgtcaacttggagtccgctgctgaacatagtgttcaggacatcaatagtcctataaagacttctgcccctgttacaaaaccaaagaaaacaaaggaacaaaattatactgctgctgaagaccttctactttgcacaacctggttgcaaattagcagtgatcctattgtccacactggacaaaggaagaagggactttgggcacgaatagaaaaaaggtacaacgaacaaaggggcgagtacccttgtagaatgaatcgagcccttagcagcagatgggacaagattagagcagatgttggtaagttctcaggctgttacgcaagagtgctgcgagagaaacaaagtggtttgacagacgacgataagacttccaaggcggcaactttgtttgcacatgaggagaacaaaccatttcattttatgcattgctggcataagctgaagggggaacctaaatgggagagcatttgtcaaggacctttccgaggattacatggaaaagcaattggatcttctggtggtccttttattggtgtagaagaatcagatagtgggtctgctggtttgactggtaaacggcctctctgtcgtgattcttctaaatcagagagaaagaaggctgcgtcatcaacgacgacggaatacttaagccgtcttcaagaattaactgaaaaactaattcagcgcatcatagaaaagggtgagaagaaatataagtacaatgaacaggacatggagctagagaagaagaggttggacttggaagcaaaaaaattaagcattcgtaaaagggaattgagattaaaagaactaagtatggccgaacaacaactcgagatgctggagcgtactcgtgaagacgaggtcgatccagaagtatggagtatgatgaaggagcgcaaaaaacatttgcagcagttcatatttagtttttgctaaatttactgttgtttaacatgtcgtgcttctgtttccatatccggtttgcgaagaaatttataagtgcattgtcttatttgctttctaaaacattataaagttgttgtatgcttatgtcttgcaagacatgtcagtgttattaaagtttgtaacgttaattctgaaaggaaatgggcattaactattttctataatc

SEQ ID NO: 18630 - DNA, 2457 bp, Zea mays
ttgggtacctcgaggcccgccggcgccttcaccgccacacgctgccacgcgccatatataaccagccgttccctcctctcatgctcccctttccaaatccgtctccgccctcacgcacgcggcccaactagcctaacaaaccctagctagatttagaaaaaaaatttgtccccaatccgaaccgacgaggagctcgccgccgtgagatgtccgagtacgacgagcgctaccagggcaacggcgacatgcccgcagccgaaggcggctatccgcaggccgagtacgccgccgccgccgcgcctgccgccgggggttcgccgcccgcagacagcaagccctccgggttctccgaccacgccgacggccgctcctcccagcaccagcacgagacacaatcacatgacagtggttcctcgaaatctcgagaaagggaccgagaacgcgataagggcaaggatagggagcgtgacagggatcgtggccgagaaaaggggagggaccgagacagggataaggatcgtgaaagaagtgacagagatcgcgatcgccaccacagggaccatcgagagcgcagcgagaaaagggaacaccgtgatcgttctgatgatcgtgaccgtcaccgtgatggtcgtgaccgccaccgtgatgatcgtgattctgagaggagaagagatcgtgacagagatggtcatcgtaggcatcgctcccgctccccttctaagagtcgtgaccgtgaccgcagatctagatctcgttcacgctctcgatcaaagagcaagcgcgtgagtggttttgaccaagcacctccacaacatgcacttcctattgttgctgctggtgctatccctggtcagcttcctggtatcactgctcctattcccggggttggggtgcttccgaacttgtataatttggctgcaggacagttcaacccccttgttattcagccacaagccatgacacaacaggctacccggcatgctcggcgtgtctatgtgggtggacttcctccaacagctaatgagcagaccgttgccatattcttcaatggagttatggctgctattggaggaaacacagctggtccaggtgatgctgttcttaatgtctatataaaccatgacaagaaatttgcttttgtggagatgagatctgtggaggaagcaagcaatgcaatggctttagatggcataatgtttgagggagcaccagtgaaggttagaagaccaacggactataatccttccctagcagctgctcttggcccgagccagccaaatccaaatctcaatcttgctgctgttggcttaacacctggctctgctggaggattagaaggtccagaccggatctttgtaggtggtctaccatattatttcactgaggctcaagtgcgggagttgctcgagtccttcggacctctgcgtggattcgatcttgtgaaggatagagaaactggtaactcgaagggatatgccttctgtgtttaccaggatcttaatgtcaccgacattgcctgtgctgcccttaatggcatcaagatgggggacaagactcttactgttaggagggcaaaccaaggagcttctcagcctaggccagagcaagaaagcatcctgctgcaggcacagcagcaggtgcaaatgcagaaactcgtataccaagtcggaggtgccctgccgacaaaagttgtctgcctgacacaggtagtgacagcagatgaactgagagacgatgaggaatacaatgacattgtggaggacatgagggaagaaggacgcaaatatgtcccacataatgccattgcagagtgttttatagtccgaccctatgcaatattggcaatcgggctttaacccacagaagacactattcttttgagtttgattaatcattatatcattagcctcttgcctatatatctctactcactaacacttggacaggtaacttggtgaaagttgtaattccacgacctgaccccagcgatgctccagttgctggtgttggaaaggtgtttttggaatatgcagatgtcgagggctcgaccaaagcaaagacggggatgcatgggcggaaatttggcgggaaccaggtggtggccgtgttctatcccgaggacaagttcgctgctgagcagtatgactgaaagttgtagaacctgttctagagttgcaacacacaatgtgtgtgttttttttaaaatctttgagggtaccggtttctcttgaatttgaatcttatctagttataagtttggtgcaggaccagtcgataagcgataagtttgtgcaggaccattaggctttgtttgggtaattagtattgatcccaatccaaatctatatatgttaatgccttgttcagttattcttattccatatggattggagtgtatcggaatgagttttgacttgctatagatttaaacaaactcaaaaaaaaaaaaaaaaaaaa

SEQ ID NO: 18631 - DNA, 1165 bp, Zea mays
  misc_feature (1154)..(1154): n is a, c, g, or t
ctcgaggccggccgggccgggctttccaatccgtctccgccctcacgcacgcggcccaactagcctaacaaaccctagctagatttagaaaaaaaatttgtccccaatccgaaccgacgaggagctcgccgccgtgagatgtccgagtacgacgagcgctaccagggcaacggcgacatgcccgcagccgaaggcggctatccgcaggccgagtacgccgccgccgccgcgcctgccgccgggggttcgccgcccgcagacagcaagccctccgggttctccgaccacgccgacggccgctcctcccagcaccagcatgagacacaatcacatgacagtggttcctcgaaatctcgagaaagggaccgagaacgcgataagggcaaggatagggagcgtgacagggatcgtggccgagaaaaggggagggaccgagacagggataaggatcgtgaaagaagtgacagagacagagatcgcgatcgccaccacagggaccatcgagagcgcagcgagaaaagggaacaccgtgatcgttctgatgatcgtgaccgtcaccgtgatggtcgtgaccgccaccgtgatgatcgtgattctgagaggagaagagatcgtgacagagatggtcatcgtaggcatcgctcccgctccccttctaagagtcgtgaccgtgaccgcagatctagatctcgttcacgctctcgatcaaagagcaagcgcgtgagtggttttgaccaagcacctccacaacatgcacttcctattgttgccgctggtgctatccctgaaggcaaccttggcccactttgtcacctgctgccaatggattgagctgactgctgtagctttgatgtacgaggacactatctggtttggtcagcttcctggtatcactgctcctattcccggggttggggtgcttccgaacttgtataatttggctgcaggacagttcaacccccttgttattcagccacaagccatgacacaacaggctacccggcatgctcggcgtgtctatgtgggtggacttcctccaacagctaatgagcagaccgttgccatattcttcaatggagttatggctgctattggaggaaacacaggtggtccaggtgatgctgttcttaatgtctatataaaccatgacaagnaatttgctttt

SEQ ID NO: 18632 - DNA, 2173 bp, Zea mays
cacctcctccgaaatcgcctccgctccccgcacgcggtccaaccaacctaccaaaacctagctagatttagagaaaaagaaaaactgtccccaacccgaaccgccgagcccggcggccggtgccgtgagatggctgagtacggcgagcgctaccagggcaacggcgacccggccacgcccgagggtggctacgcgcagaccgagtacgccgccgccggtggctcgccgcccgccgaccgcaagccctccgtgttctccgaccacgccgacggtcgctcctcccagccccagcatgagactcaatcacatggcagtggttcctccaaatctcgagaaagggaccgagaacgtgataagggaaaggacagggagcgaggcagagaccgtgtccgcgaaaaggagagggaccgagacagggacaaggatcgtgaaagaggtgacagagacagggatcgtgatcgccaccacatggatcgtcgcgagcgcagcgagataagggaacaccgtgatcgttctgatgatcgtgaccgtcaccgcgatgatcgtgaccgtcgcaggagtcatgattctgagaggagaagagatcgtgacagagatggccatcgtaggcatcgctcccgttccccttctaagagtcgtgaccgtgaccgcagatctagatctcgttcacgctctagatcgaagagcaagcgcgtgagtggttttgaccaagcacctacacaacaggcacttcctattgttgctgctggtgttatccctggaggcaaacttggcccacattgtcatcggcttccactggattgagctgactgctgtagctttaatgtcagctgcctggtgtcaccgctcctattcctggggttggggtgcttccaaacttgtataatttggctgcaggacagccacaagccatgacacaacaggctaccaggcatgctcggcgtgtctatgtgggcggacttcctccaactgctaatgagcagaccgttgccatattcttcaatggagttatggctgctattggaggaaacacagctggtccaggtgatgctgttcttaatgtctacataaaccacgacaagaaatttgcttttgtggagatgagatctgtggaggaagcaagcaatgcaatggtcttagatggcataatgtttgagggagcaccggtcaagattagaagaccaacggactataatccttccctagcagctgctctgggcccgagccagccaaatccaaatctcaatctttctgctgttggcttaacacctggctctgctggaggattagaaggtccagaccggatctttgtaggtggtctacaatattacttcactgaggcccaagtgcgggagttgcttgagtcctttggacctctgcgtggatttgatctggtaaaggatagagaaactggtaactcgaaggggatatgccttctgtgtgtaccaggatcttaatgttaccgacattgcctgtgctgctcttaatggcatcaagatgggagacaagactcttactgttaggcgggcaaaccaaggagcttctcagcctaggccagagcaagaaagcatcctgttgcaagcacagcagcaggtgcaaatgcagaaattcgtataccaagttggaggtgccctgccaacaaaagttgtatgcctgacacaggtagtgacagaagatgaactgagagatgatgaggaatatgatgacattgtggaggacatgagggaggaaggacacaaatatggtaacttggtgaaagttgcaattccacggcctgaccccagcggtgctcctgttgctggtgttggaaaggtgtttttggaatatgcagatgtggagggctcaaccaaagcaaagacagggatgcatgggcggaaattcggcgggaaccaggtggtggcggtgttctaccctgaggacaagtttgcagctgagcagtacgactgaaaagttttagaacccctattctagagttgcacttgtggcacacaatgtggttgttttgaccttttgtagttaagtttggtgattgatccgctgataagcgatacaagtctcgtgcccaagtattatatcagccggtatgtggctaagatggtttcggtccatcaatcgactgacatatacaacatctaggatcttaaaaaaaaaaaaaaaaaaggcccctagggcc

SEQ ID NO: 18633 - DNA, 2267 bp, Zea mays
ctcgagggccggccggccccgccccctttccaaatccgtctccgccctcacgcacgcggcccaactagcctaacaaaccctagctagatttagaaaaaaaatttgtccccaatccgaaccgacgaggagctcgccgccgtgagatgtccgagtacgacgagcgctaccagggcaacggcgacatgcccgcagccgaaggcggctatccgcaggccgagtacgccgccgccgccgcgcctgccgccgggggttcgccgcccgcagacagcaagccctccgggttctccgaccacgccgacggccgctcctcccagcaccagcatgagacacaatcacatgacagtggttcctcgaaatctcgagaaagggaccgagaacgcgataagggcaaggatagggagcgtgacagggatcgtggccgagaaaaggggagggaccgagacagggataaggatcgtgaaagaagtgacagagacagagatcgcgatcgccaccacagggaccatcgagagcgcagcgagaaaagggaacaccgtgatcgttctgatgatcgtgaccgtcaccgtgatggtcgtgaccgccaccgtgatgatcgtgattctgagaggagaagagatcgtgacagagatggtcatcgtaggcatcgctcccgctccccttctaagagtcgtgaccgtgaccgcagatctagatctcgttcacgctctcgatcaaagagcaagcgcgtgagtggttttgaccaagcacctccacaacatgcacttcctattgttgccgctggtgctatccctggtcagcttcctggtatcactgctcctattcccggggttggggtgcttccgaacttgtataatttggctgcaggacagttcaacccccttgttattcagccacaagccatgacacaacaggctacccggcatgctcggcgtgtctatgtgggtggacttcctccaacagctaatgagcagaccgttgccatattcttcaatggagttatggctgctattggaggaaacacagctggtccaggtgatgctgttcttaatgtctatataaaccatgacaagaaatttgcttttgtggagatgagatctgtggaggaagcaagcaatgcaatggctttagatggcataatgtttgagggagcaccagtcaaggttagaagaccaacggactataatccttccctagcagctgctcttggcccgagccagccaaatccaaatctcaatcttgctgctgttggcttaacacctggctctgctggaggattagaaggtccagaccggatctttgtaggtggtctaccatattatttcactgaggctcaagtgcgggagttgctcgagtccttcggacctctgcgtggattcgatcttgtgaaggatagagaaactggtaactcgaagggatatgccttctgtgtttaccaggatcttaatgtcactgacattgcctgtgctgcccttaatggcatcaagatgggggacaagactcttactgttaggagggcaaaccaaggagcttctcagcctaggccagagcaagaaagcatcctgctgcaggcacagcagcaggtgcaaatgcagaaactcgtataccaagtcggaggtgccctgccgacaaaagttgtctgcctgacacaggtagtgacagcagatgaactgagagacgatgaggaatacaatgacattgtggaggacatgagggaagaaggacgcaaatatggtaacttggtgaaagttgtaattccacgacctgaccccagcgatgctccagttgctggtgttggaaaggtgtttttggaatatgcagatgtcgagggctcgaccaaagcaaagacggggatgcatgggcggaaatttggcgggaaccaggtggtggccgtgttctatcccgaggacaagttcgctgctgagcagtatgactgaaagttgtagaacctgttctagagttgcaacacacaatgtgtgtgttttttttaaaatctttgagggtaccgttttctcttgaatttgaatcttatctagttataagtttggtgcaggaccagtcgataagcgataagtttgtgcaggaccattaggctttgtttgggtaattagtattgatcccaatccaaatctatatatgttaatgccttgttcagttattcttattccatatggattggagtgtatcggaatgagttttgacttgctatagatttaaacaaactcaaaaaaaaaaaaaagggcggaaaaaaaaaaaaaaaaaaaaaaaaa

SEQ ID NO: 18634 - DNA, 1977 bp, Zea mays
gtcgacttttttttttttttttttttttttagcttgccaactacgaacatatttattatatttcgaagtctccaaatttactacacggatgagcttctcaagccattctaaacgaacactttaaaagacacacacacgcaatatgtgtttgactcccttatcaataatctgctactggtagtagggtacgtcgttcgctgattccgaattattagcttagctaggtggactcttcgcccaacttctggtggtccttgacgaacctgccccagtaccagtggcgcgcgaagacgtgagccatggactcgagcggcacgcccttggtctccggcacgaacgccacggcgaaggcggtcatgacaaccagccacgacgcgtagaagaggaaggtgccgtacttgaagcagcacagcatggccaggaagaactgcgcctgcaagaagttgagccccaggttgagcgccacggccgcgccctgccccgccgaccgcacctccacggggtatatctcgccggggatggtccagtacagcgcgccccacgaccagctgaagctcgccgagaagatcagcgccaccaccagcaccgtcaccgcgtaccccttgggcatcttgctcccgttgccgaggtgtgatccgattatgctcgccatcgccacctggcacgtgaacatgagcgcgccaccgatcatgaagagcagcttccggccgtagcggtccatggcgaagcccgacgcgaggatgccgccgatgttcatgaggcccaggatgacggcgcccatgagcgcggcgtcgctctcgaagccgacggtccggaacagtatcggcgagaagaaggcggtgacggccacccctgtgaggttgaggaacaccgggaacgccacggccatcaccaggtagggccggtactcccggcgcaggatccggcggaacgcgccctcctcgttccggcggtcgttctccgccgcggcgaggatgtccgcgaactcggggccgatgtccacgcccttgccgcgcacccgctggagcgcggcgcgggcgtcgtcgtgcttcccgcgcaggacgaggctgctgggggtgtccgggatgaacgcggcgccgaccaccatgacggcggccgggacggaggcgaggccgagcgagaggcgccagccccagcccgggatccgcgaggtgccgtagttgatgaggttggccaccaggtacccgacgctgatgaagagggggaaggccgagatgaagccgccgcgccagcgcgggggcgacacctcggcgaggtacaccggcgtggcctggccggagaagccgagccccaggccgagcagcatcctcccgacgatgagcatggcgatgttggccgcggcggcgttgacgagggcgccggccaagaacaggccgccgccgatcagcatgacggcctgccgccccagccgccgggtcacgcggctcgccagcagcgtccccaccatgccgaacgcgtacagcgacgacgtgaaggccgtcagcgcctggttgttgtaaatgcagtacacgtccttgttggcgcgcgccgtcctcttgagcaacccggggaagaacttgttcaggaaatcctccatctccgacacacctcctgagatgccaatgtcgtagccgaagatgaggccgccggaggccgccatgaggcaggtcacgacgacggggacggtgaggccgccgccgtagtccgccatgccgccgccgctgccgttgaggaggaaggcgccaccgggcatttctcggccgacggcccgccgctgctccccaaggtgaacagaccacctccccccgcgccgcggagattttttttgttgttgttgtgctacgggctacgggctacggcgaaccaggcaggagcagctaggctagcgcgcgcgggcacgggcaccgagcactggcagggcagtccagtgcccgcagagcacccgaggttgatgctgctgtgtgggcgtgccccggg

SEQ ID NO: 18635 - DNA, 1884 bp, Zea mays
aacttaaaatataacgtctatatcactgcgaacgttcgcttaacattaacaaccttgcatgacgtactcctgtattagaaaaaccacggacagggcacacgcattgatttccagccttcgtccacagacaactcttcctcagacgacgaccacagcagacaaactgcaaccattgacacacacaacgtccggaagcgtgtcacgtccacaacagaaggccgcatcagtcactcatcaggggtcctccgcaacagaaggctgcacgaaccgtctccagtaccagtggcgctcccagatggcgcccatggcctcgagcggcacccccttggtctccggcaggaacgccacgacgaaggcggtcatgacggctacccaggccgcgtagtagatgaaggtggcgtacttgagcgtgcacagcatggagaggaacgtctgcgtgagcaggaacgtggcgcccaggttgacggccacgctgatgccctgccccgccgaccggatctccacggggaatatctcgcctgggatcacccaggtcagcgggccccacgaccagccgaacgccgccgagaagacgcacgtcagcgccagcaccgcgagggagtagggcctggccatcgcggacccgccgtcggccccgatctgggaccccatgatccacgcgaccgcgacctggcaaacgatcatgacgaagccgccggtgaggaacagcggccgccggccgtaccggtcgaccgtgacgatggacaagagcgtggaggcgaggttgacggcgccgaggatgacggcgcccatgagcgcggcgttgctgccgaacccggccgtctggaacagcacgggcgagaagaaggcgatgacgatgacccccgtgagctgctggaacagcgggaccgccacggccacggccaggtggtgccggtgctcccgccggaggatcctgcggaacgcgccctgctcgtgggcgcgcgcggcctccacggcgcgggccacgtcctccagctccgcgtccacgtccgccttggcgcccctgacgcgccgcagcgcggcgcgggcctcctccgcgcgcccgcgcacgaggaggctgctgggcgtgtccgggatgagcagcgcccccgcgaggatgacggcggcgggcgccgcggccaggcccagcgagaggcgccacccccacgccgggatgcgcgaggtgccgtagttcaccaggttcgccgccaggttgccgatgctgaggaagagctggaaccccgtcgtgaaggcgccccgccacttggccggcgccgtctccgccaggtacaccggcgccgcctggttggtaaagccgatgccgaagcccagcagcatgcgtccgacgatgagcatagcgacgttgacggcggcggcgttgacggcggcgccggcgaagaagagcgcgccgcccgcgagcatgacggcctgcctgccgatcgccctggtgacgcggctggcgacgagagaggcggccagcccggccaggtacagcgacgaggtgaacgccgtgaggacgtggctgtcgtagacgcagtactcgtcccgccgcgccgcggccatcctgcgcagcacccccgggaagaaggccgacaggaacgactccatcgccgtcacgccccccgagatgccgatgtcgtaaccgaagatgaggccgccggaggccgccatgaggcaggtcacgacgaccgagaaggtcacccggccgccgtagtcgacggacgggccatcggccacggcgaagccacccccggccatgcttgcctttgtcttcctgctcgctcgagcgccgcaggctttacctactacagtagtagctagctagctaccatcgtcaccgaacagctcttcttgattaggatcttctaggtaatggtctcgtgc

SEQ ID NO: 18636 - DNA, 2128 bp, Zea mays
gtttttactgctctgtagtagtaggcggtggagagtgtactctctagtctctactcccccctctccgccttctctctccccgcaggcggtatcctcccttcctcggttcctctcctctcccccaccaccccaccccagcgccccaaatgccgctccaaccctagcctcccgccacgcctttcgatctcgggcggccatgggcaactgctgccgctcgccggccgccgtcgcgcgggaggacgtcagctcctcgcacttccccgcatccaacgcgaagaagaagccgcaccaagcgcgcaacggcggcgccggcggcgggcagaagcggctctcggttctgggcgacgaggggtgcgaggtcgtcgggatcgacgacaagtacgtcctggacagggagctcggccgcggggagttcggggtgacgtacctgtgtatggatcgggacaccaaggagctgctcgcctgcaagtccatctccaagcgcaagctgcggacggccgtcgacgtggaggacgtgcgccgggaggtggccatcatgcgccacctgcccaagagccccagcgtcgtgtccctgcgggaggcgtgcgaggacgacggcgccgtccacctcgtcatggagctctgcgagggcggcgagctcttcgaccgcatcgtcgcgcggggccactacaccgagcgcgccgccgccagtgtcacccgcaccatcctcgaggtcgtccagctctgccaccgccacggcgtcatccaccgcgacctcaagccggagaacttcctcttcgccaataagaaggagaactcgccgctcaaggccatcgacttcggtctctccatcttcttcaagcctggtgaaaagttttcagaaattgtgggaagcccctattacatggctcctgaagtattgaagagaaactatgggccagaaatagacatatggagtgcaggagttatcctgtatattttattatgtggagtccctccattttgggcagagactgaacaaggggtggcgcaggctattcttcgtggaaatatcgattttaagcgggaaccctggcctaatgtttcggataatgcaaaagatttagttcgacacatgttggagcctgatccaaagctcaggctaactgcaaagcaggttcttgaacatcattggcttcaaaatgcgaagaaggctcctaatgtccctcttggagatattgtaaagtcaaggctcaaacaattttctaggatgaatagattcaaaagaagggctctaagggtcattgctgatcatttgtctgctgaggaagttgaggatataaaggatatgttcaagactatggatactgacaatgatggaattgtatcttatgaagaactgaagactggaatagcaaaacttggttctcatcttgcggaatcagaagtacagatgctcattgaagctgtggacacaaacggtaggggggcactagactacggggaatttctggccgtctcgctccacctgcagaggatggcgaacgacgagcatctccggcgggccttcctgttcttcgacaaggacggcaacggtttcatcgagcccgaggagcttcgagaggctctggtggacgacggggcggccgacagcatggaggaagtggtgaacgacatactgcaagaagtcgacaccgacaaggacggcaagatcagctacgaggagtttgtggcgatgatgaagaccggtacggactggagaaaggcgtcccggcactactcgagagggaggttcaacagcctcagcatgaagcttataaaggacgggtcggtaaagctgggtgtcgagtgaaaaccgcaccgacgctcgttcttgtgtgtgtgtgtgtgtgtgtggtgtgtgtgcatgtagttttaggcccttggcccactaagcagaagaactctaggccttcttctttttttgttccctcgtgactgtcttgcgtgcaaattttagataggtggcagtggaaccctccgatttgtcttactacctgtgtaattagctatcccggtctcgctgacaggcactgggccaaacggtgtacctaatgctctcacccgttctcttgatgccagcccgagtgctgtacgatacagtgtgttttgccaaaaaaaaaaaaaaaaa

SEQ ID NO: 18637 - DNA, 1096 bp, Zea mays
cttataaaatctatagttaacatttgctttaaccaaataaattttagttttttcacaattctcaattcacctcagctttctcatagctcacaaaaaaaaacttgttttttttgaatctacagctgcaccagacaaatccttaacaattgtaacaacctaaacaaggtgtatgtcttcgagaacagaagcaagcagatggattcacagttatacactgctacagccatatgagactactcagcaacagcgaaagagaactctccgcccttaaaactgccctagcctaccggtgtatacatcacctttgccccatcgcgatacaggtaaatcttcacgcaagtctctggtccagagaggcccagtagctcctcgcagagctcctcgtggacagtggctttaggatcgaagattatggtaactgatttgagcgctcccatccagcccagcagtcgtttcacaaacatgaagtcacggtttgctctaagtccacaaacgttcagttcctggagagagttcagcacgagctcctcgctttcccagtcatgctgctggtgacaagcacagtctggtgaacaagcagctctttccttaatggattcacgtatatccagaaacagacttcttatcctagtagaaatcttaaggagatggaacacacaagagccaatagcatgtccacatgttagaaggatcaggtgtaatttcttagccagcagcgaggtcaggccttccgtgcagtagtggaagtaaacgatcttaattggatagaagatcgtgatgtgaagatcgcggatctccctaaagcgttgcaacaacttcacactgccccgattgtactgatgttcaaccaatccataccatgcacctgcaaagaaggagatcaccagtacctgtagctgggacaattcacccagctggacccacctcggatcatattcatcaagccacccgaacttttccagaatcggagcagtgatgtcagccactggagcagtgatgctggccaccggttgcctcttgaagaagcaattaaacatatgcagatctctcagcattggcgacacaaccctgagctgctgtaaccctttcaggttat

SEQ ID NO: 18638 - DNA, 1855 bp, Zea mays
cctcgaggccggccggactttattttcgggtccctcgaggctggccgggagcctgcagcgcagaaaaaccagcggcgcagtgacaaaagcccacagcttcttctccctactcctccagtcctccgtcatccgtttcgctctctgccgccgccaccgcacaagaagctagctcctgcctgtaccgccccgtcatggcgatgctatcccgcgcagcctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtaccttccgatgggaggcagcgtcaagatgattgaagagtcactgaagctggcgtacggagaagattctgacttcatcaaagataagaggatagcagcggtgcaggcgctttcaggcactggtgcctgccggctctttgctgatttccaaaagcgttttttgccggattcgcagatctacataccaacaccaacgtggtccaaccatcacaatatttggagggatgctcaagtgccacagaagacattcacatactaccatccagagtcaagagggcttgatttctcaggattgatgaatgaaatcaagaatgctccagatggttcattctttttgcttcatgcatgtgctcataatcccaccggtgtagatcctacggaggaacaatggagagaaatatcccatcagttcaaggtgaaaaaacattttccattctttgacatggcataccaagggtttgccagtggtgatccagagagagatgccaaggcaatccgaattttccttgaagatggacaccaaattggatgtgctcagtcatacgcaaagaacatgggactttatggacaaagagcaggatgcctgagtattttgtgtgaggatgagatgcaagcagttgctgtcaagagccaactgcaacagatcgcaagaccaatgtacagcaacccacctgttcatggtgcactggttgtttctataatcctcagtgatccagaattgaagagtttgtggttaaaagaagtcaagggtatggctgatcgtatcattggaatgcggaaggcacttaaggaaaatcttgaaaagctaggttcacctttgtcatgggatcatatcactaatcagattggaatgttctgctacagtgggatgacacctgaacaagttgaccgtttaacaaatgaataccacatttacatgacccgcaatgggaggataagcatggctggtgtaacgacaggaaatgttggttacctagcaaatgcaattcatgaggttaccaaaccaaattgagttagggtgctaccttctttggtcgatggaagctgatggaatgagactgtgaagcggcgtttccccccctctgttcctgacagaaataagtttagcctgctgctcccatatacatggacacagactcacatgtagacactcaagttttgagagctgtgatcctgtttcatttaatcaaaaacaattttgtttttttttccatcttgtcatggcaaatgttacaccagctgcaaaataattacaataattgatcttgatccaaaaaaaaaaaaaaaaaaaaaactagcagcgttgcacgtcaaatgtttggtgttaataaggacaggctatgtatcctctgccagattgttgtacatatacattgtggtgat

SEQ ID NO: 18639 - DNA, 1886 bp, Zea mays
aattaaataggagaccaagccgtgaggtggacgaggcgcgccacctgctaagccgaatcgagcagcagtagccaccttgccatggcgatgcaggctgctttcctcgcggggttctcgcagctcgccgcgcagccgagccgcgactgcgccgtggcagtggcgccgacgcgggtggccgttgctgcggtgggtagcgccaaggtgggcgcgcgggtaggcttgaaggcggggatcgccgcgcccgcgcccgcgcccgcggcgggccgcggggtgcggtgccgcgcaagcctgatcgagcccgacggcgggcagctggtggacctggtggcgcccgaggagggcgggcggcgcgcggcgctccggcgggaggcggcggaactgccgcaccggctgcgcctcggccgcgtcgacaaggaatgggtccacgtcctcagcgaagggtgggcgagtccgctgcaagggttcatgcgcgagcatgagttcctccaaacacttcattttaatgccatccgcggccaggatggcaggatggtcaacatgtccgtccccatcgtgctctccgtaggggacgcacagcgaagggccatccaggccgacggcgccacgcgcgtcgcgctcgtcgacgaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggagattatagaaccaatcaagtacaatgatggtctagatcagtatcgcctgtctccagcacagctgcgtgaagagtttgccaggcgcaatgctgatgcagtatttgcctttcagcttcgcaatccagtacacaatgggcatgctctacttatgaccgacacacgcaaacgcctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatcttcccctctcctatgcattatgctgggccaactgaggttcaatggcatgctaaggctcgtattaatgctggtgcaaatttctatatcgttggaagggatcctgctggtatgagccaccccacagagaaaagggacctctatgatgctgatcacggaaagaaggttttgagcatggctcctggccttgagaggctcaacatccttcctttcaaggtggctgcgtatgacacaaagcaaaagaaaatggatttctttgatccatcaaggaaagatgatttcctcttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaaatctggaaaatccttcatataaggaatgctactatatcttagcaagcggttctttgcgacatagaaccgatgctatatgattgtatactggctgtaagactgtaaaacactaggcttgattcggatgttaatgtgtgctttgtacccggtgtaccttctctgctggcagtgttgcacatgcactggagcacatcaaacgtttggtgttaataaggacaggctatgtatcctctgccagattgtacatatatacattgtggtgatatataattataaagctgacctctgccgtccgggctcgtagtgatgaacagttttatcactagttctcttt

SEQ ID NO: 18640 - DNA, 1840 bp, Zea mays
agtcccgcacggggggacgaggcgcgccaccggccgagccgaatcgagctgcagaaaccaccttggcatggcgacacaggccgctttcctcgcggggttctcgcagctcgccgcgcagccgggccgcgaccgcgccgtggcggtggcggtggcgcccggcgccgggcccggcccgggtggccgttgcggcggtgggtagcgccaagttgggcgtgaaggcggggacgtccaggaccgcggcggtggcgcgcctcggggtgcggtgccgggccagcctgatcgagcccgacggcgggcggctggtggacctggtggcgcccgaggagggcgggcggcgcgcggcgctgcggcgggaggcggcggagctgccgcaccggctgcgcttgggccgcgtcgacaaggaatgggtccacgtcctcagcgaagggtgggcgagcccgctgcaagggttcatgcgcgagcatgagttcctccaagcacttcatttcaatgccatccgcggccaggatggcaggatggtcaacatgtccgtccccatcgtgctctccgtcggggacgcacagcgaagggccatccaggccgacggcgccacgcgcgtcgcgctcgttgacgagcgcgaccgccccatcgccgtcctcagcgacattgagatctataagcataataaggaagaaagggtagcacgaacatgggggacaactgcacctggattaccttatgtcgaggaggcaattaccaatgctggtgactggttggttggtggggacttggaggttatagaaccaatcaagtacaatgatggtctagatcagtatcgcctgtctccagcacagctgcgtgaagagtttgccaggcgcaatgctgatgcagtatttgcctttcagcttcgcaatcctgtacacaatgggcatgctcttcttatgaccgacacacgcaaacgtctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaactgaggtgcagtggcatgctaaggctcgtattaatgctggtgcaaatttctatattgttggaagggatcctgctggtatgagccatcccacggagaaaagggacctctatgatgctgaccacgggaagaaggttttgagcatggctcctggcctcgagaggctcaacatccttcctttcaaggtggctgcatatgacacaaagcaaaagaaaatggatttcttcgatccatcaaggaaagatgatttcctcttcatctctggcacaaagatgcgcactcttgccaagaaccgcgagagtcccccggatggttttatgtgcccgggtggctggaaagtgctcgttgaatactatgacagcttggtgccatccgagggcagcagcaagctgcgcgagccagttgcagcctgaaatatgggaagcgcttcagataaggaaccgtactatgtcagcacaagcggttctttgcgacatagaaccgttgttgtatgattgtatactggcttgtaagacttaaaatcactgggcttgatttggacgttaatgtgtgctttgtacccggtgtaccttctctgctggcagtgttgcacatgcactggagcacatcaaacgtttggtgttaataaggacaggctatgtatcctctgccagatgtacatatatacattgtggtgttatataattataaagctgacctctgccgtccgggctcg

SEQ ID NO: 18641 - DNA, 465 bp, Zea mays
  misc_feature (33)..(33): n is a, c, g, or t
  misc_feature (74)..(74): n is a, c, g, or t
  misc_feature (165)..(165): n is a, c, g, or t
  misc_feature (436)..(436): n is a, c, g, or t
accctattaatgctcgtctctctcgcgctgagntcccaatttcctccacttcccaaaccctaccggcggcgcanagcattcacaaccaccgcccgaagatggtgaagtttctcaagcccggcaaggccgtaatcctcctccagggcaggttcgccggccggaagnggttgatcgtgcgcgtgttcgaggagggcacccgcgaccgtccctatgggcactgcctcgtcgccggcctggccaagtaccccaagaaggtgatccgcaagactccgccaagaagacggccaagaagtcccgcgtcaagtgtttcatcaagctcgtcaatttcactcacctcatgcccacccgctacaccctcgacgtcgatttcaaagacgtcgcctcgggcgggcccgacgcgctctccacccgggacaagaaggtcgaagcctgcaancggccaaggcgcgcctcgaggagaggttc

SEQ ID NO: 18642 - DNA, 1692 bp, Zea mays
gcatttcacacgcgaaatttccccttttccaacgccacagcaaacagcatccacagcggagagcgtctctttctccttcccctccctctttccacgacacaaaaagaaaccgaaaaccatcgacgcgctccgtccaccctcccctaccccgcgtcctactcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggccacacccaagccgccgccagcgggggaggagaagggcggtggcgcggtggtggagctcacgggcgtcccgcggagggttaacgtggaggcgcggcggctgcggacgaagctgggcacggaggtggtcgcgatgcacgtgcgccaggcgggggccaagctcacgctgctctactcccacggcaacgccgccgacctcggccagatgtacgagctcttcgtcgagctcagcgcccacctcaacgtcaacctcatggggtatgactattctggttatgggcaatctactgggaagcctagtgaacaaaacacttattctgacatagaagctgtatacagatgcctcatagaaacctatggagcttctgaggataatatcattctttatggacaatcagtgggcagtggtcctactttggatttagcatcccgattaactcgtttaagagcagttgttctacatagcccaattttgtctggcttaagagtgatgtatcctgtaaaacatacatactggtttgacatatacaagaacatcgacaaaattccattagtcaggtgtcctgtgttagtgatacatggtacagcagatgaggttgttgactgttcccatgggcggtcactgtgggaacttgctgaagtgaagtacgagccgctgtggatcaaaggcggaaaccactgcaacctagaactgtacccggaatacatcaaacatctgaagaagttcgttggagccatagagaaatcgccacccccacctccgatcgacgagtgcatggagagctcaggcccgtcggattgtaccccagcagaacccgagtgtacagcggactcaaggaagagcacggactgcagggacaaagcaaggccaagcatagatcagagacaaagcacggaccggcgggacaagccgaggggcagtacggataggagggacaagacgaggaagagcgtggaccatcccgagaagccgcgggctagcgtcgatcaaccggatcggccgaggaaaagcatcgaccggtttggaggcatgatgaagtcggtgaggctgtgcaatatcgactgcttcaaagtgacagcaacctctgggagctgaagagaaggaacggatggatagtagcaggaaaggttagtgttgggtgccgtctgtatgtattcttcccttcgtgtaacttattcaattgggcgattggtttggccgcagtagaaggcgtgtttttgttttctttttcttcgctccttcctcatacaattacaatggtgttgtttccgttgggctgttctttttaacatgagatgaaataataatcttgttgataaaaaaaaaaaaaaaaaaaaaa

SEQ ID NO: 18643 - DNA, 632 bp, Zea mays
  misc_feature (632)..(632): n is a, c, g, or t
ctccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggccacacccaagccgccgcctccggccccggccacacccaagccgccgccagcgggggaggagaagggcggtggcgcggtggtggagctcacgggcgtcccgcggagggttaacgtggaggcgcggcggctgcggacgaagcggggcacggaggtggtcgcgatgcacgtgcgccaggcgggggccaagctcacgctgctctactcccacggcaacgccgccgacctcggccagatgtacgagctcttcgtcgagctcagcgcccacctcaacgtcaacctcatggggtatgactattctgggtatgggcaatctactggggagcctagtgaacaaaccctttttccggcn

SEQ ID NO: 18644 - DNA, 782 bp, Zea mays
gcgcatttttttttttttttggaaaagtactatcgtgcaaagaatttttcttctccgggattcaagtcttcttcaaacattttttgaacagaattagggggcaattggcaggtagcgacaagcaatctcagcagatctccatcgagttcttttcctataaccaggggggcaacaaagttctctacacaatctcagaacaaattctcttccacattttgagagcgaatcagcgaaataacaacagacaaccatctctcgcgctttgtagccgcatcttgcaccatgccaatacaatagaatttcaccgaggtaccgggttcagccatggatgagctcggagcacttggccttgatccagcggaatcccctgcggaacgatgccttgactttgccctccgccgagtaagccttgtagctggccacccgccgccgcctcttcatctccggatcgctgaagcaccacgccgaccccacccctcccccgccgcccctattggataccggcggcggcgacctcgcgggcggcttgacgatgatgtcgatgcggcggtcaccgtagggcacgacctcgttgcggtaggggcggtcgtactcaccggcgggggcgggagccgcgtacgggcggtgcgcgcggtcgtagtcggcggcggcggccatcgcgaggccagacgacgcgggggcggaccgcgtgggagtctcgcggcgtggcgtttgtgcagagggagggagggagggaggccaacccggccccatttccccggccggcctcgaggtacccaatg

SEQ ID NO: 18645 - DNA, 1471 bp, Zea mays
  misc_feature (188)..(188): n is a, c, g, or t
cctccagtagtcgactctgcagagatagctcataaccgagggacgataaagacacattcatattcgtgaccctcttagagaagcaacgtcgtctcggtctgtcaatggccgagtttaatttggtctgcgggagtctagaagtggcgagcgcaatatgcgcgttgcacactttggactttgtagtacancctaactttagccactcaatttcaggactccttttgccgatttacttggaactccttttttttagtgaatctatcttcaaaatgtactgttcgttagaatcagccaatgcaaccaaactcactacaaaactagcgaacaaattcagacgtctgccttctggtcaaagaaaactagcgaatggccattgatttttcttttttttctttacacgttgacatggaaatatctagtctagttttttaaattgcaggcgggtgccgaaaagattacgctaaatcatgccagcgtgttcatctgcctatctagattctacttgatacgaatgtagagcactatagcgctcaatcaaggacataggctctggctaccttgtgcagcgggatattttgtttacatcttggtcgactagaagagaaaagacagtcaattaccccatcgtcaccaaaaaaagaaaagaaaaaaagcaacaactaatcattcgtggtacgtcggtcggggtttgctctgcttcaggtctcgcggccaccgcagcagagctcctggatgacgcgcgccgcggcggtccgggtggaggctgacgatgatccagaggaagacgaggacggcggcccagatgaggaggtccagcgacaggtgcgtcttgggctgcgacaccacgaaggtgagcaccaggctggagtaggccaccacgaaggaccagcgcacgtggcgcgagtcaacgggcatccgcaccagcaggctcagcgtcatcatcatggagctcgcgaaccccacccagctcgcgcccatgaacacccagtaccttggccggtgcaggtcgcgcatgatggggtcgccggcgcggtacgtgacctgctccttgccgtccctcgacgccgccgtcgtgtcctgctgccagtagccgccggggatgctggtgccgagctggtaggtgagcgtggtgatcagcgtggccaccaccagcagcgtgttggcgtcgttgcccacccaggtgtgggggccgccgccgagctgctgctggttcacggaggcgggctgcccgcgaactggcagcggcgggaacacgccgccgttgccgcccatctccaggtcacccgccgccgccgccgcgtttgggtgcacgcgaggctgagccatgggacgcacgcagcgcacacgacacacgcgcgcgggctaacaagcgagggattgttaggttgatggaaccgatcggtgggagctgaggtttggtgtgggaaattaaacttggagtagtgttggatccggccgcctgcgtccgcac

SEQ ID NO: 18646 - DNA, 1131 bp, Zea mays
gggtacctcggggcccccgggccggctctctctgaccttatccccttgcggcaaaaccttgcgcgcaacaatggccgcctccctcccgaccaccgccgcgcgcctcgcggccccggccttcgcctaccggtcgcccaaggctccctccgccaccgccctcccgcgtgccgccgccttccctgcaatcgccgtcgcggcggcgcccctgcgcccgcgccgcgcgccgaggccggtggcggcccgggccgggggcgaggagagggagacgatactgctccccgggtgcgactacaaccactggctgatcgtcatggagttccccaaggaccccgcgcccacccgcgagcagatgatcgacacctacctcaacacactcgccaccgtcctcggcagcatggaggaagccaagaagaacatgtacgccttcagcacgaccacctacaccgggttccagtgcaccgtggacgaggagacgtcggagaagttcaagggtctgcctggggtgctgtgggtgctccctgattcctacatcgacgtgaagaacaaggactacggaggtgacaagtacgtgaacggcgagataatcccctgcacgtacccgacgtaccagccgaaggagcggaggacgtccaagtacgagagcaggcggtacgagaggcggagagatgggccaccggcggccagcaggaaaccgaggcagcaggcaccagctcagactcagaccgagtcggcgtcttcgtgacgagctctgcaggcattttgtccacgtacctacctacctagaagtagaacaagagaggaggacgcctaaaattctgtcgcattgggcaccgcgtactggactggacaggcgggtcgggatccatcatccatcgtcagccagaaaattgtcgctgtccaagcagcctgggcagcttgtgtgtgactgtgtgtgctgatatcttgagctagctgtggcagaaactggaaaccctactgtgtgtgtgctgatatcttgtcatagcgagctgtgtgatgccgactggtgtagagctgtatcgctgattgcgtgaaaccgaaatgctgtggctttatttagactgatgttgtcacttccagtcatcggatcaaaaccagcactttgttcgttcc

SEQ ID NO: 18647 - DNA, 2061 bp, Zea mays
gcaacaactctgcatgctgacttgatggcaaagggtaaaagccgtcgtaaactaggcattcaaaaatcactaactcaagaatgtaaacctgccgagggtgctggcgattctggaagtgataaattgtcttactcactaagtactttggttcctcgcgccggccaactctctcattgcttatcatcacgtttgctccgtagatggtgcatgtttgagtggttctatagtgcaattgattacccgtggtttgcaaagagtgaatttgttgagtatttgaaccatgtcaagctaggtcatgttccaagactgactcatgtcgagtggggcgtcatacgaagttctcttggaaagccccgtcgattgtcgaagcagtttttgcacgaggagagagagaagcttgcgcagtatcgtgattcagtcaggcagcattatactgaacttctatctggcgttagagaaggtctaccaaccgatcttgcgcgacctctagcagttgggcagcgtgttatagcctgccatcctagaacaagggaacttcatgatgggaatgttcttactgtcgatcataatcagtgccgggttcagtttgatcgacctgaactgggtgttgagcttgtgaaggatatcgactgcatgcccctacatcctctggaaaattttcctgaatctctcagacatcaaagtgccatcaatggatactacagccacttatcggaagcaaaatatgaggatcagatgaaagagttggctagcggaggtgcagcaagatccacatcgaatttgaatggtaccgatgcaaccttctataccccttctggtcatccgatgagtaccttaatgaagcaagcaaaggccaacacggcagttaatgaggttgcagttgcgacacaacagtcaatgtacaatcaaccatgcacactttcgcagatacaggaaagagaagctgatataagagctcttggtgagctatcacgtgctcttgataaaaaggaagctttgctggtggagttgaggcacatgaatgaagaagtgtctggaaagcagaaagatggagaaattattaaagacttggagcatttcagaaagcaatatgctatggtgcttgtgcagctaagagattctaatgatcaagtggctgcagctttgctttcgcttcgccaacgcaatacatatcatgggaattcagggcagtctaaatctatggaaaatggcatagcccttgctggagcaccagatccgtataaccttttcagttatattaatccagagtctggttctcaagtgatcgaagttatcgagacttcaaagtccagggcaaaaatgatggttgatgttgctatccaggctatgtgcaaagtgagtgaaggagagaatgctttttcaaaaataggggaagcactagatcacttgaatagccgcggtactggctctggttcaagtatacttggcataagacggatacctcccgattcaggacagtcaaatgcatcttatcatgacgactgcacagcggcccctgcagcaaacagcagttcaaggttgccgaacggctgtgattcggaagctcaatttcccaaagagttgatatcatcctgcgttgctatgatgcttatgataaagaactgcacggagaagcagtatcaccctgctgaagtcgcgcacatcctcgattcggcactgtcaagcgtacaaccgtgcagctcccagaacatcccgatcttcagagagatcgaaatgtgcatgggcatcatcaagaaccaaatgctggcgttgatacccactccaagtggctaagcttcaatcctgccgcgggtatttaactaatgtactctgaaaacgaaaaaacggatacctgtatgtgatgtgcaatattcctttttttgctgttgtctgtatgtacaaggcgtgtgttattattcattgcctgttattattatattcaactggggtaaaaaaaaatatcatgtactctgtctccctttctccctctttctcaaggaggcatttccctccctttttatgtctaactaataactaatgggtaaaaaaaaaaaaaaaaaa

SEQ ID NO: 18648 - DNA, 1361 bp, Zea mays
gcaacagcaacggcgtcgcgctgcccccacaacaccaccacagcgaaaagcagcagcctcctttcaatccttcacccacctccccgctccccccggcctgtctctccgttcctctcacgcacttcttcctccacacagacacccacacccacccacccacttggccgcccggggcgccccataatcccccctggcctcttgatgactactgcgcccaacatcgagatgatcgcctcctcgctgcgccactgctccctcaccggcggcgctggcgggcggcgccggggaggcaccaggcgccgcggcgccgagggcggcggcgacaccgacggcgtcaccgtggagctgaactccgaggtggcactgccctaccactgggagcagtgcctcgacatccggacggggcaagtgtactacatcaactgggagaacggcacccggacgacggtggacccgcgcacggcgtcggcctttgtctcctccccgacaccgcgctcctccacgtctcggcgcacccggcgcgcgtccacgccgtcgtcggggtacacctccgtgtcgtcgtccctgggcgcggcggacgtcgtgaccggcgcgtggcgcggcgccagcaacgacagcgggtacgacaacgacgacgagcaggaggacggggaggcggacgacgaggacgaggccgagagcagcagcagcaccaccaccagcagcagcagctccagcagcacgggcagcagccgggggtcggcaatctcgtcgacgctctcgtccttctcgcccaccgacgagtccggctccggcgacaacggcggcgcccgcctcggcgccgggcacgtcctcgtggcggccggctgccgcgcctgcttcatgtacttcatggtgcccaagcgcgccgacgtgtgccccaagtgcggcagctccggcctcctccacctcagccgcaacggctacgcctgagatcgccggcgcggccgtatgctcgctccgctaattgtaggagggggatcggaggacgtctcctgaggcgcaggcagtcgtgcgtgcaatgcaagccacctctgttcggctcttggctagagatcttccataagaactaggagtactacgagtttttggtggggagagaggggagaggtccccaaacccgatctttggtcattcattgctgctacattgtacgccaattgcccaatgtatgggagcagagaggaaccattccttgatttcttttttttttttcttccttctccctactgtattttccatgcatgtcactgtttttttttcttcacttgtgcctgtggaattggatcagctaggtagagagaggctaaccctttttattggtttcaaaaaaaaaaaaaaaa

SEQ ID NO: 18649 - DNA, 3426 bp, Zea mays
tttgccttcgaagctctcatttgtgtatagcagaaggtatgcatgtaaacgttatcacattgcaaggaataatatttgaggcggatacacacataacttattgtttgtttaaaagcaaaagcaagtaagtgaccaacacaaataacctattgtttgtagtgatacatttctagttaaacaactcggagtgaaaatggttttatgacttgtttgagaacaggataaaattcacttgctacccaaaattgaataatatgtagattttaggcctttcaatttctttgctctaaacaggcccttaagagcgatagtgctgggcagctggggtgttgtgtttaataacaacgtgagcgtccaagtaaaacccgtgacaaagctatagggtataggggcaaacaaaagaagaaaacgaccaaagatgcctgcctcatcatcaagaaatgagccaaggattacatccacagtggttatatataacagtgggcggctgcaatctccactcggcctccgtcgctgcaacagcaacggcgtcgcgctgcccccacaacaccaccacagcgaaaagcagcagcctcctttcaatccttcacccacctccccgctccccccggcctgtctctccgttcctctcacgcacttcttcctccacacagacacccacacccacccacccacttggccgcccggggcgccccataatcccccctggcctcttgatgactactgcgcccaacatcgagatgatcgcctcctcgctgcgccactgctccctcaccggcggcgctggcgggcggcgcgggggaggcaccaggcgccgcggcgccgagggcggcggcgacaccgacggcgtcaccgtggagctgaactccgaggtggcactgccctaccactgggagcagtgcctcgacatccgggtacgtccattgctgcatatcgtaccctacgggtcggttccctcattccccatcacggctcgcgcctggacgccggtagcgcgcgcgcgggtttcctaatcatttggccataaatgggcaactgtctccgagtccgaggttggtgggtgccggcggcggcgcgtttctggaaaggatggatcaatcattccctcattaatggtgaaagtggtgagcagaccggccggatggggataggattttttttccgccccttcattaactcgctcccgccgcctgtccccatcttttgttctcttgctcttggattcttgccttgcgcctcccggacccggttcagatcagcttcttccttccccgtgttggttttttcgatggattgtttggcggggatttcttgaggacctccctgaatctctgagagagagagagagagagagagagagagagagtgtgtgtgtgtgtcgagcaacaaccaaccaacctatctttcatctcggttcgatcgagctcagaagactatttctttttccatctccttgttctgttatactactagcgttctcccaatttcatacggcagggaagtgattaaggcgagtccagatctgtccgtgttctcaatcctgacacatccctgcggatccgtccctttttactaatctgtttgtatctggaactcgagatttcgccgcggatttcttctggaccacagcgagcggttctgcaccctgttgctggttggtcctgggccgtaatcacccagcctaatcaactgctctgctcaagcgcgtgttccccactgcagatgcagagagatctttgagtttttccatctgacacgcaccaacttatcctgcagcaaggaagcacatcattattaactgaaaaggcctgtgatacgcaactcaagctgttcccccctccgcgtttactttcctcctcctggaaccaagttgcattgttttgcatctgattccaccccagcaagaaattcacacagaacccaagcaaaaagagcatctttttttaaaatttcttttgaaacgcaaacacatcatcataggcgaaaagttttgccatcgggcaaggctttttgctggaaagctcctttccatgattccgatccatctcagacagcagagatgctgttggtgaagcggaaggcgtgtgcggtcatggtggagtggagtttccttctttccagccctgccccagctgccttcctgcaacctgttccccgatacctgcatagtgcctgcacacccccacccccacctctaatgccactagttcgtgtgagtgtatgcactgtataaacagacaaacagaacgcaacaaagatgattaggaacggtctacgtgcaaatagattctatagcgttgtccaacagctagctgtttgtttaacgcagtaacctaattaatagctggtgtcttgcgttttttttttctctctgagctaattttcgtgcagacggggcaagtgtactacatcaactgggagaacggcacccggacgacggtggacccgcgcacggcgtcggccttcgtctcctccccgacaccgcgctcctccacgtctcggcgcacccggcgcgcgtccacgccgtcgtcggggtacacctccgtgtcgtcgtccgtgggcgcggcggacgtcgtgaccggcgcgtggcggggcgtcagcaacgacagcgggtacgacaacgacgacgagcaggaggacggcgaggcggacgacgaggacgaggccgagagcagcagcagcaccaccaccagcagcagcagctccagcagcacgggcagcagccgggggtcggcaatctcgtcgacgctctcgtccttctcgcccaccgacgagtccggctccggcgacaacggcggcgcccgcctcggcgccgggcacgtcctcgtggcggccggctgccgcgcctgcttcatgtacttcatggtgcccaagcgcgccgacgtgtgccccaagtgcggcagctccggcctcctccacctcagccgcaacggctacgcctgagatcgccggcgcggccgtatgctcgctccgctaattgtaggagggggatcggaggacgtctcctgaggcgcaggcagtcgtgcgtgcaatgcaagccacctctgttcggctcttggctagagatcttccataagaactaggagtactacgagtttttggtggggagagaggggagaggtccccaaacccgatcttttgtcattcattgctgctacattgtacgccaattgcccaatgtatgggagcagagaggaaccattccttgatttcttttttttttcttccttctccctactgtattttccatgcatgtcactgtttttttttcttcccttgtgcctgtggaattggatcagctaggtagagagaggctaaccctttttcttggtttccgttatattgtttttcttattagcatttgtggctcaacttagggtctgtttggttgcgggacagtgttgtgtgacagtcatgacaagaaag

SEQ ID NO: 18650 - DNA, 632 bp, Zea mays
ccggccgggataaacgacaagaccaaactagcaagagcagcagcgttcagagtttggaaaattcagacttgagctagaaccagaggaacaccaaacacgcacgcgcccaccccccgaaacggagagaactgaccccgcagagaagatggccggcgagatgagctgggtgggcaagaagatccacctctacaacgtcaccatgggcctctacatgctcgattggtgggagcggtgcctattcaacatattggtgctgatcctgctctggttcgtctgcttcaatggctcccgcttcgcttccgacgtcttcgaaagccacctgaaggcgcggattttccaaggctcaaattacggcctggcaattggcacgccctcctcataggccttcagcgcaacacacagaagcagcgaaatctgctggttctggaatgttaactagttcccacaaactttagcgctgtcgtgatgtgtatgatgtggttccaatatgtaagattttttttacagttattctctttattttcttgttttgtgtttgattacacgatatcacaccctgaactctactgtaattaaaaaccattttcttggtaaaaaaaaaaaaaaaaaaaaaaagaaaaaaaaaagcggcc

SEQ ID NO: 18651 - DNA, 684 bp, Zea mays
  misc_feature (672)..(672): n is a, c, g, or t
agtcaggctttccgattctttttgtgtacaatgttctgtataaattcgcgtcagccccggcgcccccccccccaacagcgcaccgttgattcagagttcagaattcagctacgttgaacctgcggaacacaggcgcccttagatctccgtaagaaggcggaacctgtagaagacatggccggcgagatgagctgggtgggcaagaagatccacctctacaacgtcaccatgggtctctacatgctcgattggtgggagcgctgcctattcaacatactggtgctgatcctgctctggttcatctgcttcaacggatcccgcttcgccactgatgtctacgaaagccacctgaaggcacggattttccaaggcgcaaattacggcatgggaattggcatgccctcctcctaagccttcaatgcaaaacacagaagcagcaaaatctgctagttctggaatctgaactgggttcccacgtgctgtagcctgtagtgatgtgtatgttgtagttccaatatgtaagattcttaacagtattctttatttaatgtactttgtgtaactaaggtttgagcgcacgatatcacatcctgagttctactgtaattatatccatttccgtggtattatgttttgttactcatttactatacgtggccacagtttgactanaaaaaaagaaaa

SEQ ID NO: 18652 - DNA, 723 bp, Zea mays
taaacaaaggcagtcagactttccgattctttttgtgtacaatgttctgtataaataaacgacaacctctgtgtccccaggagcgcaccgttgattcagagttcagaattcagctacgttgaacctgcggaacacaggcgcccacggaccgggaaggttagatctccgtaagaaggcggaacctgtagaagacatggccggcgagatgagctgggtgggcaaaaagatccacctctacaacgtcaccatgggcctctacatgctcgattggtgggagcgctgcctattcaacatactggtgctgatcctgctctggttcatctgcttcaacggatcccgcttcgccactgatgtctacgaaagccacctgaaggcacggattttccaaggcgcaaattacggcatgggaattggcatgccctcctcctaagccttcaacgcaaaacacagaagcagcaaaatctgctagttctggaatctgaactgggttccaacaagctgtagtgatgtgtatgatgtagttccaatatgtaagattcttaacattattctttattttaatgtgctttgtgtaactaaggtttgagcgcacgatatcacatcctgagttctactgtaattatatccatttccttggtattatgttttgttactcatttactgtacgtggccacagtttgactgcatgacatcacattcatagtattattagcttgttttttc

SEQ ID NO: 18653 - DNA, 624 bp, Zea mays
agcagcgttcagagtttggaaaattcagacttgagctagaaccagaggaacaccaaacacgcacgcgcccaccccccgaaacggagagaactgaccccgcagagaagatggccggcgagatgagctgggtgggcaagaagatccacctctacaacgtcaccatgggcctctacatgctcgattggtgggagcggtgcctattcaacatattggtgctgatcctgctctggttcgtctgcttcaatggctcccgcttcgcttccgacgtcttcgaaaggttttgttgaaacaatcatcgttgtggtgatgatctacgaatgtattcttgctagtcaattaatcactgttttaagacattaagcgtgggtttgattgttgttatgccacctgaaggcgcggattttccaaggctcaaattacggcctggcaattggcacgccctcctcataggccttcagcgcaacacacagaagcagcgaaatctgctggttctggaatgttaactagttcccacaaactttagcgctgtcgtgatgtgtatgatgtggttccaatatgtaagattttttttacagttattctctttaaaaaaaaaaaaaaaaaaaaataaaaaaaaaaaaaaaa

SEQ ID NO: 18654 - DNA, 3009 bp, Zea mays
cgaatgatggcaactggagagattgcatactccaagcaatcattctcttggccacaaaattaggcagaaggagcgtggttgatagggtgtaccggggaaaagggaggttggagaaggaggaattccctttcgctcgtaacaatgattttgtcggtaggaaaaaagagctttccgaattggaactcattttgtttggtgatgtcatgggagatggagaaagagaatattttgagctcacgacaaagcagaggagaaaaggccttgcagttaggcggtctgctaacaatcatgagcacatgaatactgatgacagcaaaggtaaggagcctgttatttggaaggagactgagaaagatattgagatgcagaggctgggtagtccattgtggcatgggcgtccactgagagtgaagaatggcgtaaggtgtggaaggaaaaaaagatctaggaagatactttatggtaagggtattgcttgcatatcaggggagcctggaattggcaagacagacttggttttggagtatgcatatagattctttcagagatacaagatggttctgtgggtcagaggggaaagccgatatattcgacagaactatttggctctgcggacttttctggaagttgacttaagtgtagatagtcacttgcatgaaaagggaagcgatcgatgctttgaagagcaagaagaggaagccattgccaaaattcgtcaagaattgatgcgtgacataccgttcttagtcataattgataatttggagagtgagaaggattggtgggataagagagtcataatggaccttctgccacactttggtggggagactcacttcatcataacaacacgtcttccacgagtgatgaacttggaaccaatgaagctttcttatttatctggtgctgaggcaatgactttaatgaagggaggtgtcaaggaccatccactggtggaaactgatgcactcaaaatcattgaggaaaagcttggaagattacctcttggcctaagtattgttggagctatactctcggagcttccaatcactccaactaggctacttgacacattgaatcgtacaccgctcatcaggaacttttcatggaatgatagagaagttctcagcttgaaaaatcatgaaatccttgtccgcctgctggatgtgtgcttatcaatatttgaccatgcagatggtcctaggagtctggcaactcggatggttcaagtatgtggttggtttgcaccctctgcagttccaattcacatgttggctcgtgctgcacacaaagtcccaaagaagcaatggaggggtccaaggtggagaaagtggtggcgaccacttacttgtggccttgcaacttctaggatgaagaaatctgaagctgaagcagctgcaatgttaatgaggtttggaattgccagatgcagtgcaaagcccgaacatgtacagttccatgatctgatcaggctatatgctcgaaagctaggaggcacaagaacagctccggccatggtccagtcagtgtacctccaaggctcaatcaaacattcctctgagcacctgtgggcttcgtgcttcatggtttttggatttggttctgatcctctgttggtagaactgagaccatctgaactaatgttctatgttaaacagattgtcatgccacttgcaatacacacatttataacatactcccgctgtaatgcagcactagagctgcttcgcctgtgcactgatgcattagagagagcagctgagtccatgcttgctcatgctggcaaatggagagaaacatcattctcctgctttaggcaagctcattcagaagcccagtacacttatctttggcaggagctggctcttctgaaagcttctgtactggaaacaagggccaagctgatgctccggggtggacaatatgacattggagatgacttaataaggaaggccatatttatccgtacttctatctgtggcgagcaccatcctgacactgtttctgctcgagaaactctcagtaaactcacaaggcttcttacaactgttcagcttagttgattcttatagtttaggagttcacaatatattcttttcagtgtgccttttcatgaacgccgtacaaaatgcaccagatcttgaaataacaaagtaaatttgtcttatatatcttgactgccttttgttgcttgatggttctgtctttctatcattcttggttcatcaatgtgcaacattggattgaactactgtattccagttttctgggctatacttttgatggcacacagaaaataatactgagctaatgtgtatgtaagtttgcatacctcaatgataaggtatcatagattgtgtccagttgaactcatacatggaatgttttgatttattgtgttgttagttgaagagttcggcattgcttttagttctgtagttgcatcaagtgcagctaatgttaactttagaagaacttggtgccatggatttgcactaggctattatcaacttccacattcctttgcgatgaacttgctgcatgttggactactctcagcatctgtcatgattgcaaccttcagctcagggacatatgtttttgttactaatttgctaaatcttggttgatggttggactattctctctctcgctctctctctctgactgatcttcatgtttgagagtaacctgcttatggagacttgagacagttttgtcaattggccagtctcttttgaaacgcagaggtgatatgagatcatttttgtatgttcaaatactgtcaacgggccatgattattggatacctttctttttgtgcaagttaaaggacacatttgtatctccatgcattactgtaatatctatggcagaattagcattaaatatgaaccaggtaatgtaaatatgatattgatcgattattattacagttctattttattttaatcaatcatatattacattgtttgtcataggatgcactggcactaatgtctactagtc

SEQ ID NO: 18655 - DNA, 2078 bp, Zea mays
gggtcgagtcagcccacccatggtgggtttgattaaaacaggataaccgattttatcaaacccacccatggtggagggggcaaggggatgagaatagtcgaaaggcctgatgaatttgtggattctgtactgagcgctcaacgggaagctgcagcatcgtttggtgtaaacacactattgattgagaagtatattactcaaccaagacacgtagaagtccaggtatttggcgaccaacatggaaatgcgatatacctttatgagagagactgcagtctacagagaaggcatcagaagatcatcgaggaagctccagctccaaatgtgccagctgagtttcggtctcatattggtggagctgctgtatctgcagcaaaggcagttggttactacaatgctggaacagtggagtttattgtggacactctttctggagagttctacttcatggagatgaatactcgactccaggttgaacacccagtgacagagatgattgttggtcaagatcttgtggagtggcaaatacgtgttgcgaatggagaacgactaccattatctcaggagcaggttccattaaatggacatgcatttgaagcacggatatatgctgaaaatgttccaagagggtttctccctgcaacaggaaccttacatcactaccgaccagtcccttctgacccaactgtaagagttgaaactggagtcgaagaaggagataccgtcagcatgcattatgatccaatgatagccaaacttgtagtatggggtgaaagtcgcacggctgcactagtcaagctaaagaagtgtttatcaacctttcagattgcaggtttgccaaccaatgttgatttcctccaagaactcgcaagccacagtgcctttgaaaaaggcctagttgacactcacttcattgaacgttataaagatgaccttttgagtatttctacaaagtcctcaaaagaatctcatggtgtagctgagcttggtgcaattttggctgctgcatgcatttgcaagaaggaacacattacatctaaagaatcactacgagccaacaagtcactatctgtatggtacaataatccacctttcaggatgcatcactttgctaggcatcccctggatcttgagttggaagagaatgatggattcagtgagaaacttcttaaactgttcattactcataagtttgatggaagctacttcatcgagacagaagatggcacttctggtttagatgtcaaagttgatcacaagggtgaccacgattttcgtgtggatgtttctggtctgcaaactgatgtgactctagcatcttattcaaagggaaacagcaaacacatacatgtctggcatgggaatcatcaccaccattacagacagactgtaagagctgagcatgcagttgaagatagctcccaacctagtcatgcttctgaagggaagtcgcatccaaaagggagtgttctggcaccgatggctggcttggttgtgaaagttttgcttgaagacggggctcaggtggacgcagggcagcctgtcatggttatggaagcaatgaagatggagcatgttgtgaaggcgcctcgtgccggatacgtgagtggcctgaaggttactgcaggccaacaagtttttgactccagtgtccttttcacaatcaaggacagctctgcaaactgagatggagcgatcactgccctagagtagttgcactgcaactgcatcaagcacccagcggatgctcgtccagatagagaagcgaaggaaataaactgctgggttcgtctgcgggcaatccaatccggcagggcaagcagacggcgcatggtgtttcccggcttgatgcgaatccatcatccgccgcaacaattccattgcgtagtgtacacgaacatgaaactgtaccacgctgagcaagaggaattcttgtttgatttgtgcaatgaaataagttgattccatcaccgttccatttctcatatgttaataattagtaataataatgaataattagtataatataatgagaaatgtgctcagtttaccaattttatggaatggatttgtaatgt

SEQ ID NO: 18656 - DNA, 1074 bp, Zea mays
attcggtgcctcccgcccggccggcccccgccccccccactctggagataaggctctccgcctccgcctcgcagcctcccttctatcctctccggcacgagccgtccagttcagttcacctcggtccgggaccgcgactacaccgacggcggcgcgtccgagcccagccgacgccgagccaatggtgactccagcgacattctccctccgccccagcgcgccccccgcgccgcctcgtgccgggctgccccgcgctcgggcctgtttcgcgcccgccatccgcacctccccttccgtcgccttttcctaccagcctcggcgcttcagtggcatccgccgcgccgtggccgtcgactccgagcagggcttccccgagtccccagagcaggagaagaagcccaagacgtactacttcctggtggcaaacgccaagttcatgctggacgaggaggagcacttccaggagcaactcgccgagaagctgcgcaactacgccgagcgcgacaaggagcaggacttctggctcgtcgtggagcccaagttcctcgacaggttccccaacattaccaagcgcctcaagcgccccgccgtcgcgcttgtctccaccgacggcaactggatcacattcatgaagttaaggctagacagggtcttacaagaccagttcgacgcagaatcagttgaagaggcattggcttctaaccctgttgagttgaaatttgagaagcctgagaaatggacagctccgtaccctaaatacgggtttggatggtgggaacccttcttgcctccaaagtccagcaatggcacggcatagagataagcagcaatccctatgaggcatgtaagattactcccctgtaagtgatgaatgtaattttaattttgatgatgaggatgtagtacttgaggttgtacgagtacagttagttgaattagttgcacagtttttgtaataccaaataatcagctgttttattttatttgagaaagtcgtggttctgtcagcggccaaaaaaaaaaaaaaaaaaaaaaaaaaaaaaaacaaataaaaaaaaaaaaaaaaaagcggcc

SEQ ID NO: 18657 - DNA, 1058 bp, Zea mays
ttttttttttttttttttttttttttttttttttttttttatatgaagctcgtgccaaaaaagatggcaaattacactctgcttttttttttttttttttataacaattttgtttatagataaactggatgtctcatgatcagaaagcttaatagagcaagggagacactacgtacagtagaacaatatctacactaggggggcagaaccaccaaagttagaacactgaagtcacgaatcatccctactttttaaacctggtaccagttactgatttgtgatcgcccctcctctagtctttatatgctccagaacatgacaccacgcagtagagggggtgtgacaacgcaggtgcgcggcagctaagcgccccacacggtgatcccctgcatcatgttcttgaactcgccgaagtcgacgcggccgtcgcagttgcggtcgacgttgcagatcatctcctgcacagtggccaggttccgagcctcgggcaggccgagcttcttgagcacggcctgcagctcggcggccgagatgaagccgtcgccgtcctcatcgaacacccggaacgcctccttcatgtccccctcgtcgtcgtcgtcctcggtcacagccaccggcatggggccgaacagcgcgtccccgagcgcgcggtggagggactcgaagtcgtcgaagcggagccccgcggcgccggccgggatgtacccgccaaccgcggcctccaggccggagcggtcggcgccgaggccgagcgcgtcgagcgccgaggccatctcgtcgagggtgatctcgccgtcgccgttgcggtcgaagaggtcgaacacgcggcgcaggcgcagtgcgttgaggctgccgttccggaggcggaacgacggcgagggcttcttggacagcgacggcttagcgatggcgggggcggcgttctccatcgtcgcgtgaactcgcgccgttcagtctcttcttctcttcgggtgttttgtgggcgtgacgcgtgaggatgcgagggcggattattccggagtgcgtgggggtccccgccgcccccggcgtacccaatg

SEQ ID NO: 18658 - DNA, 2442 bp, Zea mays
ctgcagctagcttatagatcacttattttgaacattgtggttgttagaaaattagttattttcagttgcattttaatccagaaaatctagttggggataataggaagaagcatgtgtgaactgacataatcgtgcactattacatgaaagaaccatattcaggacgaccttacctgagtttccaattgttattattctaagtgtttaagaatgttcagcatgatgtattggcttgcaggtaatgtacaacaaggggtgaacaataatgttttgtaacttcaacctcatgcagtttaagtgatccatgcattttaagtatattgattctagcaaaacctactcaaacatagtatccttgctttacgaagtctaaacttggtcaattcaaattaagttttctcagctagcctcttgtttgatgaattctagcaaaacctactcaaacatagtatccttgctttacgaagtctaaacttggtcatttcaaactaaatttgcttaattggcttttacttgatgaattcttaccaaaacatgcaaaacatagatttggctaactataactaagttttgacatttgactttccatttggtgtattctaggaaaacttactcaaactagcaaaatataacacatcgcatctaaacttgatcaacacaggtcgatgatacaagagatttagatttaccatagtccacctgcaagaattatggacttcaagaaagccatgcattatatatacattgattatatcaaaacctactcgaagtagtcaaacatagttttcttatttgatgaagtttaaacttggtttgagcaaattaagtttattcatttagcctcttgcttgatgaattatatcaaaacatgatcaaaataacgaaaagcatcaggtagaaaagctcaacccatggtgcctagatacatacatttaaggtggttatggatcaccgtcaaaatgtttcttcatttaagctattaattaatttttttttttttttttttttttttttttttcaatctaaagaagtcttgatcattaaattttatagtgtaaaattcgagttcattaacacccttaagtacacaccaggcagctgagctgagggaacaacgataaggcaggtgcgctgcagctaagcgccccacacggtgaccccctgcatcatcatgttcttgaattcgcggaagtcaacgcggccgtcgcagttgcggtcgacgctgcagatcatctcctgcacagtggccaggttccgagcctcggacaggccgagcttcctgagcacggcctgcagctcggcggccgagatgaagccgtcaccgtcctcgtcgaacacgcggaacgcctcctccatgtccccctcgacgtcctcctcaggcaccgcctccgggatggggccgaacagcgcgtccccgagcgcgcggtggagggactggaagtcgtcgaagcggagccccgcggcgccggccgggatgtacgcgcccaccgcggcctgcaggccggggcggtcggcgccgaggccgagcgcgtcgagcgccgcggccatctcgtcgagggtgatctcgccgtcgccattgcggtcgaagaggtcgaacacgcggcgcaggcgcagaacgttgaggctgccgttccggaggcggaacgacggcgagggcttcttgggcagcgacggcctggcgataacgggagcggcgctctccatcgtccacgtgaactcgcgcggcggcgtcccttctcttcttctcttcaatgctttgtgggcgtcggccgtcagcaggtcaggatgcgagggctggctgattgtttgtggagttggttgtttgtcgctggcgatggatggggattttattatagacccgggaggaacccacgcggccgccggcccggccgccgcccctcggtctctttgtgagggatagtgcccacacctcttgccgttttagtttttacactaccatcgtagtagagcttagtttatttaaaaaataacagtacaaattttagttttttagaccaaactattgaatttactaaaattgtatagaaaacaacgaagattataattacaaacacatactttctctgtccttatttaagcgtggctttgggaaatatattgctcgggctttctaagcaggtttgattggatttgtaaaaagtaggaataatagtttatatctccgaataaatttgatatggaaatagattcgatgatacacttgtgtttattttttgttgggacagatggactaaggtttatcatatcgttgagatagtttgactgtacgggctcatatatagtatatatcatatgtatgtcagcctcctcacagtgtcacagtaagatgtttacgaagtgtcatatgttttttttttcacagaatataaacggaatgatgagaaaaagttggactgcaatattagccttattgcatattag

SEQ ID NO: 18659 - DNA, 3149 bp, Zea mays
acacgaggcactactacttgctcagtctaccagaccagaataaagacctctgtgccacgaagcacgaacaaatggacaatgccaatcacaatagtaaggacggactaacctgaacggttattatgggtccgtttggtttctttagtctcgagactaaagtttagttaggagactaaagtttagtccctattctgtttggttctaggactaaaagtattcaaaacacattaaataaatcataagaagactaaaatatcctttagcattctcctgtcattagtgcaactgaaataaaggaagaataaaaagtgtaatttatatggtttagtctcttttagtcacccttgaaggattagagacaaacaatttagtccatgttttagtcccaccgattgacaatttagggactgaaattgagagactaatctttagtccctcaaaccaaatggggcctatgaagtacaattgtttatccctataatatggtgactactaatatcttgggtgaaaacctacagatcgagaagccatttgccatttctatcaatttctgatcaccatggaattgggttcagaaacgctttgaaaccactagacaaacgttttgaaaccactaggaacactggatattatatgaagctcgtgccaagaaagatggcaaattacatcatagtagaaatcgagcatgttcataacaattttgtttatagataaactggatgtctcatgatcagaaagcttaatagagcaagggagacactacgtacagtagaacaatatctacactaggggggcagaaccaccaaagttagaacactgaagtcacgaatcatccctactttttaaacctggtaccagttactgatttgtgatcgcccctcctctagtctttatatgctccagaacctgcaataagaagggaaattgaataaccaatataatgtctgaagatccacgccaaatttagccgaaaacgaaattcataatgactcaaagaatgtgatgtgcaacttgatgaagagtgctgcacatcatgcaatgatgcaagcatgtgaggtgggtttctttgagcgtttagttaggttgtcgattaagaaacactcttggttggttggtaagctggtgcggcagtcttgaagtgggtttctttgaatattaggttagtttgctgtcagtgtagaaaagaatcgcttggttagtgtaacaaacttcacgtgcttggtaggtagccatggggcggagtcaatggagacattgcccatgtgaagcgctactaccactccatttctgcgcatgcatgtgggtaatgcttgtatgtcaagtgatggccatagaatgaactttaaagagccgttagcttgctagccagtagtagcttatattaaggggtaaacaaaccatgtcatggacaaagctgaagatgtttataggactggagaagtcttctttgaggctacggatgtagacattttggagatgtttggtttgatggatcaatctattctagatgagttagtgcatcacgagtcaattccataaatttggtgaaataaacttatttatcatattattactaattattagcataagaagaatgaaatggtgatagatcgacttatttcatttcataaatcaaacaaaaaatgagaagtgagaagatgatggactaacttattcctaaaaccaaacacgccttttaatcatagacttgctcagtatttagtaaccaaactttgctttttttgctaattgatttacatgaacactgatgaatagaataacgagaaggggcaaggtatgtaaaaaaaggaagcacatttcaaatggcagaactccttgttttctaaaaagaaccttttccaactggcgcaactgaaatactgaatacgtaaactgacttgattgggatttgggagacgcataccgcatacgtgacccgtccctccttgtttgaaggaatgttttttttttttttttgctggtcaaggtcaacgttcttacatgtaaataaactgtgcaattaaacacggagtaaatcaaacacaagaaactaaagaaaactatgtctgtgtgccgccagattctcaagactacaagcagagtcagatagcaaagccaagaacaggaagaatccactgcgccatcaagaggaggaagaagcgccgggtagaaaagcgcatcctacggtgcctggatacatacatgacaccacgcagtagagggggtgtgacaacgcaggtgcgcggcagctaagcgccccacacggtgatcccctgcatcatgttcttgaactcgccgaagtcgacgcggccgtcgcagttgcggtcgacgttgcagatcatctcctgcacagtggccaggttccgagcctcgggcaggccgagcttcttgagcacggcctgcagctcggcggccgagatgaagccgtcgccgtcctcatcgaacacccggaacgcctccttcatgtccccctcgtcgtcgtcgtcctcggtcacagccaccggcatggggccgaacagcgcgtccccgagcgcgcggtggagggactcgaagtcgtcgaagcggagccccgcggcgccggccgggatgtacccgccaaccgcggcctccaggccggagcggtcggcgccgaggccgagcgcgtcgagcgccgaggccatctcgtcgaggctgatctcgccgtcgccgttgcggtcgaagaggtcgaacacgcggcgcaggcgcagtgcgttgaggctgccgttccggaggcggaacgacggcgagggcttcttggacagcgacggcttagcgatggcggaggcggcgttctccatcgtcacgtgaactcgcggcgttcagtctcttcttttcttcgggtgttttgtgggcgtgaggatacgagggacgagggcggattatttctggagttcgtttcgtgtggctggctatcggtgagattttatagagctagagaaaacgcggcggggtctctgtctgactgtctcttatttgtttgggggcagggcccacgcctcttgccgttttggtggaaaaaaatttggtgcagcccctcataaaaaggaggatagaccccacctgcaggtctagcagataacgttttagttgtattattgttgctgcgggtagggtttattctcctttttgtg

SEQ ID NO: 18660 - DNA, 1833 bp, Zea mays
tggctcgcccgccccactctggagataagcctcggcgcccgccccgccggccgggagccgcccttctatcctctccggcacgagccgtccagttcagttcacctcggtccgggaccgcgactacaccgacggcggcgcgtccgagcccagccgacgccgagccaatggtgactccagcgacattctccctccgccccagcgcgccccccgcgccgcctcgtgccgggctgccccgcgctcgggcctgtttcgcgcccgccatccgcacctccccttccgtcgccttttcctaccagcctcggcgcttcagtggcatccgccgcgccgtggccgtcgactccgagcagggctcccccgagtctccagagcaggagaagaagcccaagacgtactacttcctggtggcaaacgccaagttcatgctggacgaggaggagcatttccaggagcaactcgccgagaagctgcgcaactacgccgagcgcgacaaggagcaggacttctggctcgtcgtggagcccaagttcctcgacaggttccccaacatcaccaagcgcctcaagcgccccgccgtcgcgcttgtctccaccgacggcaactggatcacattcatgaagttaaggctagacagggtcttacaagaccagttcgacgcagaatcagttgaagaggcattggcttctaaccctgttgagttgaaatttgagaagcctgagaaatggacagctccgtaccctaaatatgggtttggatggtgggaacccttcttgcctccaaagttcagcaatggtacggcatagagataagcagcaatccctatgaggcatgtaagattactcccctgttataacacgaggcactactacttgctcagtctaccagaccaaaataaagacctctgtgccacgaagcacgaacagatggacaatgccaatcacaataattctcaagactacaagcagagtcagatagcaaagccaagaacaggaagaatccactgcgccatcaagaggaggaagaagcgccgggtagaaaagcgcatcctacggtgcctggatacatacatgacaccacgcagtagagggggtgtgacaacgcaggtgcgcggcagctaagcgccccacacggtgatcccctgcatcatgttcttgaactcgccgaagtcgacgcggccgtcgcagttgcggtcgacgttgcagatcatctcctgcacagtggccaggttccgagcctcgggcaggccgagcttcttgagcacggcctgcagctcggcggccgagatgaagccgtcgccgtcctcatcgaacacccggaacgcctccttcatgtccccctcgtcgtcgtcatcctcggtcacagccaccggcatggggccgaacagcgcgtccccgagcgcgcggtggagggactcgaagtcgtcgaagcggagccccgcggcgccggccgggatgtacccgccaaccgcggcctccaggccggagcggtcggcgccgaggccgagcgcgtcgagcgccgaggccatctcgtcgaggctgatctcgccgtcgccgttgcggtcgaagaggtcgaacacgcggcgcaggcgcagtgcgttgaggctgccgttccggaggcggaacgacggcgagggcttcttggacagcgacggcttagcgatggcgggggcggcgttctccatcgtcgcgtgaactcgcggcgttcagtctcttcttttcctcgggtgttttgtggggcgtgaggatacgagggcggattatttctggagttcgttgagtgtggctggctatcggtgagattttatagagctagagaaaacgcggcggggtctctgtc

SEQ ID NO: 18661 - DNA, 1102 bp, Zea mays
gattaaaagaaaaatcctaaaaaaataaataaagtgaacagtcgaactcatcaatctcagcccgcccgccccactctggacattgggctcctcgaggccggccgggagcctcccttctatcctctccggcacgagccgtccagttcagttcacctcggtccgggaccgcgactacaccgacggcggcgcgtccgagcccagccgacgccgagccaatggtgactccagcgacattctccctccgccccagcgcgccccccgcgccgcctcgtgccgggctgccccgcgctcgggcctgtttcgcgcccgccatccgcacctccccttccgtcgccttttcctaccagcctcggcgcttcagtggcatccgccgcgccgtggccgtcgactccgagcagggctcccccgagtctccagagcaggagaagaagcccaagacgtactacttcctggtggcaaacgccaagttcatgctggacgaggaggagcatttccaggagcaactcgccgagaagctgcgcaactacgccgagcgcgacaaggagcaggacttctggctcgtcgtggagcccaagttcctcgacaggttccccaacatcaccaagcgcctcaagcgccccgccgtcgcgcttgtctccaccgacggcaactggatcacattcatgaagttaaggctagacagggtcttacaagaccagttcgacgcagaatcagttgaagaggcattggcttctaaccctgttgagttgaaatttgagaagcctgagaaatggacagctccgtaccctaaatatgggtttggatggtgggaacccttcttgcctccaaagttcagcaatggtacggcatagagataagcagcaatccctatgaggcatgtaagattactcccctgtaagtgatgaatgtaattttaattttgatgatgaggatgtagtacttgaggttgtaccagtacagttagttgaattagttgcacagtttttgtaataccaaataatcagctgttttattttatttgagaaagtcgtggttctgttatgaaaaaaaaaaaaaaaaaaggcccctacaaaaagaaaaaaaaaaaaaaaaaaggccccta

SEQ ID NO: 18662 - DNA, 1294 bp, Zea mays
gctgtcagagtctgacatcgcttgggcgtctggacggccctcctcacccccgtccggccgcccgcgcccggaggtcaagtgccacaccggccgctcgtcgccttcccatctcgccgcgccatggatttctgcagccacctccgtctcgcggctgtgctcgcgctcctcaccggatgcgcttctgcggcgagccggggcgctggttccttcgacccatcccgcgtggttcaactctcttggcgccccagggcgttcttgcacaagggtttcctgttggatgcggagtgcgaccacctcatcgcgctggccaaggacaagctggagaagtctatggtggcggacaacaagtccggtaagagtgtccagagtgaggtgcgcaccagttccggcatgttcctcgagaagaagcaggatgaagtagtaacgaggatagaggagaggatatctgcttggacatttcttccaccagagaatggtgaagccattcagatattacactaccagaatggtgagaaatatgaaccccactacgactacttccatgacaaaaataatcaggccctgggcggccatcgcattgccactgtgctgatgtacctatcaaatgtcgagaagggtggagagaccatcttccccaatgcagaggggaagctattgcaacccaaggacgacacttggtctgattgtgcaagaaacggatatgcagttaaaccggtaaagggtgatgccctgctgttcttcagtctccaccctgattcaacaacagactctgacagcttgcacggtagctgccccgtcatcgaaggccagaagtggtccgcgactaaatggatccatgtgaggtcatttgacctcaccgtcaagcagccgggtccctctgatggatgtgaggacgacaatgtcctctgcccccagtgggcggccgtgggcgagtgcgccaagaaccctaactacatggtggggaccaaggaagcacctggcttctgccggaagagctgcaaagtatgcgcagagtaaggtatcggtcctctgcgtctgatgagtaatcgtggcgtacgtgttacgtagttgctgtcaccattttaccagggtttaggtacgaccgagtacagcatgtataagacagtacaaacccggaagaaggaatcgtaagagttaggggacgggttacctgccgagttagttaaagctgagcaatctaatcaatggcaacagttcgagcaaatcttgtttccttcatttgtcatggtaaacttgtcctgttggaaatgaaaagcttgttggcgagggcggg

SEQ ID NO: 18663 - DNA, 1552 bp, Zea mays
atttaattttgacgactcacctggtcaacccctccgttcttcgctagggactcgggtcctcgcattggcgggtccgctgtcaccggcagttctgacataacacaccgcttcttccccagttcaagtgccacaccgctcgtcgccttcccatctcgccgcgacatgaatttctgccgccacctgctcctcgccgcggtgttcgcgctcctcctcgctgtctgcgcttctgcggcgagcaggggcgctggttccttcgacccatcccgagtggtccaactctcgtggcgccccagggcgttcctgcacaagggtttcctgtcggatgcggagtgcgaccacctcatcgcgctggccaaggacaagctggagaagtctatggtggccgataacgagtccggtaagagtgtccagagtgaggtgcgcaccagctccggcatgttcctcgagaggaagcaggatgaagtagtaacgagaatagaggagaggatatctgcttggacatttcttccaccagaaaatggcgaatccattcagatattacactaccagaatggtgagaaatatgaaccccactacgactacttccatgacaaaaaaaatcaagccttgggtggccatcgcatcgccactgtgctgatgtacctctctaatgttgagaagggtggagagaccatcttccccaatgcagaggggaagctattacaaccgaaggacaacacttggtctgattgtgcaagaaatggatatgcagttaaaccggtaaagggtgatgccctgctgttcttcagcctccatcctgatgcaacgacagactctgacagcttgcacggtagctgccccgtaatcgaaggccagaagtggtccgcaactaaatggatccatgtgaggtcatttgacctccctgtgaagcagccgggttcctctgacggatgcgaggacgacaatatcctctgcccccagtgggcagctgtgggtgagtgtgccaagaaccctaactacatggtggggaccaaggaagctcctggcttctgccggaagagctgcaaagtatgcgcagagtaagcaggggcactaggcatgactacgacgacctacttgatgctgcatcctgccgaggatacctaattgtttcgtctttgcacaattgaaggaggtcgatcgatcggcagggcagtcttttgattgcgatccatgccatgcacatgcatatcgaaatctcagacaagcaactgtagcagcggtacatacatcactgttcactccagtccagctagctagccagtggcagtaactgtggttagttggattcacctaaaaggttgtacgggcatcgccgcgggtttttgcgtgtcccccctctcagaataatcctgagatcttttagcttctatccgagcagtagtcggtacatatatataagtatcctttcatcttaattagcatctactttagtactagttattagaaagtattgaagattttttggtttttgagtttgctacttctatatgtacctaatcctatcatgatttatgatgtggcttaacaaaat

SEQ ID NO: 18664 - DNA, 1276 bp, Zea mays
atttaattttgacgactcacctggtcaacccctccgttcttcgctagggactcgggtcctcgcattggcgggtccgctgtcaccggcagttctgacataacacaccgcttcttccccagttcaagtgccacaccgctcgtcgccttcccatctcgccgcgacatgaatttctgccgccacctgctcctcgccgcggtgttcgcgctcctcctcgctgtctgcgcttctgcggcgagcagaggcgctggttccttcgacccatcccgagtggtccaactctcgtggcgccccagggcgttcctgcacaagggtttcctgtcggatgcggagtgcgaccacctcatcgcgctggccaaggacaagctggagaagtctatggtggccgataacgagtccggtaagagtgtccagagtgaggtgcgcaccagctccggcatgttcctcgagaggaagcaggatgaagtagtaacgagaatagaggagaggatatctgcttggacatttcttccaccagaaaatggcgaatccattcagatattacactaccagaatggtgagaaatattaaccccactacgactacttccatgacaaaaaaaatcaagccttgggtggccatcgcatcgccactgtgctgatgtacctctctaatgttgagaagggtggagagaccatcttccccaatgcagaggggaagctattacaaccgaaggacaacacttggtctgattgtgcaagaaatggatatgcagttaaaccggtaaagggtgatgccctgctgttcttcagcctccatcctgatgcaacgacagactctgacagcacgcggggtagctgccccgtaatcgaaggccagaagtggtccgcaactaaatggatccatgtgaggtcatttgacctccctgtgaagcagccgggttcctctgacggatgcgaggacgacaatatcctctgcccccagtgggcagctgtgggtgagtgtgccaagaaccctaactacatggtggggaccaaggaagctcctggcttctgccggaagagctgcaaagtatgcgcagagtaaggcagtagcctgctgtctgatatgtgtcatggcgtgttgcgtagtagtctgctgtttggataccgactggagtatagcatgtatgaagtagaacccggaagaaggaatcgtacgagagccgagttatctgataacttgtctcttgtgggaaatgaaagcgttccttaattaaaataaaaaaaaaaaaaaaagccgcccgcgcgggcccggtacc

SEQ ID NO: 18665 - DNA, 1093 bp, Zea mays
gccggcccggccgggaaaaaaaacactttccgtcagctgcaagaaaggagaaccaattctccctcgaaaaaaaagtcccgtcgttttcctcacagttccttcggcctccgcttccactcccacccgccccgccgtcgcgatgcacaagacggctcaggcatggttcaccggcgggaccgccgcctcctccggcgccgctgccgagtcgcagccgtccctgctcgctgactggaactcgtacgccgccacccgctccgacgcctcctcctcctccccgctccccttcgacatcgaagccgccgtccgctccgccaacgacaccgtctccggcaccttaagctcggtgaccaagggcgtgcgggagctgccggggagcttccagagcgccaccagcagcttcccctccggaaaggctctcatgtacttcggcctcttcctcgccaccggcatcttcttcgtcttcatcgccttcgcgctcttcctccccgtcatggtgctcatgccacagaagttcgccatctccttcacgctcgggtgcgcgctcatcattgcctcgctcttcgcgcttaaggggccagccaaccagctcgcccacatgacttccaaggagaggctaccgttttcagttggatttattggatgcatggtcggtacaatttatgtttctatggtgcttcacagctatttcctctctgtgatcttctcagtccttcaggttctggcccttgcatattacaccatatcctacttccctggaggatctagtggactgaaattcatctcgtctggtctcttgtcctcggcaacaagctgttttggtcgatgaccttcctttgtcaattgtcatacatttatttgatcataccatgttatcgctttaagatttttgtatgtagctgctgatcatccctttgaggctttgtttggtccgctggtctggcctctaatccacatgtgtttgaggtggaattgatgtgtaaattagttttaagttacaccccaatccacctcaatatatgtggatttggggtcaatactagagtacccaaactaggtccgatagagattcatgggtgtttcctctcctgtcatc

SEQ ID NO: 18666 - DNA, 1009 bp, Zea mays
ccggccgggaaatcgtaatagctaggatcagatcatttcaacttcccgactctcgcatcccggattgttccgccgcccgcacacgtctctcctcttccgttcctctcctgcctccagctctccacggtctctgacccgcacaactgaacccgcgatggcgcgccgcctcctcgtcgccctcctcgccgcgtcgctcctgctcccgctcgcccgcgcggactcctcctcgtccccgcccgacaccaccgcgtacgacgagctccgcctccggggcttcccgcgcggcctgctcccggccaacgtgcgggcctacacgctcgactccggctccggggacttcgccgtcgacctccgctccagctgccggatcgtgctgcccgcggggagctacctcgccgccttcagcgaccgcctcacgggccgcctcgacgaccgccgcatctcgggcctcgacggcatccgcgtcagggccttcttccgctggtggtccatcacggggatccgcgccgatggggaccagctcgtcttcgaggtcggctccgtctccgccaagttccccgcgcgggacttcaacgccagcctcgactgccccgcccaggcggcgtcctaagtcaaggaggtatcctgtcgcatgttccatgacatgtgacattctaaaggggcagttggaagccaagcacatcaatgtttttaatttcatctgtctttattgtaattgtataagtttacaatagatgcatagaacagactggatcgataaaagcgccttcacagaccaaaaacccggtatcacggtagtggttcgtgcatttcgttagaaatgccctacgtcttattttgaaaagttgtgcttgtatatcttacttattgacaatagctgtacttataagactacttgcataaagaagaaaagtgaggtgcaaggccgaaaggcccctatgcgctaaatacaaaaaaaaaaaaaaaaaaaaaaaatgaaatagaaaaaaaaagaaaaaaaaaaaaaaaa

SEQ ID NO: 18667 - DNA, 806 bp, Zea mays
aaattttattgcaaagtgggcccgtttcaaaactaattgaaagtaggcgacgtatcccccctcaaacctaattgaagaggctgcacatttcctctctcttccaacccgagcgagcgacaatatcacaccaccggttttttttttcttcggtcacaatcagacaagcagcggggcatccagtgcagcggcggctctcggggtgtcgtcctgcagcctcagcgtggaggtgaccaccagggagagtacggcgaagcaggaggggatcaggcccgtcccgtacctgctcaccgtgttgaggcccctcgtctcgccgtagctcaccatcgtgtcttcgtacgattctagcgcgaacagggcgattccgcaggagatcttgtccaggaagctgagggagccgtagacgaaggcgcagccgttaaggtcctcccctaccaacgcgccctccagcccaatcgtcgtgaccatgacgagcgcgttggcggcgcccatgaccatggcgagagggtacatcaggctgttcatctggctcgggaggacgaagacggccacgccggagatgacccatagcgtggcgccgacggtgaggagggacttgaggcgccggctggtccacttgatctcctgtgttgttgcacaacagcaggcagttgccaggacgatggacacgaagaagctgcagcagaatatgatggctggtattattgctttcgagtactcattcattctcaaatctctggtgacgtagaaagcgatgagcgactgagatacgtttggatcagcctcgcaagcatatccggcccggccgg

SEQ ID NO: 18668 - DNA, 1445 bp, Zea mays
cattgggtaccctcggggccggccagcctcactctcgcgccggctcaaggtacattgcgtgtcctagccaagacacgcagctcatctcagcctcacacgcacagcaagagcgaggcgtgattcgccatgggcggcctcactatggaccaggctttcgtgcaggcccccgagcaccgccccaagcccctcgtcaccgaggccaccggcatccctctcatcgacctctcgcctctgtccgccagcggcggcgccgtggacgcgctggccgccgaggtgggcgcggcgagccgggactggggcttcttcgtggtcgtgggccacggcgtgcccgcagagaccatggcgcgcgcgacggaggcgcagcgcgcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggctgccgtggccgacggcgagctcgtgttcgagaacaagtggccccaggatctgccgggcttcagagaggcgctggaggagtacgccaaagcgatggaagagctggcgttcaagctgctggagctgatcgctcggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtgtggagcaacgacaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtagaacaaataatgatgtgcgtgctgtgtgtaagcatggatatggatgtgaatatgtaatatgatgagcactcctactttggtatgtttgggaataacagacttgtgttggtctggttaaaaaaaacaaaaaaaaaaaaaaaaaaaaaaaaaacctcttgcccccccgcgcgccgccccgcgaccccga

SEQ ID NO: 18669 - DNA, 2036 bp, Zea mays
ctcggccccgggagaagcgctagcaaacaaggttcacctaaaaatccatccagattcattgaatccaaccagcacaaacgtcccatttattaatcacctcatcacaggtcccccaagcctcactctcgcgccggctcaaggtacattgcgtgtcctagccaagacacgcagctcatctcagcctcacacgcacagcaagagcgaggcgtgattcgccatgggcggcctcactatggaccaggctttcgtgcaggcccccgagcaccgccccaagcccctcgtcaccgaggccaccggcatccctctcatcgacctctcgcctctgtccgccagcggcggcgccgtggacgcgctggccgccgaggtgggcgcggcgagccgggactggggcttcttcgtggtcgtgggccacggcgtgcccgcagagaccatggcgcgcgcgacggaggcgcagcgcgcgttcttcgcgctgccggcagagcggaaggccgccgtgcggaggaacgaggcggagccgctcgggtactacgagtcggagcacaccaagaacgtgagggactggaaggaggtgtacgacctcgtgccgcgcgagccgccgccgccggctgccgtggccgacggcgagctcgtgttcgagaacaagtggccccaggatctaccgggcttcaggtgacgaaattaactatatatccctttcgatcatagttgcgttaataaattaagggaatcgtgagcgtacgtacgtaagtttccgcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccttgcccgagccccgacctggccctcggcgtggggcggcacaaggacgccggcgccctgaccatcctgtaccaggacgacgtcggggggctcgacgtccggcggcgctccgacggcgagtgggtccgcgtcaggcccgtgcccgactcgttcatcatcaacgtcggcgacctcatccaggtacgtgcccacctgatgaactgagctgaacgtaggttgcatgcactgcatgtgtataggcttctcagatcgctccctgtggcgtaaggtgtggagcaacgacaggtacgagagcgcggagcaccgggtgtcggtgaactcggcgagggagaggttctccatgccctacttcttcaacccggcgacctacaccatggtggagccggtggaggagctggtgagcaaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactactgctactgctaggatccatgccattgccatgtcgtcttcagattcagagcacgccatgtcgtcgctagcttcgtggtagaacaaataatgatgtgcgtgctgtgtgtaagcatggatatggatgtgaatatgtaatatgatgagcactcctactttggtatgtttgggaataacagacttgtgttggtctggttcattatttgcaaaaaaaaaaaaaaaagttagtagggcaggaggctaaccacagtcatgctgcaccacatccctggtggaaagctggccgggttacgctacgctcgtgcagccagattactgcagggccgggatatgcttccggtggaaggaaggggacggtggctgaggaccatggggctggagcctgggagagaggtcgagctagaagaaagggggagagagaagacgcacaacgaagatgggtcagccagggatttcgacccaagggggagctagtggattttgggagaaaacagaaaagagaaaagagaaaagaagaaaaatttgttggtgtgaacacaaggttgatttgtcttttcttatttggattgatgatgagtcgtggactaaccga

SEQ ID NO: 18670 - DNA, 1410 bp, Zea mays
  misc_feature (1405)..(1405): n is a, c, g, or t
cattgggtacctcgaggccggccgggaggccactctcgcgccggctcaaggtacattgcgtgtcctagccaagacacgcagctcatctcagcctcacacgcacagcaagagcgaggcgtgattcgccatgggcggcctcactatggaccaggccttcgtgcaggcccccgagcaccgccccaagcccatcgtcaccgaggccaccggcatccctctcatcgacctctcgcctctggccgccagcggcggcgccgtggacgcgctggccgccgaggtgggcgcggcgagccgggactggggcttcttcgtggtcgtgggccacggcgtgcccgcagagaccgtggcgcgcgcgacggaggcgcagcgcgcgttcttcgcgctgccggcagagcggaaggccgccgtgcggaggaacgaggcggagccgctcgggtactacgagtcggagcacaccaagaacgtgagggactggaaggaggtgtacgacctcgcgccgcgcgagccgccgccgccggcagccgtggccgacggcgagctcgtgttcgagaacaagtggccccaggatctgccgggcttcagagaggcgctggaggagtacgcgaaagcgatggaagagctggcgttcaagctgctggagctgatcgcccggagcctgaagctgaggcccgaccggctgcacggcttcttcaaggaccagacgaccttcatccggctgaaccactaccctccatgcccgagccccgacctggccctcggcgtgggacggcacaaggacgccggcgccctgaccatcctgtaccaggacgacgtcggcgggctcgacgtccggcggcgctccgacggcgagtgggtccgcgtcaggcccgtgcccgactctttcatcatcaacgtcggcgacctcatccaggtgtggagcaacgacaggtacgagagcgcggagcaccgggtgtcagtgaactcggcgagagagaggttctccatgccctacttcttcaacccggcgacctacaccatggtggagccggtggaggagctggtgagcgaggacgatccgcccaggtacgacgcctacaactggggcgacttcttcagcaccaggaagaacagcaacttcaagaagctcaacgtggagaacattcagatcgcgcatttcaagaagagcctcgtcctcgcctaactacgtactgctagtactggcctactgctaggatccataccattgccatgtcgtcttcagattcagagcacgccatgtcgtcgctagcttcgtggtagaacaaataatgatgtgcgtgctgtgtgtaagcatggatgtgaatatgtgatatgatgagcactcctactttggtagtatgtctgggaataacaagttcacaattatcaaaagttgacaatttcccaaaanaaaaa

SEQ ID NO: 18671 - DNA, 1947 bp, Zea mays
tgcagcgggccggccagccagatccatcctcctcatgccggccggcggcgacccagcgcgcgcgcggttggcgtttccaagcgtgcgaccgcacacgcgcgcccgtaaaaaaaaaagaaaaagaaaaatcagggtcagcgcgtggactcggccctagggaaggattaggagtgatcgagatcgaatcggcggccacccggcaccctgcccgcctgtcgacactgtcgggtccggttggtgccccagcgaaaagcaaaagaaatactactaccggaagaaactgcctcctcctctcctcgcttctctctttggaggcaggcgcaggcgggcgagtggtccggtacacctctagctgcagatcccagctcgcgcggtccagcaggccagcactaagctccctccctcctgtccacctggacagcgcgcccgatcgtgaatcgtcgcttgctctggagaaagcttgcatttttttttcgtttcttccccggttcttcttcttcttcttttttttttttttgccccgcatcctttttcctggcgcggtttccttcgtacgggaaattttcggttggtgcggttggttggtcattttcctgcaccttctctttggttcttgcgcgagagcgccatctttcctgctgcccgttgactcgggcgggcattccgtcgagcaccttccgtgcggtgtggggagcggcggttcctggtttctcgggaacgttccttgatgccgctgttgtgtcaggcgcaggattctagcggatggaatgccacagctggtacgcgctgaaatcaagaagatctgtagcgatcgctgatgcggggtttgaagatgctgcagacggcgccggcgatcttggtggcacgatgagtcttgcacgcaagcagaaggttgtcaaggaaacagtggagatggaggaggagcaggagtttgtttggaaatctaacctgctcccctacaaggacgatgatgctttcgttcttcctgagagtagtaaggaggagtacgcatcaacatcaggagacacagctccgtctggcaaaatggacccgaggatggaaaggtctggaagcaatgggacaagcaaggtccctagactgggttccatgcttgggacagccagcatggctggatttggcaaggcagtggagattctagacacgttaggctgcttgatgacgaccttgagctcagatggtggctttgtttccaggaccaagaccaaaggatgcaagatatcaattcttgcttttgaggttgccaacacaatacttaaaggtgctagtattatgcaatctctctcggaagacactgtcacatacttcaagcaggttgtgcttccttccgaaggtgtgcagaatttggtttctagtgagatgagtgaactgatgcgaattgcagctaacgacaaaagagaagagctgaaaatattttcccaggagattgttaggttcgggaaccgctgtaaagatccccagtggcataacctggatcgctactttgtgaagttagaatcagagagtgcaccccagaagcagctgaaagaaacagcaatagcagagatgcaaaagttgatgaacctcgttcaacgtacaactgatttgtatcatgagctgcatgcattagacagattcgagcaagagtaccgctctaggctaaacggaaagggtaatacagatagatttgagaaaggagacaatattcaaattgtgagactagagttgaagacccaaagtagttatgtgaagagcttgaaaaaaagatctctctggtccaagacgttggaagaagtggtcgagaagcttgtagaagttgtgcactacttgcatgtcgagatcggcaatgctttcgggccttctgatggaggaggggtggtggtgaatgcggaaccagccgtgagctgtcaaaggctaggtcctgccgggctcgcattacattatgcaaac

SEQ ID NO: 18672 - DNA, 3307 bp, Zea mays
taaatgatgttagccctcatggctatgaaaccacggagattccaaacatgggcaatcgtacagatattcttgataagatgtacctaggagagaatttattgtttgcccccgaaactggtaatatgctacttgaaactacagatgatatcaacaatgaacagcatgatgatgcagctgtctctgagccccaatcggcagataatgatggaagtggaccttctggtgcatcatcactaccaccagagaaagatgcatacatgggatctaaagaggattctattaacgactatcatgatccttcagttgtctctgagttccaaattgctaataatgatgcaaaatgtgaaccttctggcgcattcttgccagaaaaggataaagatttggaagctaataaaacgagcttggaaggtccagcaaaaacaggccaattgtcatctgaagctagtggcagcactttgatgatctcagagccacaagtattgtttgtgtccccacaagatgggactctgtctttcatggacaataatacgaacaaccaagagatgtggaggttcctgaatgtttcccctgataccatggataccgaaatgcagatggactctaattcattggtttacgaggcaagcttgattcagggtttcttgtaccttgacaatgagggttctccaatttgttggacagtgatgaacccggaacctcctaggcgcttgatatgtgctactgctctggaaccaaactcaaagctgtcgaaacagtatgttgaaatgaggttggagaatgatgcatcaacgtctgaacacaagaagggaggaaaattgtccgataaggctgcagatatccaagacaatgtcagtagaaaaaaacagaaaccctacattgcttctttaaataattgcgtaagtatggacaatttaactgtcaatcctattgatcctgtagttctcaatgagggagagcagacaggtacagcaatcactgagcaggttcctgttcctttgaatctagtgcttgagaacaaaaatgacaaggaccaaggtgagcaaagcagtgaaacttcagaacaacttatgtccaaagaaccacaaaaaagggacatcaaaaggcaaaagagaacatggtctcatacatgcaagtttgatgatgatgaccttctgatgacagctgtaatatataagctgacagcacgttacaggaactcttttcatcggaagctcagaaataaattcggtttcaggcgtcttccaacataccgctgggagaatgaagataaaggtgacaggaagaagtttcctggagaagcaaggacggtgttgaacaagttacttgaaatgggcattgttgctagagtggatattcttcaatgtcatggtccaggaggcaaaaatgtgttgaaggatgggaacataactgcgagtggcattcaatgccagtgctgtggtaccacattcacaatgtccaagtttaagtgtcatgcaggtctcaggcaagaagtcccatctctgaatcttttcttgggtacaggcaaatcttacagtctttgtcagcttcaagcatggtctatagagcagaaggtgaggaaagagcatgcaaaggatacaatgtcccttcaagcagaccaaaacgatgatacctgtggatcatgtggcgatggtggtgaactgatatgctgtgacaattgtcctgctagttaccatcaagcctgcttgtcttgccaggatattccagatggcaactggtactgctctagctgcctttgcgacatttgtggtgaagtaatcgattcaaaggagcttgtaacttcccttcctgctttagattgctcacagtgcgaacgccaataccatgtaaaatgtgtatctgccaaagttccgtgcaatgaggatggatctggtacctggttttgtggaagagagtgtcacgagatctatatgaccttccgttctcgtgttggagtgcctgatcacatggacgatgatctgtgtttcaccgttcttcgtaacaacggtgataagaaggttcgcacggcagaggagattgctctcatggctgaatgcaacatgaaactcatgatcgccacgagtatcatggaagagtgtttcctgcctattctagatcccaggacagggatagacattattccctccatattgtataactggaggtctgatttacatttcaattacaaggggttctatacagtagtcttggaaagtgatgatagcatggtatctgttgcctccataaggttgcatggtgcaattttagcagagatgcctctggtagcaacttctaaagagaatcgtcagcaggggatctgcaggcgcctcatgggttacattgaggagatgctgcaatccctgaaggcggagatgctgctcctatcagcaatcccgcacctggcggagacatggacatcgacatttgggttcagagagatagatgagtcggacaagaagaggctgagtaaggtgaggctggccgcagttccggggaccgtcctactgaagaaggacctgctgtgtgaatgttcaggcgcggacgccggtgagccgccgagccctaagcccttccaagtttactcgcgcgtgccgggcgcccgcaccggtttggatgcagtgtgccaataaagatgacgcagtggatcgaatgcgccgcggtcagtcgtcgtcgtcggtgacagggggcagctggtggtcgtcacggggcctcgtctccggttgctgaagccgaggccgagcacatcagcacgcgccggtttgtgtggtggaaatggaaagcctcgttgctctggtaggagctctgaagatcgctgtcgtctgcttgtagtctgtaaatagcttctccgtcggcgagaagcccagggtccacggccattgtagaaccgaacctgtatgataaaactagaccgtgttggcgccccaccagcgtttagtagtttccgttgccctttgaactcaaagtttctggctagtccattgtgttcgtttcagaagcctgcggttttcagggggaggggaggtgccagaaagggaggacataacgcacgtgcagaccgagtattatgtggtggtgtcgtagacacgcacgagttgacgaagctataggagcagctcgtgatgagcaatggttggtgcagatgatgatgtcaatgagctcctcccgcagggaccggacctgtggacacggatggagctgaacttgtttgaaggatgcgtagtactaataatatatgcagtcaagccagcctgaacttatttgaatgaggtgtagtactaataatatatgcagccaagccagcctgaca

SEQ ID NO: 18673 - DNA, 2659 bp, Zea mays
  misc_feature (1629)..(1629): n is a, c, g, or t
caccatggaaattaattccataatgtatattttttttgtaaaattctattttctacgaactttattgtcaaaaagtttcactttgtaaacgtgtctatgtccaaaatgacttgcatttgacatatatatgagaaccaaccatgctgatgtgggtagctgctcaatcagcttgtggttgctaaacaaacactctgaagttgatacatgtgccagattctccctttgacacgctgcttatgggtgtgtgtggtttttttgggaccttattaattagtgctgttggcaggtagggtgctgatatctagttttagttggcatttattttagttagccttttgttttgggctactgaagctgattggattatattcgttcaggtgggtggtgggtgttggaacagtactgttttgtcataagtgggccccctatgcagggtggctgccccacatcccgatccttctctcggcggcccgttggtcacgtgactcatccccctgtgctctcctctcgtggccttgtttcctggcggcgacggctggtcgagcggcgccgcccttggctaggtcttcgctgggtccttccccggcgacgagcgtccatctggggtcgactgaactgagcaggcagtaggaagagacactatgttgttcttctcctacttcaaggagctggtggggaaggaggtgacagtggagctcaagaatgacttggcgatccgcgggacgctccactcggttgaccagtacctcaacatcaagctcgagaacacccgcgtagtcgaccaggacaagtatccccacatgctttcagtgcggaactgcttcatcaggggctcggtggtgcggtacgtgctgctcccgcaggacggcgtggacatcgacatcctccacgacgccaccaggagggaggcgcgcggaggctgatcctgatgcgcacccgctccctcacctgctggctgctgcttcatccccgattgtacgaagcatgcatgtacggtgtgtggtagacagatgccccagtttagttctttggtgcttgcctgacatagatattccaggttggatgatgacctgaatcacctgatatattattgtcatatcatatgcaatggtcttgcatggggttgctatattattaccatatcgtattatcacatcgatagacacttaaacttattagcacgtgagcagcactgctgtgctccccggcactgctaaacttattaaacacaatatggcttaattttgttcggtgaaaataagatcacaaaactaaacacgatatgattcaaattctgtccagtgaaaattagattgaacaaatctgtagccttttttgatgggaatgtgtcaggtgcatgcaaaacaatcgtgcatcaactttcaaaatgatgaatcttgttggggtgtttggttgaggaatcactccatctaaaatgaagtgtattatgagtctattctttaaatttggtgggataacctcattcgttatcttaatactaactaattaactatgatgaaatggggtgaaaatgagtctattcctcaaatttgggggaataactccattcgttatcttagtactaactaattaactatgattcttagtactaactaattaactataatnaatgagatgatgatggattaactcatttcattctataaactgaacaaaaaatgaggagtgagaagatgattgactagcttatttctcaaaccaatcacgttacaaatttggtgaaatgatccattacttatgttagtactaactaattaattatgatgaataaggtgatgatggattaattcattttatttcataaattaaacaaaaaataagaaataagaagatgatggactaacttatttctcgaaccaaacactctatatatcttccatcttcatctagttgatttgcatgccgccaaattgtagcgtcaaactatctccaacaggctttttatcctattttttattttaaactatactctattaacagtataatttataatgtaaaaaaatgatagtgtagagcctgttagtcgtaggagagagcgaatagaaaatgggcctaggaaagtggcttgatggtcaggcggggccacgccgcacaccagacacgcgctagtggacctgacgttttgatttgaccaattaaaagcgagaaggtaccttcgaagcaaaactaagaagccttcattttgtaagaactcccaacaggccaacagggactaactagaaaatgagtggtgcttgttcctttattacgtttttgttatgtcaacgaccttcaaaagttgagatttgtctttaaaggaagcacaactacatatattatatagaaacatatccggtatacattaatctttattatgcatagattgtacataaactaacaaagttcataaaaaactctaaaaaaattcatacaaattctttccaccctactccaattatatataaaattttaagtttatttttttattaataaaaagataaaatttctgacaagtttaaattagaaaatcggctcaaatgttctctttttataacaactaaactataacgaatttgaccttcaaattttatatataattagagtaggctaaaaagaatatgtatgattttttcagaactttttgtgaacttcgttagct

SEQ ID NO: 18674 - DNA, 1800 bp, Zea mays
attccaccccgccggcccggggcccgtgtcacttttactgatccgttgttgcgcataaagctgcccgcgtggacagccccctcctcctgccccgtgacctccactgcgcgcgcgggcaccaatggcggccgcgtcgctcaagttcgcctcccccaaacccttggcctccgcaccgtccgcgctcctttgcgggcgtcgcgcccaggcgcggcccctcccagcaagtcgcctccctccgcctacccgcgtcgccgtgcagccccccgccgcgccggtcgcgacgcgcatcggctcctttgacaaggtgctggaggcgctgatcggcgggaccgacttctccgaggaggatgcggaggcgacgctgaagctgctgctggacgagaaggacgaggcgcgcatctccgccttcctcgtcctcctcagggccaagggcgagaccttcgaagagatcgtggggcttgcgaaggcgatgttgagctgctgcatccgagtcgatggtctggacgacgccgtcgacattgtcgggacaggcggcgacggcgcagacaccgtcaacatctccaccgggtccaccatcctcgccgccgcggccggcgccaaggtcgctaagcaaggaagcagggctagctcgtcggcgtgcggcagcgccgatgtgctggaggcgctcggggtcaacatcgagcttggacccgagggtattaaacgatgtgtcaatgaggtgggtgttggattcatgatgtctgcaaattatcatcctgcaatgaaaattgtcagacctgtgaggaagaagcttaaaataaagacagttttcaatatccttggtcctctactgaatccagcaagggtgcctcatgctgttattggtgtttaccatgagaatatagttaccaagatggctaaggctgctcagaaatttggaatgaagagagcattggtcgtccattcaaagggtttggatgaaataagcccacttggtcccggatatatccttgatgttactccagagaagattgaaaaaatgttcttcgatccattggattttggcattcctcgctgcacattggaagatctgaaaggaggcgatccagcgtttaatgcaaaagttctccaggatgttcttgctggtcaaaggggggcgattgcagatgcccttgttctaaatgctgcggcgtccctacttgtcagtggtaaagtgaaaaatttacatgacggtgttgctttagcacaggagacacagcggtccgggaaagccatcaatacacttgagtcttggataaaaaaatcaaatagttccagagactgagtgaagttgagtagcaatagatggatttctgcaataagacatgaggaatggtagcaaataagggctccgctgagtccatccatcatccgtgtatgattggctttcttctcgtgttttgttcatgatttgtgtcagaaacctaggtggcatctagtctggtttatgtattgccagtgctgttgtgtagaaaaatctccgtcgatattctaagctttttggttagaaaggtgcgctcttcattgtccttgacggaactcggggtagatgaacataggccatctgttgtgatcttgtgatgctgcattacgtttgcaatggatcatatattatgcaatggcatgggaagattatacccatttgtaatgggggagaatcagggcttaaacatttctacaataacgtgcgaagagttgtccccattggtaacgcatgtcctgaaatatgaataaagctgcaggcagttgatattttgcaaaagaaaaaaaaaaaaaactcga

SEQ ID NO: 18675 - DNA, 1468 bp, Zea mays
ccgcaccgtccccgctcctttgccggcgtcgcgcccaggcgcggcccctcccagcaagtcgcctccctccgcctacccgcgtcgccgtgcagccccccgccgcgccggtcgcgacgcgcatcggctcctttgacaaggtgctggaggcgctgatcggcgggaccgacttctccgaggaggatgcggaggcgacgctgaagctgctgctggacgagaaggacgaggcgcgcatctccgccttcctcgtcctcctcagggccaagggcgagaccttcgaagagatcgtggggcttgcgaaggcgatgttgagctgctgcatccgagtcgatggtctggatgacgccgtcgacattgtcgggacaggcggcgacggcgcagacaccgtcaacatctccaccgggtccaccatcctcgccgccgcggccggcgccaaggtcgctaagcaaggaagcagggctagctcgtcggcgtgcggcagcgccgatgtgctggaggcgcttggggtcaacatcgagcttggacccgagggtattaaacaatgtgtcaatgaggtgggtgttggattcatgatgtctgcaaattatcatcctgcaatgaaaattgtcagacctgtgaggaagaagcttaaaataaagacagttttcaatatccttggtcctctactgaatccagcaggggtgcctcatgctgttattggtgtttaccatgagaatatagttaccaagatggctaaggctgctcagaaatttggaatgaagagagcattggtcgtccattcaaagggtttggatgaaataagcccacttggtcccggatatatccttgatgttactccagagaagattgaaaaaatgttcttcgatccattggattttggcattcctcgctgcacattggaagatctgaaaggaggcgatccagcgtttaatgcaaaagttctccaggatgttcttgctggtcaaaggggggcgattgcagatgcccttgttctaaatgccgcggcgtccctacttgtcagtggtaaagtgaaaaatttacatgacggtgttgctttagcacaggagacacagcggtccgggaaagccattaatacacttgagtcttggataaaaaaatcaaatagttccagagactgagtgaagttgagtggcaatagatggatttctgcaataagacatgaggaatggtagcaaataagggctccgctgagtccatccatcatccgtgtatgattagctttcttctcgtgttttgttcatgatttgtgtcagaaacctaggtggcatgggaagattatacccatttgtaatgggggagaatcaaggcttaaacatttctacaataacgtgcgaagagttgcccccattggtaacgcatgtcctgaaatatgaataaagctgcaggcagttgatattttgccactgaaacaaaaaaaaaaaaaaaaaaactcgagctcggggcccggtac

SEQ ID NO: 18676 - DNA, 807 bp, Zea mays
gaagatccatcggctcacgcactgacgcacatccattaccttctataatacgtctgcggtgtcaaaatttccctctcagccgtgttgctcgccgccgccccgccgtgttgctcgccgacaccgccccgccggcagccaaaatgccgttcaagaggttcgtggagatcgggcgagtggcccttgtaaactacggcaaggagtatggccgcctcgtcgtcatcgtcgacgtcgtcgaccagaacagggctcttgttgatgcccccgacatggttcgttgccaaatgaacttcaagcggctttccctgactgacatcaagattgacattaaacgtgtcccaaagaagactacactgatcaaggcaatggaggaagctgatgtgaaaagcaagtgggagaatagctcatggggcaagaagctgattgttcagaagaggagagcatcactcaatgactttgacaggttcaaggtcatgttggcgaagatcaagaggggcggtgccattaggcaagagcttgctaagcttaaaaaggtggctgctgctgcttagattgctttggtggttcctctattcgatctcttgaaatgtaatgcacgaattactttgacagttagcttgtcaagatgtcaattttaaactggcttatttagatattttgtccaaaatgctattctgaatctgagatagtgttgtattctgatatctatcaagtgttgcattgttgttacattcaaaaaaaaaaacggctggctttcagtttcatgtgaccaatatttgccatctagaaaaatgaataaacagcgccgcc

SEQ ID NO: 18677 - DNA, 6226 bp, Zea mays
  misc_feature (1487)..(1487): n is a, c, g, or t
tcttcggggcattcgcttatcactgcacagttttttttttttttttttgctttgctaaaaaacagaatagtggtttgcgaaacttttcatctgttgggctctgatctcgaattatcactgaatgagattttggggccgaacgctctgaccttgggccgaattcccggcgcacctaaaaaatcccaacgctaccaaacgcccaaaaaaaagccaggccaggccaggccagcgtgaaacgacccagtccagtcatgttgacttctccgcgttcgactcggctacccgaaactcccttgggcgccgaggcgacagcggcacgcgggcgaagctgcgtgggcggctcgttcggctcggctggccctggacgcttcacctcccccctctctgtcttgtccgcttttggtcgaccgcggccttgggcggagcaatccaggtggagtgggccgagaagcggccgcctgatcgagccgaaccaacggccgacgcggcgcacgccatggtagcaggttcgtcgacgccctccatgtcggagccccctctcctgccgtgcttacgcgtgtctgattgatcggctgcgcgcgtcgccgactcgatccggccggttggtggatcgtctggtcgccgggacgagggtgaggaatccgtcgaattcgtgcccaatttcggcccgatcggtggtcggattgggttgggaagctccgcggcggtgggcgtgtccggtcggttaggcttcggtgccgctggggctggggctgggtagcggtgcttggggatactattgctcctgtgaatgtttataggaagggctcttcttggtttcgcgccgagagtctcgccgggcctattgctagatatgctactccagccggccgtcgaaggaaaatcgatgcgattaagataagggcacgcgtaaagacgaggtgtcagccttgacggattgtttagcttaggatgaacttgctgccttccacgatgccttttacctaagccgtgactcgtggacttctgtggttttaaacactgatgcgcttgttgggatcctgtatttcacggagaaacgggatatggttatgagctttagccttgtgcttgcttttatgccaggatttctcattctttatatactccattcgctagatgtaggtaagtccatctgaatcatttggtactagatgtctagtactggtgtagatgtaatgtaaaacctagggtgacaagactaatgtgtgtgttgtattgtcaaaagtcatcaatatgtgctttgcaagcactaatataagcattctggtattttgtgtacctgtccttacatgtattagcgatggatgtggcatctgtgatgtacattgcctacatattgaggaaccaaaatattgaagtctcaccatgttcatgggctttggttacgcacatgttgcgaattcaattaatgatcaggcttgaggccatcagggcttgaactagtgcttgtattttttagcacattnctcactgtagttttgttttcttcttaaggaggaactttatttgacccccattctgtattgtttactacttctgaccaaatatataggtaaaaatattaatatttatgacaccaaataagtatagtatgaaagtatatggacaaacccaatgttggagcctcccatatgaatggggtctggggaaggaataaatgaggcaagtcttacccttgcattttgcagagcgtcgaacccaaggcctttggcccagtggaaaggcacaccactgcaccatatctatccttcatagtacgaagatgtatctcataaaaatctagtggtgcttattttatattataaatatttgtattgtttatagttaatcaaacgcaagacactttaacttggtagtgtgctagaattggattttttgtcgactgagggagtaccatatcgtcttatggataccacttcatgtttctatataatgtgtgagtagttcattctttgtttatggttggaggcttactgaaaaattgtccatggatgtgattggcagctggcaatccacctccaaaaccgtgggaacgtgcaggaaattcatctggcccagtgccttttaagccgccctctggtggtagcaccagtgatgttgttgaagcttctgggacagcaaaacatggagaagttgtttctgctgctgctgctggaaacaatgttgcctccaatgtaaacagcacaatttcaatgcctgtgcccccaaggccttggcagcagcaaggctatgaaaactcttatgggggtaattgtaatctgttttgcatgtttcagaaaatattcttgtgtctcaaaatgttaacgttttgatgaaaatgcaggttatggctccagtatgtatagctcttacggcggatatagtgggccctatggaaataacatgtactcaggttatggaggaggttatggcggtacgtatggaggttctggaatgtatggtggaccaatgtatagcggtggaatgggaggaccctatggtggttatggtatgggcatgagtccctataatcagggaccgaattcatttgggccacctaccccaccccctggtttctgggtgtccttcctacgagtggtaatatatgttattttatctagttactgctgatgcagatgattactttcaattgaccatccacacaactctgcataaataagatcttttacagtgcattaacagctgttttcaaatgctttccagaacttagattgcagttgtaccccatagtccctgcttgccatgattgttacacacatggtgaagcaacacatttcgtattttacctgcattattggaacatatattttgctaattcaataccaaattccatgtagtgactgcgtatcgttcatgacgctttgcatcagttgatttaaaaatatctttcacaggtgacaggactcatcgttctcctaaccagatctcttcttaattacagatgcatggtgttgtgaatttctgtgggagggttagcttccttgttagccagaacactcaggcatttcacatgttcattactgcacttttgcaggtatcttccgactggtgcttatacttttcctgtcgaatttacttagagtgtatctcctgtgtttcccctgatgcgatattattatctccgtagttatgtgatcgggctggaatgctttatggtgagcttgcaagatttgttctacgtttgctggggatcaaaagaaaaccaaagaagagcggtgttaagggcccaggagctccatcatcggagggacgaggccagcagcttgttgaggcgccgaaagttaactcgtgggacagcgtgtggactgagaatggcaagggaaattaaagggcccgtttgggcacagtgaggcagttctcctgaaaggagaggagggcgagtttgcttgtggaagagaaatctgcgaatatctgttcggatgcgttttgcatatgcatagaaggcatagacaaggaaccccttatgcctttttgtatttgtcatgttcttccatggtgtacatatagatcagtgtgcaatgagaaatgtgagcgggtaatgtacggctttcccccccaaaatattactgcaatagtaccgtttgtacttaaaaaagacggaacacaatatagatgatcctttttatttggcctgttgctacatataaggttgtttatacatggagtcttggcatgtggtggtgccaggtattagcagctgttctgttcatgggatgaaagtgccatgatgggactctttttttcttccttctcatatttcttatgtagcagacgatcaaactgatcatgatgttttgcgtcgatgagcctacaaattgtggtatttgcggtatcacccagatggtattcggttgaatgcttctctagtttctttagcttgcaatcttcgttacgcggcccgcggcggtgcggtcggtgagctccatcgccgcacatctgatataagagcaatgccgatcatgttgtaattcgaccatcatctatacacaattactctgtaataaccgtactacaaagatacctaatcttgttgcacattgtcggaaagaaatgtcagacgttatacacacacgaccaggtgtaaataaactgcgacgttcgtcgagtatatataatgaacaacaaaattgcagctttgaattagccttcacagatttgagaagcttctgtaccctttacggcacatccggcctgttaacacgagccggcccagacagcagatcctgtttgtcgttggcgctccaaagacacgctgacctgactgccgggcgggccccgcctgagtgtcacgagtcgcaccagctccggagagcaacttggcccgcttttggctgtcgcgtccgccgctgccggagggagagtgtgtgtggaaaaaaaaaaattggagctgctgctttcgcagcatcgccacaaaaaagaagtggcgagggcgatacaaagggctggatcaggttccaaaccaggtgacaggcgatcgcatcaaatccagctcgggatccggagctggcccactcggcagccgaacagtattccgctttcgcttgtgttttcttgttaggctaattattcagcaaagtacctgcttttgttgtttgatgacaaaagttgctcacatcacacttcacaccccacaacggtcaaaatattatagcctagtgagtgtgcaacgagcgtggtagtacttttatattgctagaaaaagggcgcacagggatcttcttctgtcgttgttgtaattggtggtgagcatgtttagacattgcttgcttgcagatgatgatatgcacgattcaggcaggttgctgattttttttttccaccaccacccctcttgtgtgctgatctgacgattggggccacaccacgccgcaccaaatcctgacgtgacgctggctgtttggtaacgagattcgtgtcagcaacagtcgcacgtgcaatacactctacgtaccaaaaacaggtggcgtcattttgcgtcgtcaaacagtttggagtatatgattatcagacgtggtacgcgacgtttacaatcatggaattaagcgtaaaaaacgagggttatttgcggaggacacagagatggcaatgggcacctatgacccgatacccgatgggtatttactccattaaagtatgtatatgggctaaatattctactcatggttctgttatttggtaaaaaacttcattaaatgagtaaacgggtattataacgttctgccctcacccgtgcccggtattagaatgtttttccctcactcgtgctcgttaacacgtgggtatagaatacccagtataaagttggacaaaaaatagttcattatatttgttgaatgatgcttaccgcatatgatatatgtctaatcttgtgggtatgagtgactcatacccaccagtaaatatggatgatccgacgagattatcttttttgtcgtggttgtatgggatagtaatatccgttgggtatttactcattgtcatcggacggagcaacatgtgaggtttatcgtaagtccactcaatcactcctacattgacaaaaaaaatccctatcactgccaaaaaaaatgaaactacagatcccattaaagtcaaactatatttaagttcgcttgacctaatgttttatttataattgcatcgtttcaggaacggctggatggattcgaacaggattcacattttttttcttgttttcacggttgcacagttgtcatgtgtcatcttcccactctatgtaaaaataagatacaattacgtacaggtgaggatttaaatctgggttggtggctctaagtccatacggaggctctacgtcacctaaccaatggaatagacattttttttatgttaaaactaagtctatccatataataaaaccgtatgactagtgtacaagtatctgtcagtcagtcacgatgaagccaactgtccggtaaatcctcaagtatcaacccaactgtccggtaaagtccaagtgggaataatgatggttccaaaatagctcctcgagtttatccagaaatggtccagatccagagaggccgcagcgagcaggtgcccagttgcggtcacgcaaccggccaaaaacagcaacaaagacacgtcaactcgatcaactgtttattccttgccttcccgaggagagagaaacaagcgaaaagcacatctcctcatctcctatgctacgcgcctacgcacagct

SEQ ID NO: 18678 - DNA, 1442 bp, Zea mays
gcaccatggtcatgttgacttttctccgcgttcgactcggctcctcgaaactcccttgggcgccgaggcgacagcggaacgcgggcgaagctgcgtgggcggctcgttcggctcggctggccctggacgcttcacctcccccctctctgtcttgtccgcttttggtcgaccgcgccaccgcggccttgggcggagcaatccaggtggagtgggccgagaagcggccgcctgatcgagccgaaccaacggccgacgcggcgcacgccatggtagcagctggcaatccacctccaaaaccgtgggaacgtgcaggaaattcatctggcccagtgccttttaagccgccctctggtggtagcaccagtgatgttgttgaagcttctgggacagcaaaacatggagaagttgtttctgcttctggaaacaatgttgcctccaatgtaaacagcacaatttcaatgcctgtgcccccaaggccttggcagcagcaaggctatgaaaactcttatgggggttatggctccagtatgtatagctcttacggcggatatagtggaccctatggaaataacatgtactcaggttatggaggaggttatggcggtatgtatggaggttctggaatgtatggtggaccaatgtatagcggtggaatgggaggaccctatggtggttatggtatgggcatgagtccttataatcagggaccgaattcatttgggccacctaccccaccccctggtttctgggtgtccttcctacgagtgatgcatggtgttgtgaatttctgtgggagggttagcttccttgttagccagaacactcaggcatttcacatgttcattactgcacttttgcagttatgtgatcgggctggaatgctttatggtgagcttgcaagatttgttctacgtttgctggggatcaaaagaaaaccaaagaagagcggtgttaagggcccaggagctccatcatcggagggacgaggccagcagcttgttgaggcgccgaaagttaactcgtgggacagcgtgtggactgagaatggcaagggaaagtaaagggcccgtttgggcacagtgaggcagttctcctgaaaggagaggaggacgagtttgcttgtggaagagaaatctgcgaatatctgttcggatgcgttttgcatatgcatagaaggcataaacaaggaaccccttatgcctttttgtatttgtcatgttcttccatggtgtacatatagatcagtgtgcaatgagaaatgtgagcgggtaatgtacggcttccccccccaaaaaatattactgcaatagtaccgtttgtacttaaaaaagacggaacacaatatagatgatcctttatttggcctgttgttgctacatataaggttgtttatacatggagtcttggcatgtggtggtgccaggtattagcaaaaaaaaaaa

SEQ ID NO: 18679 - DNA, 1962 bp, Zea mays
cccgggacgaggactgttttgcaataccttgattgtccagttctgcttactagctccagtttccaaataaagcgctgctctttgtctccagatttcagacccaaaatcgatgggcaaaagcggaaagaaaccgagggaatcgcaccggcagggccgcggccggcgggcgtcgcacttctgcgacgaggacggctacgacttaccttcgtcagcctacgatgcgacgccgcgccaaaacgaggaatcctctgaagacaacgacgacaccagcgaagcaacagcggaggacgaaccagagagggatacggaagcaggcgagcaggaccaatggcaaggatcaatgccttccaagtttcacctataccagctctccgtgcagtcgccgaagggggacatcagctacttgcagaagttcttcctgatgtatgtcggcgggcgcgcccctctccacctgcaggaggatttctgtggcacggccctcctcagcaccgagtggatccgtactgatgcaagaaggacagcaattggcttagacttggatcttgagtcacttgagtggtgccttgaaaacaacctaagcaagattggagctgatgggtattcaagaatgttgcttttccatggaaatgttctacaaccaatggaatcccgtcttgtcaagcaaaagtttactaatcttgtgcatggtctagatttgaacagcaacaatggcacaggaagtaacagttgcaagcagatgggtcttgctgactcgaagtgcttagccaatctgaccatgtcagaggcagattttcctgcaagggatattatctgtgcattcaactacagctgctgttgcctgcatagtagaaaggacttggttttatatttcaggcatgtatgcagtgtgctctcggaaagaggtggtatatttgtaatggatgtatatggtggcatatcatctgaacgcaagttacgtctccagcggaaattccccagcttcacgtatttctgggagcaagatgagtttgatatcatcagtcgccaaacaaggatcagtctccactttcaaggcggaaagaaacagatgctgcgatatgctttcacataccattggcgcctatggtcgattccggagatcaaggactgcttggaggaggctggattcaagtgggtccacgtttggatgagggagatgccaaatacccagtcaggtggaaacgccaaggagtataacgccaaccgggacgtgaagtacgaagaatcgcagcatttcaaccaaggagatgcttggaacgcctatgtcgttggagtagcaaatgtctagccggtacgtgctgaattctgctacgaaaatgtgatggtggctctcagtttcccaggccaattaatgtttcgtggacgcttccgctttgatcacaacttctgcatcgcgttgctgcggaggaagtatgcagcaggctggctattaccggacccagagaacttttactccagaacacggcctcagtgatgtttctgttttcaaaatgaaatgctggcaacgtgacatgcctttgaatgtatttcttacggatacgatgtgtaggatatgatgggtgcttcgacggataccgatactacctttcatgatagcttcatatgcattaggggttggtatgtgattcgtgtttgggcgattgatcgtccggttggcgatcggtcatacatctttctaccaaacggaactttcccgctataaaaagcctttcagcctattgtaccaaaaaaaaaaagtggtggctaccatcttctcctttttacttgtgctgtcattttcatctcatcgtccgtgctataggtgtctccgggtccgttccagacgcggcagactcttcgtttggttaaaaggctggacgccgctttggaccacttcagcggaccgctaaaagataaactgatgcagcagcttgcttttgagttttgtctgcaggtcgactttaa

SEQ ID NO: 18680 - DNA, 1952 bp, Zea mays
cagacggatgggcggacgcgtgggcggacgcgtccgcggaccgtgggcggacgcgtgggttcagacccaaaatcgatgggcaaaagcggagagaaaccgagggaatcgcaccggcagggccgcggccggcgggcgtcgcacttctgcgacgaggacggctacgacttaccttcgtcagcctacgatgcgacgccgcgccaaaacgaggaatcctctgaagacaacgacgacaccagcgacgcaacagcggaggacgaaccagagagggatacggaagcaggcgagcaggaccaatggcaaggatcaatgccttccaagtttcacctataccagctctccgtgcagcaccgagtggatccgtactgatgcaagaaggacagcaattggcttagacttggatcttgagtcacttgagtggtgccttgaaaacaacctaagcaagattggagctgatgggtattcaagaatgttgcttttccatggaaatgttctacaaccaatggaatcccgtcttgtcaagcaaaagtttactaatcttgtgcatggtctagatttgaacagcaacaatggcacaggaagtaacagttgcaagcagatgggtcttgctgactcgaagtgcttagccaatctgaccatgtcagaggcagattttcctgcaagggatattatctgtgcattcaactacagctgctgttgcctgcatagtagaaaggacttggttttatatttcaggcatgtatgcagtgtgctctcggaaagaggtggtatatttgtaatggatgtatatggtggcatatcatctgaacgcaagttacgtctccagcggaaattccccagcttcacgtatttctgggagcaagatgagtttgatatcatcagtcgccaaacaaggatcagtctccactttcaaggcggaaagaaacagatgctgcgatatgctttcacataccattggcgcctatggtcgattccggagatcaaggactgcttggaggaggctggattcaagtgggtccacgtttggatgagggagatgccaaatacccagtcaggtggaaacgccaaggagtataacgccaaccgggacgtgaagtacgaagaatcgcagcatttcaaccaaggagatgcttggaacgcctatgtcgttggagtagcaaatgtctagccggtacgtgctgaattctgctacgaaaatgtgatggtggctctcagtttcccaggttcgtggacgcttccgctttgatcacaactcctgcatcgcgttgctgcggaggaagtatgcagcaggctggctattaccggacccagagaacttttactccagaacacggcctcagtgatgtttctgttttcaaaatgaaatgctggcaacgtgacatgcctttgaatgtatttcttacggatacgatgcgtaggatatgatgggtgcttcgacggatgccgatactacctttcatgatagcttcatatgcattaggagttggtatgcgattcgtgtttgggcgattgatcgtccggttggcgatcggtcatacatctttctaccaaacggaactttcccgctataaaaagcctttcagcctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaagggggggccccccccacaagaaacccccccccccggaattttttttgggcccgtacccttgggagcacccacttttcctttttggggagggtttaaaaggggggggtttaagggggcaaatatgttcccggggaaaaatgtttttcccttcaaaattcccaaaaaaataacccgcggaaaattaaagtttaaacccggggggccccataggggggccacccccccatttttgggggg

SEQ ID NO: 18681 - DNA, 1012 bp, Zea mays
ccggtccggaattcccgggtcgacccacgcgtccgagaaaaaagttgcataatgtagaagcccatgttgatcgcgcccgcggccagaaccacattccataaacccaaaatagcaatcagctcatctgtcagcgccacaggtgaccggaaaaccacggccggcgttcctgcttctctacccggtccgaattgctgaccggatcaacccgagaccttgcaggattatcgatctgattgcggcatgatccgcttcatcctgctgcagaaccggcaggggaagactcgactggccaagtattacgtcccgctcgaggactcggaaaagcacaaggttgaatacgaggtacaccggctcgtggtcaatcgggaccctaagttcaccaacttcgtcgagtttcgcacacacaaagttatctacaggagatatgctggactgtttttttcaatatgtgtggacataactgataatgaattggcatacttggaatgcattcacttgtttgtcgagatattggaccatttctttagcaatgtttgtgagctcgatttagtgtttaattttcacaaggtttacctgatactagatgaatttattcttgctggggagctgcaagaaacaagcaaaaaggcaataattgagcgaatgggtgaactggagaagctggaatgacgaagaccaggaagatgctgccgcgtgtgttgtattccaatttgtattattcgtttcaggtgttttacatttgctctcctggttcgttccggctgacagcgtgatgcccatgctgtcactcgaaagaatggtagtagtagctagcatgagtacattataaacgtaccttcgaaaacataataatttcccagcaattatttcgttcccctctgcagtgaaaatgaaaaagacaaaacagcgcgttattcgtgcgactatgtttgcagtgccgaccagctgcagctgcagtgggcctatcaattatagggctggcaaggaattttctcaatcataaaaaaaaaaa

SEQ ID NO: 18682 - DNA, 936 bp, Zea mays
gaaacggagaaaaaacaaaagaataaaaaaagttgcgccggccgggtccccatggtcccccggggggaagagagaaccacattccatagacccaaacttgcaatcagctcatccgtcagcgccacaggtgaccggaaaaccacggcgttcctgcttctctagccggtccgaattgctgaccggatcaacccgagaccttgcaggattatcgatctgattgcggcatgatccgcttcatcctgctgcagaaccggcaggggaagactcgactggccaagtattacgtgccgctcgaggactcggaaaagcacaaggttgaatacgaggtacaccggctcgtggtcaatcgggaccctaagttcaccaacttcgtcgagtttcgcacacacaaagttatctacaggagatatgctggactgtttttttcaatatgtgtggacataactgataatgaattggcatacttggaatgcattcacttgtttgtcgagatattggaccatttctttagcaatgtttgtgagctcgatttagtgtttaattttcacaaggtttacctgatactagatgaatttattcttgctggggagctgcaagaaacaagcaaaaaggcaataattgagcgaatgggtgaactggagaagctggaatgatgaagaccaggaagatgctgccgcgtgtgttgtattccaatttgtattattcgtttcaggtgttttacatttgctctcctggttgttcgttccggttgacagcgtgatgcccatgctgtcactcgaaagcatggtagtagtagttagcatgagtttggtgcccagttacattataacttatcgtaccttcgagaacataataatttcccagcaattgtttcgttcccctctgcaaaaaaaaagaaaaaaacaaacaagcccttcgtccggccgccttgtttac

SEQ ID NO: 18683 - DNA, 2351 bp, Zea mays
cagccgggtaaggaacttcagtttagagtttggcgctagaagtaggaggatactcatgaacacttaaggatttttgggtatggatggagatgccttagaggttttccctatgaagtcacctcggcctgaactacttcagcctagtcttctctctaccaagtgtgtcatcccctctatagctagggatggcaattctgcccgcgggcactacggatatccgcgggtttcgtatccgatgggcatggatacgggtaagaaatctcgcccacggataaggatacgggcaacacttctcacccgcgggtaattgacggatataaaatttcgcccgcgggtattacccgttacccgcttaatttattagcccatcaaaatatcgcccatgtgttcattttatcctaaaacattgtgttgtaataattaattatcttaagagtttgagacttatgtttgtggatgatcgatcatgtttgtggacttttaagtttgaactatgttccttgtcattattatgtctgtcaagttgttgtgttcttggtaaaatgaacatgaccccatactctatggtattttctggcgaataacgggttgtccgatatccgcggatatcctgcgggtacgggcacgggtcgaaaattttacccgcaagctctcgcgggcacggataaacactagcggatatgttagcgggcgggtaaatgacttacccgcactttatccgacccgctgccatccctatctatagcctaagagaggagcttaaatgaagcctgagtctcgaaaagtggacccacagaaataaagagatcgtggagcaagaacggtgctcgtggattgatatcttctccgtccattcttgtcttctgcctggtcttgctagcgtgtgagttacagcggggttagttatgcgattgcccgtcgtttttgttacacccatcgctatcgttcaggagtcctttctgtttgcatctgacgaggttatccaactgttattatggcgagcttatcggaataaatctagagatagagaagatacggcccaagcccaaccgaagcccatacgtcttgcacggctgcttttctttcctttatatacccaggaaggctgaagcgagccgccagaattgctgctgggtgctggccgttgcgggcgaaccgaaaatcacgggcgcgagagatcggagcacggcatgtcggaggagcagttcctcgccgtggcggtggaagccgccaagagcgccggcgagattattcgcaagggattctaccagaccaagaacgtcgagcacaagggccaggtggatttggtgacggagacggacaaggcctgcgaggacctcatcttcaaccacctccggaagcacttcccggaccacaagttcatcggggaggaggagtccgcggcgctcggggccaccgctgacctcaccgacgaccccacctggatcgtcgatcccctcgacgggaccactaatttcgtccatggtttcccatttgtatgtgtctccgttggcctcaccattgggaaaattcccactgtcggagtcgtcttcaaccccatcatgaacgagcttttcacggcggttcgtggaaaaggggctttcctgaatggctctccaattaaagcatcatctcaagatgagttagtgaaggctcttctggtaacagaggctggaaccaatagagacaagaccactgtggatgatacaaccaacagaatcaacaggctactatacaagattcgatccatacggatgtgtggatcattggctttaaacatgtgtggagttgcctgtggtagactagatttgtgttatgagataggatttggtggtccatgggatgttgctgctggtgctgtaattcttcaggaagccggtggccttgtttttgacccaagcggcggagagtttgatttgatgtcgcgaagaatggcaggatcaaacagcttgctgaaggataagttcgtcaaggaactgggggatactaattgaaacaaatgttagtattattcgtggaacagattaagacaataaggttgccccgccgcatggtgattaacttattgtttgggcaacaaaattccatgtaattctgcacctgtacaactatgttggacgcagaacattttattgagttttgtgattacatgggaatacataggttgaggcaacggtccctactttatggcaatatgtttgggttggaatggcttgagtccaatttcaagtgtgctgcaaggaggaaagtaaattgctggatctttacgcatttgctgataataatatatggttgctacgctgcaaacaatttgcggtggcatatttaagaaaaaaaaaaaaaaaaaaaaa

SEQ ID NO: 18684 - DNA, 2413 bp, Zea mays
gtaggagacctgactgactacgcgcgtccacagagctgtctactcctttggtccacgcttttttcgctgatgaccccaccccggccgcccgccggaaccccccccccccaacaacagtccctcccctccattcccttccctgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaaaggtgcaggactcaagcaccacttttacctggccttcctgatgatcttgctattgcctgccttatacgagttcctcgacttgaacagcccaaactcaggatggtttgcaaaagatggaaccgtcttttgtctgggaattacttttactccttgcgtaagaaaattggagtggcagaagaatgggtgtatgtctttaaaagggaccgtgaagggaagatatcctggtatgcctttgatccactccaccagctatggaagtcactcccaccagttccacaagagtattcagaagcattgggctttgggtgtgccgttctgagtggttgctatctgtacttgtttggcgggaaagatcctttgaggggttctatgaggcgtgttgtattctacaatgctcgtacaaacaaatggcaccgggctccggatatgatgaggaaacgtcacttttttggttcttgtgtaataaacaattgtctctatgttgctggaggagagtgtgaaggaatacagagaacactgcagtctgcggaagtttatgatccaaataggaacagatgggcctgtgttactgaaatgaacaatgggatggtgcctttcattggagttgtatatgatggcaagtggttcttaaaggggctagattcccatcgccaagtaactagtgaggtctacttaccatcatccaatacatggtcagcaattgatgatgagatggtcacaggctggcggaacccaagtatttctttcaatggccgtctctattcagctgactgccgggatggctgcaagcttagagtctatgatgagaacacaggaacatggacaaggttcatggacagcaagcaccacttgggcagctcacgtgcctttgaagctgcagctttggtgtcactaaatgggaaactctgtgtcatcaggaacaacatgagcataactcttgttgatgtctccaacccaacaatgagtgttgagacagatagtgcgcgcatgtgggaaactgttgttcggaagggccagcacaggtcgtttgtggcgaacttatggtcgagcattgcaggacggaacttaaagagtcacattatccattgccatgtgctgcaagtttgagggcaggttttgttagtgggaacatgatcaagttttttaagaagcaaaaggttcagatcagtgacagaaccctccatttcgaaggtagtaaggtttcattgcagaatcgcggggaaaaaggtcattggcgtgccactgctgcccccaaagtcccaaatagttatttgctctcttccagaactgaaaattccaattactttctggcaacatttgaagactcttatcattcatggataaggttttttcagattttgagtgcaaaccagaaagtgactaggaacttccctagtgtaatgacattttccccttgctggcaggctgggaaatgtgtttggtggatatattggtctcttatcatatttatctatctttgcattgtgtaatatgtggcatcttactgtgtaatgttggtgtatattgtagcggcggactagctagactccaggattagagtagtcaggattatgcctattatgcttcaattttttgttggaatgcctgatatcctccgttaataaatatgtgttaataaatatgtgataccgtgggcttttttgaaaaaaaaaaaaaaaagtcttattcaaaaaataataagttatcatttatttttttgatttattttatcacttaaggttctttgtatttgacttcaaattttacatttttgaataaatattttaaataaagtgagtggtcaaagtttttgaaaaaattcaacggtgtcatatatcttcgaacggaggcagtataccttatctatgtgggtgctggataaatgcaagagaatctgatgttttttcatgctatagttgaaacacacgccgttgttttccaacttagttttagctatgagtcgatgaccccatcaaaagaaggcacg

SEQ ID NO: 18685 - DNA, 1472 bp, Zea mays
ttgggtacctcgaggccggccggggatgcccagtgcaaccgcgaacctcagactcctcccggaccagctgacctccgctccattcaccccacaccttcttcttcttcttcgtcgtcgtcttcccctgctgcggttagcctggccgtggccgcctcctgctcttcgatctcacgctgcgatggagcggtacgaggtgatcagggacatcggctcgggcaacttcggggtgacaaagctcgtccgggacgtcaggaccaaggagctcttcgccgtcaagttcatcgagagagggcaaaagattgatgagcatgttcagagggagattatgaaccaccggtccctgaagcacccaaacataattagattcaaggaggtcgtgctaactcccacgcatttggcaatagttatggaatatgctgctgggggtgagctatttgaaaggatctgcagtgcggggagatttagtgaggatgaggcaaggttcttcttccagcaactgatttcgggagtgagctattgccattccatgcaagtatgccatagagatctgaaactagaaaacactctcctagatggtagtgtcgcaccccggctcaagatctgtgatttcggttactccaagtcttctgtgctgcactctcaaccgaaatcaactgttggcacacctgcatacattgctccagaggtcctctctagaaaagagtacgatggaaaggttgctgatgtctggtcttgtggagtaacactatatgtgatgctcgtcggcgcgtatcctttcgaagaccctgatgacccgaagaacttccgcaagacgatcacgagaatactcagtgtacagtactcaattccagactacgttcgcgttacaatggagtgcggacatctgctgtctcggatatttgttggaaatcctgagcagagaataaccattcctgagatcaagaagcacccgtggttcctcaagaatctgcccatcgagatgaccgacgagtaccagcagagcatgcagttggcagacatgaacaccccggggcaaagcctggaggaggtgatggcgatcatccaggaggcgcggaagccaggggacgccatgaaccttgccgggcagctgccctgcctggggagcgtggaccttgacgacattgattttgacgatattgacgacatcgacactgagaacagcggcgacttcgtttgtgcagtgtgactgtgtgaggctcagcagggcaggagctagcttcctttggtcgttggtgtctgtagatccttgttgtgctatgcttccattcgttcctggatcagatatgttgttgtgtaaccgagaaaattggcgttgctgtggacaatagaaacagacccataaacttatgcggaaatctaccccccaaaaaagaaaaaaaaatcctctgtgatctgttgaattagaacaaaaaaaaaaatcttggcaatggtacagcttgtattgctttagc

SEQ ID NO: 18686 - DNA, 3390 bp, Zea mays
  misc_feature (1543)..(1543): n is a, c, g, or t
agctgttaattatttcgtggcccttctcctctctctctctctctctgttcaccatcaagctagtcgactcgaggttatttctttaggttcagtgccgtacgtccgtgctcaggggatgcgagtgcttccttgtattactaattacactacaatgtgagaataaattgaaataaaatactcaaactgtaggagtcctctaagttttgcatatgctatcaggaatcaggttgggcagatttcgtcgcacaaaaaaaaacaagatgatcctctgctgtgggcctgtggcctgtggcctgtctgtctctatccatgcaattggccggcccagtcgaaattaggggggccacgggagaaactgctgtcatgcgaatgcgatgcgagtgcctggcacgtgagcgaggagcgccttaggcctagccatagagtcatacagccacgtatacactgttgtcccacgttgcgacctgtaccgctggtggggccgacaatccaaggaactcatatcagacatttcccatagtgccctttgtttcataaggtggttaagatccaaccatattgaaaatctaaacatttctagtttgcattacaactagtctttctacacaaccataaatatcaatgagcaccctaaaggcataaatatcaacgagctcataagatattgtaaaaagcacgttgaaatgaagctagtgcgatcaaaagagacaactatagatattgttcttttatataaatacaagtatgagcgaagttacggcagcatacgcgcaagagtttgcaaaagagaccgacccttattggttccacgagtcgcatatatgtcaatatttttactttttgcatgtaacgtaaaccaacatatccacatacttgtaaagcttcgactaccaaatttatatgaaagtaacgtttatagaaaattctccgacaacttacatagaagatatgttgattcacatgatcattcccatagtgccctttgttttataaggtgattaagatccaaccatattgaaaatctaaacatttctagtttgcattacaactagtctttctacacaaccataaatatcaatgagcaccctaaaggcctaaatatcaatgagctcataagatatttgtaaaaagcatgttgaacttaagctagtgagatcaaaagagaaaattatagatattgttttttatataaatacaagtatgagcgaagttacggcagcatacgcacaagagtttgcaaacatttcccatagtgccctttgttttataaggtggttaagatccaaccatatattgaaaatctaaacatttctggtttgcattacagctagtctttctacacaaccataaatatcaatgagcaccctaaaggcctaaatatcaatgagctcataagatatttgtaaaaaacatgttgaacttaagctagtgagatcaaaagagaaattatagatattgtttttatatgaatacaagtacgagcgaagatacggcagcatacgcacaacggcataagagtttgcaaaagagaccgacccttatnggttctacgagtcgcatatatgtcaatatttttactttttgcatgtaacgtaaaccgacatatccacgtacttgtaacgcttcgactaccaaatttacatgaaagtaacgtttatagaaaattctccgacaacttacatagaagatttgttgattcacatgatcattcagtaacaaaacatatatatatatataaatctttaaacagtaaaactcattgtgtgaattatgcatgccctatatagaacagagatggcttgtgtaaccctagaactaaaaaccggtcacatgtaccaacccggtcggcagggcactatggtaaaagcaaagggaaaaaaaacgtccccaaaacagcacacagctctttggctccggccccgcccagggggaatctccgtggtctggtctgagacaacctcaggcttcccacccacggtttcccacactcgccgtcccccgcttcccaccacccatttcatccccccagcaaatccaaccccacccctctcactctcgtctcctgttcgccagagccacctcgctccagaagctttcctcccctagatctccctcccgtgcctggtcgcgctgccgacccggccatggcgaccaaggggaagctcggggagctagtgtgggagcaccgggtgcaggcggccgcagcggtggctttcgtggccgcggccgccgtctcgatctccgccgtcgggcccaggctcggcgccgtggtgtcattcttctggccgctgctcgtctccacgggcctcttcctggtggcggtcgccgtgctgctccggatctcgccgccgcccgcgggcgacgacgacgagtccggcaaggagctcatcgacttcgtcgccgggtgccgcccggagcacctcgtcccggatgcggcgccgccggcggccgtagcccccgtggaggctccgcccgagctgcagatctaacgggctgccggaggaggaggctgacagcagcgtagctgtgctgctctgtgcgtggcatggcgtgctccgtccccgggtgaacttcctccagtggcacgggtgggggcaaccgttgcgggcccacctgtaagtgtcaggccggcgcgccgccgtggctcggtagcctaggacttctccatgtcttgctctgctccggtgtaagataccgtggattttaataatgaatcatggcataaaataaaaaaaaatcctcgccggagcgatctgtgtcgaacgctgtcgttgtcaggttggctgtggcttgtgacgctaatctcaagtaaagtgggggtttatactgacatgacatggcgccgacgaacagatgatgagaggtcgtaaggcttgacgatccaaggttttgcaatttgcgttgctgctccacgacgacgcgcagctggagatcaatcccacagttgcaatcctcagaatcattcatgagacattacagatcttcagagctcagcagtcagcatcactgatgacaatccaatttttttcctctatacgcagccgcactctctccctaggcggccagaacggctggtgagtggtgaccgaccaccgtggcgacgcctcccgtgaccgtggccctgtcgctgtctgttcttgaaggcccccaccagtcatactaaactcgggcctggcgagtcgctgtcgccgcactaaatttttatctgcttcgaactttgaaggaacggcgctttccattccagctgctgtcatcctcatcaatctgtgtatgtcataataataatatgaaagtcagtcatggcttcatggctactcctagtgacccgtgtgaccgtttttttattgaggacatatctggtgcacatggtgcacatattaaatcatcacc

SEQ ID NO: 18687 - DNA, 1311 bp, Zea mays
atgataaaaaagaaccgtgcccgataaataagcagtgcgttccctgtgggcggccgccgacacctcccaataaaaacgttcctccccgtcccactcgccggagcctggccgacgggatgcctcgagattcgcgcccagccgggatgcgcctcttcggcgtcaccatcgcgccggcgccggaggcggatccaccggtacgggatccgagccccaacccgcccgtggcggccagggaggacgtgatgcgtaagtgcaagagcatgggcaacctcgccgcccttggcgctgtcgcggacggtggaggaggtggtgcggacggcggaggcgccggcgacggctacctctccgatggcgggctgatgcagtcgtccgggaagcggcggagggcgcaggagaggaagaaagctgttccttggactgaagaagagcataggacatttcttgctggtcttgaaaagctagggaagggagactggaggggcatagcaaaaaattttgttaccaccagaacaccaactcaagttgcaagtcatgctcagaaatattttcttaggcaaactaatccaaacaagaagaagcgcagatctagtctttttgacatgatgccaagagagctgtcaccagcaccaaattgccccatattaccaccatcgatggcaaaagtacacgatgtggtagctatgacgaaacaacttcagaatagcaacttggaaggaacctcctcttcaaatgcagcatctcaagttggaagagatctccccccagttccatcttttaaggcaacaaatatggatccaagtttcagcaaatttagccacatggagcgcgtctggagaactccctacccattcggaccagttcccagagcccctgaagggacgccttcaccaactcctgctgctgctgccgccgccgctgccaatgcagctgttccggtctctcaagctaacctgacgactgcctgtactagtaacacattcttgagccagccaaagccaagtgatactccgtcactgcctccgaagggaggtcctccatcagaggaggacggtttggaactgactgttgccccaccctcccaacagaacatgacgaacatgtcttcccagaatgcggtaggcgtgatccaagtcatctaagctaatatattttattttattttatttctctctctctctttctctctagaagttactgtggctgttgacagttattgaccgaataaatattaacattgtattagcaatactacatgaataagaagagcatgaggtataagcccatcatttgcctataaaaaaaaaaaaaaaa

SEQ ID NO: 18688 - DNA, 2184 bp, Zea mays
  misc_feature (724)..(724): n is a, c, g, or t
ttgctatcaagacatattctaaagatcccgacaaaagaaggaaaactcgaggagggcttactggcgctagtcacgtccccgaggctcatgtcgtatacccgtttggatgtagatattgatgcataaaattaagaattgaaataagtttttctgaattttgttgtttgattgcacatggaattgagatttaaaatcagagagtcaattatgtggattagactatagctagaaactcactctttaaattcagagtgtcacacctatgtatttcgtggaattagaccacctaattctaacattaaattaatgagcctttgtccttgttagttctaacagtgcgacgacaacatatttcgagccaaacttatgttggttcgatgaatagtttgtaggttttagtcaacacgagagataactaaactcacatctttaatagacgacaaatatttcattctcagcgtaagagcttctccaagagtttttaacatccattcttaatttttaggttaaaaaatactctctaacaactaattaccttaatctctaaatctatttgcacttgcaaaatggactcaaccacatacaaaatctcaacttttttcatagaaacctttagagatgttataaggctaatagaaaatttgaaaaccactgattccataataatgccaatgttgatcaaccttgcaagagtcatgttaaccatgcaaatatgttgttcaantatgtaccaacgggatttcttaaaaaacatatcctatttcatggtcgatattgagatatattgtgtacacataagaaaaaaacaggattttgctaagaaagtccctattgctcatttgaaggtaaatactaagcaacctctcatgagttcctataacatggtagagtaatacgtgagaagttttattgcgaaatttcagaaaaaaagacatgataaaaaagaaccgtgcccgataaataataagcgctgtctctgttcggggcctccgacagaacctcccaataaaaacgttcctccccgtcccactcgccggagcctggccgacgggatgcctcgagattcgcgcccagccgggatgcgcctcttcggcgtcaccatcgcgccggcgccggaggcggatccaccggtacgggatccgagccccaacccgcccgtggcggccagggaggacgtgatgcgtaagtgcaagagcatgggcaacctcgccgcccttggcgctgtcgcggacggtggaggaggtggtgcggacggcggaggcgccggcgacggctacctctccgatggcgggctgatgcagtcgtccgggaagcggcggagggcgcaggagaggaagaaaggtgccgtcttttgctcctcgttttgcgttcgaaatctttgtttttgatgcagaaatgcgtagaaatatgcaaagatctggtgaccaatagtcccattacggttctaggaatgttaagtttggtacttctgtctttggatgtcgaaaggtgccatttctggattgtttatacggaaatgctcttcctacatatgtctgcatgcttcttagggttgacgaagaggaaccgttttgctgtatctatatgattgcctgctggtttatttgttgaacgcacaaagtttgtttctttgctacaaattataccttagcttgtatgtgcatccatttgttgttttgtcgtattgattcatttaatgtgtaagcatccttgtttcttgttagattgtgactgtatcttgtatgttcataatagactttgaattgtcagtacacagtggtggatgattgggagatatagaacttggatttcatacatctaaatatctaatgatatcgtgtgatgttgactagtccagtacataaatgatttatgaacttgaccttgtgtctgtcaagacaggagctcagtaagagttaagacagtcaccaggcttgatgtatgtcatgttgtgtggccatgttgaaccctgccacttgtatatacttttgtgttgcatcacaacaggcataataaaggaaaagttttaatgcttttgttctagtgatttgtgcgattggacattggattgtttctagtcatcttgtgcccagaaatgacgggctctttgtcttctaccagggaagtggtgaatgtgatgctgaattctgctatttttcagtgcttgctcatatactgtcaacc

SEQ ID NO: 18689 - DNA, 1963 bp, Zea mays
attttaattttcccaaggtaaaataaactaattttactttacaaaattggaatccatcggaaaacagtgttcccaaactagccctaatagagagaaaaatgaggtagctcacctttgtgtaagtaaggccgtagagttggcttctattttattttggttagattgcttccctaattggcttttggaatcagctagcagagattgcaatttcacattggactagtaataaagaacttgtgtgttgtttggttcacatatttgtaatgtaatcggtaacaaataacgttaaatcatgtttctttaaattcaatcgtaatcggataccacactagaaattgataccagcctattcaaacttgttaccaccggtaatcgaatgtaaactgttaccattaccattttcgttacattttagaaaccaaacaacacccggtgttctgcctaaaaaaactcgcaccgctccctccgtcggcatccctccatacccaccaaaagccccaagccaaatccgccatggctatgctcgcccgcgcgcgcctcccacctcgcacccaccttccccccatcaccaccgatggcggtggcgccggcgtggaatttcgccgtaagatccacttcctctcttctgagctgcacgtcgacccgttcccgctcctcgccatcaaccccatgctccgctcggcgccgctgccgctcctccgcgattccctccgcctcctcacctcccacggcctcacaaccctcgacgctgcgcgcgtcttctccgccttcccctccctcctcacctccccgcccgaggagcccctccgcttcctctccgccgatgcgccgctcccgccaccgctcctccgctccgcggtggtccggtccccacgcctcctggccgcatccgttcccgacacgctccgccccgcgctgctcttcttccgccgccgcgtatcgctccgtcgggagccgctccctctcgccgccgcgctgctccttgctttcaacgttgagcgcaccctcctccccaaactcctattcctccgtgacgccacggggctccccgactctgccgtctgtgcggttctcaggcgtgcgcccgccatcctctcctacgggatcgagaccaacctcaggcctaagctagagttcctcgcggagcgcatgcagagggaccctgccgcggagctagccgagttcccgcactactttgcattcagtttggaggggaggatcaagccgaggcacgaggcgttgagggaaaggggcatcgagatgccacttaaggatatgctaacaagcaacgatgacgatttcagggagcggctggtcaatgtgacgctgtcagacactaaggcaaggctgtgagctggcattcagatgcaccctatgcctttttactgcattgcgtatgaaatatcagtcctttgagtttgggttctgtgaagcaagattatccaacaatgtcaccaaatggaaccggcgacaatttagaatgtatttatggttcgcatgtcaattcgaagctcagcctttgtaatgttgagatacatggagttcacctggagaagcctgattgaatctctgaatggatattcacttgacatataagcagcgaaggtaggttaaagttgatgtacagctaatggtcccattgaactctaagttatgtttcctacaacgtggagtaagaatgggcctgaggcttagttgttcgagaacgaaggacaattatgagcagctgtggatctccctaaacataggtgcttagtaatcagccaaaggagtttagtagtagcattctgcttcttattttctttcttttaatttttatttatggacatgaatttaagaatgaatacacaaatttgtttttcctcctttttttggaagaaaagtggcaggatctgtgtgtgccttctattatgtagaaaaaaggagcttaagttacaggtcctattttcaggcctcaaaggtt

SEQ ID NO: 18690 - DNA, 4909 bp, Zea mays
  misc_feature (1223)..(1223): n is a, c, g, or t
gggtgctagttcagcaatggagttcccttctaaccacccgtccttccaaaataaaaaaaaaattccaccattaccaatgatggaaatcatagccatgttgaagagagctttgacatttcatgggacctccacttgaaaaccatcccaaggacgtgatcgatccactttttgagtccatagccaccttattttcggtgcccaacctaatttttccagatttaaaatccctaatttttctaccatacttatatctcgattatctaggctaccttcagccttgtttgtggctttgtttttcaggtgctagcaaagaaggcttgcctccgcgggagagaatcgtgtggagtagcttatggtcgacttcgccatgctactcggatcattgctagttactgtttattttatttcctctgttagtaaattctgaactaacattatgttcaagactctgtttcataataataaaaaatacttataaagcatgtaattgtaactatggatgattatattctcttcttatgttcgaatgaaatgtggctatcgatccagtatacgtggttaaatcaggctcgatccgatggattaatagtttaatccaatttaaatgtacggattcggttctaccacacaccatcgcttgtcgttacatgggtgtcggtcgggcatcatctacttccagcacatgggagccagcttcatagtctctgtcctcggtgtcatggcgccgcgtggccttgagcgcgacctcatagatagttccagcatcgtcgtgcccatcagcgtgtgttctggctagtgctgcagtacgcgctccacggcatgcgacagtgaccatatgagagatgtgggagggcgagggatcctgccccgcgtcgaaggcttgagaaggaaaagactcgaccaggtatgtatgggtccgttaaaatgtaaaagagacccaagcatttaagagatatattttaaaagtttttagagcggattgatatatcaagacaagtttaagtttaaggattgaaagtgtattttacttaatttcaaccggtagattgaacttatgtatttaacaatcataaggtcttcgatataacatttaatacattatatattggggagagaaaaatctggtttgctaagggcatgtttagatcccataagccaaaataaagttactaaagtttagtcaatttagaagctaaagatttaaatagcaaagagtatatttntattattggtaacctgatagttccgcaaaagaagagtattcaaatactacctctatttttttttacacttgacgctagctagtgcaattttacactaaccaacgtcaactataaaaaaactgagggagtacgatgaagcaatgcagcgaattagcattatgaaaagatgccaaaagacccaatcatatatacaataatacaagcttagcaaggcactacatggattaaatcaaacaccaagcatgatatgaggttccaggtacctttccgttaggactttttactttttccaccgcccgatctctatcaatggaaagtccatatttttcccaactattataaagcttgtaacagaaccacatagatgatagaacaattaagtttcctgttagacaagcttctactaacctaaacaatcaagaattagtggtttaaatgtactcgactaaaacatgcaaggatttgtactgacaaggagaaaaagagcacaccatcctacgataccatgttagcattaggttatctccagcaactttcatatcctacagtctatctaactctttatttcaaactacacgcagtgtaaaacagagctttgcgtgcccatatgcacgtcttcggtggagatagcctaggcatcacaagttcacaacgcatcagcacgaaaaaaagatgcaactatctgttagggcgtgtacaccactattaaaaaaacgtcgtgtcttagactagtgacaggggctttataatttttttttggagaaccgtctctttgctaaggaacgtttctggcgctcggctcgaagacaaatacacgaaaccgtgcctgcattgtacgatgaatgtcgtttcttcccgatccactgtggtacgcgaactctcttctccgcatctgttgcatcttctactctcgtgcctaaatccattctaccgctaccgcaacccaccagatcgccatggccagtcatcgttgccccgtcctctggctattgtcgcccctagctccgtcgtcaacgtcgacccgcccatcaacaacaaccccgtttggctccagagttccctcccccgtcggcaaccaggtgggcttcaccggtgcccagggtcctctgctgctctttcatgcccccatcacgtacatcaccttctttctctgatttgcttcaaaggtaatacaagttgtttagagactgtacaacagtttattgattaatttctaaaggatgatcaaccctaaacccagtttgaatgaatgtatatttaggtttaggtttacatttcagtttattgattattttagagtaacaatttcaatttacccagtttaggtttatatttagtttcagcaccagattacatttagtaaaccgccctagattacattcagtttcagcccagattacaatttcaatttacttaattcaggtttgcatacagtttcagtaccagattaaattcagttttagccctagattgccatttcaatctacctattttagttgaaggtggcacaagataaataagtggataaacatgttcaatgactgttcgttgaagcctagaaggttgttcactagcaggtatttggatcaaatgtggatagaaaaagcacacaagttctatgaggatgaaaacaaagggcctcattttgtgctaatggatgttttgaatatgcttgtgcgaaattgatggttcaaccatgtttctctgatgattcagttatgttttcagtatgtgacatatgtagtatgttctgtgatgattcagtcacgtttctgtgaatttagcataaaactgtgtatctcagaaaatgagacgggaatgcagtctgaaacatgtgtgttacaacctgaaactgaaaatgtgaatgcatggactaaggtgctgtttggttcacatatttgtaatgtaatcggtaacaaataacgttaaatcatgtttgtttaagtccaatcgtaatcggataccacactagaaattgataccagcctattcaaacttgttaccactgataatcgaatgcaaaccgttaccattaccatttacgttacattttggaaaccaaacggcacctaagtgtatatgcacactagtttttttttttttttttacacgtaaatacaatgcatttattaaagcatttaatctaagatacaacccactgtatgaaactgtcttaggtgtgtcttgcgcttggagaaccgtgaagtgggttctaggttgtacatgcccttacacttttatgggaaaaggatgcaactagctgttacactttcatgggccgtgtgacatggcatcaaagttgtatccagaaactaaaaagaggaataaatctaagggttttgatcaattagaggagggcatagtcttatcctattgtctgccagtaagccatggttctccctgcctgcttgccagcttcctcatcttcatggcagcagccttaagtgtgtcgtcgcccttgcagaacgcaaacctgacatatcggtggcagtagctttcaccgtcacaagtcttgtggaagaacccacggccaggcacggcaaccacaccagcatcgttgatcaactttgtcacaaattctacatctgaaagttggcaggaccttggcagctcagcaaacacaaatactgaaccttgtggcttgacgctgattttgaagcccaagtctttcagcaacagaaggatgaagtctcttttcacctcatagtcttttctcagggatatgtagtaatctgctgtgcttgttaatgcaatcaatgcagcttcttggaatggtgcaggagctgaatctgttaattttatgtggatatttctaatagctgaggcgatgcttgctgctgcacaagcccaaccgagtctccaaccagtcacactgtaagtttttgacagtgaggatgtgatgatggtcctctcttgcatccctggaagagaagccagtgagatatgcttgttcgcatcgtaagtaatatactcataaacctcatcagttatcacaaagcagtccattttctgacaagcttgggagataataagcagctcctctttgctgaagaccttccctgttggattgtgtgggctgttcaagaccaacgccttggtccgacttgtaaaagatttcagaaatttttcttcgttcagagtccaagaaggtggatccaatggcacatacacagggacgcctcgagctagctcaatgcttgtctcatacgtttcataagcagggtcgaagatgagaacttcgtctccttggtcgattattgcaaagatggccgcggcgaatgcttcggattggccgcagcagatgacaaagtccgtgagcgggtccacgtcgaggtcatggtcacgtttcatcgtgttggcgaggatgtcgcagatcccctgcacatgcctgtactggttgaggtccgcggcaatggcggcgacggcggcggccttgacgtgggggggtgcggggaagtcggggaagccctcggcgaggttgacggcgccgacgcgctgcgccaggtgggacagccgttggatggccgacggcgcggaccgcctggacgtcgccgacagcctccgctccatggcgcccgcgccgtccggataaggtgtggtcaggtagctgcgtgcaggagtgcagcgtgctattgctgtgacgcgcgcgattcggagcagagggggttttctgctttcccggccgg

SEQ ID NO: 18691 - DNA, 820 bp, Zea mays
gatgaatgtcgtttcttcccgatccactgtgatcgccatggccagtcatcgttgccccgtcctctggctattgtcgcccctagctccgtcgtcaacgtcgacccgcccatcaacaacaaccccgtttggctccagagttccctcccccgtcggcaaccaggaccttggcagctcagcaaacacaaatactgaaccttgtggcttgacgctgattttgaagcccatgtctttcagcaactgaaggatgaagtctcttttcacctcatagtcctagccaaagtcatcacaattgcaagcttcttggaatggtgcaggagctgaatctgttaattttatgtggatatttctaatagctgaggcgatgcttggctgctgcacaagcccaaccgagtctccaacctaaccagtccagacagttagtttgtcaagtgtcatctcacaagtcttgctatttctatagctggttgtgtcactacaaactgtgcagcaaattttgagttgtgctcaccagtcacactgtaagtttttgacagtgaggatgtgatgatggtcctctcttgcatccctggaagagaagccagtgagatatgcttgttcgcatcgtaagtaatatactcataaacctggaaggtatttacacacattgagacaagatgtagacagatttttatgaaaatttgcttgggaaatatgtacaaaaaaaaagctcatgaaatttcactgtgtgggtaatggggataagaacaatccttattgctcatcacagatgtacctcatcagttatcacaaagcagtccattttctgacaagcttgggagat

SEQ ID NO: 18692 - DNA, 2892 bp, Zea mays
  misc_feature (1924)..(1924): n is a, c, g, or t
  misc_feature (1952)..(1952): n is a, c, g, or t
tcgatttactttcgatgttcttgtttccaaacaagctctaaaaaatatattaaacctaattattaggtaattcacataacttttgttaatcattgattaattaggtttaaaaaatttatctcatcatttagtctttagttatataattggttttgtaattagattaaacatcctgtacgaaacatgctaaattttataggccagtgtctattcgtctttgcctcgtctccagctaaggttcctgatcgtttcttctcgcgcctccgtgtccgatgagttgtctcgcccccaccgccacgcctttcgccgcgacatctacgcgtcgttcgcccccttccttcctcccaaagtcttctcgtcttatcggcttgccggatccgctgccaccaccatctccgcacccacatctgtgccccaggtgtggttcggtttgagaaacggtaccagcctgccgacggccaacgggcagaagtctccgcgtccctgagcgccacagcaaccgtcgccttcaccacttggttctttccgtactttgggccctgcgcgcccagaggggggcccggacttcccctcgctcgactcgatccgcagcaagctaagcgcaaccgaccagctacgcaaccatggctttcgcttcctcgaatgccaagcagagcctctacccggatgtggaccagtcccaccctgatctcaatacccctttcttctccgcacccaccacctccacctgcgccggcgccggcgccgccacgggcaactccctctaccccaccgtcgaccccaacgagctcgcacagaacctcttccccgagacggtcgaagaggacgcggcaccgccaccgcccaccacagaggagaccatcatcgctgtccctggggcgcagctccacctcatcgaccccgaccgcagcgtcgatctcggcgctggcacgctctccatcgtgcgcctccgccagggggaccactccgtcgccgtcctcgcgcgcctgatccacgagaagccccaccaccgccgcggcctcttccgcttgttcagcagcgggcggtctgacgctggcgccgagcaggagcccgtccagtggccgctggcccgcgatgtcgcggcggtcaagctcgaccccgcgcactacttcttctcgctccatgtcccacacacggaccacccggacgacaaggatgacgcggacggtgccgaagcggacgcggaggcggcgctgagctacggcctcacggtcgttgggaaggggcaggaggaagtattggcggagctggacagggtcctcgaggagtacaccaccttctcggtgaagcaggtggagacggcggcgaaggagaagtcagaggtcatggacgcgagggcagtggccgagatcacgccggaagaagctgtcggggataagaaggaggttgttgaggagaagtccgcggcgttctggacgacaatagcgccgaacgtggacgattacagctcgtcggtggcgcggctgatcgcccggggatcggggcagctagtgaggggcatcatctggtgcggtgacatcacggcggggggcctgcggcgtggggaagaagtgatgaagaagagcgtgggtcccagcgcggagccgacccaggtgaagcccagcactctcagaaggatgaagaggtaggatggtggacatgttactactactcgcatttattatggctattgtaactgttaatttcgttttaagtcggttgctccaaaaattagaaaatttgcagatggataggaaatctatttaccgcgaattagattattatcttgttaatttagtgcgatcgttcctttcggattgcagtattttagacactaatcatagataggagttaaatcaccgtgctgttaatattgtatgtcatggtaactcgtagagtcagacaacttactggtagctcttanttagtaaatgtttcttaattggaactcnctttgcatttcatgttttgatagattttaatttatcagagcaggggatcttttgcttgagcagccatgtttttctttctgaatgcaaagcagatgtcccattcatgtatgatcatgtcaactattccttcagagtgttgccatccatctttattagttgattggtgcgaaatgatcctgaacttatccattgcctgctttagagtcaccatgtagtatatatatatatatatatatatatatatatatatatatatatatatatatatataaagcacctaggatctcttgataatgactaccactgatattttcctgcctgatgtagtgattttaccttatgatggtaatgacaagtgttagcgaagatttgtgactgaggtgcaaaacatgatttgtttgagcatctatctagtgttctagattactcagttctaaactgccaatcagtttagtcaagtagcctacttgttatcaaccatgcgtatcagtgtctgaagtagaacttttacaccaccgactgttattcatgtccctttcggttggttggcgtccattgctattaaattaatgtatgatgaccaatttgtgtccctcttcctgctgcttatggttttctgtctatttttttagggctaggagggttacaaagatgtccaacagggtggcaaactcaatcctgtctggtgttctgaaagtcactggctttgtcacaagcaccgtgttgaactccaaaccagcacaaaagtttttcaagttaatgcctggcgaagttattcttgcttcacttgatggatttggtatgtctgatttacatttctttaagatttgcttgagaaatataggttcattcaggctagtttatatgtttttggggtgattgaatctaaaatgataggtttgtaaaaccagaagatataattgaaatcataatatggctt

SEQ ID NO: 18693 - DNA, 1568 bp, Zea mays
gggtacccggccccccctcgtgttttttttttccttttttgaaacgaatgagatttacatttctttcctttactgatctggataggggctccttgtcatgacagcactatgaacaatgaccaaaatgctcgaagagaagcagctggcaggctacggctatagaaaaaatagccaatttactaaataactaatgaactacctgcttcattttccttggtagctaaaagaaacaggaagacaggtcagaaaaattggaccgtgatgagcagtaaacatatcgcatgacataaaccgatatgcaacaccaacattgaacagctctttgcagaaccatccgggttaactcaaagctcgctcagtacgaacggtgctccaaaatggcgccaagactgctgtggatgcccacatgaagtcacagttacagtatttgccaagctcctttcgctggacagccccctcccactggtccgagaaatgaactgctgcggtgtgtaagcctctatgtttaagagaaagatggctacaggatttaggttaccaaaatatggtccaccttcaacatgagcccgctgttttatcctaggagttcaacggtcttcttagtccactttccacatcattagccagaagagatctacaagcaaaagatttaagtcgtggtgactggcccgcggatgttgaaccactgtcattactaccactttgtttatcaccctgatgattgcatgcattgtttcgaacatcctcgaacagtgacgagtagtaagaaggatcatagattgaaccccctaatatatcatctgccatggaattccgtctaactgaatcagatctagggctcaagaaactagttcttgcttcatggttggtttcaaaatatgttggcgtggtgaaagaaggccctaatctatacatctgaatccataagaacgaagacaaaaacctgactgaaaacccaatgatttgcatccacaatgcaagtctgagtgagaaaacaaacagttgaccatacttatcatcaggattaatagtccagatagcatgtgagaagagtataaaccaagcaaccccagggccgacagcaaagaagagaaggacagcatatgtccgaccaagtctctggctactgctctcaattgcaacaacagcaaatagaccaatcaccaggttgatcacaagaaccccattgaacaatgccccaagtgatccgatcagtgcacaaccaatctggaggtagatgagtacgagggcgagggactggagcgcgtcgtagtcgcggaggaaggagcgcagccgtgggccgactccgagcagcgacggcgggcagcagggcatcccgaccccaggcgagcccgggcgggcgggggtgccggagcctggcggcctctaaacggtgcgctcggggcagggcggcgagaaggaatacgagaggggggttcgccgcagattcgcgtcgtgagggcggggtggaggcggtggtggagaatctgccctccggcctccggcggatggttttcctgttattactaatcgagggagttgagtgtgacggccgaacctcgagggtc

SEQ ID NO: 18694 - DNA, 3231 bp, Zea mays
atagactaatttgacttgtataacttgtgggtccagaacaatttcgtgtgaaaaccctgccgcttttctaacaaaactcatgcatccaatagggatcacagctctttctagaacagaatgaaacttacatttgtttcctttcactgatctagagatctgttccttgtcaacacaaatgctatgaacaatgaccaaaatgctagaagagaagcaactgccagcctacagctagaaaataactaagtgactaaagaactaacgaactacttgcttcattttccttggtagttaaaagaaacaggaagagaggtctgaaaaatgggacatgatgggcagtaaacatatcgcatggcataggtcgatatgcaacaccaacattggacagctatttgcagaaacatccggctcaagctcgctgagtacgaacggtgctccaaaatggcaccgatgctgctgtggatgctcggcaacacaggcagtcgccgttacagtatttgccaagctcctttcgttggacacccccttcccgctggtctgagaaataaactgctgcggtgtgcaaacctctatgcttcaaagagaacggtggctacaggatttaggttcccaagatgagcccgttgttttatccctaggagttcaacggtctttttagtccaccttccacatcattagcaaaagatttaagtcgtggtgtctggcctgcagatgttgaaccactgtcattactaccactttgtttatcaccctgatgattgcatgcattgtttcggacatcctcgaacagtgacgagtagtaagaaggatcatagatcgaacctcccaatatatcatctgccgtaggactccgtctaactgaatcagatctagggcttaagaaactaattcttgcttcatggttggtttcaaaatatgttggcgtgctggaagaagcccctaatctatacatttgaatccataagaatgaagacaaaaacctaactgaaaacccaattatttgcatccacaatgctagtctgagtgagaaaacaaaaagttcaccatacttctcatcaggattaatagtccagtataattagaagacaaagttaggaaacagattataacactacaagaatgttgccgtgcctaacaaaaattatataagaaaaattctctacacttgtccaatagaacacatgcactttccagtcagtcatgtcacaacaagtaatgcttttcacactgatacatgatgccaaactaacctctactgtaacaactttattaaaccttgcaaaattagaatgttaccaaaataaaatttgacgacaaatctatacatataattttgcaagtataatttaaatgttcctaaacatatgaaagcaatggtttagaatatatgatcacacatgctaaagcttcacttgatggagtaccgaacaacttgtgcttcaaagttctaagtttcaatgatcatagtaatgactctagtgatatattagaactcagaacctatataggtagtcattgcatgacaagtcattgacagatcaactgttatacaacattgaaaacaattagttatgtcatggtgaaagatgaataaagaaacccagtcaaaaaatcagtcaattaagcattcgaatatagagaatacaacattcctttctaggtgccaaacttcacattgtaccaaatgaaaacatcagggtaactaaactgatagatggtggctaccgaagacataccagatagcatgggagaagagtataaaccaagcaacgtcaaggacgacagcaaagaagagaaggacagcatatgtccggccaagtctctggctgctgctctcgattgcaacaacagcaaatagaccaatcactaggttgatcacaagaaccccattgaacaatgccccaagtgacccaatcagcgcacaaccaatctaaaacaaaaattgatgaagtaattatgagcatgaatatcacgacttcattaaattcaacttctgccgaatgaaggcccatttcaaggatataagaattaaagtcgcataatgatcaagagaaccaaacaaaaagcaagtactcagccgagctaactatgtaaaatgctaataatagccaagcgtcatcacattgtaaaccgaccagtttccgttcactgtttcaccaacttggtagctaattcaacataatcacgtctaagggattcacttaggtgatgtttggttcacaaatttgtaatgtaataggtatcaaataaagttaaatcatgtttgtttaagtccaaccgtaatcggataccacactagaattgataccagcctattcaaatttgttaccgctagtaatcgaatgcaaaccattaccgttaccatttacgttacattttaggaaccaaacggcaccttagttgcatctaacaaaagctgacgcatgattgtctccaacaatgtaagaaacacaaagacaacaacagaaactgaccaaattcagagaacataaaccacagtattaaagctgcaaggcgcagttatctctaaacgtaactgaaccttgaaacttcatccagaagcctactagttcaaaacccaagcatcaagcaacctcacgcctaaaatataaaataagcggaaccctatctgaattgcattcgaccaaactacaattccccgtcgcgttcaactactagaattactgacaaaactgaggcagctaaaatatcgcccactacggtaggaaacactagaggacgctcaaacccgataccgtcaccaggtttcacatcacaggcgctaacagcaagagcagcagcgagtacaagagcagaagttggccgatctcgcggggagcggcaagccgccggtgggccaggccgatccggccttctgaggcgacatacgaggggaatgcgcacctggaggtagatgagtgcgagggcgagggactggagggcgtcgtagtcgcggagaaaggagcgcacccgcggcccgactccgagcagcgacggcgagcagcagggcatcccgacccccggcgagcccgggcgggcgggggcgccggagcctggcggtctctggacgacgcgatcggggcggggaggagagaaggaatccgagaggggggttcgccgcggattcgcgtagtgagggtggagtggaggcgatggtggagaatctgccctccggcctccggcggatggtttttttctctgttattacaatcgagggagtttgagagtctgaac

SEQ ID NO: 18695 - DNA, 1163 bp, Zea mays
ggcgtattaaacggtaaataagatcggggccggccggcagttgctgctactcggcacaccaaaccactccagtggagtccaacaccgcctcttctcctcttctcgattcgaaatcgagtacgtccgaatgctctagaaccttccgggcctagggatctcgatggggcccgagcaggaggaggccgtgctggagaccatctgggacctccacgacaaggtcagcgacgcgatccacgccctctcccgcgcccacttcctgcgcgccgttcgccgccgctcctcggcctccgcccccggcctcgtggacgtcaagggcgggggtctgggtctcggcgcgcgcggcggagacgaggtcgtcgccctggcggccctggctgaggaggccaggagcctgcacgccatccgcgccgcgctggaggacctcgaggaccagttcgagtgttttctcgccgtgcagacacagcaacaggccgaacgagatttcgcgatggcgaggctggagcaaagccgcatcatgctcgcgataaggctcaaagagcatcacgggagaaaccacaaggtcatagacgaggcgtctgccttcgtccgcgatgtctaccaggacgtctggccttccctgtcagctaccaaggccgagagacgcgccgacagttcaggtaacccggcgaagggtccgagcttcctcgcgcggatggtgtcctctagccttgctgtagctgggagcggtttcagtctcaaaagtctggctttagctctcggcctagtcgcggtgctgcagtcttcaggggtcggtgaccgcaggtacaggaggaccaccagcgagaggagctcgtcgtggctgggatcatcatctccgagaggcggtagaacgggtcgtcttgacgtgtctctagccaggggttgaaaggggggctgcggtttgtggccttgcactgtatgcccctgtggcaagggccaagctcaggcccgctgcggtgttttttttgttgctttctcgggccagcagcaccaggcttcatcgctgaggctgctctctgcccatcatgccgggcgcagccggtgggcatgtttgatttgtggctaaatgtgacacattttatctaaggttagtcttttgaatggaagaattaaacttaaaaaaaaaataaaaaaaaaaaaaaaaa

SEQ ID NO: 18696 - DNA, 960 bp, Zea mays
  misc_feature (916)..(916): n is a, c, g, or t
  misc_feature (932)..(933): n is a, c, g, or t
cgcgtcgttcgcccccttcccgccccccaaagtcttctcgtcttatcggcttgccggacccgctgccaccaccatctccgcacccacatctgtgccccaggtgtggttcggtttgagaaacggtaccagcctgccgacggccaacgggcagaagtctccgcgtccctgagcgccacagcaaccgtcgccttcaccacttggttctttccgtaataaaatcccacctctcccatttctgtttccccacttcccctcgctcgactcgatccgcagcaagctaagcgcaaccgaccagctacgcaaccatggctttcgcttcctcgaatgccaagcagagcctctacccggatgtggaccagtcccaccctgatctcaatacccctttcttctccgcacccaccacctccacctgcgccggcgccggcgccgccacgggcaactccctctaccccaccgtcgaccccaacgagctcgcacagaacctcttccccgagacggtcgaagaggacgcggcaccgccaccgcccaccacagaggagaccatcatcgctgtccctggggcgcagctccacctcatcgaccccgaccgcagcgtcgatctcggcgctggcacgctctccatcgtgcgcctccgccagggggaccactccgtcgccgtcctcgcgcgcctgatccacgagaagccccaccaccgccgcggcctcttccgcttgttcagcagcgggcggtctgacgctggcgccgagcaggagcccgtccagtggccgctggcccgcgatgtcgcggcggtcaagctcgaccccgcgcactacttcttctcgctccatgtcccacacacggaccacccggacgacaaggatgacgcggacggtgccgaagcggacgcggaggcggcgctgagctacggcctcacggntcgtgggaggggcagnnagaagtattggcggagctggacagggt

SEQ ID NO: 18697 - DNA, 3405 bp, Zea mays
tactatcgctgccgctatgtggcatgagtaaatattatacaaattactaattgttgaactgtaatcatgttacatttatgactaaatcttattgtaacaaaaaattgtcaatattataaagtattaaagaataaggttaagaaagcattgaaaatgagctattatcagcctcaggagcatccatattattttatagatcttattttatagaccagacaaagaatttatgaataaaaataattaggattgtcaaacatcttaggtgtcgtttggtttctgaaatgtaacgtaaatgataatgataacgatttacatttgaataccgacggtaacaaatttgaataaggcggtattaatttgtagtgtgatatcggttacggttggacttaaacaaacataatttaacgttatcgattactcattacattatcaatatgtaaatcaaaccgtaccttagattttctagacagcattcagaaaatttcgcttctcagctaagcgagtttcagaacagtggaaacaagcagcactttgcttgtacagctcgtcacgggtggggtggtggggtgactcctgggccctggcattcggcgcggtgcggtttctggcgctttccacgctctgttggctcctggtcggtagcgatggtgctacaatataaaaagtggtaggctgtgttcactgttcactgcttcccgtagtcctttgtcgcgagctgctgtgctgtgtcctgtgtgcccgcaccatcgcctgaggcctgagggtgcgtgctgcaggtatttattggacgcttcccggatcaaagcaatgtcgagtggcgacagtcggcggtgggcgcgcatgcagtgggtggcgacgcgaccgagtgcggtggtggtacggcgagcgagcgagcgacacgagctgagtgagtgccctgcaagcccaagctcgtgacagagataggacttcagctcgactcgcgcggtcgccttgcctgctgcacacgagccgtcgccaactcgatcctcaccggtgacccctaccgcagctcatatcatcctgttcttgctcttcatcttactgttaatttcctgccaatttaatcccaccggccatcgttctcctgaaccaaagccatggcgcaagctgcttccggctccagcaagatcgacaccaaagctcccacctcagccgacgaggccgctcaacccaagagctacggcgacctggtatccactctcccggctagaggcgggtgggtgtcgctcgtgcagtaccagaactactggctgaaccccggcaggctccagaacatcatccccgtgaaagagctctacaagcctcgcgccgacgacatcgtcctcgccacctacctgaaatgcgggaccacgtggctgaaggcgctggccttcgccatcacgacccgcggccgccaccaccaggccttcgccgccgccgaccaccccctgctcaccgtgcacccgcaggaggccgtgccgcacctggaggtgcacacgccagggcagggcctggcagacatcgagaggctgccgtcgccgaggctgctcgggacgcacctgcccctctccctgctcccgccggccgtggccacctccggctgccgcgtcgtgtacctgtgccggcagcccaaggacgtgttcgtctcgctctggcacttcgtgaagggcatgcgcgggggcaggtcccccgtggagctggacgccgcgctggccatgttctgcgagggggtctcgcctttcgggcccgtctgggagcactacctcgagtactggaaggagagcctggcgaggcctgagcgggtccttttcctcaggtacgaggagatggtggcggacccggtgcgtgccgtgaggacgctcgccggcttcttcgccgtcccgttcaccgacgaggaagaggggcgaggggtcccggaggagattgtgaggctgtgcagcttcgagatgctgagcggcttggaaagcaatcggaccggagatcttgattgcggagacaacacggtgatcggaaaatctaccttcttcaggaagggcaaggttggggactgggagaaccacttgacaaaagagatgggcaagaaggtcgacgccgttttcgaagacaagctccagggatctggtctcgtgttttgaattttgattactatccatgcatggcttttgtttgtgtgatgctgtttgtccagaataactaatcgtttgcgcatgttgcagtatttacgtaacgggatctttctatgctcaaaagacaaagatcaagggatctagccagccctatattttgattagccgtgtctttcgattgtgtgatgatgtttgtcaagaataatctttgtgtagtatttatgtaatgggatctttctactcgaaaaaattactctataactacgcttttatatatgttacttttaccataagaaatatggcgatccatggttatgataagttgttcgttttatattaaagtcagttatttaaattagctgtaatttatagagagaaaacggaggtcacattattacgagaaatcatcgtgaaatgatgtaacttgtgatcgtactctccggctctccctccctgccggaaaaaaattggttgctgcctggcggtaaaccagcctgtttgcagcccctcataaaaaagagaatatgtctcacctgcagactaataacacaactaaaacgttatttgatgaatctgtaggtagggtctatcctcctttttgtgaggggctgcaaacagagtggtttgcaaccgggctgcaacaaatttttttccccctgcctccagaggccggctctatagtgacgaggcataaaagaggctactcgtgattccccactctcaggatttaattaatgctccctccgttttaaattaaagtttgttttagttaattaatagatttatataatatttgatgtatttgttttatacatgagtctaggttcatctttatctatttgattatagataaaaacaagacctaaaattattactattttaaaatggatagattagttaattttagatgtatctctactatctattaagaatctaatgtggggctggggtgctaccacggctttaccctcacgtcaagcgtccacaaaaaatagtgcaaaaccagcacataaacccacacccctctactttagaaatttgaggctaaccactagatcacacataccttgatgtttacaaataaacaaaaaatatatttgtagcctaggcgccgctccccacgcttccccgtctcgtggcaacgcacgggcacatacctaatgtggacacctggtgctaccacggcttcactctccccacacccagcgtccacaaaaaatagtgtagaatgagcatttgaacccacaaccccgtactccagaaattaaagctaaccacc

SEQ ID NO: 18698 - DNA, 893 bp, Zea mays
  misc_feature (691)..(691): n is a, c, g, or t
  misc_feature (760)..(760): n is a, c, g, or t
  misc_feature (860)..(860): n is a, c, g, or t
  misc_feature (874)..(874): n is a, c, g, or t
  misc_feature (879)..(879): n is a, c, g, or t
  misc_feature (882)..(882): n is a, c, g, or t
  misc_feature (891)..(891): n is a, c, g, or t
ccggccgggaatgtcgagtggcgacagtcggcggtgggcgcgcatgcagtgggtggcgacgcgaccgagtgcggtggtggtacggcgagcgagcgagcgacacgagctgagtgagtgccctgcaagcccaagctcggtgacagagataggacttcagctcgactcgcgcggtcgccttgcctgctgcacacgagccttcgccaactcgatcctcaccgccatggcgcaagctgcttccggctccagcaagatcgacaccaaagctcccacctcagccgacgaggccgctcaacccaagagctacggcgacctggtatccactctcccggctagaggcgggtgggtatcgctcgtgcagtaccagaactactggctgaaccccggcaggctccagaacatcatccccgtgaaagagctctacaagcctcgcgccgacgacatcgtcctcgccacctacctgaaatgcgggaccacgtggctgaaggcgctggccttcgccatcacgacccgcggccgccaccaccaggccttcgccgccgccgaccaccccctgctcaccgtgcacccgcaggaggccgtgccgcacctggaggtgcacacgccagggcagggcctggcagacatcgagaggctgccgtcgccgaggctgctcgggacgcacctgcccctctccctgctcccgccggccgtngccacctccggctgccgcgtcgtgtacctgtgccggcagcccaaggacgtgttcgtctcgctctggcantcgtgaaaggcatgcgcgggggcaagtcccccgttgaactggaagccgcgctggccatgttctcgaaggggttcgcctttcgggccgtcttggagactanctcgaatactgaangaganctngcgaagctnaa

SEQ ID NO: 18699 - DNA, 1080 bp, Zea mays
tttagaaactaaggggattcccccgggtttggcgcggggctcgctcactagtccccccccccccccccggacgaaactaactttggcattttcaatctggcgaagttctccaagaaaagtgctcttccctgtgatatatgcatgcgatgtgatacaatattgaaccgtatttttgtttgctcgagctgtaaggctactgtacacttagattgctaccagagtctggtgtatcccactggcccatggaaatgtgaactttgccatgagatgccctcagattctgttacctctggtgaacaatcagaccaaaatggtccgaaagcttgtttggtgcaatgtggtttatgccatggaacatctggtgcttttagaaagactgtgaagggtcaatgggttcatgctttctgtgctgagtggctgttggagacaacattcagaagagggcaacataatccagtcgacggaatggagaggcttcatcacaaggataaagatacatgctctatatgccaccgctgtgttggtgcatgcttgaagtgctgtacattagattgtcaagttacttttcatccttcatgtgctagagatgctggtctttacatgaatacaaaaagattgggtaatatgttacaacataaagcatactgttgtagacacagtattgaacagagaaaggcctatagtcaacaatatggtcctgatgaaatcaagggcatgaaacaaatgagggttgaactggaactattacgtttcctttgtgagaggattgttaagagagaaaaagtgaagaaagatttggttggatgtgcacatgacatacttgctgcaaggaggataactgccgtctcttctttgtggacttcatgttatacttctggacctggagcaagttcagaatctgccactacttctgttaataacaaatcatatggtggaacaattcaaaatgtcacagtgagattggaagatgtcacagtggacagtacagttaccaaaaaacatactgtcaggttttctctgcataacagggacactgatgttaaacacaataaagttggaactggaggggggaaaggattt

SEQ ID NO: 18700 - DNA, 3789 bp, Zea mays
  misc_feature (202)..(202): n is a, c, g, or t
  misc_feature (277)..(277): n is a, c, g, or t
ggcttgatgctgtagtatttcttgctgctgatcagtgccctataggctatagcttgaagatggtgaagaaactcttggattatatttatatgtttctgtttttctcgttcttggcaggttgaactggaactattacgtttcctttgtgagaggattgttaagagagaaaaagtgaaggtaaaatagctgttaatcgtgtctntttctccgcctttggtttctcagcaaatttaatggttctctttggaactttaatactttttctttgtgataacancaaatagtaatattatacacatccttgaattgtgtttcccatttattttgttatactagcgttactatcctacagaggcagatatatttgttataaactactactggcctccgcatttttagaagtcttattttggtaaactttatcagcaactgatccaaaatatatatggttttggttgcacataataccattagataactttgtaaataaaagtagcaccattaaatctgtttgcatatactctcagtccattttttttgcaaccctcggattccaaggatgaattagacatataagtaaaagacgcatggatcccttacatcaccaaccccgagtctctcattctctccatgctcatgtcctacagaaacctgagtacatctctgtgctagcctggacccctatagttgcattctttcttggacaaagtttcaagtctagaattgcatacttttgtgaacggagggaatagtatcataagggattaatcctgtgtttcttttccttttgttattatgtgctgcaaaagaaagtttaatttcaattaccgtcgaaccacaaaatatagggtacaatttgtggttctatggtaattgagaattggaattaaactttcttttgcaggtatttgaaattgaacttaaatagaaatggttagaataacccggagctaaatagacaatttattccaacagtgaactcagtagctaattaatattggcatgttgtgttgtggtttaaattgcgagacaaaaggcctatttgcagcactttagtcggtgtattggttgtgtatttgttcaatggtaactctcagttttgaggtctggcaagtgaaaagtaaggattccatgtccttttaaatgtgatttttttgaaataaattatgggaataaaaagtaaaaacagaagattttaagcacttgattgcaatgagaggatgattttgatgtatgtatgttagggaatgtgccaaatgtacagtaggggtcaagtaaatgagtatgcaccaaaaggttgcagctattaagtgttgatgtcagttactattgttgaaatgtgtagttagaacatctcagttgtcaacctttccatcaatttgaaaagtacaatcttgcagcttgtgcaaccaaatgtcttaacaattggattcctgttctggtcaactgatcttgctgcattgattttgatgtttttgtacaataacattcttcatcttcattaccagaaagatttggttggatgtgcacatgacatacttgctgcaaggaggataactgccgtctcttctttgtggacttcatgttatacttctggacctggagcaagttcagaatctgccactacttctgttaataacaaatcatatggtggaacaattcaaaggtctgatgatgtcacagtgagattggaagatgtcacagtggacagtacagttaccaaaaaacatactgtcaggttttctctgcataacagggacactgataggaacactgctgacagttccacatcaacaatatcatacaaacggaagttggatgatggggaatcacttgcattcaagagtcatcccggaacaccagctactgccttgttggagtcacgggatgcagaaaagccaatagataaaaaggttctacattttttatggatgtatttgtatttgtatttgtgcaattttttgaagtgtttcagctacgtaggcccccccccctgttggagtcacgggatgcagaaaagccaatagataaaaagctcagggatatgtatcaaaaggagcttgtcatggttacttctcaccaagctttgttgaagaacaagacccctccagagagatatgtttacactcgccgcagctccatgtccaaaaggaagcaatgtagtcagcatgtagttcaaagacctggtggatgacagcaggcgaagtcgcttcttgggatatctggataataatattcttggaagctcgatgcagaaaaggacaaagtaaatacagcaagcggggctggccattaatcatgacagccgcaggggctggcgcgtggccgcactggaatcggaaatttggtgcaaattgggctcttcgaagatttgaccaattgagcccatgtcaccttggagtccaacatgcgctgaattcattcactaatttagtcaagggcaggttttgtgaaatacgcccaattgccagtatggcgtcttcacattatgtcgaagaaggaaatcgattgagttatgtgtggtgaaagaaagtgggtagacaaatattactgactggtgaaagctaccaataggccatccgcacattaatgaccatgtttaggagttgttgctatgtactaacagaactgcatgttttgttgtgtggctccattctgacttgtgaaatgaactctcggtaagtcatagggcatttcatgtttgtacaggcatgtaggtttagctttctggtatgtagctaaattcaaagcatcatcttgtagccttatgtggttaaccagatctttgatctattagttaatttagtaaaccaagagctgccttgtgttcgtatgggttgagtcgggcttttactgtattgatatctattattagcgtgaaggctgtttattgccgatgttgagcttcataagcattatctttttttaacaaaacacagtgcttgttttgtgaatacttgtaacctcgaatgtgtaataaatgtagcacgtctattcaactcaaaaaaaaaaaaaaaatatatggtcaaccttgcatgtccattactgtcattaccgaagcatgttacttattactccattttcataagtccgatgcgaatgacaggcagaatattacttcagtttagagcaagattaatgatataggtcatagtgggtcacatggcattgtcatgtcacatatagttaactaaaaaacgtctaatataataagtttttttatgacacaaactgtgcatttaatatttggttcacctctctcatgaagtcttttaagcatgtttaagtatatgagcagcacactttcaactgtctactaatgagcagcctattttccttctctataccattctctttttttcttcacattagcacaaatctgatgtagcatctcttacaacttgtctacaccatctcattatacttattcttatggaacgattacgtggctatggctaaaaggtgcaatgtcagatctctcccatattcccgtgtatgtcgtggaaggcaagaatcagacctttttatacttaggccattctcggtggaagtttcataagagttttgttctcattatataacatgccacctaagcaaactttggtatgcaatttaatgaagtgagatataagagagtttcattggagatgaaaaagtttcatggggatcactttggatttattgtttttctagacaaatattgacatggtagacttggaaatagtcagatgaaactacccattgagaatggccttacaatttagggctaagcttgatttacactagatc

SEQ ID NO: 18701 - DNA, 2352 bp, Zea mays
  misc_feature (2352)..(2352): n is a, c, g, or t
ccccccagggtttttctctctgttaaaaagggggccgggggtcgcccccccaaaataaggggggtttagccccccttttgggcccccccgggttttccccttttatttttcccgctttttttttttgggggaatttggggcggtaaccattttccccccaggaaccagttttgccctggtttcccccaacttggaaattaaccccccttaaaggggaccaaagggtggggttccccccccggtgccggcccttttagaattaggggattcccccgggttgcaagatgctcactagtccccccccccccccccgacgaaactaactttggcattttcaatctggcgaagttctccaagaaaagtgctcttccctgtgatatatgcatgcgatgtgatacaatattgaaccgtatttttgtttgctcgagctgtaaggctactgtacacttagattgctaccagagtctggtgtatcccactggcccatggaaatgtgaactttgccatgagatgccctcagattctgttacctctggtgaacaatcagaccaaaatggtccgaaagcttgtttggtgcaatgtggtttatgccatggaacatctggtgcttttagaaagactgtgaagggtcaatgggttcatgctttctgtgctgagtggctgttggagacaacattcagaagagggcaacataatccagtcgacggaatggagaggcttcatcacaagctcgaggcggcgggctctcttcgccaccgctgtgttggtgcatgcttgaagtgctgtacattagattgtcaagttacttttcatccttcatgtgctagagatgctggtctttacatgaatacaaaaagattgggtaatatgttacaacataaagcatactgttgtagacacagtattgaacagagaaaggcctatagtcaacaatatggtcctgatgaaatcaagggcatgaaacaaatgagggttgaactggaactattacgtttcctttgtgagaggattgttaagagagaaaaagtgaagaaagatttggttggatgtgcacatgacatacttgctgcaaggaggataactgccgtctcttctttgtggacttcatgttatacttctggacctggagcaagttcagaatctgccactacttctgttaataacaaatcatatggtggaacaattcaaaggtctgatgatgtcacagtgagattggaagatgtcacagtggacagtacagttaccaaaaaacatactgtcaggttttctctgcataacagggacactgataggaacactgctgacagttccacatcaacaatatcatacaaacggaagttggatgatggggaatcacttgcattcaagagtcatcccggaacaccagctactgccttgttggagtcacgggatgcagaaaagccaatagataaaaagctcagggatatgtatcaaaaggagcttgtcatggttacttctcaccaagctttgttgaagaacaagacccctccagagagatatgtttacactcgccgcagctccatgtccaaaaggaagcaatgtagtcagcatgtagttcaaagacctggtggatgacagcaggcgaagtcgcttcttgggatatctggataataatattcttggaagctcgatgcagaaaaggacaaagtaaatacagcaagcggggctggccattaatcatgacagccgcaggggctggcgcgtggccgcactggaatcggaaatttggtgcaaattgggctcttcgaagatttgaccaattgagcccatgtcaccttggagtccaacatgcgctgaattcattcactaatttagtcaagggcaggttttgtgaaatacgcccaattgccagtatggcgtcttcacattatgtcgaagaaggaaatcgattgagttatgtgtggtgaaagaaagtgggtagacaaatattactgactggtgaaagctaccaataggccatccgcacattaatgaccatgtttaggagttgttgctatgtactaacagaactgcatgttttgttgtgtggctccattctgacttgtgaaatgaactctcggtaagtcatagggcatttcatgtttgtacaggcatgtaggtttagctttctggtatgtagctaaattcaaagcatcatcttgtagccttatgtggttaaccagatctttgatctattagttaatttagtaaaccaagagctgccttgtgttcgtatgggttgagttgggcttttactgtattgatatctattattaaaaaaaaaaaaaaacaaaaaaaaaaaaaaaaaaactcgagggggggcccggtaccccattcgccctatagtgagtn

SEQ ID NO: 18702 - DNA, 1251 bp, Zea mays
ccggccgggactttccgccggcccatcgagattggtaattgctctacgtgaacgaagcttctggaaactcgctggcccgatggcatcggaggccgcgattgctcgtgcgcagtgcctccttcgcttccgccgctggtcgccactgccgcttcttcctctcccttcccctcccgctaccacacgagcagcttcctgccgccgcagcgtacgcatggcctcgtcggacggctctgccgcggccctgcccagcgctaccgtcgatgtgcccggcgccggggcccctgtcctcgtcgtgggcgcgccggggctccccgaggctgacttcaggaacgcggtggagtcgtcgctgttcaagcagtggctgcggaacctgcagtcggagaagggcgtcctcacctacgggaggctgagcctcacgcgggttctcatccagggcgttgacatgttcgggaaacgggtgggctttctcaagttcaaggctgatatcgtggacgaggaaaccaaaaccaaggttccaggaattgtctttgcaagagggcccgcggttgctgtgttgattcttttggagtcgaatggagaaacatatgctgtgcttaccgaacaggttagagttcctattggaaaattcctgttggagctgcctgctgggatgctagatgacgaaaaaggtgattttgttggcaccgcagtccgtgaggtggaagaagagactggtataaagctgaatatagaagacatggttgatcttacggcactgctggaccctgctactggaggtcgaatgctaccatcaccgggtggctgcgacgaagagattggcctgttcctgtacaggggccgcgttgacgaggagaccataagatcgctccaggggaaggaaaccgggctgcgcgaccacggtgagctgatcaagctgcgcgtggttccgtacagcgagctctggcggtcgaccggcgacgcgaaagcactctccgcgatagccctgtacgagatggccaagagggaaggcctgctgccgcagccgacgccgtcggccaacttgtgaagacctgctagcactttaaaacagtggtggccgtcatgcctgtaaaatggaaggaggaacgtcactcgcgaaaccaaatcatatatatctctatctcttcgtttggtataacgcgcttaagcttgtctgtttgtgttatgtatacatatactaataatttaaaaataaaagtataatcgtgtttaaataaaaaaaaaaaataaaaa

SEQ ID NO: 18703 - DNA, 1359 bp, Zea mays
  misc_feature (1135)..(1135): n is a, c, g, or t
  misc_feature (1222)..(1222): n is a, c, g, or t
tgtagcagagataatagtgcaatgctggcatacggacccaaagttgcggccatcatttgcagatatcatggctgcactaaagccactgttgaagaacttgaccagcaatctagcccctaagagagtgcaacaaacagatgagtgagacaaggaggatgacaactgcccaacgtccgtaacttgtagattatttctgtacattaacagcaagcatgtgttcaaagatgaaaaaagatgtgatgttggtctgtttgctactctatccagctagaggtgcaacatttcggattggcaatgccatggtaagcttaaggccgcttgccattgatccacattcgaagatcagtgctggtatacccgtgaaagaagacggaggagggctgtgatttatgcaaagaattgtgcagaacagtaatgttttggcactgtggaacgcttgaaccaggaactcgtatgggtggcagaccggggcttttgttcataccgtctctactttttttctttcgttgtgcctcaccgaatggtgggtattattatgtgtaacatgctgtttggttcacgaaacgtaatgtaaatgacaacggtaatgattcatgtttgattaccagcggtaacaagtttgaataggactatatcagtttctagggtgatatatgattacattacacataaacaaatatggtttacgttatctgttaccgttgaccttacaaatacgtgaacctgccaacctgaaaagagagggaaaggttgccctgcttgtgttgcgagtttggactcacctcacagctgacgcgtgtccacttcgcctctcaccatccgtcgtgaacagtggatcccgagcgcgctgggcgttcccgcttccattccatctaaccagttcccagccacgaaaactccgcaaacatcgcacgcacgtacgccgtttccatgccatgcatggacaccacgcgctagttaacccgagatcggccccccatcgctgatgccaggaccgatcacccgacgacgcacaaacaccactccgcacggattagccgacgccgacggtgagcagcccatcagagcgcgacgatggcgggcgtcttttggggaggcgggagggcggacgaggtggctgacttcgacgagtacnaccccaccccctacggcggcggctacgacatcgccctcaccttcgggcgtccgctgccgccctccgaggagacctgctaccgatctncaccgcctcctcgtacgaccgtccgcagcagcacggaagccggaagccgggggccgaagagtcccacggctcagctgcagggtaccgtggaagccgcggccggtacccgggggcggggcggcctcatcagcttcata

SEQ ID NO: 18704 - DNA, 1510 bp, Zea mays
  misc_feature (633)..(633): n is a, c, g, or t
  misc_feature (635)..(635): n is a, c, g, or t
  misc_feature (1475)..(1475): n is a, c, g, or t
aatgttgctccaagaattcctttaatatttccacaaccgaaacctgcagtcgggtcatctcgtccacgaaacgtacggacttcgggcatcggccccaacgccagcggcaccgcacccgcaccaccaagctcgtcggcgacatgaatccgcccgcagcagccgcgtccaccggcgcaggaggccacgccgcggcgcctgcggcagccccggagtacgtgcactacccgaggctctcgccagaggaggtggccccgcccccgcccccgccttatcacgccgccaccgccgcgccgtccgcctacggaggcaacccctacatctactcccccgccggcggcgccgccacctccccgaagaatacgatggactccgtgaaggacgtgctcggcaagatgggaaagaggtttggcgaggcggcccgcaagaccgagaccatcaccggcaatttctggcagcacttgaaaactggaccaagcattactgatgcagcaatgagcaggatctcacaggtcaccaaagtcattgcagaaggtggatatgacaaaattttccatcaaacttttgaggtcgcccctggtgaaaagctcaagaagccatatgccatgttatctgtcaaacctcggctggtccctngntttatgggggggcgggccctgtccaatgtaaaactggcattttgtagtgataacccacttgcataccaggttggagacaaaactgagtggagttactacaaggtaattatgtgtattgctgtgttttgctttagttcagtaaatataaagtttgttcaaggaaatgcaattcgtactgaagcttattcattatgacaattaggcttacagaattatgttaagaaacaatacatcttactctggagtattgttttgtatgaaaacatcaagtttcagaatttgtttcatctgttttcatcagtgcaccaatataataactattgtcgatcttatttactggtagtactcattaattctgaaatccatatatttcaacatgcaacttacgatttgtttgtctatatctgaaataggtggtcatcccccttgctcaactgcgatcaattaattcatcaacaagcagaacaaatgcagcagagaaatacattcaggtggtttctgttgataaccatgagttttggtttatgggcttcgtttactatgacagtgcggtgaagaatctgcaggaagcacttcaggaggctcagaatttacgtgcttagtgatgttcatggattggaactagcatgtcttatacattacagttgtgatatactgttttcccgtcagtttcgactgtttgtccagatttagtttgcgtaggtatcagctgtttctgtgttttgtactgacttaaaccgatgcggttcaatatgtgacgtgcatcctttcatggttgttctctgctatgatgagcccatttgcttcgagcagtaacaatgggtgtgcctcttctgagtnttaaatccgaccacagtgatttctataggtcttga

SEQ ID NO: 18705 - DNA, 1145 bp, Zea mays
cattgcctccctccaggccggcccggaaaaattccacaaccgaaacctgcagtcgggtcatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccacctccccgaagaatacgatggactccgtgaaggacgtgctcggcaagatggggaagaggtttggcgaggcggcccgcaagaccgagaccatcaccggcaatttctggcagcacttgaaaactggaccaagcattactgatgcagcaatgagcaggatctcacaggtcaccaaagtcattgcagaaggtggatatgacaaaattttccatcaaacttttgaggtcgcccctggtgaaaagctcaagaagccatatgcatgttatctgtcaacctcggctggtcctgttatgggtgtgctttacctgtccaatgtaaaactggcattttgtagtgataacccacttgcataccaggttggagacaaaactgagtggagttactacaaggtggtcatcccccttgctcaactgcgatcaattaattcatcaacaagcagaacaaatgcagcagagaaatacattcaggtggtttctgttgataaccatgagttttggtttatgggcttcgtttactatgacagtgcggtgaagaatctgcaggaagcacttcaggaggctcagaatttacgtgcttagtgatgttcatggattggaactagcatgtcttatacattacagttgtgatatactgttttcccgtcagtttcgactgtttgtccagatttagtttgcgtaggtatcagctgtttctgtgttttgtactgacttaaaccgatgttcaatatgtgacgtgcatcctttcatggttgttaaaaaaaaaaaaaaaaaaaaaaaaaaaagccaaaaaaaaaaaaaaaaaaaaaa

SEQ ID NO: 18706 - DNA, 1328 bp, Zea mays
gctcgggcgccgcgagtccgtccaggacggaaccaacgaccctgccccgccggcaccgaacggctactgtaaatgtcgtgaccgtctcgtccccgtccagtccaccttttcctcctctccgactccaccgccgtcacgccatctcgccgggggcggaaccccgaccgcgagtatggggaacatcttcgtgaagaagcccaagatcactgacgtcgatagggccatcctcaccctcaagacgcagcgccgcaagctcgcccagtttcaacagcagcttgagaaggtaatcgaagcagaaaaggaagctgcacggcagttggttcaacagaagaagagagacagagctttgattgctctgaagaagaagaaagctcaggaagagctgttgaaacaagttgacacatggcaaatgaatgttgaacaacagctggcagatattgaactagcaagtaaacaaaaggctgtatttgaaagcctgaaggctggaaatgctgccctgaagtctatacagaatgagataaacattgatgatgtccaaaagctgatggatgacacagccgaggctaaggcttatcaagatgaaataaatgctgttctgggcgagcagctttcagctgaggatgaagaagctgtcatggccgagtttgaaaatttggaagctcagcttgccgttgagtctttgccagacgctcctgctaccgaagtaaggcctgaagagaaaacgaaagctccggctgacacagaagctgctcctgaggacatcgatgacgttattgagcttcctgatgtgcctacgaaagtgccagagaggcctgaagctccagaaaaaaacaaagttttggaggagccgctacctgcataagtggatggagctgagatgaatacggcacacttttagtttgcaggaaattgtaacatacccaccatttcattgtactatctcattctcagaatttcatcgtgtacagcaagaaaaatttggtggtcttgtctttgactatcagttgtcaccagtttggatttctcagtgcccgtttattatcctatcctacggggtaaacataatatttttccattgtgtttctttgtaaggcagaaatgctgaagtctgcaagcacataccttgttccgtatgaatatatacgtgtgttttttttgtgccaaagctgtaaaatgtacggcatttgtaggtgccatttgttgcttgaatttaattggtggagcgtgtaagatagaatactcaaatcagagcagtctgtctgtatcgagtacattgaattgcctatataaggtgcctttttttgttttaaaaaaaaaaaaaaaaaaaa

SEQ ID NO: 18707 - DNA, 1057 bp, Zea mays
acaaacaaagagaacgctcaaaaagaagtttcgagtcgatggcagtgggtcccaccggagcacgacacggccagcagaccctgccccggttcaactgccgtggccgtctcgtccccgtccagtccacctttccctcttcctctccgactccgccgccggcggaaccccaaccggcgaggatggggaacatcttcgtgaagaagcccaagattaccgaagtggacagggccatcctcaccctcaagacgcagcgccgcaagctcgcccagttccagcagcagcttgagaaggtaattgaagcagaaaaggaagctgcacggcagttggttcaacagaagaagagagacagagctttgattgcactgaagaagaagaaagctcaggaagagctgttgaaacaagttgacacatggcaaatgaatgttgaacaacagctctcagatattgaactagcaagtaaacaaaaggctgtatttgaaagcctgaaggctggaaacgctgcccttaagtctatacagaatgagataaacattgatgatgtccaaaagctgatggatgacacagccgaggctaaggcttatcaagatgaaataaatgctgttctgggtgagcagctctcggctgaggatgaagaagctgttatggctgagtttgaaaacttagaagctcagcttgccgtcgagtctttgccagacgctcctgttactgaagtaagacctgaagagaaaatgaaagctccggctgacacagaagctgtgcctgaggacatcgatgaggctattgagctccctgatgtgcctacgaaagcgccagagaggcctgaagctccagaaaaaaccaaagttttggaggagccactgcctgcgtagtggatgaaactgagattagtaggacacagttagtttgcaggaattgtaacatacccactatttcattgtactatcttattttcagccatatcagaattttattgtgtacagcaagaaaaattggtgtttttgcaccatcgactataactagtttggatttctcagtgccaaaaaaaaaaaaaaaaaac

SEQ ID NO: 18708 - DNA, 4812 bp, Zea mays
  misc_feature (570)..(570): n is a, c, g, or t
  misc_feature (1812)..(1812): n is a, c, g, or t
  misc_feature (2246)..(2246): n is a, c, g, or t
gagagcgaggtcagagataaatctcctcatgtaattatcatgtggtccatgtgaattcatactgcaaactgttacttcctccattccaaatcataaaacaaattgaattttctagatgcattgctttaactatatatgtagacgtattgtatatctatgtgcatagcaaatgctatgtatcttgaaaaaatgaaacgtcttgtaatctaggatgtagtagtactgtagtagtgaaaattttgaaagtctgacaggaagcataccaggatgcagggataggaaaaccatattctttttgctaactttatggctatttaattgcttgaaccatgaaggaactccatgtatgcaacctggatcaattaatctatgataggatagccgtttcaattggtcactgagggtcatctcttgcatgaatgagaatctaatgccgctaaatgggagggcagctttggtgcttaggtaataacaattatggaaaaatatgaaatctgcattatctactgcaagagaaccatgagggctaccaatacaggtccagcttccaccatattcgaacccacacantagggaataaactaatagacaatatggtctccaagaatacttacctgaagaaacaattagatatcctgactcctgagcacattcaactttcataatcctttcgaccaaccagactcaacaaagaggcgatgcagagggatggtagctcttcatgaaggggaatgagaaagggacgtgagagctaacagggagaagaccgtggaagtggaacattgcaacagatgagatgttcttcatcatatagcgacatatccaatcaaggattccaaaacactctgaggaaacactcgaagcttttctctagtaagcaagtaggtaccattattactttgatgatcggagtaacttccatttagtcgacttcttgaatcaccccattttccatcagatctcctattttcgttgtactcatccttgtcatcctgcaaggtggtgatcaatgaacacatagtgaaattcaaagagaataatatgtttccaaagtaaggattggttattaaggagaaacatttaaaccaataaggatacaacataacctttgctaacatttcacatagacagctaaacattgtaatttagaaaaagaaattgctaaaaaaggtcacctattgtaagggtgtccatttcgttgaggatccattccttaaaaaaatacttctctagcacacaggatccattcctcagattaagttttcaaaattataactaaagcaataaaccttgtaaacctacttggtaggaaatacattgccaggaaaatatacaatttagctactgtacttttttcattttgttaagctgctaagaattttttgtattacgcttggaatattggaggaagatttgctttgtatagaaagaacaaactggaatgtcataactcataagaataaatctacatcaactaaaattttattgcaaatgcttttcatgaagaatatcggcatgcattgatgtgtgcaactgcaaaacatatgcaagatattgaagctcataaggattctagtcaacgcaattaataaaataatattgtacttccgaaataaagaatactcaccagattgtcttttcttaagtgatttacgatacctttcaatagtctcataaagatttctacagaaagactcagcaaacataagcatatcagaaatatggaaaatcgagatgaagcaagtagactaagtggaaaaatagttaactgattttatgacatggtggcgaaggccctacacttgattcatncgttcggcgcttgcacgcaagcctcgggtcaccggcaaggagggctgcaagccacgcccaaatcacagtcaggccacatggagagagggaggtgtctcgggtcgctaggggcgctcgcccgtgagccctaggtcggggggtgccccaacagcgggagggggggcgtttgagaaagaggggatggtctcctcgcattggttcacgtggatgggagggggatggatctctagcgtgccatggcaggaaagtgcagggagcatagggctcctggccaagaacaacaccctgtcggcagcgtttagatgaaatggatggatgggggaatggcgggcgacagcgtttatcagagaggggaggggtggagcacctgctggaagcttcacaatacatgacggtgcggtagaaggtggaagtgtccagaggcgatgaaaacnacggacgcacgagagagcacgcgacgaatgtgagcatccacgaatgaatgactacggacatttccaacgatgtggataggttaggaagccacgttttctaccagcttttatatataggaaatgacagtgctgccctatctcctcggtggtcacctggacgggcgtgcttcccaacctcccagacctacctccccgacgtcatactctcagttaacgtggagttcacagctaagcagctaaaaacttacacctttcaatggtatatatctgaagtaaattcttttaatgatatatatctcaaatttggttcttttgagggcatgaatccaattttctctagttttaaaaattttactttttaaaaaaaaatgtaaaaatgaaaaggctcgcctttcgtgggcctcgtccagcacctcccaagtccaccacgagcccacccagacgagacaagacgggacaaggtgtgtggtgtgttctgttcccgacacccgcccacaccggcgaccaccagaccacccaaatcagttgcccttgcccacacggccacacgcctctcctctccttttctccttcccccttcaggctccccgatccgacgaccccagcggcggcgatgggcggcaaggacctgacagaggagcagatcgcctcgatgcgggaggccttcacgctgttcgacacggacggggacggccgcatcgctcccacggagctgggcgtcctcatgcgctccctcggcgggaacccaacccaggcgcagctccgggacatcgccgcgcaggagaagctcacggcgcccttcgacttcccacgcttcctcggcctcatgcgcgcccacctcaggcccgagcccttcgaccgcccgctccgcgacgccttccgcgtcctcgacaaggacggctccggcaccgtcgccgtcgccgacctccgccacgtcctcacgtccatcggagagaagctcgaggtgcacgagttcgacgagtggatccgcgaggtcgacgtcgcgcccgacggcaccatccgctacgacgacttcatccgccgcatcgtcgccaaatgatcccgtcccctccgagtctccattccgccgatccaccctcgcgcgctcttcgtctgtaataacttcgtctcccatccccgtgatttcattttgtttcccttctatggctggctcatttgaattcaatctggcctcctcttcgttccgagactgctcggataaaacggataatggttgctgtgtgattatcaaccaatcaacgattaattattagtagatctggctgatggtgcttttgcttagctacctgtaatgtaaagtgtgggtctgcctcctttgtcactgattttggcttgcctggtaacgaatctctgctatggtctgcactggcttatgtattcatgctgatctagtgctacttttgtttgggtcataggttgtattggaatctggaaatttcattggcctgctttaggatttctaatgtttgttgcctacccgtgttgtgttgattgccagtcttcccatttcaatttcatgcaatgggattgtccaaaaacttgctcgcttgtgaagatagcgattttggacctgtggtttagtcaatcgactagtccaattgtccagcagtctcattggattggattattccttgttgctccacatttacttccttctcttggtccatgtcactgctacttgtaatttgattcataaaagagccagcaatagtgatttgcttcttttcagagcatgttgctgataagcagctgcttccatatacatgaattggccaatggccgccatcacacgtttcagttttgctgaaaagttttttttgtgtgtgtgtcaactgttagggttaccacctttccatgaactagtgtctcataggcatatattcctccattatcaatcaaatattaactaatcgtgacttcatgcagttttagtttttatctaagctcaattcacattctccatgcttgtattgaaacacttttttggtaaaagctatataggagttttttttttaaaaaaaaaaaacttcataattttatacatggtcacatggagaatgcagtcacatggagaatgcagcattctgataataagattttggccacatgctgcattgttgttgttccgtctctaagcatgtatagtgattttctggatggtagttctctttgagtatctctaagagctctccagaaaattactcctaaaaattagttttaagggacatctaaaaataatgcaactaaagcaaatgctataaacgctagccgcaatgacaaacgctagagcaaatgctataatcatgcagttacttcagtggcgtaccgtaaatactactctctcggttcataaataattagttattatttatttttttatagcttgtgtttgacttaaatttttataattttttaataaatattttgaataagacgagtggtcaaaattttcgaaaaaaaaacaacggtgttatatctttgtgaacggaggtagtactgcagaactagagcaagcagaagaaacgctatttcagagtttacaacc

SEQ ID NO: 18709 - DNA, 995 bp, Zea mays
cggtgggtcccgaacgccccgtccgaccggcccggcagccagccacccaccaccacaccacccatagcagccagtcgcccgcacgactctttcccggctacccacaccgcgcgagatctccgatccccgcccaaatcccacgacgccggcggcggccatgggcggcaaggacctgacggaggaccagatcgcctcgatgcgggaggccttctcgctgttcgacacggacggggacggccgcatcgcgccctcggagctgggcgtcctcatgcgctccctcggcgggaaccccacgcaggcgcagctccgggacatcgcggcgcaggagaagctcaccgcacccttcgacttcccgcgctttctcgacctcatgcgcgcccacctcaagcccgagcccttcgaccgcccgctccgcgacgccttccgcgtcctcgacaaggacggctccggcaccgtcgccgtcgccgacctccgccacgtcctcacctccatcggcgagaagctcgaggcccacgagttcgacgagtggatccgcgaggtcgacgtcgcgcccgacggcaccatccgctacgacgacttcatcctccgcatcgtcgccaaatgatcccgtcccttctccctcgagtctccgattcgccgatccaccacccccgcgctcttcgtctgtaatgacttcgtctcccgtccgccgtgatttcattttgtttacccgctagctcatttgaattcagtttggcctcttcgttccgggactgcaacctagggtctggataaacacataatggttggtgtgtgagtgtgtgtgattatcgcccaaacaatggatcgattaattaatggatctggctagtgatgttgcttttgcttagctacctgtaatgtactactattactactgcaatgtaaagtgtggatctgcttcctcttcaataaaaaaaaaaaaaagagcgcccctggaaatgtcattgggcctgctgtaaaaaaaaaaaaaaaaa

SEQ ID NO: 18710 - DNA, 1252 bp, Zea mays
gccttccttcctgttggttgcttctttctactcgcgctcgcaccaaccagaggagcaaccgagcagtagcgactcctctgcgtgaggcctgccgtcatcccccgtgggccgtggccgtggccgtggccgtgcgcaaaaaaacaaaccatcctcgattcgaccggaggggaaggagacgcgccgggagaagggggaagagacgcggcgaccatgtctccgatctgggtgttcgggtacggctcgctgatctggaacccaggcttcgcctacgacgaccgcgtcgtcggctttgtcagggactaccgccgcgtcttctaccaagggagcacggaccacaggggcacgccgcagttccccgggaggaccgtcacgctcgagcaccagcccgaagcgacttgcgtaggccctttctcatgtccaccctcctactctgtcaatgtaactgctaaggacagactgattactaggacacgcaaaccaaatgaattagtaaattcatggttgatgacatgtcactcccactacgtcatgttatcatgtagtacatcttttttacttatcgttttggatagcctggtaatcctcttcgcagtccatgcgattgattttgcgagctaatctgtctattttacatctttcagtggggagttgcttacagaataaaggaggaagataaggagatagctttggaggtatgtttattgcaggagaagcaataggatgagaaggtttaccttgacttgtatactgtaagatacgagggctggatctatttccctttggataatgttcgatatgtaactattacggagtattaagttgtaataactttcaggattcatcgcccaaagtaccagctgtcgaaaatgtgatggtatacttcgccaccagtaacaaggagaacaatcaaaactatcttggtcctgcacctctggaagaaatgaccaggcaaatttaccttgctcaaggcccatctggacctaacaaagagtacgtgttcaaactcgaggacgcgttacacaaattaggagttgtagaccaacatgtccaagaactggcaaatgctctgcgtgagtattctgacaccgagctatctaagtgaaagatcacatttaccccttgtttggagggtaaggatttataaataaagttagaattcattcatgcatgtcccaacatggatatattcttgtaagctgcgttttgagtgactacattacgattatattcctgggcacatgtggtttgcaaa

SEQ ID NO: 18711 - DNA, 1243 bp, Zea mays
aagttaggtttctagccagttgtcgcgttgggacaaaatgaaaagggaataaataaaaagagagaataactggctagctgtcgtctgcctctcgatttctgcgtgattcgcctgcctgccttcctgttggttgcttctttctactcgcgctcgcaccaaccagaggagcaaccgagcagtagcgactcctctgcgtgaggcctgccgtcatcccccgtgggccgtggccgtggccgtggccgtgcgcaaaaaaacaaaccatcctcgattcgaccggaggggaaggagacgcgccgggagaagggggaagagacgcggcgaccatgtctccgatctgggtgttcgggtacggctcgctgatctggaacccaggcttcgcctacgacgaccgcgtcgtcggctttgtcagggactaccgccgcgtcttctaccaagggagcacggaccacaggggcacgccgcagttccccgggaggaccgtcacgctcgagcaccagcccggagcgacttgctggggagttgcttacagaataaaggaggaagataaggagatagctttggagtatcttgaggtcagggagaagcaatatgatgagaaggtttaccttgacttgtatactgattcatcgcccaaagtaccagctgtcgaaaatgtgatggtatacttcgccaccagtaacaaggagaacaatcaaaactatcttggtcctgcacctctggaagaaatgaccaggcaaatttaccttgctcaaggcccatctggacctaacaaagagtatgtgttcaaactcgaggacgcgttacacaaattaggagttgtagaccaacatgtccaagaactggcaaatgctctgcgtgagtattctgacaccgagttatctaagtgaaagatcacatttaccccttgtttggagggtaaggatttataaataaagttagaattcattcatgcatgtcccaacatggatatattcttgtaagctgcgttttgagtgactacattacgattatattcctgtgcacatgtggtttgcaaaaaaaaaaaaaaaacccctgtgcacgttagggatttgctttgctttctacttctagcaacgagcaacaaaaaggcgaccaggaaaaagatgaatggacaaaagaaacgatgggcaatctattatatactacaaaaaagtttatataattgtagactttccaggtttatctcagtatcagtgttaataaggggatttcatattcgccc

SEQ ID NO: 18712 - DNA, 2025 bp, Zea mays
gcggcgcggcgagactgctgagcccgaggaaacgggaagagaggagaaaagcaaaacgaagctcggaaccacgagacgacggagaggatgggcttcagcgtcctgctctcaccgccgccccttccgctcccgagcgccaccgctgcggccgacttgtacctaatattcggcggccacgatcgccgccgccgccgcccgctggaacacggctgccgctgcggccgccccccggagacggcgctcggcggcagctcaggccgccgcggctcgtacgatgacgacgggacggctccaggctccctcggcctcgacggcagcagcacgtcctcctcggtccgtcggacggggagtgcaaaaccaagatatcaagtaacttcgaaagaagaggacacacaaaatgcagaccgcgaggggtggcaatatagtacagaaggcctttcaaagagcatgtccaagtcaaggtacatcaaagtatttggggttgatttgtcccctgataatgtggctgttgctattgtttacttcgtgcaaggagttttaggcctttcgaggcttgctgtcagcttctacttaaaagataatcttcatcttgagccagcagagactgcagttatatctgggttctcagccttgccatggttggtcaagcccctctacggttttatcagtgattccatccctctctttggatatcgaagaaggtcgtacctatttctatcaggcatccttggagcactttcatggagtttgatggccgctgttgtggatgataaatatagtgcagcactctctattattcttggatctcttgcagttgccatatctgatgttgtggttgattctatggtggttgagagagctcgaggtgaatcacagagtacatctggatctctccagtcgctatgttggggatcctcagccttcggaggagtcgtgagtgcatacttcagtggttctttagtggatacttatggtgtaagatttgtttttggtgttacagcacttctgccactgatgacatctgctgttgcagttcttgtaaatgaagaacgcttacctttggggaaaagttcagtctcactttcagtttcaggttcagaattaattgagagctctaagcaacgtatcatgcagatttgggattcagtaaagcaacccagcatactcctacccaccttgttcatattcctttggcaagcaacaccgcaatcagactctgccatgtttttcttcataacaaataagctcgggtttactccagaatttctaggacgcgttacgcttgtcacatctgttgcatccttactgggaatcggagtgtataatttgtttctgaaggaagttccattgaggaaaatctttcttgtgacaacagtcttaggttctgctctcggaatgacacaggttcttcttgtcactgggctcaaccggaagcttggcataagcgacgaatggttctccattggggattctttgattatcacagtccttggccaggcttcctttatgcctgtcctggtgttggctgcaaagttgtgccctgtgggagcggaagcaactttatttgccactttgatgtccatctctaacgccggaggtgttgccggaggtctggtgggcgcgggtctgacgcagttactgggagtcagcagagacaacttcgaaaaccttgctctgctgatcgcgatttgcaatctcagttccctgctacctctgcctcttctgggtctcctgccagatgaatcccgtaatgcagatggtgcacagaccaaaaatgactgatgcttgtatatctccacgcgtctttacaagacgaaagggcatacacatacactcatcggcacaaagcagcgcagctgatgacgtgaacaaaacatggaagctgatgtataggatgtattatctatgatgtatagtaagtaacgttagattaattatgaaacatatttgtaataaatttaattgaaagtataaatactccttttcataaaacaaggattaaaaaatcaaaaaaaaaaaaaaaag

SEQ ID NO: 18713 - DNA, 1255 bp, Zea mays
agggtcaccgggtcccccgcgcgcggccagcacagagcatccagcttcccccaacaaaggaatctccctccccttcctcagcagggtagccatgtttggtcttcgtgcccgcgcagcggcgcagctccagcgcccaaccccgtctccctcctccgcttcctcggcgtcgttctcgctcgcgaggctcgggtgcgcctccccgctcgccgccctcgcgcctctggcttccgcaccgccgtcgccgtcggccagggagacacagccgacctccctctccgccaggtggcctgccgcgcccatgcgtccctggggaacccgtggccactccaggccgaccacgcgcgttctctgcactgctgccggcagcgtccaaagagaggggaaagaactgctagttcagcatttgcttgttggtgaaaaggatgtcaggcttctggttgatctcgaaaagaatatcattgcagaaggagcagacttgagtgatttagccgtggagcactccttatgtccatccaaagaaaatggtggtatgcttgggtgggttcgaaggggacagatggtaccagaatttgaggaggcagcatttagtgctcctttgaacaaagttgtacgatgtaagacaaaatttggatggcatctagtgcaagttcttgctgagagggatcaatgcgtactgcaagacattgacccagaagagcttcacgcaaaattgcaagaccctagttttctcgaagaagctcaattgattgatgttcgggagcctgatgaagtggagaaagcttcacttccaggcttcaaggttctaccgctccgccaatttgggacctggggaccagttatgacagacgagtttaatcctcaaaaggacacttatgttctgtgccaccatggcatgcgctcaatgcaggtggctaaatggttgcagtcacagggtttcaaaaaagtttacaatgttgcgggtggaattcatgcctatgcggttaaagccgactcctccatcccaacgtattagaggatcctcatggtgacactttagcacggctgggaacttctcatatatcttaggcattggcgttgatcaatgcttgaattcagagctcaattttatttctcatactgtgtatcagaaagttttgggagtcctagggaggaaaaatatacagctatttttgtaaaaaaaagatacttgagaaattgctttattgaacgaaccgtttcatccggaggaaataacaagaacggggcggccgccacc

SEQ ID NO: 18714 - DNA, 942 bp, Zea mays
aagctgagctcgaggccgcggttttttttttttttcagtcgtgtagagataaactctttccgaagaatctgtctctcgtaatttttaaattaacccttggggacttttttttttttttttttcaaatgaccatatattaactgggactgcacatgcccttaacctcaaaagggagataagagaagaattccgtatagaaactacacttgcgcgcctcccccacacacgcaccgctacacacaaaacttaacttgcatatgtccacaggctgagtctacattatggagcaggtgttgcccggccgtgggtaggggtcgtaaacgacggcggccggcggtgggtagtggtagtagtactggttgtagtacgccgccgcagcttcggcgacggggtcgggcttcttctcctccttcttcttgtcctcggcgacctcgacgagctgcgcgtcgcccatcttcttgcgcaggatggtggtgagcttgatggagtcgacgccctcgccaacgacgaccacctggtccttgccgtcgccggcgatggccacggagttgaccccgcccgcggctgccaccagcgccattgccttggaccgggacttgtcgctcgccatcggcaccttgatcacgatcttttgcttggccatggctgatctaattctttggggacgcgccgctctccaagattgaaggttcagattccagaacgccgcgcaagagatcgaagaagcttcgaatgttttggtggcgtggagatccgagactacccgtggggttttttgttgtgcggaggctgcaagcagttgctttgctgtggtgggacttcccggccgggccgcggcccccatccgtttatgtattgccgaccagccggcggtagggtaggacgaagcggttagatgagcttccccgctgtagtaagctttccgccgcctcgaggtcccaa

SEQ ID NO: 18715 - DNA, 1643 bp, Zea mays
ctgggaatgttgtgattggtggaattatggagcatatcgagcaggctggtatacattcaggtgattcagcatgttctcttcctactagaacagtctcagcccaatgcctggaagttatccgttcatggaccacaaagctcgctaagcgtctgaatgtttgtggactaatgaactgtcagtatgctatatctacttctggtgatgtgttcctacttgaggcgaaccctcgtgcttcacgcacagtcccttttgtatccaaggcgattggccatccgctagctaaatatgcatcattgatcatgtctggtgtgaccttgccggagctcgggttcactaaagaagtgattcctaagcatgtgtctgttaaggaggctgttcttccattcgagaaattccaagggtgcgacattcttcttggaccagagatgcgcagcactggagaggtgatgggcatcgactatgagttctccggtgcctttgcaaaagcacagattgccgctgggcagaagctccccttaagtggcactgtgttccttagcctgaacgatttgacgaaacgacatcttgctgagattgggagtggattccgggagcttggcttcagcatcattgccacatctggaacagccaaagttctccagctcgagggcgttccagtggagccggtgctaaaaatacatgaggggcgaccgaatgccagggatatgctgaagaatggtcagatacagatcatggtgataacaagctctggtgatgctcttgactccaaagacggtctccagcttcgtaggcttgccctcgcctacaaggtgccaattatcacaaccgtcgacggcgcacgtgcctccatagatgccatcaagagcttgaaggacaagtcgattgagatcctcgccttgcaagattacttccagactgccgatgcttcggcagatttacaagcagcggcacagaccaccccttagtgctgtcttccttttccatgtactgtgatcctagctcgagccaaaacaacatcccatatgaattattttgtttacggttgcacctgcagcatgcatggcgcaaggacaggcatccagatcgtatcggtgacaagcatagctagacagaattggtattgggcgaatgtagttgtactctgtaatgttagttagggtgatgagcatccacaataaggcttcccaactgcgattttgatgactatcatattctttgtggagatttacattgtatcattgtcgcatacgaaactgtgcgacatacatgtaccgtatgcatgttatcagattcttagatgaccacacattggcacacccgtctctcgtctcgtgttctttcactgtgtgctctacaattgtacaaacaaacgattgtgtcaaggattaattaatgggtagcactgtacaacgtttaagtgttctgtgctgcggggcagtgtcacatgatgtgtgctaaagttattattctcataaagttctgacttcgttgtagagtacagtatgaattgatgaatgagaataagtttacataacccctgatcttagagtagggatgaaaatggattgataacccctgatcttagagtaggggtgaaaatggacgaaaacagataaatagtaggccatcctctatcctatcct

SEQ ID NO: 18716 - DNA, 765 bp, Zea mays
gcccccccgccgggacacctcaagctcaaaacccaaaatcgaccttgtcgacccggatccgagctaggcacccgcacgaccacccgcctcctgccggtcaccgggacctagcatcgccgggcggcggcgggggaggggaaggtaggcgatgaggaaacgtgagcgggagaacccgtgcgggatctgcgggcactaccacaagtacgaggagggggaggtatgcggggtgtgcggccaccgctggaaaccgtcggacggggagggcgccccgtcgaggcacgagtccgccttccccacagaggtgctcaaggacttcctcttcctcgggagctacgacaacgcctcacgctccgaggtcctcagaacgctcagtatctcccacatccttaatgtacgtattcaagccctattttctagatgatccacatccccttccttgtttgtgattattaaatccggcgtcttcaaagctggagatcgattccccgtccaaatagaactaaagaagctggtgagcgatagcagtacagtaccgctggcgctatctagggtttggcattttatgaccatccatggtctattcaggacagtttggtcaatctatagcttgtcatcttctacaggatagaccacagactattaatttgtactgctgttgcttgaaaggttacatttgtaggtttagtttatggcgaacagaacgaggatgtggtttttgtacaggcttggtatttatttgctcaagtggaaagcgggttcaagtga

SEQ ID NO: 18717 - DNA, 3563 bp, Zea mays
  misc_feature (3263)..(3263): n is a, c, g, or t
cacacgcgtccgattgaagattaattactatgtttagtatttgcttaacagactgtgcctgattgccacaatctgtacaagaattcattcacatatcacagtcttcaacgggacaggcctttggattttgatgaggcaaaccaatatctagagaaatgtgaaagagataaatcgcgtgttcttgttcattgcatgactggaaaaaacaggtctgctgctattgttgcagccttcttgatgaagtctagagggtggagacttgcacaatcttttcaatgggtgaaagatcgaagaccacaggttcaactgacagatggttagcttcataccctttgaagcttgttgactaattaagacaccgtctctattacattatgaatcattggttccttgcctatcaaatgttaacattttttctcacctgaattgacagcagtctactctatatacacagtgaataagcactgctaaactactttgtttagtttattgtgtagttcgtatctctgttagcaatttttcagagactagattaatacattatgaatgaatatagcagctttcacgtccccttaccccccacgccgcacaccaaaaaaaaaggaaaaggaaaaagaacacacatagtacataaactttgactctgcacagtcttttcaatgggtgaaagaccgaagacccaggttcaactgacagatgcttctcagaaggagcttttggagtatgagctgaagcttttcggacccagtactcaaaccttggttcccactgaatcatttgcttctcttggatttggttatacaaaaccagcaggtgacatgcaaacgcctgtgttcaaccaaacgaccatgccatccatattcgagcgattcaacccaaatgatcgccccgccaatttcacttttggagttgagaggaaagcagaagctaaccctcgagataacaatagtgatggcagggtaaacccaacttcaacggagaacctgatggacagctcttaagatgatttcacgatgtcgctgttcaatctccttgttccagaagtaaacccgctgtaatctgcatgtcgcggaagtaaacctactgctcggtgcctcggtgcaccgaatacttatccggtgtctaggtttcagggaggttttgcccttgtcggatgagaaatggttctctggaaaccgatctttgctttagaatgactgtatgaaatagatgtttgtggctcatctatctgttcctttctcgtatagtttctgattgctattatatggataaggcatagtgcttactgcttaccagtcgggtcgtttatttggtcatgtatatatgtagtcgtccgtaaaaggagaggagagatttttcaggtcggcagctggtggtgacgtgatgagttttagatctttagtccgatgcaacaggagattaagaatctagattatcgcctttttagttcgaaggtttgagaattaacgacagattgataaggtaaacagttatttatttatttattttagtttgtgaacccaactgagtcaattttagagacctttagtcaggtgcattttactctttttactttctcaatatgatgtgtagactactctagaatttctacggatacaatcacgagcgatgtacctgacaatcatgacagagagcgtcatagcaatgtacctgacgagtgatgtagtcatgtacctggacgcgatcgtcgaccaactggacaaactcaggatgatctatctgtatatggatcaactttaggtcttgtttgaatacgtatctatccataaatatattatattcacaatagattaagagattaaggtggatacacaagcaaatcctacacgcatcaaaatattatatccacacgcgtatatagtaactagtgcaagtctccatcctctagacttcatcaagcagtatgactttcacacacaactggagtacaagtggaagctgacgcaccgcaggccgcacaaggatccgcaagcatcgaccatggagatccgctcgacgtcgcttgtcacaccgccggtacagccccacgaggtcctgcaagaagcaagatccacacagatcaggaaactcagaagacgaacaccaaagagaatgcagaccacagcatctggtgtctcttccctgccatcatctactcatctcccaacttataacctcaaagaagacaaggacgagtcccctgatccgaacttaccactcttcctgcctattcgtttggcattggcacacaacattgtcgtcagagaaaccacggctgctggtcggcaaggtctaagaacgtggtagttcatcttcctccaaaagtcaagcacgtacttctctagattaagttacgtactgtatattatctgcatcatttttagtatctgttgagatatcaatcttaactactactacatgattgagaaagaatataatggacaacttcctaagtttggtctgcttgtaatgctacttctgctaccaataatgtaataagtacttcttttctttatttctcagtgcttaatgccatttgaatttcactctttagcaccagcaattatgccgtcctatataaatgcgttagtcatatgattactaaggtactcacagtgatggttttcattccccaaagagaagtcctacgactacagctgcgattgcgcaagatctcttgatcttggaactctcgttgttagatttgatacaaccatacaagtatcatttgtatttatttaattaaataaatttgagtgagccctctcgcaccctcagggttagtttgaaaactcaaatccccatctgagaattgagaaggaaaattagttcatttctccttcaatctcctctaattccaaataaaatttaagtttttcaaactagccctcagagtcattcggggccatcaggagtagccgttggaggttcggagttctttaggaccgatgagggatttcggctcatcggtgcgttcttgtcaatcggtgtccgttcgacacctttggggtttttggggaccgtctaggactgtcgggtccgttagacactgtcgtagcgtaccgttgtattgatcatgtccgttctatatgaatagactttttgccacttggaccgattaatagattagttaatagctaaactaatatagatataatggagatacaatgtacatgataatgagtgtgcaatatagtgactactctatttttagtcttcctataacttctactactatatctaactcttacgacacgagcacnagatagaatacaacagtacaaagtcacctctcacttctcggttgggttaaatccgaatcttctggttctggtcctctgcgcgtatggagtgtggaaagagaagaactcacgaatcgacaccggatgtatgggtggttaggtttttggagagcatcgcgaccacttgctgatcattgtcttcttacgggtgccattttagatcatcttctttcccttcatcttagtggacattcgagggatagtagtatggtactataaacatctggccgtgtcgattgtggtctactatttcaaacaaca

SEQ ID NO: 18718 - DNA, 1390 bp, Zea mays
agaatccgtgtcaaagcctcaaagcgtggaaagctatccgtacgattggataacgaggcggtcccacctcccacggacatccccgtccccaccgatttgtttgtcaccactcggcactcgtcactcatcagctattcttctcttctcctggacaactcaagctcaaaacccaaaatcgaccttgtcgacccggatccgagctaggcacccgcacgaccacccgcctcctgccggtcaccgggacctagcatcgccgggcggcggcgggggaggggaaggtaggcgatgaggaaacgtgagcgggagaatccgtgcgggatctgcgggcactaccacaagtacgaggagggggaggtatgcggggtgtgcggccaccgctggaaaccgtcggacggggagggcgccccgtcgaggcacgagtccgccttccccacagaggtgctcaaggacttcctcttcctcgggagctacgacaacgcctcacgctccgaggtcctcaggacgctcagtatctcccacatccttaatactgtgcctgattgccacaatctgtacaagaattcattcacatatcacagtcttcaacgggacaggcctttggattttgatgaggcaaaccagtatctagagaaatgtgaaagagataaatcgcgtgttcttgttcattgcatgactggaaaaaacaggtctgctgctattgttgcagccttcttgatgaagtctagagggtggagacttgcacagtcttttcaatgggtgaaagaccgaagaccacaggttcaactgacagatgcttctcagaaggagcttttggagtatgagctgaagcttttcggacccagtactcaaaccttggttcccactgaatcatttgcttctcttggatttggttatacaaaaccagcaggtgacatgcaaacgcctgtgttcaaccaaacgaccatgccatccatattcgagcgattcaacccaaatgatcgccccgccaatttcacttttggagttgagaggaaagcagaagctaaccctcgagataacaatagtgatggcagggtaaacccaacttcaatggagaacctgatggacagctcttaagatgatttcacgatgtcgctgttcaatctccttgttccagaagtacacccgctgtaatctgcatgtcgcgggagtaaacctactgctcggtgcctcggtgcaccgaatacttatccggtgtctaggtttcagggaggttttgccttgtcgcttgagaaatggttctctggaaaccgatctttgctttagaatgactctatgaaatagatgtttgtggctcatctatctgttcccaaaaaaaaaaaaaaaaaaaaaaaaaaaaaaaaaaaaaaaaaaaaaaaaaaaaaaaaaaaaa

SEQ ID NO: 18719 - DNA, 1377 bp, Zea mays
atcagctattcttctcttctcctggacaactcaagctcaaaacccaaaatcgaccttgtcgacccggatccgagctaggcacccgcacgaccacccgcctcctgccggtcaccgggacctagcatcgccgggcggcggcgggggaggggaaggtaggcgatgaggaaacgtgagcgggagaatccgtgcgggatctgcgggcactaccacaagtacgaggagggggaggtatgcggggtgtgcggccaccgctggaaaccgtcggacggggagggcgccccgtcgaggcacgagtccgccttccccacagaggtgctcaaggacttcctcttcctcgggagctacgacaacgcctcacgctccgaggtcctcaggacgctcagtatctcccacatccttaatactgtgcctgattgccacaatctgtacaagaattcattcacatgtcacagtcttcaacgggacaggcctttggattttgatgaggcaaaccaatatctagagaaatgtgaaagagataaatcgcgtgttcttgttcattgcatgactggaaaaaacaggtctgctgctattgttgcagccttcttgatgaagtctagagggtggagacttgcacagtcttttcaatgggtgaaagaccgaagaccacaggttcaactgacagatgcttctcagaaggagcttttggagtatgagctgaagcttttcggacccagtactcaaaccttggttcccactgaatcatttgcttctcttggatttggttatacaaaaccagcaggtgacatgcaaacgcctgtgttcaaccaaacgaccatgccatccatattcgagcgattcaacccaaatgatcgccccgccaatttcacttttggagttgagaggaaagcagaagctaaccctcgagataacaatagtgatggcagggtaaacccaacttcaatggagaacctgatggacagctcttaagatgatttcacgatgtcgctgtaatctgcatgtcgcggaagtaaacctgctcggcagcatgtcgcggaagtaaacctgctcggtgccgcggtgcaccgaatacttatccggtgtttaggtttcagggaggttttgccttgtcgcgtgagaaatggttctctggaaaccgatctttgctttagaatgactgtgtgaaatagatgtttgtggctcatctatctgttcctttctcgtatagtttctgcttgctatatatgaataaggcatagtgcttaccactcaccagtcgggtcgtttgtttggtcatgtatatatactagaacatgaggcgcccgcaagggcgccctattggaacgacatagaatcagtaaaatgctaacagttgaagcaaaaaaaaaaaaaaaagaa

SEQ ID NO: 18720 - DNA, 2345 bp, Zea mays
ggatgattaggcgcacgtctcttgtattcctattcctcctggtagacgcggtttttgagcctgccgtctgccgactcgcgagacccagcctgaccgacgcggacggaggacgacgaacgctgaagcctgcaatgatgatagaggtgagccgataaaaatcacgaggcgcgccactcgccaaggagaggaggacgacgacggaccccctcgctggcgtaaatcacgtgaatccactgtagcgtacccatcggctgcccccgtccccgtctttgcaaaaggaaggaggaaacaaaagcggaggaagaaaacgacaccagagaacgaggtggaaaggtgaggccgttccctcagccgtaggcgagcccatccagcaaagcagtggcccgacgcggcagcgagctcggcaacggaacaacccgacgccacacacacacgcctgctgttcccgtgcacgcatgcaggtgtcaggtgatgtgccgcggctaccgcaggagttaagaacccgaccgcaccccgtgggcgacgaaaaaacgccgcagcggcactgcggtagcagcatcgcgcggcaagctcacctcatccctctttcaccccacctctgcaattgcaagcaaagctccggcctccggatcaggatcacactgaccaccgcgagcgcgtgccggcgtccagtggttacgtcgagggagcctaggctagcgaggaacaagcagccaccagcccgccacgatgctcgtgaggagcgcctccacgccggtcctcggcgcgctgcacccttccggctgccactcgccggcggtctcctccccggccgtgcacttcgccgagtcgccggcgtcggccgcctaccacgcgccgcccatctcctgccacctggccgggcccgggtccgggtccgaccacgagcgctcgcgcagccgcggcgccggcgccggcatgcgccgcacgtgctccgaggacaacctcgcgtctctggccggcggccgcgcggacgaccacgaccaccaccaccttctcctcccgccgtccggcaagggcgcgccacgggcgcggccggtgccgctcgagaccatccagtcgttcaggggcccgcatgcgtccaccgacgacgaagaggaggaagacgacgacgacgaagacgcgtacgaggtggagcgggagctgcgcttcggccagttcagctttgccggcggcgcctactcgcaggagcacccgctgttcctggccaggggcctcggcatcgaccgcctcggctcgggcctcctcagcgccgacggcggcggcgggttcggcggcagcgacggcagcgggagcggcggcggcggcgggaatttggtgacgtcggggaacggaggggaccgctccggcatcgagacgcactacaagaagatgatcgaggaggacccctgcaacggcctctttctcaggaactacgcacagttcctgtaccaggcaagcagcagcagcagcagcatctccttctcgccttctaccgtcaatttggagttttggacgacgcgcagatctcgtatacaaaatttttaattcttcttctgacggcggcacctacctgcgctgcgcattggattggatctcaggtgaaaggggactacaggagggcagacgagtactactcccgcgcgatcctcgccgaccccgacgacggcgagctcctgtcggagtacgccaagctggtctgggaggtgcaccgcgacgaggaccgcgcctccagctacttcgagcgggcggccaaggcgtccccgcagaacagccacgtgctcgccgcgcacgccgcgttcctgtgggacacggacgacgaggagggcggcgccgacgcgctcagctacgcggccttcgctcagccggcgcactcgtctctggcttcggcgacggcaacaacctgaactctctcgccatctcacgagtctcgagagcggttcctccgcagtcgaaatggagcgtgacagtggcctctgctcgtctctgtctgtagtagcataccaataatactactcgcgaactctctttctgagcaaacagattccatagcgccgtgtagccacgcgatgattttgcgagcgagttcgtctactagtactacacagacacaggctcaatcggttcaaaaccgatacatgctggtggctgtcgcctgtcgcattgcattggattatctctctccccgcgcttctacatatgcgttgaacctggcaagtgcggtgacattgttcacctgcatgatttttcactcgatatgcgatttggagggcgtgaatatgctatgcccgcaaaggtcgatccagtgcaccgactgttatatcagttatcgaccgcacaaccaatca

SEQ ID NO: 18721 - DNA, 1943 bp, Zea mays
tgcatgcctgcagaagcaacgtatgatgagtcgatgacccacaaggccacaacgtgtcagttatatatgtgctcgagtcgaaattttagccttcgttcaaccgcgtttacctgattggacacgtggttagccgacgtctctttccccatctgcgcaactacgggttttttctgcaatttagtacagcagaaacgggctaactggtaattccaaaccatgggttgcccggtccaacactgcacgcttcagagagagcgacgaggctcgaatcgaaccaacggaatgctgttactttcaagccccaacgtgagacggcatcgccggcagtacatgcctttttttttctcctaactatatattaacgtcccacgttgctatcgtcccgaaagacaatggattaagatgcacgcggatgcaggcaacgtagactacgttgttttgtggtttgtgtccagccggcagctgatggccacaccgtcttgaacaaatcatacatatacagaaaaagaagaagaagaaaaaagaaacagggcgaaacagcgtcccgacttctaatggagtataaaaaaccaatggtgctttcagtacgtccttcgatagctggacagtggcttcgatatcttcaagaccgttatagcaaccatcagcggtccggtcagggccaaattaactgggaactgatggctgttagaacttttgctgcaggcgtccatcgattgcgacgtcgagttgtatccattgccagtttcggtttcttaaccacacgatttgcgtgatcatgaccgcatgtccgcatcacagatttcacaacgccgggttttatttgcgctgggaaactggaaactggagttggctggagagtaacactgggccaaacaatttcgggtccaataaagcccaactcgagatttatttgcgcttcgtgagccgcggcatcagagggaggatttcagccattcaggagggccaccgtacgcagcgagaccagccagcaggctgcgatgttcgcgacggcggtgcggtgggcggcgaagaaggggaagcccaagatggcgccgatcgagctgacggcgccgccggagcaggcgcagtccatcacgcgcgccatcttcgacgccgtccgggagcacggcccgctcaccgtctccgacgtctgggaccacgtcaaggtacaagtagcacaacaacatccaccccccccccccccccgccccttcggccagcgcgcgcgtccacgccccgtgaatctgttcgacggaatgcctcaccggatacctcgacaaaccctcgttcaaggatgccatcttggactggactcccggcggcgcgtccttgctcggttgcatgtgtcctctaacaagcaagcggctgagactaatctctgctttcatcctcaggatgtcgggcttcgaggtctggcaagcaagaggcagatgaagatcatgctgcggtggatgagggagcgccagaagctaaagctcatctgcgaccacgacggcccgcacaagcagttcctctacaccacctggtttaccaaccccaggaacgcgccgcagaggcccaatccgaagcccaatgtcaaagcggataagctccccaccttcccttccccttcgaagcaactgtgacgaggacttgtttctgtgctctctgcacttgtttctgctgcccccgacataatgttcagcatggaaacaaatgctagatttgttcaggcgaatttaggcttgttatggctatattgttctatgcaaacacctaattgttgtctatgcatatataaaccatattatttgagatgtataacctaaggttgttccctgaggattaaagccagctgtttggacggctccagctgcaattcatagaaacaaaaatattgtagaaacattataaacctgtacggattaaagtcaagcgaataaccaaaaaaaaaaaaaaaa

SEQ ID NO: 18722 - DNA, 793 bp, Zea mays
actcgagatttattcgcgctgcgcctccggcccggccgagaggatttcagccattcaggagggccaccgtacgcagcgagaccagccagcaggcggcgatgttcgcgacggcggtgcggtgggcggcgaagaaggggaagcccaagatggcgccgatcgagctgacggcgccgccggagcaggcgcagtccatcacgcgcgccatcttcgacgccgtccgggagcacggcccgctcaccgtctccgacgtctgggaccacgtcaaggatgtcgggcttcgaggtctggcaagcaagaggcagatgaagatcatgctgcggtggatgagggagcgccagaagctaaagctcatctgcgaccacgacggcccgcacaagcagttcctctacaccacctggtttaccaaccccaggaacgcgccgcagaggcccaatccgaagcccaatgtcaaagcggataagctccccaccttcccttccccttcgaagcaactgtgacgaggacttgtttctgtgctctctgcacttgtttctgctgcccccgacataatgttcagcatggaaacaaatgctagatttgttcaggcgaatttaggcttgttatggctatattgttctatgcaaacacctaattgttgtctatgcatatataaaccatattatttgagatgtataacctaaggttgattccctgaggattaaagccagctgtttggacggctacagctgcaattcatagaaacaaaaatattgtagaaacattataaacctgtacggattaaagtcaagcgaat

SEQ ID NO: 18723 - DNA, 793 bp, Zea mays
  misc_feature (674)..(674): n is a, c, g, or t
  misc_feature (763)..(763): n is a, c, g, or t
agaaaagtgaacgagctctcagtctctcagactctcacacactctagctgctgctctctcccactgtctcgccgtcttgctcaaacgcagtgcccggtggtctggtcggtcgctctctcgacccatgggagttggccggggttcctgctccagccactgaagacgcggcggcggctcctgctcatggcaggagctcaatgcgccacagggccgcgcgccgcgccgctcctcctcgtcctcgtcctcgtcctgtgcggcttccttgtgctgctcgtgcctacgtctcggcgcggggacgacgacgagacagaggagttccccgtcgcgtcttccgcttcgtcgtcgtcgtggcactggcacgccgctgatgggcgccgccgtgccctgccgcggccggccgccgcgacgtggccgtggcgccccgcccagccccgggcgcgcgggaggtggaactccgcggggcaggacggcaagcacgaggtccccagtggccccaacccggactccaatcggtagccgtagccagagaggtgggtggtcgtgaactccgatccgccgtctgtgtttgtttcggcgaacggcgaccaagctccctccctgtcccctgctcctgctcctggaggccggtcgtctagctaggcctggccgtcgtatcgctcctccatgcttcttgntgctccgtgctggagccagtacgtgcgtcgtttgcttgctgtgttgtatcttcttcttcgccgttctcttcgttagagaatgaacatgnccatcatctgacgcaaaaaaaaaaaaaaaa

SEQ ID NO: 18724 - DNA, 1737 bp, Zea mays
gctcgctccctcccctccctcccttcctcctttcccacccttctctctctctagccgccgtgctctccttttctatctccacggcaggcttctccctccctccccctcatccccattgcctttgggaggctatatagggcgggactggactggattggattggaaagggagctcccggcgagtttgaacccaccccaccccacttttctcgcctcgtcccctcgcgcttcccgccgccgacgccgcgtctatctggtctaggaccaaatgccgcgagatcttcgcgcgtgacgccgtcccccccgccggagccgccctccgagctccgggccacggagcgcttcgtcccggatctctctggtggctcaggacagtagaaaggaaaggagaaaagcttgttgtgtctgtgtgtgagctgcagaccccgagaggatggatcagtatgaggtgctggagcagattgggaaaggagcatttggttctgcactcttggtgaggcacaaggccgagaagaagaagtatgtgctcaagaagatacggctcgcgcggcagaccgaccgcacacgccggtctgcccaccaggagatgcagctcatcgcgacggtccggaatccgttcattgtggagtacaaagattcatgggtggaaaagggttgctacgtttgcattgtcatcggttactgcgagggaggagacatggctgaagctatcaaaaaagtcaatggaaaccatttctcggaggagaaactttgcaagtggcttgtgcaacttctcatggctctcgattatctgcacgcaaatcacattcttcatcgggatgtgaagtgctccaatatatttattgccagagatcaaagcatacgccttggtgactttggtcttgcgaaaatattgacttcggatgatcttgcatcctctgggggaggaacaccaagctacatgtgcccagaacttcttgccgacataccgtatggtactaaatctgatatttggtctctaggatgttgtatttatgaaatggcagctctcagaccagcatttaaagcctttgacatgcaagccctcattagcaagatcacaaagtcgatagtatcgccgttgcccacgagatattctggttcctttaggggactcatcaagagcatgctacggaaaagcccagaacaccgaccaagcgctgcagaactgctgaagcacccacacctccagccatacgtgctgcaggtccagctgaagtccagcccctctcgcaccacgtccccaatctaccaagctctgacggacaaagtgaagaagatgacgttcgtgagcgacaccgccgattccgcgaggaggagggctgcgagacggagctctctggggagcgagaggaccgtgacgttctgcaagccatcccccgagcgcaactccgtcagctccacgcggagcatcaaggagtacacgacgacgacccagagtgccagggagctctctgtcggcagcagcctgcaggtcgacgacgaggtcacgagtaaggccgttgtgacgaagacggcaggcgttctacggactcccagcaagagccgtgctccggcatctaagacgttggtggcggctagaagccggctggatcctccgaagacgtcctatgccagaacgaaccgtgccgagttggactcaaggacgcctctgagcaagagcagcgcgcggacggcaaggagagcatccctcccgctggcggcgtacagagcacccagc

SEQ ID NO: 18725 - DNA, 1224 bp, Zea mays
actcgctacacatgcgcaccttggcacctcgcccctcgcagagtcgcagtctacagcagccgcgcaacctttgccgcgccctgcacaccggagtccaggcggcgcccggcccagccctcatgaatctggccgccttttcctccacccttgccacgctcccctggtatgagatgccatcaataaattcctccgcaactttctcgtcctcactgctccgccgctcgctctgcgcgtcgctccggacgatctcccacatggcctccgccgccgcccccacctccgcgcccgtcgccaccaccgagaacggcgccgcgaaggcgatagagcagcggcccgtgcaggtcgcagagcggctggaaaagttcaagacaacaattttcactcagatgagcatgcttgccatcaagcatggagcaataaaccttggccagggctttccgaattttgatggcccagactttgtgaaagaggccgcaattcaagctatcaatgctgggaagaatcagtacgcaagagggtttggtgtgcctgaactgaactcggctatcgctgaaaggttcctgaaggacagtggattgcaagttgaccctgacaaggaagtcactgttacatctggatgcactgaggcaatagctgcaaccatactaggtctgatcaatcctggcgacgaggtgatactgttcgccccattctacgattcatacgaggctacactgtcgatggccggtgccaacgtgaaggccattaccctccgcgctccagatttcgcggtcccgcttgaggagctggaggctgcagtctccaaggacacgaaagcgataatgataaacacgccgcacaacccaaccgggaaaatgttcaccagggaggagctcgaatccatcgccgccctctgcaaggaaaacgacgttttgctgttctcagatgaggtctatgacaagctggtgtttgaggctgaccacatatccatggcttctatcccgggcatgtacgagaggacggtgaccatgaactctctggggaagacgttctctcttacaggatggaagatcgggtgggcaatcgcgccgccgcacctgacatggggcctcaggcaggcgcactcgttcctgacgttcgccacctgcacaccgatgcaggcggcggccgcggcggctctgagggcaccggacagctactacgacgagctgaagagggactacagcgcgaagaaggctatcgtgc

SEQ ID NO: 18726 - DNA, 1103 bp, Zea mays
  misc_feature (916)..(918): n is a, c, g, or t
  misc_feature (983)..(983): n is a, c, g, or t
  misc_feature (1032)..(1032): n is a, c, g, or t
cctcgaggccggccgggccaccagcggtcaatttcgacgcctggagtcaaccggccgagtcgtccacctacgccttcacagttcacacgcgcggcggcggcggcggcggtggagcgggtgatgagggaagtggcgtgaaccaccgaatctcgcggtcgcggagcgggcgtcgcgggcgaacgagccccggtctctctcttctctgcgcgcaacctttccaaggaactcctctgatgctacagtaataatagaagaaagatggacctgctcagcatcattctagttatagcatctctgctcccattcgcagcatctgatggtcaaggtgatgccttgtacgatatgaagctgaaactaaatgctactggcagtcagctttctgactggaaccaaaatcaagtcaacccatgcacctggaattctgttatttgtgacaacaacaaccatgttgtgcaagtaacattggcttctatggggtttactggagttctgtcaccaagaatcggagatctggagtatttaaatgttctgtccttgcctggtaacaacatctctggtggcataccagaagaatttggcaacctctctcgattgacaagcttagatttggaagacaacctgttggttgggccaataccagcttcacttggcaggctttcaaagctccagcttctgatactaagtcaaaacaatctcaatggctctattcctgatacactagcaagcattttaagcttgacagacattcggctggcttacaataaactcactggtcaaataccttcccagctgtttcaagttgcacgttacaatttttcaggtaataacttgacctgtggagcaaacttcctccatccatgtgcctcaatttggtcttaccaaggtttcttcccgtggttcgacaataggcattgtnnncttggacagttggaggtcttatggggcttctaatcatatgggctgtattcattatctgcaacggnaaggaggaaaggccatctacgcgaaattatttttgtggatgtatcaagntgagggattgatcgtagaattgcatttttggccagttgaaaagaatttgcatgggcgagattgcaacttgc

SEQ ID NO: 18727 - DNA, 1876 bp, Zea mays
  misc_feature (14)..(14): n is a, c, g, or t
  misc_feature (23)..(23): n is a, c, g, or t
agcaccaccagcgntcaatttcnacgcctggagtcaaccggccgagtcgtccacctacgccttcacagttcacacgcgcggcggcggcggcggcggtggagcgggtgatgagggaagtggcgtgaaccaccgaatctcgcggtcgcggagcgggcgtcgcgggcgaacgagccccggtctctctcttctctgcgcgcaacctttccaaggaactcctctgatgctacagtaataatagaagaaagatggacctgctcagcatcattctagttatagcatctctgctcccattcgcagcatctgatggtcaaggtgatgccttgtacgatatgaagctgaaactaaatgtcggctccccgtcggcggccggactggaaccaaaatcaagtcaacccatgcacctggaattctgttatttgtgacaacaacaaccatgttgtgcaagtaacattggcttctatggggtttactggagttctgtcaccaagaatcggagatctggagtatttaaatgttctgtccttgcctggtaacaacatctctggtggcataccagaagaatttggcaacctctctcgattgacaagcttagatttggaagacaacctgttggttgggccaataccagcttcacttggcaggctttcaaagctccagcttctgatactaagtcaaaacaatctcaatggctctattcctgacacactagcaagcattttaagcttgacagacattcggctggcttacaataaactcactggtcaaataccttcccagctgtttcaagttgcacgttataatttttcaggtaataacttgacctgtggagcaaacttcctccatccatgtgcctcaaatatgtcttaccaaggttcttcccgtggttcgacaataggcattgtgcttgggacagttggaggtcttatggggcttctaatcatatgggctgtattcattatctgcaatggaaggaggaaaagccatctacgtgaaatatttgtggatgtatcaggtgaggatgatcgtagaattgcatttggccagttgaaaagatttgcatggcgagaattgcaacttgcaacagataatttcagtgagaaaaatgttcttggacaagggggttttgggaaagtatataaaggagcacttccagatggcactaagattgctgtaaaacggttaactgattacgaaagtccaggtggagaggctgctttcttgcgtgaggttgagctaattagtgttgcagttcaccggaatcttttaagattgattggtttctgtacaacacaaacagagcgcctacttgtttatcctttcatgcaaaatcttagtgtggcctaccgactacgagaatttaaacctggggagccaatattagactggtctgcaaggaagcgagtggctataggcacagctcgtggactggagtatttgcacgagcactgcaatcctaagattatacatcgtgacgtcaaggctgccaatgtcttgcttgatgaaggttttgaaccggtggttggggatttcggcctggccaagctggtggacgtgcagaagacgtccgtgactacccaggtccgtggaaccatgggtcacatcgcccccgaatacctgtccactgggaagtcctccgagagaaccgatgtttttggctatggcataatgcttcttgagctagtcactggtcagcgtgccatcgacttttcacgtctggaggaagaagatgacgtgttgttacttgaccatgtcaagaagctgcagagggaagggcatctcgacgccatcgttgaccgcaacttgaacagctgttacaacgggccaggaggtggagatgatgatccagatcgcgctgctctgcacgcaggcgtccccc

SEQ ID NO: 18728 - DNA, 2297 bp, Zea mays
gccggccgttttcaaaacggcccgggccctggtccgcccctcctgctgctacccctcaatctccccgcaccgcgcctcacctcccccagctcctcctcttcctctaattgctacacgctttcgaggctagggttgcctcgtcctcctcgctgtccacatggcgcgaatcctcatgcggctcctcctcctcgccgcggcggcggcggtggcggcgggggacggctgcctcaactccggctgcgtcgcgctgggctcctacctcgtcgcccggaaccagaacctcacctacatcgccagcctcttcggcatcggcgactaccacgcgctggcgcgctacaaccccggcaccacaaacctggactacccccgggccggccagagcgtcaacatctccttcacctgcggctgccacacgttccccaactcggacgccacctacctcggcggctccttcccgcacaaggttgtcaccggcgacacctacggcggcatcgcccagaactacaacaacctcacctccgccgcctggcttgccgtcaccaacccgtatcccacgaacaacatccccgacaccaacaccgtggtgaacgtcacggtcaactgcacctgcggggacccgaagatctcgtcggactacgggttcttcctcacctacccgctcatgggccagaccctcgccgccgtcgccgccaactacagcttcaactcgtcgtcgcagttggacctgctccgcaagtataaccccggcatggacaccgctacatccgggctcgttttcatccccgtcaaagatggcaatggaagttaccatcctttaaaaccaccaggaaacggaggttctataggagctatagtaggaggagttgttggtggtgttgctattctggtcctgggcgtcttgttatatatcatgttctataggcgaaaaaaggcaaacaaggctgccttacttccatcttctgaagattctacccaacttgctactacatccatggataaatctgccttgtcaaccagtcaagctgatagtagctctggagttccaggaattactgttgataaatcagtagagttctcgtatgaagaactttttaatgccacagagggatttagcatgagtaacaaaatcgggcaaggtggttttggtgctgtctattatgctgagctcaggggcgagaaagctgccataaagaaaatggatatgcaggcttctcacgagttccttgctgagttaaaagttttgacacatgttcatcatttgaatctggtgcgcttgattggtttttgcaccgaaagttccttgtttcttgtctatgagttcatcgagaatgggaacttaagccagcatttgcgcggaactggttatgagcctctgtcttgggctgccagggttcagattgcactagattcagcaagaggtcttgagtacattcatgaacatactgtcccagtgtacatacatcgggacatcaaatcagcaaatatcttgatagacaagaactaccgtgcaaaggtcgcagattttggtttaacaaaacttacagaagttggtaatacatcactacccacacgtggaatcgtgggcacatttggttacatgcctcctgaatatgctcggtacggtgatgtttctccaaaggtcgatgtttatgcctttggcgttgtcctctacgaacttatttcggccaaagacgccattgtcagatcaaccgagtcttccagtgattcaaagggattggtttatctgtttgaggaggctctcaacacaccggatcccaaggaaggccttcaaagactgattgatccggcgctcggcgaggattaccccatcgactcgatcctcaagatgacggtcctggcaagggcgtgcacgcaggaagaccccaaggcaaggcccacgatgagatccatagtggtggcgctgatgacgctgtcgtcaaccagcgagttctgggacatgaacgcgatccaggagaaccaaggtgtcgtgaacctcatgtccgggagatgactcctgtccctgtgggctgtggtatatattattgtacgtcctacctgccttcccctgggcaattgtacattagggctcatttgtacggcccgttgacggccagagaggagggccactgtaggtatttacaatgtaatatcttgtcactcaagggttttctcccgtgtttaggctccctttggaacaaaaaggaaatttcctgaacctgtgttttttgctgtattttttaactaatttctatgaaattcttatagcattcatgtgaaaaaaaaaaaaaaaaaaaaaa

SEQ ID NO: 18729 - DNA, 1140 bp, Zea mays
gatgcgggccggatgcgttcgctcttttttcattcacgtcggccccgcctcttctccccccgacgcgcttgccgatccgcccattccgccgctaccactctcccgccgccgccgcgcgcctcagccgcccgtggcccggacatggagggcgccgccggggaggagggcgcctccacgccggcggcgagagggggagcggaggcaggggcaggggcaggggcaggtggagggatgctgaaggggaggtcctgcaagggctgcctctactactcgtcaaagctcaggtcgcgagcgcgcggccccgtctgcgtcggcgtcacccgcgcccttccccaagtttctgagcgtaaggttggaaaacttgaactggaagctatccaagaaggtcgttatcttgcagatttcagatatgcatgcattggctattcaatgtacttaaatggcaaggaaactcctacgggggtacgagataagccacgtgcccatctgcctgtttgtgctggagtcgagctgttgatagatagaaaagtcccaacaaacgttaagaaagaagctccaaaaccacgtcaatataaaccagggcatgcaggagatgatttcttaacgaaatttcagaggaatgcaggtcttgtggccagtggtgtggctaagaacctgaatagagttgggacctacatcaaagacactgtcagtgatatgatgcagcctcaccgcaagcgtcccaaataaaacataggcctgtctctcctaaatcctgtatggaagtaaacattagaaattagatgatcggggaacatcggatcaatcacttcctcccatacacacccagcgcagcagtagcttagctttctgttggtttcagaaactctagagaattgagagaagatctatggttaggaaaaatagccacttgaaacatgttatccactagctcatggggcttcgattccccctgtctcgccccattttgggagccattgttgttttcactaggcccctcctccggcaatgtacaggatggcaccatgtaatgaaacatcaaaacaaccacgttccgccccttctgacaataataacgtggtgccgttgagaggtccaaaaaaaaaaaaaaaaatttaaaaaaaaaaaaaaaaaaaaaaa

SEQ ID NO: 18730 - DNA, 825 bp, Zea mays
agctcgagggccgcccctttttttttttttttggtcataaaagactgtcctttgtatagggagactggactcaaatagttaaaaatagtatcaattaaattcatgtcactcaaataaacacgaccatcatcaaggccgttttttttttttttgtgttcatcatcaaaacactcacactcagttaataagacttttttattcatgccactcaaataaacaaccttctttctttgaccacgcaacgctcaaaataaatgagtgccaaatttgtaacagcaaaggtaacaaaataaacatgtccaatgttcgccaggagccatgcaactgactcttttctgaagtggagtgactacatccatgccgacaatagattagctcaccgcgcgggggctgaggctgccgtgctatgggcccgccggtggtgtagagtggagggacttcaccagctcgactttctcggctgacaaggcgcgccggaacgcgcgctccacgccaccggcctgcaggatcctcacgcccaagctccagaaaaagctctccagagaagagaagagaagggagatctaatgccttgcataaagaagaggaggaagatccggtgcttgcgcgaagaagaggaggcagccgtgcgcgaggaagctccggtgcttcactgagcacgcaggtgcgagggagtgctcgtgctcagcgaaatcaccgtgcggcgaaatcaccggtagggattgggccggatcctcccgggatctcaggttgctaaaagagctcgattagagatgtattgagatcccggccgccctcttggatcccaatcgccctataggagtc

SEQ ID NO: 18731 - DNA, 1253 bp, Zea mays
cattgggtacctcgagccggccgggccggccttcgccgcatagatcccagcggcccccgtcctcagcgtcccccgcctttgccgtccctctatctaaagtcgccgacgacgacccagtgaaaagtccacagccttttccaagaggaagggatgggctgctgcagcagccggagctccgattcgccggccagccgcgtgacgcggtggcgctccacagggatcgtggcgctccgagacgccagattgaaggaagtgccaaatgaagttctacaagtgggcaattccttgagaactctggatttgaccaataacaagctagttgagattccccaggaaattggtacacttgcgaacatgcaaaggcttgttttggctggtaatttgattgaaatcatcccagctaacattggatacctgcggaatcttaaaatcctcacacttgaccgaaataggatatctatcttgcctgaagaattgggttcactgtcaaaccttcagcaactttctgttcctcaaaattttttactgtgcctgcctaagagcataggagatttgcgcaatatgtcagtactcaatgtatctgataacaaactaaaggaacttccagaatcaattggaggttgcagttccctggaagaatttcaagccaatggaaatgctattgaagatgtgccagcgtcaatttgcaacctagtttgcctgaaatccttatcactgaacggcaacaaaattcgtcagcttccacaaaacttactgaaagactgcacggctcttcagagtttatccctgcacgacaacccaatcacaatggaccagttccaacaaatggatggatttggagagtttgaggcgcgcagaaggaagaaattcgacaagcagattgattcaggggtcatgatgggctcgacggctctggatgaaggggttgatttccactgattttagaactcgagtgtctcccattctttctagttggtcaggagtcaggaccgattgtagatttgtagatatcagtctcacaacctacaaagcagggttcaccaaaccggttgtaaggtgaaaaccggcgcccagtgaaaactggtaaaaaccggccgaaatcaaaatcaccccacttttcaatttgaaacggtttgaaaaaaaataaatcaggctcctaggctgattaaccggcgtcatagaagcagaaggcgagctatatgtatttttgcaaataaagcacattgagatctcataaaaaaaaaaaaaaaaaa

SEQ ID NO: 18732 - DNA, 1712 bp, Zea mays
gggagatccaacgcgcgctccaagattaggcaaggaagcggaagcgaggcgcccgtcatgctctgcctcagcctggtcgcgccaccaccgatggcccccgccggccggcggcggcggcggcggcatccgacttctgtgacccgccgcggccaaaccctcgccgccctcccgtgccactgtggacggcggcacgtcatcggtgcctcctcggctgccgctctccttcctttcctcgcccctccttctctggccgctccgcccgtcgaccccgacgtggtgctccagcgagtgcacccgtcgaggccggactggtatgaggagttctatgcctcggccatggaccagggaatgaaatcatacgaagcagagatcgcaggatacaaagtaaagctcttctctcaactgtcgcctgcgggaaagaacattctcgagctcggtgttgggacagggcctaacttcaaatactatgcaagtgaagatggggttaatgtgatcggagtggaccctaacaagcacatggagaagtatgcaagggctgctgttgtgtctgctggactcgcgtcgtcgagcttcacattcaggagaggggttgctgaagccttgccggcagaagacaattccatggatgtggtggtcggcacactggtgctgtgctctgtaaacaacatcgacatggcactgagagaaataaagcgagtcctaaagcccggtggtctctacgtgttcattgaacatgttgccgcaccagatggtacgttgctccgcttggttcaaggtgcgcttgatcccttgcagcaattggtagcggacggatgccacctcaccaggagaaccggacagagcatccgagatgctgggttctcgagtctgagcctggacggtgtccgactgtcgaacgcctacatcattagccctcatgtttatggcgtagcctgcaagtgaggtaccagtccctaaatcctcattggcaaagtccttcgacgagttgtctatatcttatttagcacttcggcttggtatctttgtctttgtaattggcgaaaaagaaatcgggaatggactataggaatacaagtacttcaaagaaaatgggaaggaagtgcttttgccttctaaaaggaaacaattacatatggcagacaacagacaacagataataacacaaaacttgagacattgttaaaactatatatgtggttatggtcggactctgaccattgatgtctcacggcagttcctcatgatgccaatgagttgaagagctttaaacagcaagggcggagaaactaaaatgtaatttcaatcaccgctcacagatcctcagcatcctgtttagatgatttggggtgcccttcatactctaacttcacccctaagcttgcagtgatgaccctgaatttcagctttatcttctccatcacgtcttgaatttgttcattctccggatcggacagcggatagctgcccaccagtgcagtcagttgctcgatattcttcctgacccgagctgtgaaggcattctgatcaatgagaattgcagacgtccacacatccagacagccctgaaagaaacccagttcttcaccgacctggaaaccaatctttaaaccaacctgcctcccctcttcctattccagatgccaaaccatcattatagccatttctgtacccctcctggtaatgtgtctcatctaagagtacaggggtacgag

SEQ ID NO: 18733 - DNA, 1113 bp, Zea mays
gcacgagaccattacctagaacatcctaatcgaaaagaggaggaagaaggggcagcagcatttacaaggcgaggagagttgcgctcctcaagtcacggcagcaggccctcacttgacttcaatcctgcgcagaagagcagaagtctgcggcccctccgttcctccagctccagaccatgccttgcgccgccaccgagctcgtccatggcgagggaggcacggtcaaggtaggcacaacgggcaccatcggctcgctcatgacaagggagctggactccaccaaggtggcggcgccgcaggcagccgcggccgcggccgcgggcgccccaccgctgaggcgccaaggcggcccggtctcggtgccgtgtggcgccaccactccccggaagctcatgctgaggaagagctcgtccgacgtctccagcagcagcaacagcaacagaaccggccgcgtgggcaccgtagaggcgtgcaagccgaggagggcctcgcggacgaacaccttcgactcaccgatgctgcggcccgacggcggcgcgctggtggaccgggccccgagcgccggcagggcgaagaagaaggggacgagcgtgggcgtgcacggcggcggggtccaggtggtggacgtcaagtgcggcaacccgatgagcatgagcagccggctcaggaagctcggcttctccaagctgtcgcagacgtttgcgtagcttcaattctgtgcagtggagcttggcgagggcaaaggaccagcgccagcatctgaattgaagggtctgcttgctgctgccctttccttgagggcgtcttcggcttcggaggacatctgccatgtgctggatttagtgcagcaatcattcactaacagtgtgtgagtgtccattcggtccggccttgtgggctgccatccagttcgcatctagctgtagtcgctttttctagctgttttttctccactatgtggaaactgctgttgcgctctgtgtatggatgatgtgttcgactgtaggtgcaagagcaccttgattagatcttctatttttttatctgctttataatatataaacagttataggagggtaaaaaaaaaaaaaaaaaatgcgagcccaacacaat

SEQ ID NO: 18734 - DNA, 1225 bp, Zea mays
tgcagcagcgagaggaggcgggagcgggggtttagggtttggtcctgcgattctctctcttccccctcgctagagtgttttccgcgtcgacctgaccaaaatacccctaggcctccgcagtccgcacacccctcctgtgctttgagattcgcgcgtcgcgcctgccgacctcgtgcctcccgcggactcgccggcgaacgcctcttggagatgccgcccgccgcggcggcgctcctccggtgcgctccggcggtcccattcgcggcccgcagtagcgctgtttcccgctcaggcatggcgcggcgtctggtggcagcgagcgctgcggccggcaggctggcaccggcgtaccgcgggctgctgctcgacgccggtggcacgctgctgcaggttgcgcggccggtagccgagacgtatgcctccatcggccgacgttacggtgtgacgaagactaagaagagaatcatggaggggttcaagcgggcattctccgcgccatggccgaagacactcaggtaccagggagatgggcggccattctggagaattgtcgtggcagaagcgaccgactgcactgatggtgattatttcgaagaagtgtatcagtattatgcgcatggagatgcttggcgattgcctactggagcagacgcagcactgcgtgagctgaaggatgctggagttaagctcgctgttgtatctaacttcgataccaggctacggaaattgcttaaagaccttaatgtctccgagatgtttgatgccattgtggtgtcatccgaggtcggatatgagaaaccttccccagagatcttcaatatagcattggatcaaattggcgtggaagccagcaaggcaatccatgttggagacgatgaaactgcagacatggcaggtgccaatgctacaggacttgagtgctggctgtggggtaaggatgtgacgacgttttcggaaatacaggagcggattctgacaacagatgatcctcaatgagtgaatttggaatgttgcaaaaaatgatagttgtttcttttttccctcagttccttctttttggtttccttccaactcgtgtgttggcattttcattgtgctttcgtgaaataagctcatgccatggctaggtactgatgttccttcacattcttctcacatatgagcatttaataagaagcacaaggactcttgataattggtaaaaaaaaaaaaaaaaaaaaaaaaa

SEQ ID NO: 18735 - DNA, 2508 bp, Zea mays
  misc_feature (131)..(131): n is a, c, g, or t
cacgctgctccgtctccatctccaaatctcaaattacctatcctctccgtcgattcggtaccccgagccccgccgggccacggcctacgagccggaatgaccacatcagccgccgacgatggcagctcttntggcgcctaccatcaccgagggagaaaccacagccgacgccggtgctggggcaggtgttgagtgcgtcgagggcaaagagatgaaggttggggccgcggctccagttgaggagccggataaggaggtggcgcgggaggaggatcctggtgatgatgatgactatgaggaggaggaggaggaggaggaggagacggaaactgcgaatgggaaagaggctgagttgatggagccattggcggcgctgaagcctggggaggaggtcaaacctgaaaagctagagggggagaaggaagagctggatgaggagcccgaggcatcggaagaggaccccgaggaggtggaagagttgaaggaggagggcgacggtattgcggaggaaggcttggtggatgggtcggaggcgaacgatgataaagatgctgatcaattgagcagtgggagtgatagtggtggaagcagaagtcgtggtatgcagaactctgaacttgctggaggtcttgaaatatttgttgatgacttgcctcaagattgtgtcgaggaagacattgctatggccttttctcaatcaggggaggtcaaatctgttaggataattaaaaattcatcaactggaaagaaccaagacattgcatttgtttgttacacaagtattgaagctgcaaagaaggttcttgctgaatttaaggagggaattgaggtaaaaggaaaaatggtcagggtatctgcttgtcaagataataataccctttacctggggaacatttgcaagggttggaccagagatcaggtgttgaacaccctaaaaagtattggaattcaagagtgtgagataagctttcccagttacaagggaggaagccgagggtttgcttttcttaagttcacctcacattactatgctagagcagcacttcgtcgcttaatgaaatccgatgctatttttggtactgatagaagcgctaaagtatccttttatcgaacccccacaaaatcatccaagagacttatacaggcaaaaatagtatacctggaacatgtccctctttcttgggatgaaaataaagttaaggaatactgtgaagaatatggggagatcctgaaagctgatgttttccagatatcaaagaatatggaaaatgaaacaatttcttttgttgaattctcatccaggaagggtgcgttagcttgtgtgacaggaataaacaaagcaaatattgttgatggaagcttcaagttgtgtgcatatcttgcttggccaaaaagtgcttcaaaggtcaatagtgctgcaccttcaaatgctgccaccgcaaccgagaaggacaaaacccacacagagaagattcttgtagacatcgatttgcaacataaattccagaaaggcgacaagagcaaacttacatctcagacaaaggaggcaattatgaagaagaaaaaatcaagtaaattaccaaatgacaatgatacaaaactaacctcacaaggtgctgccgaagtaccacaaacctccaaatcttctgaaggcaagaggaaagttggaaaaaacaaacatgcctctgtataccaaaaaccattgaagaaagcaataaataatcgtaacgttgatgagagccagctaactcatcggagtgctgcagtactgcaaacgtctaacacttccaaagggaaaaggaaagccagtgagaacagaagtttatatttaaacgaaaaggctctcaagaaagcacgtggcaatagtaatttgggtggaagttcaagatctaaatcatatgcctctgatctggaacctcatgctggattcatttcgcctgcgattcgagataatggcagtgatgcatataatcgacagagaactgcacggtatgatatccatcctatagatgtccatccttatgctagagcgccatcatcagcctactctggttacaaaagccatgctggctatgaggctgcaaatacatatgaatacgcagggaaccgggcgcctacacctccaagtggatcttacatccctcgaagaggacattactaacaaaaaatggagtgctggctctgtgcatccattcgatcgcatggtaacaaggaatcaaggatctccgtatttagatgtttcatacatgttatgtagcagttaaaaagtaacttgtttaaggaaaataaggaccctctgcagctttccctttgactgaagtgcagcccggcacaccggttgcttgttgaagaatgcttttttattattattgtagttaagagtccagacgtcgttattaccacttatcgtcgtattggaaaaaatgtctttttcttaaaaaaaaaaaaaaaaaaaatggccccgactagttctctcctcgtgccgaattcctgcagcccggggatcca

SEQ ID NO: 18736 - DNA, 3872 bp, Zea mays
  misc_feature (3691)..(3691): n is a, c, g, or t
ctcgagcaataaccgtccgatggttacggatcgctaccccactaaaatggaacgcccaagcgcgtgctccggcccggcgcattgaccacaaaccgtcgccggccacgccggcatcgtcacgcacaccaccggtcgcgtcccgcaccaccggcagcccgtggcgtgcccaggcctcacattttagtgcgcgccgtggcgaccgggccccatcgttcaccgaaccggtgcttctccgtgcatatatatataagcgcgcgaccccggccgggcggcatcacagcacagcagtgcgccgtcattcattcatcgctgccatggcttcccctgtcctgctcgtcgccgcgctctgctgtctctgcgcgctgctcggagcggcgggggagccggcgaggggagcggcggcggaagcgtcggcactccgcagcaaggcggccacggaccccaacatggaggtgaagttcgacttcacgccgttcctgatccagtacaagagcggccgcgtgcaccggttcatgggcacgtcgttcgtcccggcgtccgtggacccgcgcaccggggtggcctccagggacgtggtcgtggaccacgggactggcctcgcggtgcggctgtaccggccgagccgccaagccgtcgccgccggcgtcggcggcaggctccccgtgctggtgtacttccacggcggcgcgttcgtggtggagtcggcgttcgaccccgtgtaccacggctacctgaacgcgctgacggccaaggccggggtcatcgcggtgtcggtgaactaccgcctggcgccggagcacccgctcccggcggcgtacgaggacgcgtgggcggcgctggcgtgggtggtggcgaacgcgaacgcgcgacgcggcggggccggggccggggccggggacccctggctgtccaggcacggcgacgcgtcccgcctgttcctcgccggcgacagcgccggcggcaacatcgcgcagaacctggcgatgcgcgcggcggggcagcagcagaggatcagggggctggcgctgctggacccctacttcctggggcggtacgtgggcggggtcgcggcgcgcgcgtgggacttcatctgcgcgggaaggtacgggatggaccacccgtacgtggacccgatggcgctgccggcggaggtgctgcggcggctgccgtcgccgcgcgtgctgatgacggtgtcggagcaggaccggctcggccccttccagcgcgcgtacgtggacgcgctccggggcagcgggtggcgcgggcgggcgcggctgtacgtgacgcccggcgagggccactgctacttcctcaacaacctcgcctcgcccaaggccgccatgcacatggccacgctcgccgcgttcatcaacggcagctgatagcttgtcggcagcgtggtagtgctgctcacccgatcgatcagccagccctctgtacgtagctatagtggtctgtctatctcactggtgagtggagacatctgtaaccaccataccgtatactgtattttgtcagtggccgcccgagagagaggtgtttagcatgcatgttatgtaatgtaatactacgcgcacgtttttgttcaaaaaaaaaaaaaaaaagtgacatgtaattttcccacttctgccgggtacggacgtcggtttcactggagcttggaaacgggaagggggaggctactgttggcatccaagactcgttgctcgaactagtagaggcaggaccgcaggaggcggaatagccccagccgcgccgaccggcacttgaagtgtgctgtgtcctctcggtccgcggcagaaatgacgcgccaacagcgagcgtcccctcccgcctgatcagcggcagaaatgactgtgcgcctttcgtcgtgacctcccggccgatcgacggagaggagagctcggctccgcagcagcagtcggctctgtttgagctcggcagcagacgcgtcatggcctcatggtcatgggtactgctgcctagtaaacttggggcctggaatggaagctgggcgcacgcactgtcgaggtggaggcatagtagattattatggaccatcgaacgtgtgtcacggcatgcatttcggacaggacatagactatgctactcaccaccaagtagtagtaatgctgtagcatcatgacccatttctgcactaaatggtgctggcttttaatcggatggcacgcgcacttgacacttgtagggtattcatacagccttttgaaaccgagatcactgcactcgctcaggttgtgccgtggtggtttgtggacgtcgcgctcgctctctcgctcgctctagcacagctttaccgctgccactacgcatgctcgccccgttgacagttcagattattatggttctagtggtagtggctctgactcctgatcttgcttatcgcatcccactgatggaaaactgagtggaagcagaagctgctgtgtgaactgtagaaaacgtcatcgccggacaagtaacgcaactgtcctctctccctccacagactcgtgaatcgcttccaagaacgtgacgttctttcccgtgaattttggtatcgtgttcatgtggcgcctgattggttcatgattgcgtatcgaatccgaagctggcgaggcagttgccagttgccacagccccgtgccagtgccagtgccagggccacgctctggaccagcggatgatttttttttttttagtttttactgccaataacaaagagagggctctcctgctcgtacggccgaaaagcaacgctcgcgctcttgtcgctcttcccgatccggacgggcgaggtcgacttcgacttctcgccgttcctcatccgctacaagagcggccgcgtgcgcccctccctcatggccacgtccagggatggaggacgccgtcgacgccggagccggcctcgccgcgcggctctacatacccagcgacgtcctccgcacgcccgagaagctgcccctcctggtctggtctacttccacggcggcgccttcgcagtccactcggccttctccggcgcgcgctcccgctttctgacttctgagcgcgctcgtggcggctgcccgcgtggtggccgtgtccgcggactaccgcctcgcgccttcatcaatcctctggctttgccggcggaggagtgggcgaccaccccttcatcaatcctctggctttgccggcggaggagtgggcgaggctcggctgccggcgtgctctggtgaccgtggccgagctcgacacgatgagggacaggggccggcggtacgtcgacgcgctgaggcctgagggggagcgcgtgggccggggaggaggctgttctgtacgagaaccagggcgagacgagggacacgtctacttcatcgacaaaatcagtggcgacggcgacaaggacaaggcggagatggcggccgtcgtgtccttcatccagcagagcggctaggtagtactgtagtaggataggatccatctgtgtcgtgtcgttctcgttcatcaagccaagggtttcgtgcttggattacgcattcccatttctccaaagtgttgtggacaactaaataatgattacatgcccgattggaaactaaagaattaaaaaaaaaacaaaaaaaaaaaaaaaatttgatgtatgcaaatgtatctgatacaaccaagccaattaatataactgtacaatcaagacacataaatggtnctcgggacaggctgttgttccgcactttcagtccaagcacaacaagagcaggctaggccgttataggcttcatatctactagagatagcaatggaaacctgactccgatttctcgtggaaatttctctattatgacttttaggaaccccattttttcgagtaaaattaatttattttccct

SEQ ID NO: 18737 - DNA, 523 bp, Zea mays
atgctgggtggatctcgccgaggacataagagatggcggagggagaaacatgccgccgacatgggatacttggctgcgtggtcgttcgggtggcgtgtggtggtcggagatcttcttcgaagcacgctggagcaaagggtaccctcggcgggcgcgattggtggtctgaggggcaggacttcctcaccggagctactctaccacagcggggccgcaatacatagagcacggagatcctggcatcgggtcgccatgtcgttgctcaccggtgtatccaggccatgaaggacgaccgccgttgtagtgcttcgccaagggagagtggcatgggggagatgatggcgggcaccgtcggatctaatttatgcgatcaggattagatagggggtgtacccccttcatggttgggtttgggccgtccgatccaaatcggtcggatgaaaagtgatcttagtattttaaaatctggaccgttggatcgtgatccagtggtcaaatattgatatcaaaaaaaaaaaaaaaa

SEQ ID NO: 18738 - DNA, 655 bp, Zea mays
agcttaaccgacccgaaccctcggcgcatttctcagacacccttctttctctgtttcctcttcatctcgctctcggtctcggttccatccggcctccgatccccagcagcaagaatcagcggccgcggcggcgatggtgtgcgctaagtgcgagaagaagctcgggaaggtgatcgtgcctgacaagtggaaggagggcgccagcaacaccaacgagagcggcggccgcaagatcaacgagaacaaactcctatccaagaagaacaggtggactccatatggaaacaccaaatgcataatctgcaagcaacaggtgcaccaggacgcaaaatattgccacacctgtgcttattcaaaaggagtgtgcgcaatgtgtgggaagcaagtgttggacacgaaactctacaagcaaagcaatgtgtgatcatagctttactaaactgctaataacttgtatgaaatcttgtactcgcaatacaatcaagctattgacaatagttaacagaaattatgtacttgactaacaattctggaatggaacacaaaatgtctccaaaattaaagctctacggactttatgctaaaaaaaaaaaaaaaaaaaaaaaaaaaaacaaacaaaaaaaaaaacccaaaaaaaaaaaaaaaagggccccta

SEQ ID NO: 18739 - DNA, 636 bp, Zea mays
atggaaaaggcttgataagcatttttgggcctggcctctgccagacaccgaggtccgcttcctcctctgtttccccttcctctcaagctccatccagcctcagatcctgaaccgcaagaacagcaagaatcagcggcgcccgcgatggtgtgcgctaagtgcgagaagaagctcgggaaggtgatcgtgcctgacaagtggaaggagggcgccagcaacaccaacgagagcggcggccgcaagatcaacgagaacaagctcctctccaagaagaacaggtggactccgtacggaaacaccaaatgtataatctgcaagcaacaggtgcaccaggacgcaaaatattgccacacctgtgcttattcaaaaggagtgtgcgcaatgtgtgggaagcaagtgttggacacgaagctctacaagcaaagcaacgtgtgatcttagctgcactaaactgctaatgacttgtatgaaatcttgtactctcaatacattcaagctgtcaacactcaacagtagttgtgtcttaacagacagtatgtacttgactagattctggaacataaagtggctcaaaaatgaaagttccagtggcattatgtgagcgagaaagcgtgttgcatcgaggcccctagggcc

SEQ ID NO: 18740 - DNA, 1576 bp, Zea mays
tcctttcgtaaaatctccggggtccagacaacgctactccttccgccgcgggttttcgcctcgcggccgcgccagccctcctcttccggcggctcctcggccctcgcggaactcgccacatcccccattgcccccgtcgcccgttcgctccccgtccgaattatttactcaaatcattcatcgccggcccgtcccactcccacctccccaagcaacctgaccacgccaccccgcgaggtccgcgataccgtccaaatccacgcgataacaaccaggccgtcccccttccttccttccctcccgtatatagctagcgaggggcgtggcaatggttcttcagctccgcctgatcccgcgcctggctgccgcagccaggttgacgcccgcgacttcctgcgctccccggctgctcctgcggcgcgcgccgttaccaccggccctcgcgatggcgtcggcgtacagcgccggttacggcgcgggcaggaggctgctattcaggcagctgttcgagaaggagagctccacgtacacctacctcctcgccgacgtcgccgaccccgacaggcccgccgtgctgattgaccctgtcgacagaacagttgacagagatcttaatcttatcaaggaattgggcttaaagctcgtgtttgctatgaatactcatgtacatgctgatcacgtcactggaacaggactaataaaaactaagctacctggagttaagtctgttatttcaaaagctagtggagcaaaagctgatcattttgttgatcatggggacaaaatacactttggtaaccttttccttgaggtgcgagctactccaggccatacctctggctgtgtgacttatgttacaggtgatgctgatgggcaaccttcaccaaggatggcttttactggtgatgccttaattatccgggcatgtggaaggactgacttccagggaggaagttctgagcagttgtatcagtcagtgcattcacagattttcacattgccaaaggatacactactttatcctgctcatgactataaaggtttcacggtaagtactgttgaagaggaggctgcctataatgctcgactcacgaaagataaggaaactttcaagacgatcatgaataacttgaatttgtcatatccaaagatgatggatgtagctgtacctgccaatttggtctgcggtatccaggatccaccaccgaagatctgagctgttcccgtggaagcctgcaactgcacttctggttgtttatgaactctggatcgccaccagaggcttgcagctgagttgttcattaaataatttgtttgctgcatcctgtgatatcgcgagaaaataatctaaccaatggccggtgtagcctctggttgtatgtggcaaagcactattgtttagagagatcaaaaggaacaatgctgatagtcaatgaagtttgattgcctgacaacatctctagaaatacttcgctaaccgcaatcatgttatttggatgttctttttaaaacggtgaaaggatgttcttttttttaaaaaaaatagtgaaaacaacagcaagctgtctgtttcttc

SEQ ID NO: 18741 - DNA, 4026 bp, Zea mays
aaatcaacccttgaaggatgaccaatcctgctttcgtagaactaatctatccaactctcacccgaaagggatcccatcagagcaaggacgtcgtcagattgccctagatcagtcagtaagcctagagcattgtccttgattatcggatcaagcgacaaacaactagctagggttagaagggcaaaagagaggtagttgattgatttttgttcgattggatgttgaatacgtcaatggattatgatcctcttaagccttgggccttagagagtagagaccacgcaagggtgcaggtgtactagctagtgttcacttgctattaagttacatgcatgcaaccgaaattagaatggagggggtgattggttttgatgtgacttgtgatcatgtttgctcacctgtatctgtatgataagggatggagttcacagatatatagcagaatcaatgtcgatatatgtcatctgtaaagagtaagcagtccagtttctggggtgctctgggaattccggattgcccccagactgcagcaacgttctgctgagcctgtttcggtcgtccgctatcccagcgaaacactacaacatgtttattctcctctgttgctggcagctttggaagcgcagaaatgctgtagtgttccgtggggaaagatcccctcttgcggctaccatgctgttgtgccgctctgaagccggattttggaggtccaggctgcggcacgaggaccaccagatcatggctgcctggtgttgtgttttgcatgtaacgtagcgttaccacatcgatgtaatctatatcctcccttgttgtactgtcaataggcgatttggccgcaaaaagcaatgcaatttaggtgggaattctatcccccggtgatattaaaaataaagtaagcagtacgtagttaaataaatgggccgtgttgatgggacatgcatgcaattgtgtgtttagaaccagctggagttgcttgagtttccatacagctgaccattcatgtttcgatcattgtgtgtgtgttggttgagttggaagttaagtgtaggtctgcaaaaggttggaagttttgggttgagactaatgaatgcctgcccaaattgcgcggcactaagcgtccatccaactagctaggagggcgatcgagaaaaagaggagtacgttacgtggggtggtagggactaggctgctgtctcttgaacacgatgtgccaccaaccagccataccatgctacctcatctatattgaacgaaagagctgaaggctcttacagcaaaatcagctagcatgacccgacaaggagatgatcaaaggcagctagctagctagctaggtggagaaaattgtggaaagaaagttcagtggggactgacagcagtgtcgtgtcctcctgacttgcgaggagaaaagagaagaggaacacgatttaagtgcgcatatttatttatatacatgttttggatgttttcttttggctcgatcagaaattgatcgtcgatatggtgcgaaggagataaggtgatgcatgtagaagaacatgcctcagcctctagcctctacttggtttatctttctatttcttcttttacgaagagaaaagaaagaaagaaattgatgtagagatatgtggactgatatatatgctctgaaactgacccaacccaaggtgcagtgatggatgtggacgcctcacctgtcgcctccactagactctctttcaactttccaagctaagtgttgttccctgtagggttagctggggcacaagttagttaaaagcgctctccccctctctctctatatatgtatgtattagcactatatgctaataggcaggatatatatataatataattgctagtgctggctgcagtttatatatcgaccaatgcaagaatgaatatatatataggttgtagatgatcttcttggttcagctgttgttgcacgcatgattatttctctgctgatgaacaaaagtatagactgctgactgcagtttgggatcaggaggatgaaagaatcacagtcggatgcatgtcacatggtatgataagagagaggacgaaatgatatgattatcgatggaccaacgacggtgcatgatgaataaaaccacaaggaattgaattattgatggatatgcatgggggccgggggtcatcagtctgaatttcattcatcagctagcggaagcttgtaatttcagcgacaagcagctagctagcgcacaaataagtcgatagtcagcttgaaataaagatgcttcatctatgagctagctatgtgccgtacgtacgtacgtgctttaattttacttccgctggcttgtgaatgatcagcgtcctttttggaggccaagtcttgagaaagaccgtactgaatccatccttccttcacgccaaaacccaaatgtaggccggactcaatatacaaaccaatatatatatatatatatatatatatatatatatatatagccaataattaatattcttctaatagtataaagttagtagcttaattagaatgtctgcctgccagtgccagtggcaggcttataaacactaggggcccccgcggccggccgcggctttcctctctgctagctagctcttgtcttgtcactgagtgagcagaaggagtgtgtggtggagtgcaaaccaaatcaaacgaagaaaagtgggagcgaggaggaagaaaagaagaagaagaagacgacgacgacacccaccaccagcagcaagcagcaatcagcaaccagcataacgaaatgtcgatcaagtactgcgaccagcacaaggactgcgagcggcagcgtctgtaccgtcgcttctgcgccgccctggtgggcgtcatcgtgctcgtcctcctcatcgtgctcatcgtctggctcgtcctccgccccaccaagcctcgcttcttcctcaacgacgtgagcatcgtgtgcatcaacgtcagctccgcctcctacctcaccgtcaccatgcaggccacgctggcgtcgcgcaacaccaacgaccgcgtcggcatctactacgaccgcgccgacgtgtacgccgagtaccgggcgatgcagatcacggtgcccaccgcgctgccgcccttcttccagccgcccaacgacgccgccgtctgggcgcccttcctctccgcctccaacgtcccgctgccgccctacctcgccaccgcgctcacacaggacgagacggcggggtacctgctcgtcaccatccgcgtcgacggctggatccgctggaaggccggggccttcatcaccagccactaccacctcagggtgcgctgccccgcgctgctcaccgtcaacgacggacaaggaagctacggctccaacgccggtggggggctcggctacttcaagttccagcgcgcagcaccctgcatcgtagacgtctgagatcgatctcgattcaaaaatcacattaaagaagctcggccgggatgaattgaacaagaagcccttttctttttcgtaataagatatatacatatgaatcaaataatagcttcaactctttggtttaattttgttgctttttcttcttttttttgtttggatgggaaaaaacgtagactatatatgtagcaattaatatctggaggatatgcttctagatggatggatatatgaacgaaagggccggccgccgggaaagctcagctaactttgagttacctctacttttccctatctctgtactgtagagtgtattttggatttcctcgaggtatggtgggacaaaaaaaaggactattgctttgaatctacggaattcatgagagggacaaacccacacacacacaaaatgtaagtgtacgtgttactattaagttgttgatgtaagtagacttttcactcattgtcatactagtatgatcaaattaatagctattaattatccaccatatatgattaacttacttatgtgtactccccctgatctgccatatactccatcgcctctattcttttttatttgtttaaaaataaactaacggacaaa

SEQ ID NO: 18742 - DNA, 1425 bp, Zea mays
agtgccagtgctaggcttataaacactagctcccgtcccggccggccgctgctttcctctctgctagctagctcttgtcttgtcactgagtgagcagcggggagctgtctagctagcctagtacaggtggagtggagtgtgtggtggagtgcaaaccaaatcaaacgaagaaaagtgggagcgaggaggaagaaaagaagaagaagaagacgacgacgacacccaccaccagcagcaagcagcaatcagcagaacgaaatgtcgatcaagtactgcgaccagcacaaggactgcgagcggcagcgtctgtaccgtcgcttctgcgccgccctggtgggcgtcatcgtgctcgtcctcctcatcgtgctcatcgtctggctcgtcctccgccccaccaagcctcgcttcttcctcaacgacgtgagcatcgtgtgcatcaacgtcagctccgcctcctacctcaccgtcaccatgcaggccacgctggcgtcgcgcaacaccaacgaccgcgtcggcatctactacgaccgcgccgacgtgtacgccgagtaccgggcgatgcagatcacggtgcccaccgcgctgccacccttcttccagccgcccaacgacgccgccgtctgggcgcccttcctctccgcctccaacgtcccgctgccgccctacctcgccaccgcgctcacacaggacgagacggcggggtacctgctcgtcaccatccgcgtcgacggctggatccgctggaaggccggggccttcatcaccagccactaccacctcagggtgcgctgccccgcgctgctcaccgtcaacgacggacaaggaagctacggctccaacgcaggtggggggctcggctacttcaagttccagcgggcagcaccctgcatcgtagacgtctgagatcgatctcgattcaaaaatcacattaaagaagctcggccgggatgaattgaacaagaagcccttttctttttcgtaataagatatatacatatgaatcaaataatagcttcaactctttggtttatttttgttgcttttttttcttttttttgtttggatgggaaaaaacgtagactatattgtagcaattaatatctggaggatatgcttctagatggatggatatatgaacgaaagggccggccgccgggaaagctcagctaactttgagttacctctacttttccctatctctgtactgtagagtgtattttggatttcctcgaggtatggtgggacaaaaaaaaggactattgctttgaatctacggaattcatgagagggacaaacccacacacacacaaaatgtaagtgtacgtgttactattaagttgttgatgtaagtagacttttcactcattgtcatactagtatgatcaaattaatagctattaattatccacaaaaaaaaaaaaaaaa

SEQ ID NO: 18743 - DNA, 1081 bp, Zea mays
aaatcaaacgaagaaaagtgggagcgaggaggaagaaaagaagaagaagaagacgacgacgacacccaccaccagcagcaagcagcaatcagcagaacgaaatgtcgatcaagtactgcgaccagcacaaggactgcgagcggcagcgtctgtaccgtcgcttctgcgccgccctggtgggcgtcatcgtgctcgtcctcctcatcgtgctcatcgtctggctcgtcctccgccccaccaagcctcgcttcttcctcttcccaccgcgctgccacccttcttccagccgcccaacgacgccgccgtctgggcgcccttcctctccgcctccaacgtcccgctgccgccctacctcgccaccgcgctcacacaggacgagacggcggggtacctgctcgtcaccatccgcgtcgacggctggatccgctggaaggccggggccttcatcaccagccactaccacctcagggtgcgctgccccgcgctgctcaccgtcaacgacggacaaggaagctacggctccaacgcaggtggggggctcggctacttcaagttccagcgggcagcaccctgcatcgtagacgtctgagatcgatctcgattcaaaaatcacattaaagaagctcggccgggatgaattgaacaagaagcccttttctttttcgtaataagatatatacatatgaatcaaataatagcttcaactctttggtttatttttgttgcttttttttctttttttttgtttggatgggaaaaaacgtagactatattgtagcaattaatatctggaggatatgcttctagatggatggatatatgaacgaaagggccggccgccgggaaagctcagctaactttgagttacctctacttttccctatctctgtactgtagagtgtattttggatttcctcgaggtatggtgggacaaaaaaaaggactattgctttgaatctacggaattcatgagagggacaaacccacacacacacaaaatgtaagtgtacgtgttactattaagttgttgatgtaagtagacttttcaccctaaaaaaaaaaaaaaaaatttgcggccaaa

SEQ ID NO: 18744 - DNA, 1623 bp, Zea mays
tttttttttttttttagttaaaacgatgccgtcgtcgtcgtcgcatctcttctgaccatctcgctttcgtgtgggtccagactccggacccgccccgccggcaacaaatatctctctgcacgtgctcgccgctcagccagaacagtccatcgacggtggcaatgtcacatgcaccaactccaaggtgcagtacagactcgcgagtcgcgacccgctcctctcacgcacgactcttcacgtgtagtgtattgtatatagtagaaccaaccaacagtgggacctcgagccggcgggacacacccgacagcgacaccaaccacgaggtacatcccctcctgcgctgcccgcctctccttaagatcgccgcctcgcagtcgcacagtcgcactcgctccacttccattcccagcgaccccgcccgcccggaggcgtcgcacctgcacgctgcggcagcgggcagccgccaagcctctctcgtgcggcaagcaccacacagacacccgatggcgctgctgctgctgcgcggctgcgccgcgccgccagccgtccacgcggccccggcggggtcccggctgctccctccggcgctgccgcggcggcggctcgtggccgtcgcctcttcggcctcctccgcgccgtccggcgaggtggcgtcgtcgtcccaggacggccgcggctacgggatcgtgggcgggcccaacggccacgccatcgctcccgccacagacaccaagtccaccgccgtcgagaccaccgtcgagagggtgatcttcgacttccggttcctggcactcctcgccgtcgccgggtcgctcgccggctccgtcctgtgcttcctcaatggctgtgtcttcatcaaagaggcgtaccaggtttactggtcgagctgtgtcaagggggttcatacggggcagatggtcctcaaggtcgtcgaggccatcgatgtgtatcttgctggaacagtcatgctgatatttgggatgggtctctacggcctcttcatcagcaacgctcccgccggtgttcctcctgaatccgaccgtgccctcagcggctcgtcgctgttcgggatgttcgctttgaaggaacgcccgaagtggatgaacatcacctcgcttgacgagctcaagacaaaagtggggcacgtcatcgtgatgattctacttgtgaagatgttcgagaagagcaagatggtgacgatagccacggggctggacctcctcagctactcgatctgcatcttcttgtcatcagcttctctctacatcctgcacaatcttcacaagggcgaccatgaggagtgacgagagtgaaatgccgaatttgtagcctattcgagagagagagttgacggtcttgtccaataatcaatactggatttttaagactctcttcaacggtgttctcttcataaaatataaaatgagaaatgtatgatacaatttatctaaaaaaaaaaaggaaaaaaaaaaaaaaaaaaaaagaaaaaaaaaaaaaaaaaaaaaaaaaaaataaaaaaaaaaaaaaaataaaaaaaaaaaaggggggggccgttttaaagaaccaaattttacttccgcttccttgcaaatttttagtttttttttggggccccctaaatta

SEQ ID NO: 18745 - DNA, 2080 bp, Zea mays
aaaaaatcataaaaaagtctaaaatacaaaaaaaaaacggccgtttggaatggggagccgtgggggttgttactgtgcgcgcgcgttcttgcatctgtagcccttctctgtacacacgtgctgcacgcccaatggtacaggtacacacgagctggctttgctctcgtccacggctccggcctctgtgtgggggcgcagtgtgcaatatgcatttgctggccttggtctgtccccaaaacgatgccgtcgtcttcgtcgtctcatcccttctaaccgctttcgtgtgggtccagactccggacccaccccgccggcaacaaatatctctctgcacgtgctcgccgctcagccagaacagtccatcgacggtggcaatgtcacatgcaccctcgcctgcctgcagtacagactcgcgagtcgcgacccgctcctctcagctctcacgcacgactcttcacgtgtagtgtattgtatatagtagaaccaaccaacagtgggagtgggacacacccgacagtgacaccaaccacgaggtacatcccctcctgcgctgcccgctgcccgcctctccttcagatcgccgcctcgcagtcgcacagtcgcactcgctccacttccattcccagcgaccccgcccgcccggaggcgtcgcacctgcacgctgcggcagcagccaagcctctctcgtgcggcaagcaccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcccccgcgccgtccggagaggtggcgtcgtcgtcccaggacggccgcggctacgggaccgtgggcgggcccaacggccacgccatcgctcccgccacagtcaccaagtccaccgccgtcgagaccaccgtcgagagggtacgtgtccccgtgacggcccctcaccatctgctccatccatcacccatgcccgtctgacgcgcgcggtcgctgctgctgtgctgtgctctgctctccgcaggtgatcttcgacttccggttcctggcactcctcgccgtcgccgggtcactcgccggctccgtcctgtgcttcctcaatgtaagcgacatggtcttgcatgctttgctactgccactctccacaccaaggttattattaatggatctggttatctgacgcatactcgtgaccagggctgtgtcttcatcaaagaggcgtaccaggtttactggtcgagctgtgtcaagggggttcatacggggcagatggtcctcaaggtcgtcgaggccatcggtgaggtgtttgtttgttcttgtagctgacctctgttcagccaactagcgtcgtcagttaactgttcctttgctggtacacttgtgcaagcacgatcttctgcagatgtgtatcttgctggaacagtcatgctgatatttgggatgggtctctacggcctcttcatcagcaacgctcccgccggtgttcctcctgaatccgaccgtgccctcagcggctcgtcgctgttcggaatgttcgctttgaaggtagctctcaggaatttgaaatctcaatcacttctctgcaagtaaccttttgaatcctttagcaatacgatagatcttttgttcatcatgcaggaacgcccgaagtggatgaacatcacctcgcttgacgagctcaagacaaaagtggggcacgtcatcgtgatgattctacttgtgaagatgttcgagaagagcaagatggtgacgatagccacggggctggacctcctcagctactcgatctgcatcttcttgtcatcagcttctctctacatcctgcacaatcttcacaagggcgaccatgaggagtgacgagagtgaaatgccgaatttgtagcctattcgagagagagagttgacggtcttgtccaataatcaatactggatttttaagactctcttcaacggtgttctcttcataaaatataaaatgagaaatatatgataccaatttatcgaaaaaaaaaaaaaaaaaagcggcc

SEQ ID NO: 18746 - DNA, 1131 bp, Zea mays
  misc_feature (1130)..(1130): n is a, c, g, or t
ggtaccctccggcccggccttcagatcgccgcctcgcactcgcacagtcgcactcgctccacttccattcccagcgaccccgcccgcccggaggcgtcgcacctgcacgccgcggcagcagccaagcctctctcgtctcgtgcggcaagcgccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcctccgctccgtccggcgaggtggcgtcgtcgtcccaggacggccgcggctacgggaccgtgggcgggcccaacggccacgccatcgctcccgccacagacaccaagtccaccgccgtcgagaccaccgtcgagagggtgatcttcgacttccggttcctggcactcctcgccgtcgccgggtcactcgccggctccgtcctgtgcttcctcaatggctgtgtcttcatcaaagaggcgtaccaggtttactggtcgagctgtgtcaagggggttcatacggggcagatggtcctcaaggtcgtcgaggccatcgatgtgtatcttgctggaacagtcatgctgatatttgggatgggtctctacggcctcttcatcagcaacgctcccgcgagtgttgctcctgaatccgaccgtgccctgagcggctcgtcgctgttcgggatgttcgctttgaaggaacgcccgaagtggatgaacatcacctcgcttgacgagctcaagacaaaagtggggcacgtcatcgtgatgattctacttgtgaagatgttcgagaagagcaagatggtgacgatagccacggggctggacctcctcagctactcgatctgcatcttcttgtcatcagcttctctctacatcctgcacaatcttcacaagggcgaccatgaggagtgacgagagtgaaatgccgaatttgtagcctagagagagttgatggtgttgtccaataatcaatactggatttttaagactctcttcaacggtcttctcttcataaaatataaaatgaaaaatatatgatacaatttatctaaaaaaaaaaaaaaaaatttgcggnc

SEQ ID NO: 18747 - DNA, 688 bp, Zea mays
cacggtccattcttaattagtagtaggatagggccatgtttagagctctctctctcggagatgtgaactattagctctaaacacccccttaatctgtaactatctagagcaccgtgtgatctgaagggtaagcaggtggcgtatgaagtagcaactagcaagggtagctttggatattccagacatttatgtacttgagtgaataaattctctagaaaagtttgatctacgatgtaactttacccccgcgcccgttttttttttttttttttaaaaaaaaacatgtatatggattcgtgttcaaatataaaagcttcccaagttacatgtcgatccaataaatttatgttatttcgatgcatcgagcacgcgatagctaataacagatccagtagaataagtgccagatgagatccgagcccactgttattacaataataaactttttttgagactttttatataataatttacccttgaacctgttgatcttgaacgttgaacctgttgatcttgaagtgaccgagttccacgccggcctccactgcagtcctcgcctcgccgtcgatggccatctcagctaggagcctccccactgccggccccatcttgaagccgtgcccagagaacccggccccgaccaccatgtcctccccgaattccccacccagccaatcgatcctcgtgc

SEQ ID NO: 18748 - DNA, 1633 bp, Zea mays
taaaaaaaaacatgtatatggattcgtgttcaaatataaaagctccccaagttacatgtcgatccaataaatttatgttatttcgatgcatcgagcacgcgatagctaataacagatccagtagaataagtgccagatgagatccgagcccactgttattacaataataaactttttttgagactttttatatgcacgagaccattacctagaactgcccttgcgcgttgaacctgttgatcttgaagtgaccgagttccacgccggcctccactgcagtcctcgcctcgccgtcgatggccatctcagctaggagcctccccactgccggccccatcttgaagccgtgcccagagaacccggccccgaccaccatgtcctccccgaattccccacccagccaatcgatcacgaaatccttatctggcgtcatggagcatatgcatgactgccggacgactggcgcgccggcggagtccacgtggcccggcatgaactcctggatccacctagccacccgctcggtgatttctctgtcgccggatgcccagtcgcggttgtccgggtcgcacggcggcccgccgtcgcagctgatcttgatcaggcccgggagctcaagcgaaggcgtgccgtaaacgggcgtgtcgccgtagctggagaacgtcgggaagccagccttggccatcaggccgcgctcgcgaccaggcttgatgcgccagtacagggtcagcgtgtgcagcggctggatggggatctcgacgccggcgacggacctcagaagcttgctcgtccaggcgcccaccgtcacgacgcacttggcgccgcggaactcctcgccggagctcgtcttcaccacgacgcctccctccggctccttcctgatgtccacgacctcggcgttgtccctgactacggcgcccatcttgacggcgagcgcctggaacatggccaccgacttggtcgcattcagcacgccgccgccgtgctcactcaccgcggtcaaccacccttccggtgcctggaacgcgcctccccacatctggcttagatccacctcctctgcgccagcgctcttgacggcagcgaggagcgcggcgttgccgcgcgggcccatggagaggtgcggggcaggggtgagcacgcggtacccggactccgcctccgcctccgcccacaggcggcgggcgaggcgcaccatgggcgggtactgtgccttcacataggcgtcgcggatgatgcgggagtcgccgtgcgaggagccgagctggtggagcaggtcgaagcgctccaggagcagggtgtgcgccccgcgggacgcggccgcgtgcgccgcgcagcttcccatgatgcccgcgcccacgacgatgacatcgtagcggaggcggagcccctcagcagcggcggcgtcatgagctgctccggaagcagccatgaacacgaggcggacggcactcgacactgcgattctgtggccttattatcaagagcaaatgtaatgtgtgtgagcgagagagttaaaccagttcagtaaaaatagactagtctgttgttcatgcgttgcgatgggtcacaacaatactatgtaaattattcagaaaaaagatctcaagattttttaaaaaaaaaaaaaaaa

SEQ ID NO: 18749 - DNA, 993 bp, Zea mays
  misc_feature (937)..(937): n is a, c, g, or t
  misc_feature (949)..(949): n is a, c, g, or t
caaaccgtggaactggtagtaatcttgctcttcaatccatctatcatcattagcaacaacatccgcgtccagccggcaggccgtgtgcccgtccgacgaccgggtcccgacaggagagtttaagcaggcagggcagggccgccgtggacgcgggaccgaagcagggccaccgccgctgcaccatgacgcgtctgctgctgtcgtgcctggctctgctgctggcgcgggcggccgtggcgcgggagtacgcggccgtcttcagcttcggcgactccctgtcggacaccggcaacctgtgcgtggacggcatcccggactacttggccacggcgcacgcgccgtacggcatgacctacttcggctatcccacggggcgcgtctccgacggccgcgtcgtcatcgacttcatcgcgcaggagctggggctgccgctgctgccaccgtccaaggcgaagaacgcgacgttccgccgcggcgccaacttcgccatcacgggcgccacggcgctggacatggccttcttcgaggagcacgggctggcgcgcgccgtgtggagctccggctcgctccacacccagatcgggtggttccgggacatgaagcccaacatctgcagctccccgcaagagtgccgtgagctgttccggcggtcgctgttcgtggtgggcgagttcgggggcaacgactacgggtcgaccatcttctcgttccggccgctggaggaggtgcacgcgctggtgccgcacgtggtggacgccatcgcgcggggcgtggaggagctgatcgcggagggggccgcggacctggtggtgccggggctgctccccaccggctgcttccccatgttcctgtccaccttcgtcggcaagccggccgcggcgtacgggccccgcagcgggtgcaacagggagctcagcgcgctgtcgtgggtgctcancgcggcgctgcngcgcagggtgggggagctcctttcctttctcccgttttttgttt

SEQ ID NO: 18750 - DNA, 786 bp, Zea mays
tcatgactgcgtcatgcatgccaattaattagccaccactccatcgtaaggacctgatcaaactttagtctactcgtcctcggtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccggcgcctggtggtgccgtgttgcggactccgctgcatcgtctcggtcggtcgtcgtcgttatcatgggtgtccggctgccggtggcgtggtccgccgtcctcgtcctcctcgtgcgggcggccgtggcgcgggagtacgcggccatcttcaacttcggggactccctggtggacgccggcaacctggtggtggacggcatcccggactacctggccacggcgcgcctgccctacggcatgacccacttcggctaccccaccggccgctgctccgacggccgcctcgtcgttgacttcatcgcgcaggagctgggcgtgccgctgctgccgccgtccaaggcgaagaacgcgacgttccaccgcggcgccaacttcgcgatcacgggcgccacgtcgctggacacgcccttcttcgtggagcgcgggctggggaagacggtctggaactcggggtccctgcacacgcagatccagtggttccaggacatgaagccccagctgtgcgggca

SEQ ID NO: 18751 - DNA, 1444 bp, Zea mays
gcgggcacaacatccgcgttgagccggcaggccgtgtgcccgtccgacgaccgggtcccgacaggagagtttaagcaggcagggcagggccgccgtggacgcgggaccgaagcagggccaccgccgctgcaccatgacgcgtctgctgctgtcgtgcctggctctgctgctggcgcgggcggccgtcttcagcttcggcgactccctgtcggacaccggcaacctgtgcgtggacggcatcccggactacttggccacggcgcacgcgccgtacggcatgacctacttcggctatcccacggggcgcgtctccgacggccgcgtcgtcatcgacttcatcgcgcaggagctggggctgccgctgctgccaccgtccaaggcgaagaacgcgacgttccgccgcggcgccaacttcgccatcacgggcgccacggcgctggacatggccttcttcgaggagcacgggctggcgcgcgccgtgtggagctccggctcgctccacacccagatcgggtggttccgggacatgaagcccaacatctgcagctccccgcaagagtgccgtgagctgttccggcggtcgctgttcgtggtgggcgagttcgggggcaacgactacgggtcgaccatcttctcgttccggccgctggaggaggtgcacgcgctggtgccgcacgtggtggacgccatcgcgcggggcgtggaggagctgatcgcggagggggccgcggacctggtggtgccggggctgctccccaccggctgcttccccatgttcctgtccaccttcgtcggcaagccggccgcggcgtacgggccccgcagcgggtgcaacagggagctcaacacgctgtcgtgggtgcacaacgcggcgctgcagcgctaggtggaggagctccgcgccaggcaccccgacgtgcgcatcgtctacgccgactactacacgcccgccatccggttcgtcctccacgctgaggagtacggcatgctgaggcagacgccgcgggcctgctgcggggcgccgggagtgggggagtacaacttcaacctgacgtccaagtgcggcgagccgggggcgtacgcgtgccaggacccctccaaccactggagctgggacggcgcccacctcaccgaggccgcctacggccacatcgccaagggatggctctacgggccctacgccgacccgccaatcctccacccatgaatccttctcccgtactccctccgcccgccggcgccgggacgccgggtaccgtaccgtatatacacacataccgacataagaataggcatcatcgttgtacgaatacacatgctagttaatctagtttgatttgcataagaagttagcttctgtacataacttgggatcggagtataaacttgtactattacatgttgagtaataatatacaggtcgatctctttcgacttttttttt

SEQ ID NO: 18752 - DNA, 3254 bp, Zea mays
atctatttttgtagttaaattattcgaagatataaacgttgataatatcttctataaatctagtcaaactcaagaaagtttgaccgacacgaattccatagcaacaaacatttgtggagagaggtttcgtagttaatttatagcggataaaagatgttattataaagaaaaataaagggtaaccaatgcaaaacccaagtagcatagttaacatatagagggataaaaaagtagataaacaaaaattaagatccagcatggtagttaatttctagaggataagatatactaaaacaaaattaagatgtagcttggttatgtcgtcgtgtactggtgagaaaacagaaaaaaaatcaccactttacgatgctaaccgagaagtttcgttctgagtttttacgatttgacaaaattacgatcttacttgaaggtcagtggtcagagaacgattttgacaacctttcttgtactacaggcggttgttgaagtggctggatgcatggagctcaactacaggcggacgtcgtgctcatgactgcgtcatgcatgccaattaattagccaccactccatcgaaaggacccgatcaaactttagtctaggccagttgcactcgtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccggcgcctggtggtgccgtgttgcggactccgctgcatcgcctcggtcggtcgtcgtcatatcatgggtgtccggctgccggtggcgtggtccgccgtcctcgtcctcctcgtgcgggcggccgtggcgcgggagtacgcggccatcttcaacttcggggactccctggtggacgccggcaacctggtggtggacggcatcccggactacctggccacggcgcgcctgccctacggcatgacccacttcggctaccccaccggccgctgctccgacggccgcctcgtcgttgacttcatcgcgcacgagctgggcgtgcgcgtggatacagatacacatgttgcattattctatatgctgtgctggccactcgatcgatcggtctaataaccgccgtatttgcttgcgtgtcctcctcgtcgttgacttcatcgcgcaggagctgggcgtgccgctgctgccgccgtccaaggcgaagaacgcgacgttccaccgcggcgccaacttcgcgatcacgggcgccacgtcgctggacacgcccttcttcgtggagcgcgggctggggaagacggtctggaactcggggtccctgcacacgcagatccagtggttccaggacatgaagcccaagctgtgcgggcaggagcaggagtgccgggacctgttccggcggtcgctgttcatcgtgggcgagttcggcgggaacgactacaactcgccgctgttcgcgttccggccgctggcggaggcgcacgacatggtgccgcacgtggtggagtccatcgggcggggcgtggagcggctcatcgcggagggcgccgcggagctggtggtgcccggggtgctccccatcggctgcttccccgtctacctctccatcttccgcaggcagccggccggcggctacggcgcccgcagcggctgcgtcaaggagctcaacacgctgtcgtgggtgcacaacgccgcgctgcgccgcaaggtcgaggagctccgcgccaggcaccccggcgtgcgcatcgtgtacgccgactactacacgccggccatccagttcgtcctccacgccgagaaatacggtatcttgtttataagatcacggaaattcgtccgttcccgcattcaaaaaagtatgggggacgacgacgtgcgggagcgagtaataattgaagcagaagcggccgcggcacgtcgctgggcgaatctgccttccattccatcgctggccgctcaaccggaacccaggggcgaatctgccttccattccgacgagaaatccacggtcttacgcgggcagggacgcatttctgggcgaacaaacgaatcaagcgtggcggggcggggtggttgggacggctgcgtgttggcgcggtcccgtgacctcatcgatcagcctaaaataaaaagagagcgactttgaagcgcgcgggcctctgctctgctctcgaacttgcgctccatgttctgagaagattgtttctgctgtgcgccgccgggatgctgaagcagaccccccgggcgtgctgcggcgcgccgggcgtgggcgagtacaacttcaacctgacgtccaagtgcggcgagccgggggcgtacgcgtgcccggacccctccaaccactggagctgggacggcatccacctcacggaggccgcctacggccacatcgccaggggctggctctacgggcccttcgccgacccgcccatcctcgacgccaagcacctcggctaacgtcgtccatccaccgtcttctccaacgccggccccgcccgcccagtacagactactcctccggctctgggcgccgtcgtatgtgcgtccttattaccgacctgcaaattggattggttgcttgtagtagaagtgtagagagagcgagacagagatagatgacaaacacgaaacgaaccggaaggaggacgataaggcgcgcgtgccggccggtcttctactcctctctgttcatagctgtcccatatctatcgtagtcaagaaaactgagcagggaaagaaaccgggcgatatttctgttgcaaaaaaaaaaaaaaaaaagtgtgcgtgcgtgtgcggccagctcgatctgaagtcgataggcaggtgcgtcgcgtcgtggatgaactggtccgtggacgtgatcttgtttatttttttaaggagcaggtgttgtccaaagtccatcgctaagatgtgcttaaggatctcagcccaggagactgattttaaagaccaccgtaacaataacacggcactcgagtctttgagtcctgttaaggacgaagggaatagcctaatattaaatgacattatataaaagtatctaaataagatgactctccatatgctaaaaggcacatcggaccgtccgatgcagcatgattagagctgggcattcggtctattagagtaatttggttcgatctattcgggttttttaaatttcggattctg

SEQ ID NO: 18753 - DNA, 1875 bp, Zea mays
aaaactttagtctactcgtcctcggtcctcctcttctcgcagcagccagcagaccaatcgggacaagcaaactcccccgattagtttaagcagcccgggcccggcgacgaccagctccgttccgcgcggggattcattgggtacctcgaggccggccgggagcaggcggcagcggcaagcaacgaacgcgatcgcgcgccgacgacgacgcgcggtgccggcgcctggtggtgccgtgttgcggactccgctgcatcgcctcggtcggtcgtcgtcgttatcatgggtgtccggctgccggtggcgtggtccgccgtcctcgtcctcctcgtgcgggcggccgtggcgcgggagtacgcggccatcttcaacttcggggactccctggtggacgccggcaacctggtggtggacggcatcccggactacctggccacggcgcgcctgccctacggcatgacccacttcggctaccccaccggccgctgctccgacggccgcctcgtcgttgacttcatcgcgcaggagctgggcgtgccgctgctgccgccgtccaaggcgaagaacgcgacgttccaccgcggcgccaacttcgcgatcacgggcgccacgtcgctggacacgcccttcttcgtggagcgcgggctggggaagacggtctggaactcggggtccctgcacacgcagatccagtggttccaggacatgaagcccaagctgtgcgggcaggagcaggagtgccgggacctgttccggcggtcgctgttcatcgtgggcgagttcggcgggaacgactacaactcgccgctgttcgcgttccggccgctggcggaggcgcacgacatggtgccgcacgtggtggagtccatcgggcggggcgtggagcggctgatcgcggagggcgccgcggagctggtggtgcccggggtgctccccatcggctgcttccccgtctacctctccatcttccgcaggcagccggccggcggctacggcgcccgcagcggctgcgtcaaggagctcaacacgctgtcgtgggtgcacaacgccgcgctgcgccgcaaggtcgaggagctccgcgccaggcaccccggcgtgcgcatcgtgtacgccgactactacacgccggccatccagttcgtcctccacgccgagaaatacgggatgctgaagcagacgccgcgggcgtgctgcggcgcgccgggcgtgggcgagtacaacttcaacctgacgtccaagtgcggcgagccgggggcgtacgcgtgcccggacccctccaaccactggagctgggacggcatccacctcacggaggccgcctacggccacatcgccaggggctggctctacgggcccttcgccgacccgcccatcctcgacgccaagcacctcggctaacgtcgtccatccaccgtcttctccagcgccggccccgcccgcacggccagtacagactactcctccggctctgggcgccgtcgtatgtgcgtccttattaccgacctgcaaaattggattggttgcttgtagtagaagtgtagagagagcgagacagagatagatgacaaacacgaaacgaaccggaaggaggacgataaggcgcgcgtgccggccggtcttctactcctctctgttcatagctgtcccatatcgtagtcaagaaaactgagcagggaaacaaaccgggcgatatttctgttgcatcttgctttgtttgagagtgtgcgtgcgtgtgcggccagctcgatctgaactcgataggcaggtgcgtcgcgtcgtggatgaactggtccgtggacgtgatcttgtttatttttttaaggagcaggtgttgtcaaaagtccatcgctaagatgtgcaaaaaaaaaaaaaaaa

SEQ ID NO: 18754 - DNA, 5503 bp, Zea mays
  misc_feature (792)..(792): n is a, c, g, or t
  misc_feature (2358)..(2358): n is a, c, g, or t
agcggttgaaccggcctgcactagttgaactgataatttgacattatttcaaagtttgtggtgaaatttttaggcgtagcctattcaccccactctaggctactttcgggggtctcacaaaccgatgaacgggatactgttcggtgacagagtgaatctaagaaaaactccaccctaatggcagcgacgaccatcgattaaatagagattagggtcgtgcaagacccctagacgcacccctagtaggctccaacaagatatatgggcgaacaacacaacaaatggtgtcacaacaccaaaatagaatcttaacgttgacttgttttgataaccgatgactccaaacgaatttgaagtcaggaacaattgagttggatatcttatctccttagctttcgaaccgtataaattccgacctaaacaaagttagtatgtgttctggccgtctattttagtgtgaactgttcatggaacctgagatggaatcgtagttcaatagaacatggtctccttcttgctgtgaacatcatttcttctccttcttgacatcttaagttcttaacctttcctaggtccctactggtcctctccaaggttcttaatcagcaaaacatctatgacaccaaacgtaagctctaaaacacaagtgactaagttataacgaacctaaagatttagctattgtacatgtgtttgtgttatcggtccatgcattgtatgtataggagccatatcatcatcaatgttcttgattgcataacttttatgaaggtttggtattttagaggcttnggctcaagttttaggaattaatacaagtttactttgtgcaaatatttttattggcttttattcaccccactctggttgtcacattggatccttataattatttttctaaacacataaatttatcaatttaacaaatatatgtatcacctcaatttatttttactttcaaacctcttttaatagtttctgtcgcttactattttctcaaatagaaccttttattttcttaatttatccatgcgtccaatttactcatatttatctaaaaacgttggatgaggagccaatacagagttcctattggttttgaaaaattatgagttagaggagagttttacaaagttacttttaagaagtttttttttccaagggcacttttaattttttccagaaatatccaaacagggagttcatttagaaaattactagagctattctcaggatcttaaaataggaaagagttcttcttacctccctaaattatctatctcatgtgattttcttctcaacctttaaaatcaaacaccttatcatcttaattgttaaaactatttaaactacctctctctatctctctctctgaagcagtttcatcatttgactattttttgtatatatctattaattattgaaccatgaaaaaaatcctcaaatcttataaaagtatcaagaaaaatcccagaaataggctataccatgaacaatttagaatattctaattgatgtataaatatgttttgagaacctcataacaaaacataagattcaactaacatgaatgtattcgacattaaatttgtgatgcattcttgtgttgttgtcccttatgtttttaaagtttttaaaacacacttaaacatcaattagaatgtttttggaaaattttaggttttcctaaacttttttccatttcactagagctaaactcataattttcgataggatacatggtttagtagaaatatgccactccagttttaaaaagttagaaactagttcatttttatgccactctatagtgttaaaatgaactaaccatctaagtttgcaaaagtagagtgacctatatacaatcaatccctttcaaaatatacaaatacttcatttgttttttcatatcccaatctagctctataatttattagcgtttttacaagtttagagatcttcgtggagttttagaatcttattaaacatttatcattttaactaaaaactgtaaaccacctctatgctagatagatagttaatttaaatggttttataaattgatattgtaaaatatccgagtttagagtttacataaaatcaaaccacacacataattttgagagataaaaaggcataatatattatcccaacctcacagtcaaatgagacccattcagcccaccggctacacggcccatattccgtactcgtgaacctcgtgctgacgtgctcacacagtcactccgtttagctcaaatccttatcggcgactcggcgtcggagctcacgaccacgaccgcttccacgccctcgaccccgaacccccaatcccggacgcgaccgctgaaccctagnatactccggccatctgctgccggccccggcgatcccccgccatggcctcccccgagggcacaacgtgggtcttcgactgtccccttatggacgacctcgcggtcgccgccgacttcgcggcagcccccgcgggaggatttttctgggcagcgccgccgtcgctgcagccgcaggcgccagtgcagtctgtcgttgccgcgtcggctcccaacccatggtaattgccggattacggtctcgatttgggctcggccgtggcggtggttggttggacttcgtcctcgctagtcccccccccccccggttcgttgccagcatatctgtagattctgtacgtatagtagttcgttatatggatcaatgacttgattggaattcggtgaagcggctgaactgtgggatttggaccgtgtccttggaatcgtgtttgcccaacattaatagtagaactgattatggttctttatgtttccaatttactataccagcgtcgtcctgtggaaggtgtgggctgtggactctgttggttctgccagtggagttgtgtgagaggactgaggaaatggttcacaggatgggtcagtggacctttactataagttctaagtagtatggcgtgaaaggactgttcccatcttatggtgtgcaagctggtaggtaggtgcatataggtagtctcatcaagcctagatgctttcctttgggcacacctttgtgtcatctatactcttgtcacaaaaacatattgtttattaaaacatttaataaagcattagaaactacaaacatcaataaccatcacattatttatttggaaatatgtaagttatatatgtgtagatttgtattcaaaatctgttaaacttgaaggattttaagaatttattctgtgtggccctgtggaatgtgtggatgagtcggtgtacctttactgtaataattctcggtagaacggtggaaaggattgttcacatcttatggtgctccgctggtgggtaggcaactaggcatatataaggcctgtttagtttagctttttctgactattttttctaagaatctggatgtggagaaaatctgactgtgggaagaatctgaatatcgtggggattacacgcggaggaagatgaagtggtccaaagggtcaatgatctagaaagcgatgtatttctaatatcgtgacgactcgacccgattatgcgttcatgttgattttggacggtttttaccaaaacaattcttatagaagcggactgaaaagctggggcgtttggcagtcagcaacagattttggtggccggaagttgaaaaaagcccaaacaaacagggccacaggtagtgttatggctcctcatctagcctagattgcttttgtgcacactttgtgtcatctatactccctccagtcaccattgaaaatatttagctaaaccttggaaactacaataataactgtttagggttacattatttatttgggaacttaaagttttatgtgtagatttgtatcaaaatacttgcaaaatctcgtaaattcgaagaatttaatctatagaaaaaggtggtcaaatatacgtattgaagactactccaagtcaaaggtggtcaaatattcttgactgaagatagtagtttgcagaatctgttagaaacatacaatcctcattctgcaatcaacttgtggctgctctattgttgggcctttataaggctagttactacccttgttcacagagaagaatagataaattccttttgggtcagtatattctttatgtattgatctcttggttcatccaatagtctgcagaaacaggttgcacacaagttgttgtaattgaatccttcatgattggtgtggtgtgaagaggattaccatattgtgctggggttctgacagctccattgctctttagtacatacaagctcatctttgatgttaagttggagaagttttgaggtgtttggttggctgctttaaacagttgtattgtgtgctgtctgtggtaaattcttcttctatttttccacatatatttcgttagatgtagtttgtagggttatgacttgctatttgctaagttgaaaagcaccaagtagtgattttttatatttactaattattgtcttcgatttgcttgcatagatattttgtttaccatgctatgttatttgtctttttttgcttcttattatggcgcattatcttgatatttggcatcctaagggcgtacccagtgctgtaggcttcccgcactgtgcggggtctggggaagagtatctttaaatatttggcatcctaacattggcttttattttagcagtatggaaatcagtagctctgtggactgtggtcaggaaaaagaacagccaacaaataaacgtccaaggtcagaaagtactacagaatcaagcacaaaagcatccagggagaaaattagaagggacaagctgaacgagagaggtatgttccctgattcttggaattgggtgccattttggagccagggaaaactcctaaaatggacaaaacagctatattgagtgatgctattcgtgtagtaggtgaattgcgtagtgaagcaaaaaagctcaaggattcaaatgagaatctccaagagaagattaaagagctgaaggccgagaagaatgagctgcgagacgagaagcaaaggctgaaggccgagaaggagagcctggagcagcagatcaagttcctgaatgcccggccaagcctcgtaccacaccacccagtgatcccagcctctgcgttccctgctccccaggggccagcagccgccgccaggcacaagctgatgatgcctgtgattggctaccctggattcccgatgtggcagttcatgccgccttcagatgttgacacctctgatgaccctaggtcttgtcctcctgtggcgtagaagccgtgcgaaatcctgttggaaagaggcgatgctgccttccattgattcaaatcttgatcggtccgcagtgttgttggtgtagttgattccagaactgaaggggatgttacatgtgtcggacggtgacatggggtgatctgatgacccctttgtatattatatatggtatggtataaataaattccgcgaccagaagctaatgaaaaaaaaaaaaaaaaatt

SEQ ID NO: 18755 - DNA, 4158 bp, Zea mays
  misc_feature (43)..(43): n is a, c, g, or t
cttggtttcatccaataggtctgcagaaacaggttgcacaccnaagttgttgttaattgaatccttccatgatttggtgtggtgtgaagaggattaccatattgtgctggggttctgacagctcccatttgctctttagtacatacaagctcattctttgatgttaagttggagaagttttgaggtgtttggttggctgctttaaacagttgtattgtgtgctgtctgtggtaaattcttcttctatttttccacatatatttcgttagatgtagtttgtagggttatgacttgctatttgctaagttgaaaagcaccaagtagtgattttttatatttactaattattgtcttcgatttgcttgcatagatattttgtttaccatgctatgttatttgtctttttttgcttcttattatggcgcattatcttgatatttggcatcctaagggcgtacccagtgctgtaggcttcccgcactgtgcggggtctggggaagagtatctttaaatatttggcatcctaacattggcttttattttagcagtatggaaatcagtagctctgtggactgtggtcaggaaaaagaacagccaacaaataaacggtctgtatctttattctttgtagtttgtatcgtgtattgcagccatacatttttaagtttgtgttccttttatcattgagtgtttaatattgcagtccaaggtcagaaagtactacagaatcaagcacaaaagcatccagggagaaaattagaagggacaagctgaacgagaggtatgttccctggtgagacaagacaatgattgcattttagtttgcagtttaatctttttttctcttcatattatcgtattcgtcaactaccactgtacttatgatattctttttgttagattcttggaattgggtgccattttggagccagggaaaactcctaaaatggacaaaacagctatattgagtgatgctattcgtgtagtaggtgaattgcgtagtgaagcaaaaaagctcaaggattcaaatgagaatctccaagagaagattaaagagctgaaggtctatactatttcatgtggccaagttataaatggtgctgttcagatgggaggtggcacgtgatgtgttgtttaggcacttcatactgttccattttcttgatttatgatcccctttttccatttggtcatttttttttcttatctagatttaattcatccagtcaaataacatgggaataattattagtacacctgtcattctccctccagtttgtggtttagtttattttgggttgcttgcattagcaactttatatccacataatgcgtttttttttcttaaatggttaaaccctgcagctgtataacagtatggacatttgtcaattcttttctctactgtatacacttctttgctacgtgttccataaaatatatagaggtttatgattcagcatctcatgtgctgcaaaaggctttggccttcgattttgctggttgttcatcagaaaaacatgctctccccgaagtactttccgtctgcaggccgagaagaatgagctgcgagacgagaagcaaaggctgaaggccgagaaggagagcctggagcagcagatcaagttcctgaatgcccggccaagcctcgtaccacaccacccagtgatcccagcctctgcgttccctgctccccaggggccagcagccgccgccaggcacaagctgatgatgcctgtgattggctaccctggattcccgatgtggcagttcatgccgccttcagatgttgacacctctgatgaccctaggtcttgtcctcctgtggcgtagaagccgtgcgaaatcctgttggaaagaggcgatgctgccttccattgattcaaatcttgatcggtccgcagtgttgttggtgtagttgattccagaactgaaggggatgttacatgtgtcggacggtgacatggggtgatctgatgacccctttgtatattatatatggtatggtataaataaattccgcgaccagaagctaatgtggatcggtggattagcttatgtcaatacttaccggtttcgcgagccccctcctcgcatgtgaaaactgacgacggctgttggtagaagtggatgcgcattactacatgctagctgtgcgcctgtgcgttttggtataacgtgctcgcctgttatcaagacgtggccgccattgacctcgttcctctgcctgaaatgatttgggtggtatcgatcttctttctgcttaagaacaatcagctcctgtttgtttcatttcattttaaaaaattaaaatcttacatgtttcctttcattttgaggaattagaatcttactaatggaatagactatttttttaaatgtaacattctaccacttttaaaagttattatataagcctatcttaaattcatgagtgagaaatgaaaattgattatatagatttacatactatttttccgatatacaacttatagcacactcttctacatgtttcgctataccataaatatagtatataactatctcttatatgatttaggataatatacaaatatattacatatataaacatatgaatttaattagttttgtccaatttataattattaaaatggaattgaattccaacaaaacaaatgggcctcattgtatttgtagagccaaattcatatttctgagctgtatggaaaacattcatatttctgaacagcatggaaaacattatatcgttcctatgcctcgaagttttgcaacatagtggttgtgaaatggattcgcacaccctgtcactgaagacataaccattgaccaatgccgctaaaatggaattataagaagtaaatatcacaatttacacccatgtaccgaatataaacacacgacaagagtaaaaagaagaagcacaaatgaatataccgcttgtacgttcgcagtaacagaagtcctgtttcaggtacagtacagcagcagtaagcagtaactcaaaaagtcaaaactgcaacgtgcgtgcaaattacacgcacgttgctagcttaggcgaccaaggccaccagagcggccaccgccagcccagccaccgcggccgcgggctgctgataccgcggcgcgctgctcggtgcgcccgccggcgacttccctgcagcgcccagggccaccttgtgtcccgccgccggtccgggcgcgtaggcgtcggctgctggaggcgatgaggatgactggagcggagcctgcgcggggccgcttgccgcggcggtggcggaatcgtagggaacggtggtgatcgtgacgtgcatggtgccgttgaggcagtggcgcgggatgccgcagatgaagtagcgggtgcccgtggcggtgagcttgaaggcggtgctgccgccggagtgggtggagatggggttgcccggcgttgcagctggcgtagtccgccgccgtcacctccagcacgttgtggtacggcatgtactcgaacgctgcgcgttagtcgttaacgtacattatcgcacgccacatcaagatgagatgggaaggaaataatgcacgggcaagtacgtgaacggagagagctagcagtagcacgcacttatggtgtcgccgaccatgaacgtcttgccggcggtccacttgccgtagtcgacgtaggtgtcccacctgtctgacccgcccaccgtgtagtccttcgccgacgccgtcgtcgcggccaacgccgcaaccaccgctaccacggccagcagtgctccggcggaggcgatcttattcatgctcgctcccggcccgtacgtacgcgtcctttgagtggtggtccaccgaattatattgcttcggcgttcgggtcggtatatatggccctttaatttgggatcgcgtgtgctgcaaaaggtgataggactatatatacacggagacacagaacatggagagaaattcccttctttgccaatgccaaacgaagaggtgttcgtggccgaccatgaaacacatgcccgtagcaggggggaagacaggcacacagactatgagttggagaatctgctgttcattttcaaatgaattcggggtcgaaatgattaactgtacgctgcaccctgagacactcaaaattaaaggtcaatgcaatgcaagattacattgcaagatggc

SEQ ID NO: 18756 - DNA, 1241 bp, Zea mays
ccacgcgtccgggctacacggcctatattccgtactcgtgaacctcgtgctgacgtgctcaccggccgggagctaaatccttatcggcgactcggcgtcggaggctcggagcccacgaccacgaccgcttccacgccctcgaccccgaacccccaatcccggacgcgaccgctgaaccctagcatactccggccatctgccgccggccccggcgatcccccgccatggcctcccccgagggcacaacgtgggtcttcgactgtccccttatggacgacctcgcggtcgccgccgacttcgcggcagcccccgcgggaggatttttctgggcagcgccgccgtcgctgcagccgcaggcgccagtgcagtctgtcgttgccgcgtcggctcccaacccatgtatggaaatcagtagctctgtggactgtggtcaggaaaaagaacagccaacaaataaacgtccaaggtcagaaagtactacagaatcaagcacaaaagcatccagggagaaaattagaagggacaagctgaacgagagattcttggaattgggtgccattttggagccagggaaaactcctaaaatggacaaaacagctatattgagtgatgctattcgtgtagtaggtgaattgcgtagtgaagcaaaaaagctcaaggattcaaatgagaatctccaagagaagattaaagagctgaaggccgagaagaatgagctgcgagacgagaagcaaaggctgaaggccgagaaggagagcctggagcagcagatcaagttcctgaatgcccggccaagcctcgtaccacaccacccagtgatcccagcctctgcgttccctgctccccaggggccagcagccgccgccaggcacaagctgatgatgcctgtgattggctaccctggattcccgatgtggcagttcatgccgccttcagatgttgacacctctgatgaccctaggtcttgtcctcctgtggcgtagaagcgtgcgaaatcctgttggaaagaggcgatgctgccctccattgattcaaatcttgatcggtccgcagtgttgttggtgtagttgattccagaactgaaggggatgttacatgtgtcggacggtgacatggggtgatctgatgacccctttgtatattatatatggtatggtataaataaattccgcgaccagaagctaatgtcgatcggtggattagcttatgttctattcttgccgggttgtcctataacccac

SEQ ID NO: 18757 - DNA, 1396 bp, Zea mays
acggtttttaccaaaacaattcttatagaagcggactgaaaagctggggcgtttggcagtccgcaacagattttggtggccggaagttgaaaaaagcccaaacaaacagggccacagtatggaaatcagtagctctgtggactgtggtcaggaaaaagaacagccaacaaataaacgtccaaggtcagaaagtactacagaatcaagcacaaaagcatccagggagaaaattagaagggacaagctgaacgagagattcttggaattgggtgccattttggagccagggaaaactcctaaaatggacaaaacagctatattgagtgatgctattcgtgtagtaggtgaattgcgtagtgaagcaaaaaagctcaaggattcaaatgagaatctccaagagaagattaaagagctgaaggtctatactatttcatgtggccaagttataaatggtgctgttcagatgggaggtggcacgtgatgtgttgtttaggcacttcatactgttccattttcttgatttatgatcccctttttccatttggtcatttttttttcttatctagatttaattcatccagtcaaataacatgggaataattattagtacacctgtcattctccctccagtttgtggtttagtttattttgggttgcttgcattagcaactttatatccacataatgcgtttttttttcttaaatggttaaaccctgcagctgtataacagtatggacatttgtcaattcttttctctactgtatacacttctttgctacgtgttccataaaatatatagaggtttatgattcagcatctcatgtgctgcaaaaggctttggccttcgattttgctggttgttcatcagaaaaacaatctcaccctgaaatactttccttttgcaggccgagaagaatgagctgcgagacgagaagcaaaggctgaaggccgagaaggagagcctggagcagcagatcaagttcctgaatgcccggccaagcctcgtaccacaccacccagtgatcccagcctctgcgttccctgctccccaggggccagcagccgccgccaggcacaagctgatggtgcctgtgattggctaccctggattcccgatgtggcagttcatgccgccttcagatgttgacacctctgatgaccctaggtcttgtcctcctgtggcgtagaagccgtgcgaaatcctgttggaaagaggcgatgctgccttccattgattcaaatcttgatcggtccgcagtgttgttggtgtagttgattccagaactgaaggggatgttacatgtgtcggacggtgacatggggtgatctgatgacccctttgtatattatatatggtatggtataaataaattccgtgaccagaagctaatgtct

SEQ ID NO: 18758 - DNA, 511 bp, Zea mays
gaagccgtgagacagacagaagcccagaacttaaacctggaagcctggaggatggaacgggtactagcttgctagggttcgtgtccggcggcggcgactgcagctggaacgccggcggcgcagctcagtggatgctcccatcgaccattcccaggtggtcgtgtacttgatccattttgtactcgccttgaccctaccatggtagaagcactggtctgcaccaaagattggatagctggagcaagaaaaggttatatagtagtaccttatatttatttacaatttaattagtcattagttgtgatcaatttgtaatattgtgaacttgtgatctttgtgatcaacctgttatattgtgaacttgtgatctttgtgttcaacttgttatactgtgaattgtgaatttgtggtctttgtgatatttgtaaactttgttgtattgtgaacttgttatattgagatattttcatatttatatggttaccgattgtaaacaaaaaaaaaaaaaaaa

SEQ ID NO: 18759 - DNA, 1564 bp, Zea mays
aacgtcgcacgtatgagaaaaatgcaccttccttgaagaatgggattgggcaaagactcttttaccatgtttgagaaaattctttgacttgactgagttattttctggtacactatatctgactgccaacttgtttttaaaagggttctgtgagattaagtttttacttgttgattggtgtgatagcatccatcccactattagtaacatggcaaaaactatgatggtcaagtttgacaagtactggaataagtcaaatattgctcttgctgtggctagtgtccttgatcctagatacaagaggaaaatcatagaattttacttgaagaaggtgtacccatatacatatcaaactgaactggataaatttaatggggtcatgaaaaagatgtatcaatactatgtctctactacaccctcagcatcatctgttgcaccttcctcaacttcagcagttgacatgattaagtcaagtatcgaagaagagcttgatagctacatatttgatggacaaggtcatgatgattctattgacacaagtgacttagaaaaatatttggcagatccaatactaaaggttggtaaaagtaatcaacacacttttgacatattagcatggtggaaagcacacaaagaagaatatcctgtcttgggccagcttgctcgtgatgtcttagctatgcaagtgtcaacagtagcttcagaatctgcttttagtgctggtggtcgtgtacttgatccatttcgtactcgccttgaccctaccatggtagaagcactagtctgcaccaaagattggatagctggagcaagaaaaggttacatagcagtaccttatatttatttacaatttaattagtcattacctttttactaatgcactaatggatctttatattcctaggttccaaggctaagagtgttgttattcctaatatggtttatgaaatggatgaacttgaagctcttgcaagaaatatttcatttgaggttaatttaccttcattttatattctattttggtgcataaaacattagctatgatttaattctatatttctttaacaaaaatgtaggatgaacacctagatgatgatgatcatgatgatggacctgaggcatcgttgtaagcttgttgatgaagatctagatgataataacgtaccatgaatgctatgaatgtttcttattgtacttgctccgtaatgttttgtgaccttgcgaacttgggattgtggacttgtggctttgtgaactttattatgaacttgttatattgtgtacttgtgttatttgtgatcaacttatcatattgtgaacttgtgatctatgttatcaatttgtaatatcatgaacttgtgatatttgtgatcaaactgttatattgtgaacttgtggtctactggtctttgtgatcaactttttatattgtgaattgtgaacttgtggtttttgtgatatttgtaaactttgttgtattctgaacgtgttatattgacatattttcatattgatatggttaccgattggtatttaaggttccgaccagtaccgagtatttccg

SEQ ID NO: 18760 - DNA, 847 bp, Zea mays
acacagacacagcgcggagccgccacttctcttctcagcgctcccaatctggcggcggcggcacgccggcacccacccgcagttgacatgattaagtcaagtatcgaagaagagcttgatagctacatatttgatggacaaggtcatgatgattctattgacacaagtgacttagaaaaatatttggcagatccaatactaaaggttggtaaaagtaatcagcacacttttgacatactagcctggtggaaagcacacaaagaagaatatcctgtcttgggccagcttgctcgtgatgtcttagctatgcaagtgtcaacagtagcttcagaatctgcttttagtgcgggtggtcgtgtacttgatccatttcgtactcgccttgaccctaccatggtagaagcgcttgtctgcaccaaagattggatagctggagcaagaaaaggttccaaggctaagagtgttgctattcctaatatggtttgtgaaatggaggaacttgaggctcttgctagaaatctttcacttgaggatgaagacctagatgatgatcatgatgatggaccagaggcatcgttgtaagcttgttgatgaagacctagatgatgataatgcaacatgaatgctctgaatgtttttattgtacttgttgcgtaatgctttgtgatcttgcgaacttgggacttgtggacttgtggttgtgtactttgtgatctgtgtgatgaacttgttatattgtgaacttgtgatctgtgtgatccacttattatattgtgaacttgtgatcaacttgttatattgtgaacttgtgatctgtgtgatccacttactaaaaaaaaaaaaaaaa

SEQ ID NO: 18761 - DNA, 735 bp, Zea mays
  misc_feature (637)..(637): n is a, c, g, or t
agtagggtttgtggcggtgggccgaaagggtaagcttcctagggtttgtggcggcgggcggcggctgtagcaggagctcgcgacgcatcctcctcgtctggccagccgcacattgtgatctaatacaatggctatcgatggtgatgcttcacctccacggaagcgtatgttattggagttgccttgtgatgaagaaggtgcaaatgtgagtcaaaatgttggtgtgtccgcatcatcagccacacctgccgctgccagagattctcatgaacaaggtgaaaatccagaaggtggaagtaatgttgatggggatgattcttcaaaggaaaagcagtcaaagaagtccacttcaaatgtttggcagtattttgagaagtatgaagttgtggtagaggagaatggcaaatcagtgaagcaaatttgggccaaatgcaagtatcctggctgcaaaaacaagactagcaaagctagggcagaaagcaatagaggaacaactgcattttggtctcatttaaggaattatcataagattgtgaaggggcaacaggaactcaaggcagaaaaggatcatggcacagcagttgacatgattaagtcaagtatcgaagaagagcttgatagctacatatttgatggncaaggtcaagatgattctattgacacaagtgacttagaaaaatatttggcacttctgatttccattgaagcgagatttctttaaaaaaaaaaaaaaaa

SEQ ID NO: 18762 - DNA, 1268 bp, Zea mays
atttttatcaacaagaaaagtggggctcagcgcggagatcttctcaagcacaagctacattttcttttgaatccggtgcaggtttttgaattaagttcttcacaagggccagaaacaggattatttttgttcagaaagctggcactggcaatgatctttcgagagttttatcatggggaggtggcctaggtgctgttgagaagcaaggtggcctttgcacaattttacatgacatagagcatgcagcagtcactatccttgatagatggaaggtgacagtagaagataagaaatcaaagaatgtgcttctagtaaagtacatgaacaactatctcggtatcggttgtgatgcaaaagttgcccttgacattcataatctccgtgagggaaatcctgagaaattctacagtcagttcttaaataaggtgctatatgcgagggaaggggccaagagcatcattgacagggcttttgtggacttaccatggcaagttcggttggaagtcgatggcaccgagatcgagataccagaggactcggaaggcgtgcttgtcgcgaacatcccgagctacatgggaggggttgacctgtggcaaaacgagggtgaggatcacgaagattttgacccgcagtcgatccatgacaagatgctcgaagtggtcagcattacaggagcatggcatctgggaacactccaggttggactttctcgggcgcggaggatcgcgcaaggccagtcgatcaagatacagatgtttgcccctttccccgttcaagttgacggtgagccttgggtccagcagccctgcacgctcaagatatctcatcacgggcttttatgttgaggagagcagttgaagagccactgggtcatgccgctgctatgatcaccgacgtccttgagcatgcagagtccagccatgtaatcactgcttcgcagaagaaagccctcctccgagaaatggctctacggctgtcatgaagcaagcgccgctcattcggacgtcgcagaagaacggtttcctgcctgcacagcggtgattggtacctcggccgcgaccacgctactcagacatgagctcgatcatgttgttagcagaagatacaggcccggagggacgtgtccacgtgcacatagagttttttttttttggggtcatgttcacgttttggaaatagcgaggcaatgttgtgtgcagctatgtatggtgtgtagacctcgggtaagccagttccttccttctgtgcaaaaaaaaaaaaaaaaaaaa

SEQ ID NO: 18763 - DNA, 1147 bp, Zea mays
gtatcctcgtcgccggccgggccccgaaaatcttatctacccatatgcgataaaataaaatctttcagttagctgcttccggcagcggtacgatggccgctgcgagaatggcgctcgtctcttgcgcccgccgcctcccgtccttaccctctccgctcaccctctcgaggccccgcgccggcgccgtctcatttctggctgcccaaccgtcgccggcgacggcaccgagatccggcaggaatcttgctctcttctgttctttatcaccgacgtcgccatcgctaactgaggccgccgtagcactgccgccaccgaaggctgcggtggaagagacgaagccccctgtgccgagcggggacgagaagggggaaccgaccgtggaggagctagcgggcctgctggacgtccgggtgggccgagtggtgaaggcgtggaggcacccggaggcggacaccctctacgttgaggaggtggacgtaggtgaggcggagccccggaccatctgcagcggcctcgtcaacttcctccccatcgaagagctccaggacagaaacgtcattgttcttgctaacctcaaaccaaggaacatgcgtggcatcaagtcaaatggcatgctcatggctgcctctgatgcttcccatgagaatgtggagctgctcatcccttcagaaggttcctttcctggtgaaagagtatggttcggttccgaagaagaaaagaaccgtcaatctgaccctgcatcaccaaatcaggtccaaaagaagaagatctgggaagctgttcagcctcatcttagaacaacagataactgcattgcggttcttggtgataaacaaatgcgtacctctgcaggcctagttttctgcaaatcgcttcagggtgcaagagtgtcataaatctttatggccaacatctttcttgtatcatggaatcgtgtgtcatgtatcttccctgcaaataataactaactatatgaggagagcagcagggaaagaatttcctttccaactactgagataatcactgtactggaaccattcacatttagttctcacttttcagtgttaaaacaacgtgcttcctgggctgacgcaataatcttgatgatgcctggggcgagttagcacaaaaaaaaaaaaaaaaaaaa

SEQ ID NO: 18764 - DNA, 1555 bp, Zea mays
gagaaagatgaatttagcaggctgttgaaagcaaaaatcaatgagcttggcatgtcggacaggatcgagtgtacaccaaatgattcaccttcaggaaaattgactgtgcctgtgctgcaagagctcatttctgcccttgcaactgacatgagcacttcaatctcccaatgtagcaactactctggtgcatcagcacccttacgctgcaatggaaatgttgactgcatcaatccagcgcattgtatattctccaatgagcaatcacctgattttcagaaatgctatcagggtgaacaagatgttgattcttctgctacatcgctaaacaatgagcccaatcagccaagtccaacatcagtccttgaagcatccttctcaaatgatacttctttaggaagtccagttgaaaagaatgaaggaaaagacttcattgtgtcaattgagaacaagatggaagatctctttaatttggagtctgacatcgtcgatttagcaatgtcaattgacacaaggaaaactgatgctgaagaagcacaccatggcaatgacaagttatcatgtttacagaattttcttgcacatgatttcaatatcttggaatctaggctctgcagcattagagaagctatttcaaatgctgaactgcttctgggcattagcctcttgcatagcacaacatcaggtcttccactccatcctttcattgttgaaacgctagaaaatactatggatatgtttagtggaggagagtactcagattttactgaagataagaagtatcaacataccaacttcctgtttgactgcattatagagtcactggattcaaaattctgcaatcttggcaaatgtggatacaaggcttggctgaagttgcctcacagtttgagcaaagatctgttgaagcgccagctattggaaaacatcagcaactggagggagtcaagtgggactgctcttagacaagtttctgacaaagaagtggaccaagtgactgacaggtgggatgcaaaccttgaagcatttgatataagcattgcaatcgagaacgacattcttgaggcgcttgtcggtgagttcgcagttgacctatggtgaaacggcgtattgactgccctatatgtatatgagatattgacatgtttggacttctgctcgcatgattctggataaataagatactgcggatatgtttgttttttcttagcagtaaattttgtagagtcatgtatggttgaagggcctccgtgtttgttttacccttcgtatgttataatggaaacatgctaaagcttaacaatgtctcctaatctttgtggccgtcgctccttttacccaactggtaacatcggatctgttatcaatagcattcgtataccctatggggagctgtgtatatatataatcaatgttgacctctggtttgtaccttggtgaagaaatcagccaaccgaagttttgaagacacagcgaagaacttgtgcttatgtttatgtataataagcattagcaccaatatgcttataccaatatgcttagtaagctcattctttac

SEQ ID NO: 18765 - DNA, 3811 bp, Zea mays
tatacatacaacaataatacataaacaaaaaagtatagaatatatatattaccaaaataaaactaagatgttttgtggatgcacattaaaaacctttggtcagaaagaaaaaatattacaactagctcagaaataatattcagttctatgttcagtgtttaattgagtactatacagccatacagaatacatatacaataatcatcatcactattcactatccacatctaggtattggttctcgaagacttattgaagctctagattctccaagatgtgctagtcatgtgagctttgacggaccttagttaaatactgagtctatatttagtgggcctcgatgggccttagttaaatgggccgtgccaggccggcccgtgggcttgacttgaggcccagacacggcccacatattgggccgtgccggcctaggcccacaattagattgggccgtgccagatttgggtcgtgccaaaaattgtgtgctttgggccggcctattaggcacagcacaaatgtacacctgtacctaggacaggtgcttcctcccgcttcgtgtcccgcccgtgcacctgcgtcaccagagaaggttgctttgcgctcatttggcttcctcgcgacgcgttcttctcttccgagcgactcctgcgctactctcactgacagtctgacagctgcgcccactagacagagccccacctgtcatctgctacccctgcctccttgaacagaccgggtcgccaccttctcttcgcgctcactgacaagggaggcacggcggccacgcccacgctcgactctcttgcctccgtgtacctcctcgcggcgcgtgccgaggtggaggaggagcaggggaaggggagctacctgccgttgcgtgccagctactacaccttccagctcccggatcgaagcacgggtcggttaaagcacggggccccgagcggcacggccgacttggcagcagccagcaggtgaggcggagggagagggatgagcagcctcgctatagtggagaagaagccgccgccgttccccggcggcggctgcacgggcggcgtgctcttccacctcctggactggcaccgccgcctcgcctgcaagcgcaggctcttctccccgcgtcgcctcctcccttcgtccctccgctcctcgtccccacgcaggctcccgtgcccgcctcctgctgcctcgccgccaccgccgacgctgccacatccggccgatggggccgccccgggcgttgtcgcgcgcctcatgggcctggagtcctggcccgccaccgccaccgccgcgccgccgagaccgcagaagcagaggaaggtggaggcgtcgcgcgcggacggcgctgactcggcggtcgtgctcgtgctgcctacgacccggagccgtcgacctcccgcgtccgcgcccgtgccgacggcgaggagccaccacggggccgacctgccagcgcggagcccgaggcggacccgtctcgtgcacgcggccgcggcgaagctgctgcatccgggcgcgcgcgccggctcacgcgcaagcgccaggctggccctcgcgtacgcttgctcttcgccgcagcaccgcaaggatgaccacgccggcaccttgtttccaggctccggaatgaccgacgacttcctatctcgctcggagagcttgcccttggagcgttctgcactgctacaggtacagcctcctggtcttcctgcggagacagattgtgacaccgctgttgtatcgcgtaggcacgaccattgttccactaataacgtcgatgcagcgatcagtgccagtacggtagtgttgcctagaatgggttttggtgatggaaacaggagtaaacggagctctgatgtggatgctaagcacaaggggagtggaattagaaatgacgtaacgcgcacttgtgccagggctagatcgagcggtgctgccgttcaaactggagatgagaggttgttgcgcaaacgagcaacacctactcggccggaggtttctgggatgccagagtctggggacttggctggttcgacgcgcctagctgggggtgctcgtgacttggtatctgctactaggaagtttgcacacggtggttctggtccaagaagagagttcgcgggatcgatcagtggacaagggagcacgacccacagggatttgaacagccaaaatgggttagcatccacaagtaggatttcaagcaatggatctgggcataaaaggggatcagggagaaaggtggggcatgatagagcaataagtaacagagatgacagaaatgcaattgcatttacttctagatcatctacaaagccagtggccagagcttcgtcacagagcaatctattgaagagtggatccccaaatagactagcacctgatacaactcgcacacgagttctggctcctgaaaaaagatacattgaagcttcaccttcttttatgtctacttctgagaaaggtgaatttagcaggctgttgaaagcaaaaatcaatgagcttggcatgtcggacaggattgagtgtacaccagatgattcaccttcaggaaaattgactgtacctgtgttgcaagagctcatatctgcccttacaaacgacatcagcactccaatctcccaatgtagcaactactctggtgcaccagcacccttaagttgcaatggaaatgttgactgcatcaatgaaccacactacatattctccaatgatcaatcacctgatttccagaaatgctataagggtgaacaagatgttgattcttctgccgcatcattaaacaatgagcccaatcagccaagtccaacgtcagtccttgaagcatccttctcaaatgatacttcttctttaggaagtccagttgaaaaaaatgaaggaaaagacttaatcgtgtcaattgagaacaagatggaagatctctttaatttggagtctgacattgtcgatttagcaatgtcaattgacacgaggaaaactgacgctgaagaaacacaccgtgacaatgacaagttatcatgtttacagaattttcttgcacatgatttcaacatcttagaatccaggctctgcagcattagagaagctatttcaaatgctgaactgcttgtgggcagtagcctctcgcgtagcacagcatcaggtctcccactccaccctttcattgtcgaaatgctggaaaacaccatggatatgtttagtggaggagagtattcaggtttcaccgaagataagaagtatcaacgtaccaacttcctgtttgactgcatcatagagtcgctggattcaaaattctgcaattttggcaaatgtggatacaaggcctggctgagcctgcctctcagtttgagcgaagacctgctgaagcgccaggtattggaagacatcggcaactggatggagtcgagtgggactgctcttagacaagtctctgacaaagaagtggaccaagtgactgacaggtgggatgcaagccaggttgaagcatttgacataagcattgcaatcgagaacgacattcttgaggcgcttgccggtgagttcgcactcgacctgtggtgaaacggcgtattggctgctgtatgtgagatattgacatgtttggactttctgctcgcatgattaattacgtataaataagagatactgcggatatctttgttttttcccctgcagcaaattttgtacagagccatgtaatgtaaggttgaaggacctcccgtttgttttgccctttgtatgctgtaaccgaaacgtgctaaagcctaaggccttgtttggggaacacagtttttccaaaaaaaaaaaaaaaaaa

SEQ ID NO: 18766 - DNA, 1514 bp, Zea mays
gccgggcgcaccgcacccacattcttaaaaacttgttaaattcatatttaaggaccctttacataacgtggtgggagacctttactaactgctctaagttccattgatacgtttcatcgattttcggaggaatttattcgaggaatctagtgtttgaccggctccgctcgattctgcttcgttaccacgcgggtgctatcgaatcttggcggagatggggctcacgttcacgaagctgttcaggcggctattcgccaagaaggagatgaggattctcatggtcggtctcgatgcagctggtaagaccactatcctctacaagctcaagctcggcgagatcgtcaccaccatccccaccattggatttaacgttgaaactgtcgagtacaagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaatgaggacgagctccgtgatgctgtgcttttggtgtttgcaaacaagcaagatctgcctaatgccatgaacgctgctgaaatcaccgataagcttggcctgcactccctgcgccagcggcactggtacatccagagcacatgtgctacctctggtgagggtttgtatgaggggcttgactggctttcgaacaacatcgctaacaaggctcgaagcatctaggcaaggcttcaatcagtggaagcaaactgcctctaccattacagctatgaagtatatagtcgtgactgtgtcagacgtggtgtgttttgggaggataaaaggctcttttggtcgaggagctaggtatcagatgttttttatggtacctgtaattttccgtgcttctgttttggttttgtgcaaggtataccatgtctgactgtgtgctcgccactgtctgagtcgttgtactatcccgggccggcctgtccggctgtctcttggcatagcaaaatgatcgcctaatttgttagcacatgctcggtaatatcacgagggcttcggtggtcttattgctcacgctgaattctcaactttgctcttcttttctgcggttgaggttgcatcttgtattgttggctgatttcgagcaatcagaggattgtgctacgtcgtcggaggcatcatgggatagcagctagctttcgtctttgaactgggcttcggttctaaattcgacttcacttttatccttcattaaactttttaactttgatatcgctatataaactggttgtacctttaacactatattttatctttgtaattgatggttagtgattcaagagagcattgttttttttttttgttgatcacacatgttgcgtgtgcgacgtcagctatgaactccacaaataatgtaatttttagctttggaaatcatacattttttatttatattctataaagtatacagtttttattt

SEQ ID NO: 18767 - DNA, 1846 bp, Zea mays
attagttgctaatttttaaaattatctacgtaaaaaatatgttttttatttttaattgagctgacggtagaaatcaatatcacaactttcactgatgtcttgagaggtcgaaattatcgatggaaactagacatattatcgatggaaaccagacatagatgaatttgtggtcaacaggacatattatggatggaaacacaacaattgatttaaggagttacaacaaggttggtaaatgtaggaatgtaattaagttttgtatggagtttataaatttagagaactaataatgtacataaatgttggagaataattttttttaaaatttgttaaattcatatttaaggacctttacataactgctctaagagcaactccaatagttatgtaaattttagctctctaaatcacatatttaagaagttgctaaatgatttttagagtaaaaaaatgtgatttctccaatagttctctaaatataggttgtaattttgttttgtatttatccatataaaaattagtcacaaaaactatataatgcagtcaacatttttgttttgggagttgttaaatggttgccaaatgtagagagaaaataaggttagatgacaagttgttaaatttagaaagttaatttagggaactgttgaagaatagttttcatgttaactacctaaattattgatttaggaattcttttagagaactactggagttgctctaagttccattgatacgtttcatcgattttcggaggaatttattcgaggaatctagtgtttgaccggctctgctcgattctgcttcgttaccacgcgggtgctatcgaatcttgggtagtttttcttcgcttgcggcctctcgaatctgacccatttccacggttcgcgtgcgccgttgccgcggatctgcgtgcttgtggcatcgggttccgtggatctagttgcgcggagatggggctcacgttcacgaagctgttcaggcggctattcgccaagaaggagatgaggattctcatggtcggtctcgatgcagctggtaagaccactatcctctacaagctcaagctcggcgagatcgtcaccaccatccccaccattggatttaacgttgaaactgtcgagtacaagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaatgaggacgagctccgtgatgctgtgcttttggtgtttgcaaacaagcaagatctgcctaatgccatgaacgctgctgaaatcaccgataagcttggcctgcactccctgcgccagcggcactggtacatccagagcacatgtgctacctctggtgagggtttgtatgaggggcttgactggctttcgaacaacatcgctaacaaggctcgaagcatctaggcaaggcttcaatcagtggaagcaaactgcctctaccattacagctatgaagtatatagtcgtgactgtgtcagacgtggtgtgttttgggaggataaaaggctcttttggtcgaggagctaggtatcagatgttttttatggtacctgtaattttccgtgcttctgttttggttttgtgcaaggtataccatgtctgactgtgctcgccactgtctgagtcgttgtactatcccggcctgtccgtttttttttttgtctagagatgctttcagttttgaactgctagaaagtcggttttaaaaaaaaatgttttttaatccccaaacccaccgtccg

SEQ ID NO: 18768 - DNA, 1378 bp, Zea mays
  misc_feature (1311)..(1311): n is a, c, g, or t
  misc_feature (1373)..(1373): n is a, c, g, or t
gccgagacagccccggcccgctcaccctcgccgccgcgctcttccccgccgcgccctccccggccttccacggctccttcacccagctcctcgtcggcgccgtaggctccccggccgtaccctcgtcgccctccccgttcgctgtcccgccgaggctcagccctgccacgctcttgggctcccccggcttcttctctcccacggcaagttttgagatgtcccatcaacaagccttagcacaagtaacagcacaagcagtccattctcagtacaatatgatcaatcatgcagattacactatccctttttcgtcgacgacaacacctgctttggtcacagcacagcatgccaatttttctggcaatttgacatcagcacaggagaaaccagctctgccgtcacatacaggcaatagcaacattgaatcaaatgaggtttcacaaggactcaaaacttctgcacccacttttgataaacctgctgacgatggatacaactggcggaagtatggccagaaggcagttaagggtggcgagtatccaaggagttactacaaatgtacccacacgagttgtgcagttaagaaaaaagtggagcgctcagcagaaggacacatcacccaaataatttatagaggtcagcacaaccaccagcgcccaccaaaaaggaggtccaaagatggtggtggtcaactaaatgaagcagatgatttccatgagaatgaagacacttctactagatcagaacctggctctcaagatcactctggaaaacatgagggtcaaatgatggcataccagggccttcagtgtcaagaaggggagagggatatgagcaattgtcaggctcaagtgatagtgatgaggaacgagatgatgaacaaagggctggcaatggagatcctggctatgcaaatgcaaacagaagacatgtgccaactccagctcaaaggataattgtgcaaacaaacagcgaggttgatcttctggatgatggctatcggtggcgcaagtatggacagaaagtggtaaaagggaatccccatccgaggagttactacaaatgcacctatcaagggtgtgatgtgaagaagcatattgaaagatcatcccaagacccaaaggccgtcataacaacatacgaagggaagcacagccatgatgttccagcagccaggaacagtagccatgctgctgccaatgcaaattgttcatcttccaccagtgtaccacacagggtccagagttcagcgtccagtagtcgcagagtggcagacttacaaagcacatcctcagcttcttctatgctacntaaaagaggaaacgaaaatacataagagttttggagtgtgtagcagggtaaattatctctgntctct

SEQ ID NO: 18769 - DNA, 1884 bp, Zea mays
  misc_feature (486)..(486): n is a, c, g, or t
cactagctgcaaggtcgaacattagtgaggattttcctagtaaatttatgtaagttaaactgaaacaatctagacctaaataattgattaatcaaataccacactaaaaattgataccaacctatttaaatttattatcactatcactcgagtgtaaattattaacgttgtcatttacatcacaattcgtgaaccaaacaatcgcctataaaagatataaaccataagctcctataatcataaatattttcatgccaatgtctaaagcctccaaaagctggacctatatggtggctatctgtatcatagtcataggacatgaagagtacttacattcttttatgtgagtcaaatttggccaaaaccccaaaattgacgtgtcaggaccaaatcctcacggactgaccgttgactagatgaccacaccctactcaattatataaccagagagtacaaggaccaaagcataaaagtgccgaagacgangaccccgtcttccgctgccttgggggccccgggggcggccgggaccaagtcaaacgtccccagcctcctaaaatttcccctttccccaactaacacgacaccccccttcccttcctccgatccccccgcctcccccaaaatccgacgcgtaatcgccgccatggccgccgccggcaagctcctcctcctggccgccgccatcctggcggcttccttcgtcgccgacgcgcgcccgtgcggccacgcgcagacgctcctcgtctccttctcctccgtcctcaggccgaacccggaccccaccaacccgacgccgctcaccaccacagtcgtcaccgtcctccgcgtccggcgcctcggcccgcaccagatccgccgccccgtggcgctcccctccgtcgagtcggaggtcgccgcctcgtccgcccaggaccgcgccaaggacatcctcgtcgtcgtctccggcctcctcttcggcttcggctgcggcgccctcaccgcggcgtccatgtacctcgtgtggtcgctcctcgcctccacctgcgcctctggatacgacgacgacgtctacagcgacgacgaggaccggctgtccgactccgagagccccaagaatgccggctacgtcatcatccacgacgctgacgagtacggcgccggtaagaactagggctggggatccgtcttcggtctcgccgggggtcagcagaaggattttcgtaataacatttgcatgattgcttggaaatgtgcagtatactctatgcacctttttaatcatgtgtgtcgcgtctgtcggtatgtatgtcgtctgggggaaaggaaatttaagttatatgaaatgaatatgctgttgatgtgtcaaaaaaaaaaaaaaaaaacgcggccgccccaaaacatggatcttattggctgccacgatatacaaaaaacaaaatcatggtgttcttcctagtccccacaaatcggtgctacacatatgtgctgcttgcctgttgaccacagagattttcctgggtattttacctgtgcaactgttcatgaatgtgactgctacttcgtctgcaatatctctgagattggtacagtctgaagaaggcattgctccgtgttggtttcatgcaccgaccagcaactagtatatatagctgcatgcttcacttctattctcctatcttcatttggatcgggagcttgtgttcgtgtattttgacgaaggctgctaggttaaaaatacagcattactgtctggttaactaagctgactccagttgcttaacctttcttctttttatgtcatggagcctactgttggggcaacttcaatggctcatagggtctggttgtgttggcatatactttgttatgatgtgttctgggatgcatttcaggcgtgaattg

SEQ ID NO: 18770 - DNA, 1706 bp, Zea mays
ccccgcgtccgggagcccccagagatctggcgacagcccggagaagcccctgtcgctcccgagggtgtgggcgccgtcgggaggatcgacgtggttagggttgcagcccccggtggggaagactttgatggaaaggacgggggcggggaaagcgggcgttcgcccggcgcccgcccggcgccccggtttcccacgcccaaggagatttgccgtgggctggacaagtttgtcatcggccagcagcgagccaagaaggtgttgtcagtagcagtttataatcactataaaaggatctattgtgaatcactcatcaacaggtctgctgcggattgcagtcagagtgattcttgcacgagtgacaccgacatggtagagcttgagaaaagcaatattcttgtcatgggaccaacgggctcggggaaaacattgctggcaaaaacactggcaagatttgtgaacgtgcccttcgttatagctgatgcgacaagcctcactcaggctggatatgttggtgaggatgttgaatctattttgtataagctcctagcggctgctgatttcgacgtagctgctgcccagcagggaatcgtctatattgatgaagttgataaaataacaaagaaggctgaaagcatcaatcttagcagagatgtttcaggtgaaggtgtgcaacaagcattgttgaaaatgcttgaaggaacgataggttgttagtgttcctgagaaaggggccagaaggcacccaaggggtgacaatatccagattgataccaaaaacattctcttcatctgcggtggtgcttttgtggacttggagaaaactatttctgaaaggagacatgattcttcaattggtttccgagcgcaggttcgttcaaatatgcgatctggtggtgtcataaatgctgagattacatcatcgctactgaaatcagttgaaagtggcgatctcattgcgtatggactaatcccagagtttgttggtagatttccaattcttgttggtctatcctccctcagcgaagatcagcttgttgaggttctcacagagccaaagaatgcccttggcaggcagtataccaagttgttcgaaatgaatgacgtcaaattgcattttacggaggaggctttacggcttattgccaaaagagcaatatcgaagaatactggggctcgtggtttaaggtccatattagaaagtatattgacagaagctatgtatgagattccagagacacgaactggaaaagataaaatagatgctgtggttgttgacgaggagtctgttggatctgtaaatcagcatggaattggagctaagattctttgcggagaaaaagctttggatgtctatctggccaatcacaacaataaagaatcaacgggccaactccaggagagaccaaacggggaatcagagatcgatacggaagccccctctagagtggccagcatgtagaggttcctggcaacaataattatgtatataaataacttattgtctgccttgtaactgtaaccaattcaaatgtaaagtcgggccatataaattcatcatgtgaccggcgctgggttgtaatttgtcatgttgaatttcgggggactgaagcttgatcttgcagtatttacataaggaaagtaaagaggatcgctttgcgtctttgggcaaaaaaaaaaaaaaaaaaaagaaaaaaaaaaaaaaaaaa

SEQ ID NO: 18771 - DNA, 2123 bp, Zea mays
attaccgttgcaacgcacgaggcttgcagctatgagtcactgacgaagtgacgaggcatgccatgcgtgtgggcacgaagaaacaaactggtccaagacgactcttggactccctctccacttctccggccagagacgctggacggctggtgtctcgtttaattcaaacacgactcgtcgtcgggacttcgtgcgcagccgccacccgcacggccgcacgttctgccagcccagtatcccagatccagtccactactccactcccgttcccccaagtctatcagccaaagcatcgcccgccgatggcgtctccgccccactcagtcgaggtccggacccccggcgactcgccgcggcccaccgccgctctcctctccccctccgtggccgcaccccagccctccaacgcctcccgcctcctgctcctcctcaccgcggccgtcgccgccgctacggccttcgtcctgctccgcccgcccatcaccgtcgtgaccgcggcgtccgccaccgcgcggccgctctccaagctctccaagcccgtggtgctgctcatttcctcggacggcttccgcttcgggtaccagtacaaggcccccctcccgcacatccgccgcctcttcgccaatggcacatccgccgccgagggcctgatccccgtcttccccacgctcaccttccccaaccactactccatcgtcaccggcctctacccctcctcccacggcatcatcaacaactacttccccgatcccatctcgggggactacttcaccatgaaaaaccacgatcccaagtggtggctcggggagccgctctgggccaccgctgccgcccagggggtcctgtctgccacattcttctggccgggttcggaggttacgaagggttcctggaactgccccgacaagtactgccgccactacaatggctcggtgccgtttgaggagagggtcgacaccatccttggctattttgatctcccgcctaaccaaatgccacagttcatgacgctgtactttgaggatcctgatcaccaggggcaccaggtgggtcctgacgatccctcaatcaccgatgcggtcgtacatatagatgagatgctcgggaggctcattgctggtttggaggctaggggaatgtttgaggatgtgaacattatattggtaggtgaccatggtatggttgggacctgcgataggaagcttgtgtttctcgaagagttggctccatggatcgagttgaagtcagattgggttctgtcagtgacgccattgctggcaatcaggccgccagatggtgtgtcgccagctgaggttgtggccaagatgaatgaggggcttggatctgggaaggtgaagaatggggaatatttgaaaatgtacttaaaagaggagttgcctactcgcctgcattattcagagagttacaggatcccaccaatcatcgggctggttggggaagggtataagatcgagatgaagcgctccaagagaaatgagtgtggaggagcccatgggtacgacaatgccttcttctcaatgaggaccatatttgccgcacatggacctcgttttcagggtggtagaactgtgccctcatttgagaatgcggagatatacaatgtcatggcttccattctcaatttgaagcctgctccaaacaatggttcagcttctttccctggcacgattctgttgccgaacaaatgatcatggattggttttgtaggagtaagggcacatggatgtatgatggtgttctcatttggttattgtattgtacctcttaaattagacttctgccacatcactgtatctgagcaaaaatgctgctagtagagagttgcttctctctagtgacaacatttggaaacatgtttcacatcaaacgtttggctgctcaattgtttcataggagttcattcgagctccatgttttctccttaattgactgatgctcctgttgataacatatgcatttattcacgtctcatggtactcattttaaccattgtattacattatggtatactttgttttgttcttatatcgtttatcacctgtcaatgaaccagacaattgtaatatctgttatttcataaatacagatgcactcaattaaca

SEQ ID NO: 18772 - DNA, 1051 bp, Zea mays
  misc_feature (938)..(938): n is a, c, g, or t
attgtgttgcggctgaatgggcatgcagcataaaggcagcaaaaaaaaaggttgagacgggacgggacgacacagagagaatcaatgactcgtattcccaaatcccaaaaggccaaaaaccatacgccgcccaaatgcaaaagctgaagagggcgggggggcgtccaggttcaatgcatgtacacgacccccccttccgtcttgatctgacctgtggcctgtcgctgctgcctgcaactgcaatgcaggtcatctctttcaaaccccacacggccacacggcatgtttcaaaggcaggtccagattccagcagctctgagctatagaaaaaacggcttgggggcgacgcggagagaggggtatttgcagtataagtacctttggatcgaagagcatcactcgaagatgcatcgaggactgttcttcttcttcctcaagctgtagcctgtgggaggagaggccggagaggcctcccatggagttcccccactcatcacttcttgttggtcccctgctagctgttcgttccctcagcaggtagctagagatgatcttgctttaattttgtgctgatctcttactcgtcgtgtacgctcatatgcatggggcgacggatttgtctctgatcgttcccatgccgcctcttgtatcttgacttggatctatatatcaatgcaaataaatcatcgatgggtgacaatcgatccaaacaaaaaaaaaaaaaaaaaaataaccgcagccgcagcacaatcgcctcgccttcccttccccaccagcccgtctctctctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggncgggctgtcgctggccgagtcgggcggcttcgtcaggcccccggcggcgcgcccgccaacgtcgcctggcgcatcgccaagctcggcggctctccgctttcgtcggaagttcg

SEQ ID NO: 18773 - DNA, 780 bp, Zea mays
acgaatgactcgtattcccaaatcccaaaaggccaaaaaccatacgccgcccaaatgcaaaagctgaagagggcgggggggcgtccaggttcaatgcatgtacacgaccccccttccgtcttgatctgacctgtgggctgtggcctgtcgctgctgcctgcaactgcaatgcaggtcatctctttcaaaccccacacggccacacggcatgtttcaaagtcaggtccaaattccagcagctctgagctatagaaaaaacggcttgggggcgagacggagagaggggtatttgcagtataagtacctttggatcgaagagcatcactcgaagatgcatcgaggactgttcttcttcttcctcaagctgtagcctgtgggaggagaggccggagaggcctcccatggagttcccccactcatcacttcttgttggtcccctgctagctgttcgttccctcagcaggtagctagagatgatcttgctttaattttgtgctgatctcttcctcgtcgtgtacgctcatatgcatggggcgacggatttgtctctgatcgttcccatgccgcctcttgtatcttgacttggatctatatatcaatgcaaataaatcatcgatgggtgacaatcgatccaagcttcctcatgtgttttcttttttgaagttctttcactagctattcgatcggaatttcttgtctactgctgtatatgcttgtgattgatcgcctgcataaatggaaatattgtgacttgtagtttacgtgctcgaaaaaaaccat

SEQ ID NO: 18774 - DNA, 1641 bp, Zea mays
ggtacccgcgcgcccggccgggccccacaaaaacaccacgtacacgggcgcggcgcggagaccgaccaccacctcttcctccggttgcctccgccctcgggcctcgccttcgctccatcgtccccgtctccatcctccaggaccggcaaccccacgtagcgcgacagctcgtcgccgtagtccatggcggctacggaggtgtactcgccgaccacggcggcggcagcgcagcagcagcgggggaaggcggcatcgcaggcgtggcgagcggtggtagggtggatcggcttcttcctccaagtcctgcttcagatcctccggggcacgccctcctgcgcacagctcctctccttcgttggtttccgctatccgctcctctccggacctgcggcctcggagccgttgccggaggtggccttcatgccgctccactccgagatccctgctgacgcggcgcctgccccgaaacctgcgtctgagcccctgggccgcctcacggtagtgcttgacttggatgagactttagtttctgcatatgaatcatctagtcttcctgccattgtgcgcacacaagctgttgaagcaggattacattgctttgatatggaatgtatatcgtctgataaggatgttgaaggcaaacaaaaggtgaatcatgtgactgtttttgagcgccctggtttgcatgagttcttgcggaaaactagtgaatttgcagatcttatcctttttacagcaggtttagaaggttatgctagacctttagttgaccgaatagatgttcacaatagattcagaattcgtctctatcgcccatcaactgttaccacggaatatagagaacatgtgaaagatcttactcgcgtgtcaaaagattttggcaggattgtcattgtcgacaacaatccgttcagtttcattcttcagcctttgaatggaataccttgtgttccattttcagctggacaacattctgatgatcagctcatgacggttatatttccactcctgaagcatctttccctccagaaagacgtcagacccgtattgcgtgaaagatttcatatgccagaatggttccaaaaccatgggatcccccaaattagtcaggctgtgtaagttttgctgccgcacaatggaattgttttgatgaaggctggagtgcctactatgctataagccccttaaggtcatgttcgtttgatcccaaaaccatagggattgagggggattggaagggattggagaggattttgacttataggggatttaatccccctcagtccctatggattagtacaaaacgaacagggcttaagggagagcacttgtacattattatcaatattcacttagggttcttgataaaaccgagtcgctgttcatatggagttgtcacacccgaagataagaagattgtaatctagcatgacctcagatttaaatctgtgtagtggagcattttatatcaattaattgttgtatatcagcctctgttgtaaaattttattgttgacaagatagtctaatgaatagttcgtgatccatggatgtcaaaaaaaaaaaaaaaaaaaaaaaagtaaaaaaaaaaaaaaaaaaaaaaaaaaaaaaaaaaaaggggggggcccccctttttttttc

SEQ ID NO: 18775 - DNA, 3688 bp, Zea mays
  misc_feature (3680)..(3680): n is a, c, g, or t
gccggccgcctcgccgcgattccgctaagctcacccgcccgcaaaaacaccacgggcgcgggcgcggagaccgaccaccacggcaccacctccacctcctccggttgccttcggcctcgcctcccctccgtcctccccgtctccagcctccgggaccggaagctccacgtggcgcggcagctcgtacccggcgtctatggcggcggcagaagtgtactcgccgaccgcggcggcggcggcgcagcagcagcgggagaaggcggcgtcgcaggcgtggcggacggtggtagggtggatcggcttccttgttcaggttctgctccagatccttcgaggcacgccgtcctgcgcccagctcttatccttcgtcggcgtccgctacccgctcctctccgggcccacagcctcgaacccgtcgccggaggtggccttcatgccgctccgctccgagatcccagctgacgcggcacctgccccgacacctgcgcctgagcccctgggccgcctcaaggtagtgcttgacttggatgagactttagtttctgcatatgaatcatctagtcttcctactattgtacgtacacaagctgttgaagcaggattacattgctttgatatggaatgcatatcatctgataaggatgctgaaggaaaacagaaggtgaatcatgtgactgttttcgagcgtcctggtttgcatgagttcttgcagaaaactagtgaatttgcagaccttatcctttttacagcaggtttagaaggttatgctagacctttagttgatcgaatagatgttcacaatagattcagacttcgtctctatcgcccatcaactgttaccacggaatacagagaacatgtgaaagatctttcttgcgtgtcaaaagatttcggcaggattgtcattgtcgacaacaatccgttcagtttcattcttcagcctttgaatggaataccttgtgttccattttcagctggacaacattctgatgaccagctcatgatggttatatttccactcctgaagcatctttctctccagaaagatgtcagacctgtattgcatgaaaggtttcatatgccagaatggttccaaaagcatgggatcccccaaactaatcagtctgtgtaagttttgctgcccttgttttgatgaaggctgtgcctattatgctataagccccttaagggagagcacttgtatattattatcaatattcatttagggttcttgataaaaccgagtcactgtttatatggagttgtcacatccaaagatacggaaattgtaatctagcataatgtcagatttgtatctgtgtagtggagcattttatatcaattagtaactgttgtatatcaccatctgctgtaaaactcgattgttgacagttaagatagtctaatgaatagttcgtggcccatcaaaaaaaaaaaaaaacccccaggactaatgtcctgccttaccggtaaaatggcgctttttttgtagccatccggtaggtaatcattaatattaccagtaagcacacttatcagcacagataacatgtttgaatcttactcgccaatcgcaacaaccttaagtcagtgacttttgttattttatctgaaacattgtcgcccattcgccgaataagttactggaacatggagccttttatctgagtttctggacatcgaattcgttggagcttcttatctggcttataatctgggatgccttatcaaacttgtacgctctctcataaacgcctgcagccacaagataaagctccctcttgtcgatgcttgggtcatggcttagctcgccaaccagcacttcgagcgccttgaagtccttctgagcgccaaggaggctaatcatctgaaagtgcacccggtctgagaacacacaacctgcctccctcattgcctggtacagcgccgcggccttgtcgaactccttcagcttgccataagcattcatcgcggtggcaatgatctctgagtctggcaactggcccaacttcctcatttcatcgaacacctcgatcacattacggtgcctccggttcttcgcgtacaagtccatcattgctctgtgcaccgatgagtccttgatctcaccggtgttgaccgcacgacggaacagccatgcggcctcttccagacgaccggcactggccaagattttaatggctgtctccttggggatgccctccgggtcggtcagatcgcgcaacaaacgcttggcctgtgagacaagcccggcacgctcataggccactaccattgtctggtacagcactgggtcgatctccgtgccagcttccctcagcttctcaaacagcctggcagcgcggtcgagcttcccggccttcacccatatggacaagatagtggagtaagtgatggcatcaggctggacgccaatggcctgcatctcctgcaccaaccttccagctttctcgtcctccagcgacttgccgtagatggtaatcatggtgttgtacgtcaccacattcggtttgacgctgctaccagcgccaccgttgccatctgaagtgctgcgcatgaggtcaaacaggtgaactgcctcgccgaacagccctgcatcgccgtacacacggagcatggtgttgtaggtcaccacgcttggcggcacgcctgcccggcgcatggaccagaccagccggtccgcctcgcgcgcgaggtccagctgcccgtacgcgttgaggatgatgttgaaccaccgagatgtccggcttgacgcgcgccacggcgcgcatgtgcgagaacagcgacacggccgcgaggtgccgcccccttcgcgccagcgccgcgaggatgggggagtatgtctccgcgtcgggcgcgacgccgtcggccggcatgtcgtggagcagcatccgcttggcgtcgcggagaaggtcggacttgcagtaggcggcgacggccgcgttgtatgccttgaggtcgggcctgatccccgcggcacgcagccgggagaacagcgccagcgccttgggcgcgtcgccaccgcggagggcgaggtgaatgaggttggagaagaggatcaggtccggagccacggcgtcatcctccatgagcggcaggaaggtgagcgcgtggtcgaggtggcccgcacgggtgagcgcggcgaggagggtggagtacgagaacgcgtcgggggtcacgcccctctcccgcatctcgaggaggaggccggaggcgaggcggagctcgccagcgcggcaagcagagcggagcagtaggttatatgggatgaggagcgtgggggcggggaggtccggcgcgaggaggtcgagcagcgcgacgccgcggcgggggtcggggaggcgggagaggagcgcaccgaggaggcgcgcggagacgggtcggtgcgtggcgagcacggctgccaggtcgggagccgtccgcgcggccgagagcgcggtgacgagggccgggacgtcgatcgtacggtcatcgtgctgccgttgttggagctcggcggcggacttgtggcgctggtggagggggtgagaagaggggaggttggggttcagccagacggatttcgcggcggggagcctgcggtgagaaggtgatgggagcgccgcggcagcggccggggctgtagtgggcggcattgggtgtcgcgtcgtgtggccgcgtgggagggaatgagagatatncccggccg

SEQ ID NO: 18776 - DNA, 4166 bp, Zea mays
  misc_feature (2358)..(2358): n is a, c, g, or t
  misc_feature (2456)..(2456): n is a, c, g, or t
cgttgctgtcgctctgtgcttcttctcccgccgcccgtgttccgttgctgtcgctcggtgctccggcttattagggtttgtgaaccggtgcgatctgcgcttctgcggagatcccggtgctccgttctccctcatctctctcctctctcctgtcttcttctccccctccggcctccggtgtgatctgcgcttctgcggagatcccggtgctccggcttgctccgttgaggaaccgggactccggggtccggtacggcggcactggcactggcactggtactctcctctctcctagctccggtctccctctcggcctctcctctctcctagctcttgtctccctcacctatcttcttctccccctccggcactgtccggcactggcactggcacttgtactctcttctctcctagctccggtctccctctcggcctctcctctctcctagctctggtctccctcacctatcttcttctccccctccggcactgtccggcactggcactggcacttgtactctcttctctcctagctccggtctccctcacctatcttcttctcggcctctactctctcctagctctggtctccctcacctatcttcttctggtgctccggtctctcctagctccggtctctcctagctctggtgctccggattcaaatccgtggaggaaccggttggccggaccggtcatcccctcctctctcctagctctggtgctccggcttactccgttgaggaaccgggactccgagcccgaggtgggtcgatggccgtctccgacgatgaaactgttgagatcgactgcaacgaggagcgacggttgtgtgggttggccggagacgacgatgaggatgacctccgggaggatgcttcattttcttgttaagattgctatacatctaaagaactatgctaatgacactcacatcagaggtgtcattcaacctatgatagataaatataataaatattggaggaacatccctttactttactcttttgcattcatcttggaccctagagctaaaatgaaaggttttagtagagtgcttagaagattaatgaacctgacaagtacagattatgctgtttatcaggttaccactagagctaagcttactgatgtttataataaatatgaagagaaatatggatctgttagattgaacagggttgtccctcctaacttgtctggtaagaaacggtctgcttgggatgaaatttatgatgatgctgatgatgtgggtacttctgttggtatgcattcttttgcttctactctaaacattgctagagatacctctgcaactgctctactgcatgctgcaagctcttcagcttctactgcttctgaactcatttcttacttagattgtgacactgtcaaccaattaactgatgatttcaatatcttgcactggtggcatcagcacaaactcacttatccagtactatcaattatggctaaagatattttaactgttcctgtgtctaccatctcttcagaatccacttttagtttaactggcaggatcatcgacgagcggaggaggagattgaagtctgatgtggttgagatgttgacatgcattaaagattgggaggatgctgaagcaaggatgcaacacatggtggatgacaaagagcttgaagaaacatttgaagatctttatcttgattagtctctagtatcttactctctttgtgaccatttctgtaatgggacagtaatattatgtacctggactggactttgttgtaaggacaataaactttttaatgagctgggctgtactcttttttcctgtctagagtttctcacaagggtgagttttacctagacaggtttttaacgaggcagccattgcactacagctcataaaattgttgtttgattagtctcttattactctctttgtgaccatttttatgttgtttgaaattatcttgtatctgtttgattgctagaagtcataataaaattatctgttattctgtttgagtgtttgattgctgttgctgggattttatgcatagtgtccgtgctggcactagcactggcgtgccggcgtgcctgttggcacggcacgacatggctaagcactgatagtgtcgtgcctgggccgagggcccagcacgctggcactaacaggcacgacacagatcttttaccgtgccgtgcctagtcgtgctagtgccagtgccgtgctgtgcggcccggttggccatctatagtatggagcacaccatcaaatttgtccttataatttaaatcatcgatacatctcaaatagtataacatataatattcaggtgtatgtaatacgatcgatctcctcctatccagtanttagtaaatttgttaaacctttcgttacgttgtcattcaattattcaaaactagctaatataaaaggagtactatgatctttttgtaatttagctagntttaaccagttattttttttattagctgctcagtttcgatatagtaatatacatacatattaaaattagcgcgctaaagtttagcaggtggtttggggggcctaaccgatcgccgctgccgctgccgctgccgctgccgctgccctttattacggttttcagagaggctgatctgatccgcgagtggttttcacagagaaccactgcagcatgaccatgaggcgcgtcgtgcgatggctcaagtggatactgacgggcaggaaggaggagcacagaggactcgaggcggagaataggcggcggacgaccggaggccaggacgcgggagctcgacaacgccgtgccgcgatcgtcatccagaaaacgttcagaggctacctggtaacgatcgatcgtcccgtcccgtctcgttctcatcgatctgttcctagcttcttgatagcagttgatttatcattggtgtctctcaggctaggagagcgcttcgagcgctccggtcactcgtcaagatccaggcgttggtgcggggctacctggtcaggaagcaggcagccatcacactgcacaggttgcagacgctcatgcgcctgcaagccgactccatcgccgtcaagaatgctcccttccggaaatccatggaacaagaagtaatccatatgttgtttgtttttttttccctttgtttgctgcatgattaacgatgttgtgttcatcaagtttgccgtacgtgcaggagaggatctttgctcgggaccttcagacgaagccgccggcgcaccgccggaggctgtccgacagcacggactccaactacgagcgcagcccgcggatcgtggagatggacgacacgggctacctccgctcccggtcctcacggatcaccaccagcagctacatgtacaacccggaccacctactagcggagcgtcaccgccacgcggcgccgacgccgtcgtgctcgccgctccccggcggcaagcagcagcccgcgcggcgctcgtaccggcggagcacccgcgactcccggggctctaagcctgcgcagacgggcacgccccggatcgcctcgtcccacgattcctcgcccgccaagagcgtcgaccagcacggcctggccgtggccagcacgccgcggcggcgggacagggaggggctcgtcagcccgcggtacatggccggcaccgcgtcgtccgcggccaggacgcgatgccacagcgcgccgaggcagcggcggacggcggcggacgccgagcacgagcaggcgccgaggaggtcgtgctcgcacgcgacccgaacaacggccggcttctccggaatcggcgtcggcgacgaggctgccagagactactacctggacagcttctggtgatcaggcaaccgtgatgcggagctggtgggtcggtgcgctgcttgcgtttagattttgtatatatatatagtagaagacaagtgcacggatttgcaccctccactcgtagtcgtagactctaaagcatctagcaggacagcaaggctgagtgcagatgctgaaacatatttgtacacacttttgttgcttgggtgtgcaagtgttcgatctcatgctgaaacaacgacattgtcagagcacagcaaacgccccgcttggagggtatgaaaagtgaagcacacgtactacatgacaattttacaaagctaacaacgaaaataccaaatttacgaacctcactg

SEQ ID NO: 18777 - DNA, 3472 bp, Zea mays
aaaacgtttcatcaaatgttctttgttcatggattgattttgctcatggaagctgttacttgctctaaggatatatgaatatgacaagtagcttcttaagcctcgccgtcgcaccgaacaacgagtctcgccctcgcacggtcacatctgtccacctgctcgcttgtgccttgtgaagccaccgaacctgtgtctatctgaggtggcgctatttgtaatcctaggttatagaatgtcaaacaggccacccgacacgacactggcactagcattattaggcatgatactattagacacaacactgttagatattattagtaattatgctggggcctgtcgatactagcgtctagacatgcatcggcccaaacactagtatcatcaaatggtgtggaagaaaaatcaaaacaatgaagtattgggcttcaacccaattaatataagcgaaagctcaaatttatactggtcagtaatgatgtcatttaagccccatatatagaccgtgggcagtccatttcaacatttcccaaaaaaaaataagaaagaaagaaatgcagagatctatcaggctctctcttttgaatctcggagcaaggccgtggtcgacaagcctctagaaatcttagagtcgctgctggtggtggtggtcgtcatcgtcgtcgcagtcgtagtcgtaaaggagccaccactgtagctttcaacggacaaagctccataggcacgtccactgacggcgaggtccgacgccgtcttgtacatctgcggcgggagcggcgggagcctggcgtcttccgcctgcaggatgtgcatggcctgtgcgatggacggccgctcgctctggtcagggtgggcgcaccacagcccgacgaccagcaccctctccatacactggtcgtggcggagcccgtcgccggtcctcagccgctggtccgccgcgtcgaggatcgcgttccggccgtacaggccccacacccacttgagcagaacgaagggcggctcgtcctgccgcaggaccaccggggcccggccggagacgacctcgaggaggacgatgccgaagctgtagacgtcggagtgggtgctcgggtgccgcgtgttgacgaactccgggtcgatgtagcccgcggtgcccagcacggcgttggtggtgtgccaccgcccgccgtggtcgccgagccgggccaggccgaagtcgccgagcttggcgctgagcgcgtcgtccagcatgatgttgctgggcttgatgtcgccgtgcaccacgcgctgctcccactcctggtggaggtaccgcagcgcggagcccaggccgaggatgatccggtacctctccggccacgccaaaaaggggctctcgctgccgctgtcgccgctgctgctgtggaggtgccggtccaggctgccctgggccaccagctcgtacacgagcagcaggccgtggcggctgtcgcaccagcccaggagctgcaccaggttgcggtgcttgaggcggctgatgatccgcacctccgcctcgaactccttcctcccctgcgccgacgactcagacgagaacaccttgatcgccaccggacgcgcttcgccggcgacgacgaggttgcccttgtagacgctcccgaagcccccgcggccgagcttgccgtcctcggcgaagtagttggtggcggcggccaggtcgcggtacgcgtaccggcggggcccgctggcagccactcccctctcgagctccgccctgctgccgtcctggtctcggtgaccgttgtcgtcgtcgtcgtcgtcgctggttccaattcctcccgacgatcttctccttctcctgcgtttccaccagaccagcacggctgccgctgcacacgccaagagaagcgacaacagaggcaccagcacggcgactaccagtgttccttctgaagatgtcttcttgggctgctgggtgctgctgccaggtgtcagagcacgcggcggcggtgccggtgccggtgctggtgcttcctgcagagtggacgtgaatgaccacgacagcacctggtgctgctcgccgccttttccagtcgcggcggagaagccaaccgcgacgcgctccggcaggtagcttttgagatcgacggtcgcgttgacgttgtacgacgtgtcgtagatggtgagctggacggccaggaacctggtgacattctcgtacgacacggtggccaccatctcgtagccggacgtgaggttcctggtgctgctggtgtccgtggccgccgtggagttgagggagttgacgtcgatgcccacgtggctgccgctgatgtcgtcgttggcgtggttgaggaaggtgtcgaactcgacggcgacgacggtgccgtcgcccgtgccgttggtgaaggccggcatgaggccaagcatgccgccgctgctgttggtggggatgctcgacccgaagtggccgaggaagaacgccatgccgtcgccggggaacgtgctcgggtcccggctgatgaggaaggagaaggtggtggtgaagctggccgtctcgccggtgcgggcgtcccacagcggcaccgggtgcatgtacgtggcccggccgaggctgtacgtgctgctctggtcacgccggttcctcgtcagctcgagcgtgtccggggtgatgtacgcgtcgccggtgcagttgaccagctgggagaggccggggctctggggcttggagaagctgaggtcgaaagacagcgagcgtgcgcgagggacgtggatggacggcagcagcagcagcagcagcgtacagagacagtagatgccgcgcgagacggtggtgaggcccgagggacggccggccggccgccatcgttgcagcatttggtctgcagtctggaggaaggcgaaggacacataaaaatgtttccgagtacatgtacatacaatacaaggaagctgctgttccacccacccacctccggacgctaggctggcgtgtatgaccgtgacacgtttgatcgagccatgcagcgtggacttggtcgtcgagcgtcttttctgtgcacagcctgctgccgcccactacgagacaagcgtggaaatatattagtcagtttcgttacagctaataatccaacataatagaggtacggtgaaaaggcttttgggagcacgtacgttactctctgtgttttgccccttgtcagaattcattttgataacttctcgcaagtcatcctcacagcggacagatgaagagtttgagggttttgaaataatatagttttgaaatactatatttcacgattgcatatgacataaatattatagttttaatttaccgtagtaaaaccacgatattacttaaaaccgagatgtgtttagttccatcagaaaactaaagtatttttgcatagagaacagaaaaaactagggccatgagtggagttttcaaaactccaaaaatatcacggttataggtaaaccatggtatttaaaattgtgttttaccataccaacc

SEQ ID NO: 18778 - DNA, 3185 bp, Zea mays
  misc_feature (33)..(33): n is a, c, g, or t
  misc_feature (38)..(38): n is a, c, g, or t
  misc_feature (41)..(41): n is a, c, g, or t
  misc_feature (48)..(48): n is a, c, g, or t
  misc_feature (60)..(60): n is a, c, g, or t
  misc_feature (73)..(73): n is a, c, g, or t
  misc_feature (93)..(93): n is a, c, g, or t
  misc_feature (1256)..(1256): n is a, c, g, or t
  misc_feature (1481)..(1481): n is a, c, g, or t
  misc_feature (1561)..(1561): n is a, c, g, or t
  misc_feature (1671)..(1671): n is a, c, g, or t
cggtaccggcttcccgggtcgccccgcgtccgntttgnaanactcagntttcagttcggnaagcttggcgagnagattgcagctcgatctagnataaaggaacatagtcgtttcttattcattcctggacctgatgatgcaggtccttctaaagccctcccaagagtgcacttccaaaatatctaattgaagaacttcagaagcacataccaaattcaatcttccccagcaacccctgcagggtgaagttttacacacaagaaattgtgtttttccggcaagatctcctttacaggatgcggcggtcatgtctcattccaccaacaacggaagaaacaagtgacccttttgaacacctggtagcaactatcacccatcagagccatctttgtccattgcctcttactgttcaacctatcatatggaattatgatcattgccttcggttgtatccaactcctcacacgattgtattgggtgacaaaagcgagcagaaagccttcaaatatactgggatcacttgctttaatccaggttcgtttgcgaatgacagcaccttcgcagcatatcgtccttgcaccaaagaggttgagctttctgcgttggaaggctaacataaagggagaataaactgaagttctccaatttgatgaagtgtaaagtcttcgacaaattaaagaactgccacttccacacaaggaaccgtgaaaatagcatggctttcatgacgatgtggtgtttctgtgaagagaactgatgctgatatctcatcataggctcagcaaagcagtaggagcagcacattggtgtttgtgcagcatctctagctgtttgtaacaatctttaatactgcacgttagaccagactattttacttgtactgtttagtttttcattgaatcatggtaacaactaacaagattactttctgacagtgctcataactgctgtatcttcatattttgatcacccacctttccaattgttatatttggtagtctagatattgtaccttgtcatgtgttctatatttgatagtctacatagtgtcttgtatagtgtcatatgtattcatgggtcttatctcctatgttatgtattctatataaaccatctaaggactcaatacaatatattaatccttggcagcaatcccactaaggcatgttcgtttgatcccaaaaccatatggattgagggggattggaaggaattggagaggattttgacttgtaggggatttaatcccctcaatncctatggattggcacaaaacgaacatggcctaacatggtaatcatagcctagatccaattttctttctcgcttatgctaaactaggggttgtgtaccctttttggtcgcagacctccctaaagcttgatttggcgactagagaaatggatgggaccatgggggaggagtctcattcaattgtcgccttccctttggccttcatgccttgagacatcgatgccctnaggtaacgacttgtcgtcttggttgccgtcaccaatgacgtcgaagagaatgtcgttgttgtctatcatcgtgtgctggntgctcgctagctccttgatgaggagcgagcgtctgttgttgatattgagaagaaagccaccatagctgaaaagttgtcgccatcttcctcaactatggagaccatgactncttaatcgactgttgttgatattgagaagaaagccaccattgctaaaaagttgttgccatctccctcaactatggagaccacaaccgactccagagaccgttgtcgccaacctccacatctaggcggttgccattcggaactttcattccctcgtcaacatcgttttggacgcctcgtagaccaattatacctgttggcgcgatctaatgttgccgaacctaatgagatacacccttgccgaccacgtcgagttcgatgccgccctcaccgatgattctgacaagatctgatgggcgttgccgtcctctgttgactgaccaacacgatttcatctgatcttcaagaggtcgtctagaaatgtggttgcacctcgtgacacccgtggcttggcctcaataatgagttcttcggtaaccaccttgatgctaccttccgcaaatttgtataagacaacctcatcatgagcgaatacttccgcaagttcaaaggcatggccgatgccctagtcgatctcgggtcgtcgttgacaaccagatcctcgtcgtcaacacctgggtacaagatatccatggaaatctttctcttgctggtattgaacaatatctgcaactgtgggatgttcttggcaattttcaactacaaaacatggatggcaagcatgtgtagagatttaacaatagtggtttgtttagctccaaatctgtctacaatgtttttattggacctaaatcttttgagccttggacaaaagagctgggcggcccccaaagtgtaagacatttatttggcttgctataaacaataaatgttggacaataaataggctacaaaaaagaggacttgactatcctgaaaaccgtgttctttgtgacaaagaagatgaaactgtgcaacacattttaacaaaccgcgtttttgcaagacaatttttgcacgataccttagctcgaattggtctttctactatggtgcttaagagaagagatgcttgctttgctgaatggtggaggaaagcttcttctaagattcctaaaaacaaaagaaagggtttttaatagtgttgtcatccttggagcttgtagcctttggaagcatggaaataggtgtgtttttgatggagttcggccttgccttgctaccctagataaggggttcataaatgagttgtagctatggtttttggcaagtgccaataacatgtacactctttttgtatcctgactggaggaaggttttagtcttttagcttactatggtgtttgagttatgtctggtgtgtgtgtgtgtgtttatcttgtttgtttcgggctctaggccttttcttttccttttaatataatgatatgcaactctcctgtatatttgagaaaaacatcttgtattgtctaaaccattgcttccagcaagtcagggccgtcatccgatgctacttgtcgttcccgaacttggtcaaggtttgggacgatctcgttctggactctagaggagatccacctagatacctctggtctag

SEQ ID NO: 18779 - DNA, 2286 bp, Zea mays
cacaccaaagaggtcaccacctcaccacagtgaatgcctctccggccccgccccgccctcatggcctcatcacaaagcgagggaaaaaaagaaaagaaaagaaaaatcacgagtggaatcgttgatccgcacgagacaatccttgctcgcttagaagattcctacccttacgtttggttggatgcttggatctccatttcctccctctgaacattcacccgtaccgaagtctctgattccagactcgatccacgccgcgcgccacctgttcgaggtaatttcctcccagatacaacctgccgtcgccgcctccctcctagtgccccggcccggcgccggccatgtcgctggcctgcggcctgccgctgctcgagtgcgtctactgcctcgcttgcgcgcgctgggcatggaagcgctgcctccacagcggcgaggtcgacagcgccacctggggcctcgcctccgccgacgacttcgagcccgtgccgcgcatgtgccgcctcgtcatggccaactacgaacccgatctctccccctccgccccgctcctcttcgcgccgcccggcggctacggcatcgaccccgcctgcgtcctccgccgccggacctacgccgacacacgcggccgcgtcacgccctacctcctctacctcgatcacgcccacgccgacatcgtcctcgcgctccgcgggctcaacctcgtcaaggagtccgactacgcgctccttctcgacaaccgcctcggcaagcgccgcttcgacggcggctacgtccacaacggcctcctcagggccgccggctgggtgctcgatgctgagtgcgacctcctcagggaactcctcgagacgtaccccgactacacactcaccttcacaggtcattctctgggcgccggcatcgccgccatgctcaccatggtcgtcgtcctcaacctcgacaagattggcaacatcgacaggacccgcacgcgctgctacgccatggcgccgtccaggtgcatgtcgctcaacctcgccgtcagatatgctgacgttatcaattcggtcgtcctccaggacgacttcttgccccggacggctactcctcttgaagacattttcaagtcgatcctctgcttgccttgcctcctaggtttgagatgtttgagggatacatgtatacctgaagacgctatgcttaaggatccaaggaggctttatgcaccaggccggatttatcacatagtcgaaagaagaacgtgcaggtgcggaagatatccaccggtagtcaaaacagctgtgccggtggatggtagatttgagcacatagttctttcctgcaatgccacagcggaccatgccattatttggattgagagggaggcccagaaggctttggatctgatgctggaggaggagaacacgctggcagtgccgtcggagcagcggatggagcggaacgaaaccctgcagagggagcatgtggaggagcacagggccgctctgcgccgggccgtcacgctgtcggtgccagacgggcggcgaccgtcgccgtacggtacgtttgacgacgtggagcagcatcgccagcagccggagaggagcgagagcttcccgccggcggggcccaggcagcgcatgagctggaacgacctgatcgagcgagtgttcgacaaggacgaggacggccagatcgtgctgcgcagctcggttcttctctgacgggcggctgggccgttgtaaattcctttggtcttgtagctgtgctgcctctccctgtagtacccccatttttcctgtgttattattggttgttcaatgtaattccttcattcattgaagaggattctttttctcatgcgcggttcatttagcgacatcagctccgtgcagacaagttttgtgaataaattatcaaggtagagtagatcaatttttgaaatcattttcctgttgactctgatatgtaaagttaggatccaaaatcaaaacctgcattgctgaacatcattcagagcaaacctaccaaatcgtaacacgtgtttgctcgctagagaatacaaaacacacacacagcttcatgatgaagacaccctcatcagctagtaagcatatcaaaaatagtctcgtcatacatacatgacaatgtatacataacttatcacttcatcagttcatgcatgtgaagacaccctcagtttctcaggttccagttatcatccagagttcgcttgggtttaatccgtaccttctatagtgtctttatctctatgaattgtagtgtgctgcagagtcgactaaaggggat

SEQ ID NO: 18780 - DNA, 5662 bp, Zea mays
  misc_feature (173)..(173): n is a, c, g, or t
  misc_feature (219)..(219): n is a, c, g, or t
  misc_feature (252)..(252): n is a, c, g, or t
  misc_feature (268)..(268): n is a, c, g, or t
  misc_feature (329)..(329): n is a, c, g, or t
  misc_feature (339)..(339): n is a, c, g, or t
  misc_feature (487)..(487): n is a, c, g, or t
  misc_feature (558)..(558): n is a, c, g, or t
  misc_feature (602)..(602): n is a, c, g, or t
  misc_feature (611)..(611): n is a, c, g, or t
  misc_feature (4451)..(4451): n is a, c, g, or t
  misc_feature (4617)..(4617): n is a, c, g, or t
  misc_feature (4675)..(4675): n is a, c, g, or t
  misc_feature (5033)..(5033): n is a, c, g, or t
  misc_feature (5190)..(5191): n is a, c, g, or t
gcgaatggaggcggtgcgggggcatgtgggtgtgagcgtcggtcctgcttaggatggatggagtcgcgacggcagctgttgggcctgctgctgtgggactgaccgaccttctggaactctgcgtcgtccaggtgttgctcaggcttaacctgccagagatctgtagtctcacntagctcaaccacgcgttctgcaacgcggctggggctgacttcatgngggaagcgaagctaccggagaactacagttacntgatggagttcgtctngagcggcgacacgaggaggcagaagcggcagcgggtcatcaagacagggaactatgcgagncttgcgaggnctgcgccttttattttgtgacggcaaggtgagatattttgcttccttctttgaattcatcgtcttttctttgtccatgaccgagtgcttcctaatttgtgacccctggaacatttttctagagctcaataagagattagaaaaaaatnggttgagtacttactacaatattatctttcaattgaaataagtcacttgttttccttttggaaaattgtgngctctgtcttagggctgactcaaattagtggcaaggaagatcgntacattttnggccatgtatctgcttgctgctaatggaggggtcgccctagaggaacgatgccgttgggcgaggtcgtagggacccactgagtctgtattttccccaatttgaatattgaatattttcccactgtagttataaatttgaaaatggattgatatatgtcatgtcacacaaatatcctcaattcatgaatgtttgtgtacaattgctaccaagcatattcaccttaggttcctttcatccaatatataacatgacatttgtgtacctcgtcacaaggtatattagtgtcctccaacaaacgagtttgccgtttaggttctatggttgattgaaattaatataatgcggctaaaacatgacaagtatagtggaatttagaagtcacactgctaattagttacatgtgcatgctacggtttctataaatcatatagataggccttgcttaaatgaaatatttattcaaacaccattatattaaatctttattgaaattattagtaggtttatatatttacaacatctgtcttttatataacgcaaacaaacatgagttgcaaaaagccaagcgttgggttaataaactcattcttaaatatagtagagatgtgataactggtgtgaactaatatatagctttgtagctacaagtgacaatagcctaataaattcacaaatcctcatgtgaagtagtattctaaccaataccatcggtaaaaatgaacatatcgtctttcaaaccttcattatattgatgagagattacgtttcaaaatttgaacaatcacaagtggccggaaaacactgtagtcaccattagttctctaaagaaatgctcactaaactcaggtttaattaacaagttgctaaatatatattgggaacaaaactaactctagtacctaatagttcccgattttttttcacttcacacgtacacagcacgcaacctccgtcgtttgtgtcccttgggcaacatggactcaagcttctctttcttctttggtagctccagatcgtcgaccttggcgaaccatgggtggttgagcgcggcggctgccgtcagcctcctgtttgggttgcatgtaagcaggccactgagcacttggaatccttccgtggacagcttcgtctcggggaacagatcgcgcaggtggttgttccgctgcatgtccagctccggcatcacctcggtggcgaatggcgtcgacgagaaccacggccacgtgctgtcgtcaggcacgccgagcacatcgaagatcgcgcagagctgcccgtcgtcgtgggatccctggaagagaggcctgccgttgttgacgagctccgccatgacacagccgagcgaccagacgtcgaccttggtgtcgtagtcgggctttcccagcagcatctcgggcgcctggtaccagagcgtgccggccggctcgtacgggagccgctcgtcggtggacatggcgagcccaaagtcacaaatcttgacgacgctctgaccctcgccgacaaggatgttctgtagctttatgtcgcggtggatgatgcaggcttcgtgcatcttcttggtgcccgtaagtagttgccacatggcggcgcgcacggtggcctcgggcagcggcgggctcccgcgggggcgctgatggagaagatcgtggaggctggtctccatgcactccatgacgaggtacctcttccaggtgcccgggtcgcggacaacgccgtggaagctgacggcgaatgggttggcaccgccgcagcacgcctcctcatggaagcgcgcctcgcggaacaccatagtgaggtcgccgtcggctgcgctgtggcacttcacggcgacgatctggcccgtggcacggtggcgcgccttgaagacggcgccgaaggcacccgcgccgaggcgacaggtctcctcgaactcgtactgctccgaactcccgacggcgatgcgctttctcttcaggccggtctttaccgcggcggcaggctctacggaggcaggcatcacgagtgaattagttggacgacggcggattgcgttgcctaggctaggctggggacgaggcgaggagatcagatggaagacgtggtgacggtgacgacggacaagagattgggggtgcaggtgcagattatatagcattggccgactgccggttgggtggtgcgtgctgcacgagtctaaaagccagattacagcaaggcagttgcacggttgcaccccgtgtcaatcgagcgagccgatggattatgatgttgagagtagtttttgtttaagaaatgttgttcaccgtttggttcaaaaaaatagaatagtccgtcgtcttttaaattcctgtcctcattttgtttttactttatttgtgaaatagaatatataataacaatatatcaatgtcactttgatgggccgtttggttcaaaaaaacagaatagtccatatcgtcttttaattcctcattttgtttttttgtttgttttgagaaataaaataatataatctttactatattaaagcaacagtttcaacggtcgtctcacgttattttttatttgcaaaaaactccctcatttttttaacaacccggagtatattgttgtcccggatccaagaacgttgtatccccatccatctgctctcatatcccatccacccgcttctcgcattgcccgcctgcatccctcggcatcccaatctatacaagcccgtggtaacaaactctcacacctctctggcgggccgtcagttgtagtttatctcgtcgaaatcaaccataaacctgttataaatcctgcggcatgaccagaggagcagattcatcttggcgcccaccagcacagagataggctcaccttgcgcgcaaggaggaggccagtcgtgtatctgcttgctactactgggtctcgcgacggtgcggcgcgggggcatgtgggcgtgggtgtcggtcctgcttgggatggtcggagtcgcgacggcagctatcgggcctgctactgtgggactgaccgaccttccggaactctgagtcgtccaggtgctgctcaggctcaacctgccagagatctgcagtcttgcgtagctcaaccacgcattctgcaacgcggcgggggcggacttcgtgtgggaagcaaagctgtcggagaactacagttacctgatggagttcgtcggtagcggcgacacggtgaggcagaagcggcggcgggtcgtcaagacagagaactatgtgaggcttgcgccttttatttggtgacggcaaggtgagatattttgcttccttctttgaattcatcaacttttctttgtccatgaccgagtccttcctaatttgtgacccctcgaacatttttctagagctcaattagagattaggaaagaaccggctcagtacttactacaatattatctttcaattgaaataagtcacttgtttttttcttttggaaaattgtgtgctctgtcttaggggtgactcaaattagtggcaaggaagatcgctacattttaggctatgtatctgcttgctgctaatgcaggggtcgccctagaggaatgacgctgttgggcgaggtcataggtacccactcagtctggagtggaacagggttgtgaggtgcggtgttgccctcgagtcgacgcgatatgttgtagcggacagccacggtggctatgtgtaggagggggcgaggggcagggtggctcaccaagacatgtatgtccgcattgtcccacccacgcagaagtcgtgccacaccgctccagttccaaaggtgagcaaggaagtaaacagtcggaacggtagtgggcacgcgagcttctgagctggggctcaactcttttgtcttgaggnggctcgtatgggccgttggggtgtttctcgcgcttgtaatgggctttgttgtctttattcgttgtaaagatgtgcacgtggtgaataaagaaaaacaatagattattttcatttctagtttccgttattatcattctatagtttgttgggttgattttaacactgngtatttatctgctataaattaagttttatagttaaccaaatcaccaaatgttaataangcaggtttgaagcaaaaacaatcccaattacatgttattatttttataaattaaggaattcagaagcaaacttagtatattggtggttcataaaaaaatatcgaataatttgtgtgttgtcgcaacgcacgggtattatagtagtatatcactttaattcagtcgttctccataagtttaagcgctagacataatgcagtctcaattggcataagatcattcttcaaaccaaatattctatcactgcgcttagggattcgactttggataaataaagtccctaatgctccatagtttttctttgttatatctatttacataaatcacgtcgtttgtatcgtaaagccaaaggaatagnaaagataaaaggaccacttatcaagaccacgaaaatcaaatacaatggacaaagttatttgatactcttcgtcgatgttcgaaggacaaaacctatgcgatcacttagctcgttcgtagaatacgaagccccctcaaccaagactacacaacaaaannaagtctagagcttgagtttagaatcaagcgactatattactcttttttaaatggataattgaaagtaaatagtccgagtgtattttaaccttgtatagaaaataaaaaaggtaatgtcctctataaggttatatatggtcagcagattgtgtatatggtcttagaaaatattgttttacactatatattgtatagtttacatagtgaagtttaaaataagaagtgggataaataacgctcctagagatagtctaaataatcctctcacatatatcattgaaggacatgaaataagaattcaatcaagtacatttataaaatatttactcagtatcgggcgttgatagtttgtgtgtgcccaaaaacctccacgaccataaggacacggctagatccgtgaagaaaatgtaacacctcaaaattcaattcgggagttcaatagaacaatttttaatttatttatttgagtcc

SEQ ID NO: 18781 - DNA, 3331 bp, Zea mays
ccacgcgtccggccgaggcgagcagccgtcgccgcctatatatcgtgggcgctcgggccggccggtccggacttcctacacacctgccttgtgccttcccttcccttcccttgccttgcttcgcttattgccggcacatcacatcggcaggcgagggacggagcgagcagggaagcccatccaccagccagccaccgcgttcctgagaagcgaggagcgagaaaagcgaagagcggccatgttctggcacggggtcgcggaccggctgacggggaagaacaaggaggcgtggagcgagggcaagatccgcggcacggtgaggctggtcaagaaggaggtgctggacgtcggcgacttcaacgcctcgctcctcgacggcgtccacaggatcctcggctgggacgacggcgtcgccttccagctcgtcagcgccaccgcggccgaccccagcaacgggggccgtggcaaggtggggaaggcggcgcacctggaggaggcggtggtgtcgctcaagtccacggcggacggggagaccgtgtaccgggtgagcttcgagtgggacgagtcgcagggcatcccgggcgccgtcctggtcaggaacctgcagcacgccgagttcttcctcaagacgctcaccctcgagggcgtccccggcaagggcaccgtcgtcttcgtcgccaactcgtgggtctacccgcacaagctctactcccaggaacgcatcttcttcgccaacgacacctatctgccgagcaaaatgccggcggcgttggtgccttatcggcaagatgagctcaagattctccgtggcgacgataaccctggaccataccaggagcatgaccgcgtctaccgttacgactactacaacgaccttggtgatcccgacaagggcgaagagcacgctcggccgatcctcggtggcagccaagaacacccgtatccccgtcgctgcagaactggccggcacccaacaaagaaagacccaaattcggagagcaggcttttcctgctgaacctgaacatctacgtcccgcgtgacgaacgctttgggcatctcaagatgtcggacttccttgggtactcgctgaagacgatcatcgaggctgttcttccaacactggggactttcgtcgatgacacgcccaaggagttcgattcgtttgaggatatcctcgggctctacgagctgggcccagaggcacccaacaacccactgatagcagagatcaggaagaagatccccagcgagttccttcgaagcattctgcccaacggtagccatgaccacccgctaaagatgccccttccaaatgtcatcaaatcagatgtgttgaaaaaggctccggagtttaagtttggctggaggactgacgaagagttcgcgagagagacacttgcaggcgtgaacccagtaatcatcaaacgcctgacggagttccccgctaaaagcaccctggacccaaggcagtatggagaccacaccagcaagatcactgaagctcacatccggcataacatgggaggcctgtcggtgcagaacgcactgaggaacaagaggctcttcatcctagaccaccatgaccatttcatgccgtacctcgacgagatcaacgagctggaggggaacttcatctacgccagcaggaccctactgttcctgaaggacgatggcacgctgaagcccctggccatcgagctgagcctgccccaccctgacggccagcagcgcggcgcggtcagcaaggtgtacaccccggctcacaccggcgtcgagggccacgtctggcagctcgccaaggcttatgcctgcgtaaacgactctgcctggcatcagctgatcagccactggctgaacacgcacgcggtgatcgagccgttcgtaatcgcgacaaaccggcagctcagcgtggtgcatcccgtgcacaagctgctgagcccgcactaccgtgacacgctgaacatcaacgccctggcacgccagacactcatcaacgccggcggcgtcttcgagcgcaccgtgttccctgcaaagtacgcgctggggatgtcggcagacgtgtacaagagctggaatttcaacgagcaggctctcccagcagatctcgtcaagagaggtgtggctgtgccggaccagtcaagcccatatggtgtccgactgctgatcaaggactacccctatgccgttgacgggctcgtcatctggtgggcgatcgagcggtgggtcaaggagtacctggacatctactaccctaacgacggcgagctccagcgtgacgtggagctgcaggcgtggtggaaggaggtgcgtgaggaggcgcacggcgacctcaaggaccgagactggtggcccaggatggacaccgtccagcagctggctagggcgtgcacgaccatcatctgggtggcatccgcgctgcacgcggctgtcaactttgggcagtacccatacgccgggtacctcccgaaccggccgacggtcagccggcgcccgatgccggagccaggcagccacgactacaagaagctgggagcggggcagaaggaggcggacatggtgttcatccgcaccatcaccagccagttccagaccatcctgggcatctcgctcatcgagatcctctccaagcactcctccgacgaggtgtacctcggccagcgtgacgagcctgagcgctggacgtcagacgccaaggcgctggatgcgttcaaaagattcgggagccggctggtgcagattgagaatcggatcaagacgatgaacgacagtccggacttgaagaaccggaaggggcctgtggaaatgccgtacatgctgctgtaccccaacacgtcggacgttaccggcgagaaggccgaggggcttactgccatgggcattcccaacagcatctccatatgagcctgggcagattgtgtctcgtagtaaattgttgtgctgcgccgtgcgatgtgtttcttcattcgttttgtttttgtcagtctcagggtaggggatggagatcataccatgatctttgtagggttgagagaggagtccacgcttgaatattgttgtcatgtatgttattcttggttaataataaagttcgtcagctcatttcttagcaaaaaaaaaaaaaaaaaaaaaaaaaaaaaaaaaatcgcggaggggcaaaaatacaaagaaggacaacacgcaaagatttaatacaacaatcttatgaatgaccactcttaacttatgctcaaaaaccaccattttaactgacactgggctggaaaaccactggccggggcccagcttaatccttcctaagaatattcccatttcttcacctaagcctttttc

SEQ ID NO: 18782 - DNA, 3127 bp, Zea mays
  misc_feature (10)..(11): n is a, c, g, or t
ctcgaggccnnggccgggcccgggagttccatacatacatacaccagccgtgcgtgaaggaaggcctttgctcgccgccacatcacattggcaggcgaggcgagggagcgagcagcagggcaaggcatccacacccacacccaccggacactccctgagaagcgagaagcgagaagcgaagagcggccggccaccatgttctggcacggggtcgcggaccggctgacggggaagaacaaggaggcgtggaacgagggaaagatccgcggcacggtgaggctggtcaagaaggaggtgctggacgtcggcgacttcaacgcctcgctcctcgacggcgtacacaggatcctcggctgggacgacggcgtcgccttccagctcgtcagcgccaccgcggccgaccccagcaacgggagccgcggcaaggtcgggaaggcggcgcacctggaggaggcggtggtgtcgctcaagtcgacgacggacggggagaccgtgtaccgggtgagcttcgagtgggacgggtcgcagggcgtcccgggcgccgtcctggtcaggaacctgcagcacgccgagttcttcctcaagtcgctcaccctcgagggcgtccccggcaggggcaccgtcgtcttcgtcgccaactcgtggatctacccgcacaatctctactcccaggaacgcgtcttcttcgccaacgacacttatctgccaagcaaaatgcctgcggcattggtgccttaccggcaggacgagctcaagattctccgcggcgacgataatcctggaccatacaaggagcacgaccgcgtctaccgttacgactactacaacgacctcggtgagccagacaagggtgaagaccatgcccggcctgtcctcgggggcagccaagaacacccgtatccccgtcgctgcaggaccggccggcgtccaacagagacagaccccaactcggagagcaggctgtttctgctgaacctgaacatctacgtcccgcgcgacgagcggtttgggcatctcaagatgtcggacttcctcgggtactcactgaaggcgatcatcgaggctgtccttccgacgctggggacgttcgtcgacgatacgcccaaggagttcgattcgttcgaagacatccttgggctctacgagccgggtccagaggcgcccaacaacccactggtagcagaggtcaggaagagaatccccagcgagttcctcagaagcattctgcccaatggtagccatgaccaccccctgaagatgccccttccaaatatcatcagatcagatgtgttgaaaaaggctccagagtttaagtttggctggaggaccgacgaagagtttgcgagggagacgcttgcaggcgtgaacccagtgctcatcaaacgtctgacggagttcccagctaaaagtaccctggacccaagtcaatacggagaccatacgagcaagatcaccgaagctcacatccagcataacatggaaggcctgtcagtgcagaatgcactgaagaagaacaggctcttcatcctagaccaccatgaccatttcatgccgtacctcaacaagatcaacgagttggaggggaacttcatctacgccagcaggaccctactgttcctgaaggacgatggcacgctgaagcccctggccgtcgagctgagcctgccccaccctgatggccagcagcacggcgcggtcagcaaggtgtacaccccagctcactccggcgctgagggccacgtctggcaacttgccaaggcttatgcctgcgtgaacgactccgcctggcatcagctgatcagccactggctgaacacgcacgcggtgatcgagccgttcgtcatcgcaacgaaccggcagctgagcgtggtgcatccagtgcacaagctgctgagcccacactaccgtgacacgctgaacatcaacgccctggcacgccagacgctcatcaacgccgacggcatcttcgagcgcaccgtgttccctgcaaagtacgcgctggggatgtcctccgacgtgtacaagagctggaatttccacgagcaggctctcccagcagacctcgtcaagagaggtgtggctgtgccgcacgagaccattacctagaacatcctaatcgaaaacaaggactacccttacgccgtggacgggctggtcatctggtgggcgatcgagcggtgggtcaaggagtacctggacgtctactaccccaacgacggcgagctccagcgcgacgtggagctgcaggcgtggtggaaggaggtgcgcgaggaggcgcacggcgacctcaaggaccgagactggtggcccaggatggacgccgtccagcggctggccagggcgtgcacgaccgtcatctgggtagcgtccgcgctgcacgcggccgtcaacttcgggcagtacccgtacgccgggtacctgccgaaccggccgaccgtgagccggcggccgatgccggagccgggcagcgacgactacaagaagctggaggcggggcagaaggaggcggacgcggtgttcatccgcaccatcaccagccagttccagaccatcctgggcatctcgctcatcgagatcctctccaagcactcctccgacgaggtgtacctcggccagcgcgacgagcctgagcgctggacgtcggacgccagggcgctggacgcgttcagaaggttcggaagccggctggtggagatcgagaagcggatcaggacgatgaacgacagcccgacgttgaagaaccggaaggggccggtggagatgccgtacatgctgctgtaccccaacacgtcggatgtcaccggcgagaagggcgaggggctcactgccatgggcattcccaacagcatctccatatgagcctcctcactgcctgagcggatggtttgtagatgttctgttacgctgtgtgtaatgtgtcgtttattcgttggttttgtcagtctcagggtagggaatggagatgttgattggatccatgatctgtagggttgagagaggagtcacgtctggagaatgttgtcaatgtgtgtttctttcttgttaagaataaaagttcgtcagctcatttatctctaaaaaaaaaaaaaaaagcaatagtagtctgtcattgacttgttctgccttt

SEQ ID NO: 18783 - DNA, 5640 bp, Zea mays
  misc_feature (79)..(79): n is a, c, g, or t
  misc_feature (88)..(88): n is a, c, g, or t
  misc_feature (104)..(104): n is a, c, g, or t
  misc_feature (149)..(149): n is a, c, g, or t
  misc_feature (185)..(185): n is a, c, g, or t
  misc_feature (213)..(213): n is a, c, g, or t
  misc_feature (223)..(223): n is a, c, g, or t
  misc_feature (275)..(275): n is a, c, g, or t
gcttatttggcttcgaatttaacatttcaccactttccaaagtttagatataaccctatttaaaattcacaggttgggntgaaaattnattttatatatcaccngaatatgtttctaatctataatttataacacactcgatcttcagntcgcactcatacagtagaaatgtgacacataaatanctctcacatataacaaatagtaatatanaaatatattncacataaaatcatattagcttaattgatctattcctaaattgtaattattanaatgaaattcagttcaaaggaaaggatcatatgaagtagtcatgttgcccccaaattaaaaaatagttttaggtaattacaataattgatgtatgtgttttatatatgtgtctagatttatcattattcattttaatgtagatataaaatcaatagctaaaacgaatactattttgaaacggagagagtagtattttgactaattaatatcattggtagaaataaatatcctctttcagatatttatggtgacagacaaaatttgaacacttataaattaccgagaatcacagtaagggtgtatacatcaaaattacattcgctgatccagacctaaccaattgtagctaaggaacttattagggttttctctagttcttcctgtagtcttggatgatcaagattcgttggctccttcttgttgcaacttcgtcggtagcctctccatcttcttttcctaaattcccatattttgatttttcacttcattgctcgttctgtctcctgctagaaaccaacagatctgaaattactaaaattcagaggcatgcatcggatggttatattacagcgagacttatcgaattcattcaaaagcatagccgaaaatgattcatcaaataatgcaattgacatcatcacgatgctcacaatattacattaaaggagcttataagattgatctgttataacaataatagactatttttacatcatcacggtgctcacaataaatctaagtcatacgaatacaacacgcaatttctgtcgcttgggcaacgccgacgcaggattctctttctttggtagctccagatcatcgaccttggcgaaccatgggtgcttgagcgcggcggctgccgtcagcctcttctcgggattgcatgtgagcaggccactgagcacctcgaatccttccgtggatagcttcgtctcggggaaccgattgcgcaggcggttgcaccgttgcaattgcatatccagctccggcatcacctccctggcgaatggcgtggacgagaaccacggccacgtgctgtcgtcaggcacgccgagcaaatcgaagatcgcgcagagttgtccgtcgtcgtggaatccctggaacagtggcctgcctttgttgatgagctccgccatgacgcagccaagggaccaggagtcgaccttctcgtcgtagtcgggcttccccagaagcatctcaggcgcctggtaccacagtgtgccggccggcgcgtacgggaggcgctcgtcgatggacatggcgagcccgaagtcacagattttgacgacgctatgactctcgccgataaggacgttctggggcttgatgtcgcgatggataatgtgggcgtcgtgcatcttcttggtgcctgaaagtagctgccacattgcggcgcgcacggtggcctcgggcagcggcgggctcccgcggggccgctggcagaggagatcgtggaggctggccgccatgcactccatgacgaggatcatctccccggtgacggggtcgcggacgacgccgtggtagccgacgacgaacgggttggcgccgccgcagtttgcctcctcaaggaagcgcgcctcgcggaacgctgtatggtcggccgggctgtagcgcttcatggcgacggtctggcccgtggcacggtggcgcgccttgaagacggcgccgaagccacccacgccgaggcagcaagtgtcctcgaactcgtactggtccatgctccccacggcgatgcgcttccgcttcaggcctggctttaccgcggcggtggggtcgcagacggcggcagcggtcttgacgctggcagccatcagggccgcaggggacgaggcgaggagatgatgaggtggacgacgtcggtgacggatgtgagtaatgcgagagaaagcgagggtgtagaactgtagatggaatacttataacgttgcgttagattagataagatagttagattagatagatgtaatgggcaactggaataacgacatctccatctgatcgaatcttaaagcaaaagcaagtcagacgggcactatattactccaaggctatagaaaaccacgctcggccgatcctcggtggcagccaagaacacccgtatccccgtcgctgcagaactggccggcacccaacaaagaaaggtaagctcaagtcagctagtgctagtccataccaaacaaggatgccagaaatttggctgaaatccttgctgggttaaaccttttacgcagacacaaattcggagagcaggctttttatgctgaaccctgaacatcttcatccctcgtgacgaacgctttgggcatctcaagatgtcggacttaattccttgggtactcgctgaaggcgatcatggaggctgttcttccaacattggggactttcgtcgatgacacaccaaaggagttcgattcgtttgaagatatacacaggctctcacccaacaacccactgatagcagagatcaggaagaagatcccccgcgagttccttcgaagcattctgccgaacggtagccatgaccacccgctaaagacgccccttccacatgtcatcaaatcaggtaacccaatattttggaatctttctatgttaatccggtgcctgaactagaaaaagatttaccatggctaaggctaaatcttggtacaaaaccagatgtgttgaaaaaggctccggagtttaagtttggctggaggactaacgaagggttcgcgagagagacacttgcaggcgtgaacccagtaatcatcaaacgcctcacggttagcgttcttgcatcatttggattggcaaaatacaccttgcccccatatattaactgagtacagagccttaaaagccttttatacatttcgtaccagcaagatcactgaagctcacatccggcataacatggggagggaggcctgtcgttgcagaacgtatgctggacataacatagtataccttacatgcaattaggcacactggtcgtcaagtagacccgacatattggcgctactattctctcctttgttacttggttcttctcctacaattcacaaatacaaagcacattatttaaatctgaattatatttgcaaaaatataataaaacatgagatggtaaaaaaaatacagttcatgcagtaacaagtaccttttctcgagaatttttctttttctttcttgtcttcttttcaagtacattctttgctcttctactttttgcatatttcactaccgaactgaggaactctaaatgatatggtattatttactgtacctatagtagcatatgttgaaaccataggaacatcatttttcgcatctttcttagagaataatttgcttctaattctgacttctgcaatgctttctccaactaaacaagtagtgatttttttacactcaacacttcaatgcaaaagatgttgccattcgagacatgcatgtagcatgtactttcaagtttccattctcactccctttcttatcaatataagacatctcttcgcataatttgtccatctattcaatatatattgtgatggtaaaataaaaacattatacatactaagtactttgaaggtatgattgcatagtatacctataagatattgaaacaagtggtcaacagtttttataagaattagtattgtaattcgaaatgtgtatacatacatatggactcaaactttccacgagaacatgtaatagtcatatctatacttgctccttcctcagaatgcttatgagtaaccataaatgttgatgttgtggtttcggaaaccgaggggacaatagatttgagttcggtggcgatgcaagcgtggactcactctgaatactggatcatgaggatctgagctgggaactgagacaccaaggttatactggttcaggacgaggccctagtctagtgtagtgttgatccttgtattgctcaggagcgtgttacagcaagtgtgcttgtgtgtagaaggaagaatgttccgcccttttattgctcaagggaggaatttacagttgggactcgtattctactcgggggtcctttagcttgttgcccctgggccgctctagtccccctggcattgtctatgggggcgtgcgctgtcgtactcccaatctggcgttttgtcatgtccgctctccatacgggccattgtagcttgttcggtgtcaatgttgcggtacctggcgggtcccgcaatgtgggcttacgacgaggttctaggttgtgtctagaacaacttgatcttccatcataccccttgcgttaccttcctgcatgtgtaggtttacacatggtcatatatgtgtccagttctaagttataatctttatcgtttggaacagttaatttactgtgtgatgtgtaatactcaaatttgtaaaccaaattaaaggagatagttattcctatatgatattcctctttttttatatcacatgtgaacaactttatttaagtgagtaattagccaaaaacatataaataatatatgcatcatgtcgaagtttatttgtgtgtgcatttgataacaataaagataataactatagaaaaacattagtacccaaatttgaattaagaacctaattcgcaatttagagtttggagaaaagaaagaaatactataaaacacaaaacacatccataattaaataaattcattccactagtatgttcaaggttaatacttaatttgagtataaattttgctgcgagatttgaattcaaaattctagatttgaaaataaaaggaaaagaaaaacaagaaaagaaaataaaaaagaaaaagaaaaagaaaaaagaggatctcgcttgggccgtgaattcctcggccggcccaactcactcacccacgtgacccgtttctctccacaaccgcgcgccgaatagccgctctcacgcccgctccttctcactggctcacgggctcgcgcgacagcaaataaactccccgcgctgctctggcgtcccactgacacttgggcccgtgcggtcagtcatctaggagatttgtgtgcgtcccaccaacactcgagtcgttgacgtgcggtgcccccaagtcaggcccatccctaaccactcgcccgcaccggctgggaccgtcgatcgtggacgcgacaatcgcagcgatgacctcacctcgggcgcatggccttgaccagggtataagtctctgcgcactgcactcctctgaccgaatcccatctctcgaacggccaaagcctaccgccgccacgcgaatcgcgagattgggcactgcgggcgaattggctcaccacgttctgtcgccacttagggctgccgtgtaggtgagagagctttgtcaaggtgcgacggaagtacacgtggcatggcggaga

SEQ ID NO: 18784 - DNA, 3260 bp, Zea mays
  misc_feature (254)..(254): n is a, c, g, or t
  misc_feature (260)..(260): n is a, c, g, or t
gccggccgggccgggatatatcgcggcgcagggcagcaggggagttccacacttccatacacacctgccttgtgccttcccttccctcccttgccttgcttcgcttattgccggcatatcacacatcggcaggcgagtgacggagcgagcagggacgcccatccaccagccagccaccgcgttcctgagaagcgaggagcgagaaaagcgaagagcggccatgttctggcacggggtcgcggaccggctgaggngcttgnttcggttattttcaatccatatggattggggggggattgatacggattggaggggattttgacttaccagtgatttaaaccccctcaatcctcctcaatccatatggattggggtagaaccgaacaagccctgacggggaagaacaaggaggcgtggagcgagggcaagatccgcggcacggtgaggctggtcaagaaggaggtgctggacgtcggcgacttcaacgcctcgctcctcgacggcgtccacaggatcctcggctgggacgacggcgtcgccttccagctcgtcagcgccaccgcggccgaccccagcaacgggggccgtggcaaggtggggaaggcggcgcacctggaggaggcggtggtgtcgctcaagtccacggcggacggggagaccgtgtaccgggtgagcttcgagtgggacgagtcgcagggcatccccggcgccgtcctggtcaggaacctgcagcacgccgagttcttcctcaagacgctcaccctcgagggcgtccccggcaagggcaccgtcgtcttcgtcgccaactcgtgggtctacccgcacaagctctactcccaggaacgcatcttcttcgccaacgacatctatctgccgagcaaaatgcctgcggcattggtgccttaccggcaagatgagctcaagattctccgtggcgacgataatcctggaccataccaggagcatgatcgcgtctaccgttacgactactacaatgaccttggtgatcccgacaagggcgaagagcacgctcggccggtcctcggtggcagccaagaacacccgtatccccgtcgctgcagaactggccggcatccaacaaagaaagacccaaattcggagagcaggcttttcctgctgaacctgaacatctacgtcccgcgtgacgaacgctttgggcatctcaagatgtcagacttccttgggtactcgctgaaggcgatcatcgaggctgttcttccaacactggggactttcgtcgatgacacgcccaaggagttcgattcgtttgaagatatcctcgggctctacgagctgggtccagaggcacccaacaacccactgatagcagagatcaggaagaagatccccagcgagttccttcgaagcattctgcccaacggtagccatgaccacccgctaaagatgccccttccaaatgtcatcaaatcagatgtgttaaaaaaggctccggagtttaagtttggctggaggactgacgaagagttcgcgagagagacacttgcaggcgtgaacccagtaatcatcaaacgcctgacggagttccccgctaaaagcaccctggacccaaggcagtatggagaccacaccagcaagatcactgaagctcacatccggcataacatgggaggcctgtcggtgcagaacgcactgaggaacaagaggctcttcatcctagaccaccatgaccatttcatgccgtacctcgacgagatcaacgagcttgaggggaacttcatctacgccagcaggaccctactgttcctcaaggacgatggcacgctgaagcccctggccatcgagctgagcctgccccaccctgacggccagcagcgcggcgcggtcagcaaggtgtacaccccggctcacaccggcgtcgagggccacgtctggcagctcgccaaggcttatgcctgcgtaaacgactctgcctggcatcagctgatcagccactggctgaacacgcacgcggtgatcgagccgttcgtaatcgcgacaaaccggcagctcagcgtggtgcatcccgtgcacaagctgctgagcccgcactaccgtgacacgctgaacatcaacgccctggcacgccagacacttatcaacgccgcggcgtcttcgagcgcaccgtgttccctgcaaaagtacgcgctggggatgtcggcagacgtgtacaagacctggaatttcaacgaccagtctctcccagcagatctcgtcaagagaggtgtggctgtgccggaccagtcaagcccatatggtgtccgactgctgatcaaggactacccctatgccgttgacgggctcgtcatctggtgggcgatcgagcggtgggtcaaggagtacctggacatctactaccctaacgacggcgagctccagcgtgacgtggagctgcaggcgtggtggaaggaggtgcgtgaggaggcgcacggcgacctcaaggaccgagactggtggcccaggatggacaccgtccagcagctggctagggcgtgcacgaccatcatctgggtggcatccgcgctgcacgcggctgtcaactttgggcagtacccatacgccgggtacctcccgaaccggccgacggtcagccggcgcccgatgccggagccaggcagccacgactacaagaagctgggagcggggcagaaggaggcggacatggtgttcatccgcaccatcaccagccagttccagaccatcctgggcatctcgctcatcgagatcctctccaagcactcctccgacgaggtgtacctcggccagcgtgacgagcctgagcgctggacgtcagacgccaaggcgctggatgcgttcaaaagattcgggagccggctggtgcagattgagaatcggatcaagacgatgaacgacagtccggacttgaagaaccggaaggggcctgtggagatgccgtacatgctgctgtaccccaacacgtcggacgttaccggcgagaaggccgaggggcttactgccatgggcattcccaacagcatctccatatgagcctgggcagattgtgtctcgtagtaaattgttgtgctgccccgtgcgatgtgtttcttcattggttttgtcagtctcagggtaggggatggagatcataccatgatctttgtagggttgagagaggagtccacgcttgaatattgttgtcatgtatgttattcttggttaataataaagttcgtcagctcatttcttagcctaaaaaaaaaaaaaaaaaaaactcgagagta

SEQ ID NO: 18785 - DNA, 1107 bp, Zea mays
gcttggtggcgggggagggtatggcagtggcggtggctttggacacggtgtagggtttggaggagtgaagggtggcggtttcggtgggggtgcaggcggtggagctggaggtggcttaggcggaggcggggggcttggtggtggtgaaggaggtggttatggtaggtggtgccggcaggggtgctggtggaggcggagggcttggtggtggtgaaggaggtggttatggtaggtggtgccggcccgggtgctggtggaggcggcggccttgggggtggttctggtggaggtctcggcggtggtgagggcggaggcggtggtcttggtggcggaggaggagctggggctggtggtggttacggtggaggagcaggtgcaggtggcggcaatggcggggggtatggcggaggtgccggaggcggttacggtggaggagctggtggaggtactggcggtggatacggtggaggtgcaggagcaggaagtggctctggaggcggctatggtggaggcgctggtggaggctacggtggtggtgctggcgctggtagtggcagtggccttggctctggcggcggtggaggttatggtggtggtgccggaggcggaggcggaggtggaggtggaggtggcatcggcggcggtgtgtgattcaacctcttacatccatgcatggcgtgtgcatgcaagtgctcgacgcactcctcttgcagtttcaggcatgcgtggagtcaagctaatagcatgtgtgcgatataccgatcgatcctgatcgtactctgtgcgtaacgatcatagtaaacagaataaagagttaatgttgcaataaattgagtcggtcataattgtatatgatgatatatagtttatactttatacggtatataaactgcgtcagtagcaagctaagctgaggaagagctactttgtaagtttgtattgtactattttagttgtattttgtcaaaataaaggaaatattatgagctaaaaaaaaaaaataaaaaaaaaaaaaaaaaaagcggtcaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 18786 - DNA, 4042 bp, Zea mays
  misc_feature (4011)..(4011): n is a, c, g, or t
  misc_feature (4042)..(4042): n is a, c, g, or t
cttccccttctttcaccggcctcgagtcacacgcgtgagatctgtgccttccgccgcggccacatgccacacaacgacgcccggcgagcttcaccgcgatagaggtaggcccgcccgataccaaggaggatggcggcagtgggcgttggtgcagcggacgagcggtgggcttcgttgtgcaactgcgtggtgaacttcttgctggaggagcggtatcacctcacggcgctagagctattgcaggagctccaggaggacggccgctccgcgcacgccctccgcctccgcgctttcttctccgacccagcgcttttcccgcccgatctcgtcgcccgctcatcctctgcgccgcccggtgctgatccacagattttgctagaagagaaaatagcagcagaagaaaagttggcactcacggagtatgatctgcgcctagccaaagaagacctttcacagttgaagcttgaattacaaaaacaaaaagaatcatctcctgatgattcaaatgggctccttttgggtgcttctatacgcgaaggatatactaggcaacaagaaaattgggatgtgaaaatttcagcattaggccctctaaaggataatgaacgaaaagatcttaattgcgctgtaaaagaatacttgcttttggcagggtatcgacttgctgttatgacattcattgaggaggttcctgatcaagaccttgatgtttggccaaacagttcagcttgtgttcctgatgcccttcgcccgtcgttctatcagtatctttcttctactgcagaggctgcagacgaaaaaatatccatacttcaggaaaatgaaacattactcaaggacaatgaacgactcaatgctgaaaatgattccttgatgaagagcagggaaggagctaatagtcaggttgccgctttaaggaagtctttggaagctgcacacaaggatataaaagacaaggaaaaaatgattcaagacttgaggcagtcactggatgtccagaggaaggagctgaatgactgcagagctgaaatcacagccctgaagatgtacatcgaagggactcaatcaatcaaacaattgtttgttggaactagtgatggtgtaaagtcgcattcctttgctaattctgtgggagcatcatcattgaataatgaagatgaagattcaaaaggatctgaagccataacaaataagctagcatcagcagtaaatattactgatgatacgcagaaagatcgccaagttctagaaagtagcgctgaaggttcctcagtttcagaaactccagtgtctttcacagctgttgagaatgacagctatggtacatcaaaagaagataaatctgtgtcaaatatctcatcgaataatgtatgttttcagagtaatctgcatggagcttccatgactggtaaaagccaggggagttcagatggcatatccatgtatttatctattgagaaactagagagcccaagtaaacaaaaatcttcagataagattgctttggagactataaagatagtttcagatgcacttccaaagattgttccttatgtgctcataaaccatcgtgaggaacttcttccattgatcatatgtgctatagaaaagcatccagatagcgatgtacgggattccttgactcatacattgtttaacctgataaaacggcctgatggagaacagagacgcatcataatggatgcttgtgtagaattagcaaagagcgttggtgagatgaggacagaaactgagttacttccacaatgttgggagcagataaaccaccaatatgaggagcgcagattgcttgttgctcagtcgtgcggtgaacttgccgtttatgtccgtccagagatacgagattccctcattttatccattgtgcaacaacttgtcgaagatgctgcaacagttgtaagggaagctgcaacacataacctggcattgcttcttcctatgtttccaaatctggacaaatattataaggttgaggagctaatgttccaattggtctgtgacccgtctggggcggttgtggaagttgcactcaaggaacttgttcctgctgtagtaagatggggagataaattggatcagatatcaagagtactattggctcatatcctggcatctgctcagcgatgtccacctatttcaggtgttgaaggtacaatagactctcatcttcgtgttttaggagaacaagagcgctggaatattggtgtccttcttcggatgttgactgagttgcttccatttattcatcagaaagctatacaaacttgcccctttgcatcagctgatccaacaagctctacaccagagaacttctcagcatcctgcctaaaatcatatgcaacaggtgactctgagtggtcagcatttgagtggatgcacactgattgcctgccagatttgatcaagcttgcctgcttgttgcctgtgaaagaagataacttaagaaccatcatcacaaagtacctcttggaagtatctggactctacggtaaagattatctggagcacattatgctacctgtatttcttgtagctgctggtgacattgatagtggcgattttacctattttcctctatcaatccagccaaaagtccgtggcttgcgtccgaaaacttcaactgctgaaaaacttgccatcatgtgtgtcttcccattattgttatctggtattttgggttctccttccagtcgtcaacagttggaagagtatctgagaaaagtacttatccaaaacaccaaggatggttcattttctatgcatcatactactgagatcattaacgcagttcggtttctttgcttatttgtggagcaccatagtgtcatctttaacattttgtgggagatggttgcgagctcggataccagcctgaaaataaatgctgcggctctactgagagcacttgtaccctacacggatgtgaaaatagcatcaactcatattttgccagcacttgttacccttggctctgatcaaaacttgaaagtaaaatatgccagtatagatgcatttggagctgttgctcagcatttcaaaaatgacatggttgttgacaaaatacgcattcaaatggatgcttttcttgaagatggatcacatgaagcttctgtttctgttattcgtgcacttgcagtagctgtacctcattcaacagataggctacgtgaatatcttttaaccaagatatttaagatgacatgcatcacacctgtcggcaatgatattgaacggcgtcgtgaaagagcaaatgtactctgtgaagcgctccgggctctggatgctacagatcttcctgctatgggtatacgtgatttgcttctgccatcaatacaaaatctgttaaaagatctggatgctctagaccctgcgcacaaggaggctttagaaatcataagccgggaaaggtcagggggtacgctggaaagcattagcaaggtaatgggggcgcatcttgggattgcatcatctgtcagcagtttctttggtgagaacagtctcctcacaaagaaagaaggtggcgaggaacatgatcctgctggccccaccgctcctgagcaaaacctgcaggctcagccagagagcacgaggtttggtcgcataatgaggagcggatttggagacatattgcgaggtcaaagcaaaggacagtgatgcacttagattgaaatgatcaattacatacatagctgccgataccacattctttctttgtaagttgacagaatatacctcaagggttgtatgttatttgccgaggtaaaaaaaaaacgatttgacgttgccaatctagcatcaaacttcctgtatgtaagttgcctgtagttagctgcccatttataagatgctaataattgtgtctttgtttcatttgtttttataaataaaatatataactagatatgagacaaaaaaaaaaaaaaaactgaaatttggatgttatagttggctgacatcatgtaattgatctgcattggttgaaggaacggngggttctgaactcaaaaaaaaaaaaaaaaan

SEQ ID NO: 18787 - DNA, 2138 bp, Zea mays
  misc_feature (1182)..(1182): n is a, c, g, or t
cttgaaaatttcttctagcatttcttaatgcaaaattatcaatggtattgttgatatcattctcatccaatgattttttttctcaatacataaagtattgttcagtcgttcctgagacattgtaaacctcaaatagcacctcaacaatttcaattctgaaaagcttatttcagccaatgctaaaatacagacatggtaaataagccccgataagcaataaatatgttaggataagaatccgtctttttgacatacaaaaaatgcataaaaatcatcgatgtttctggcaaagctaactttagagccctgaaccaacaaattgggtcatttacctcaacatcagataaatcatgcaaatagaatttttatgccaacttagtgcaacaatctttcatctctatcaatatagtgactttaaggtttgtgagcttaataagaacctaaatatacttttgaatgtctaaagttcttcaaatatacttttcaatgatgtaattatcgtataaaccagaactaagaagtaattaacttatggtggcctggtctacagcttggcaagggcgtgctcgccgcagcgacccatatggtcaggtgaacacgggagcagcagtcgcccagcgccccagcctgggcgagcggccgaggacgacatgcggtagagggaggaagccggcaagaggagtaaaacaacagcaacatttacacgggcttgaggcgagcgcttgcattgatgtgactgcaataatctgtactacgtacatacgttctgactgaatatgcaatatgcatggggctgtttggttggaccattctaaccggtcaatggttcacttgaatctgctagcctgcaatctgttagctcttgtagtgatgagagctttgtgccattagttttacacttgaatctgctagcctgcaatcttgagactggaatggatgcaggattgtttgtgaacccccgctggttcctcagtgctccggtccagacggggttttaacttatcacaaatcgtgatccattatcatctctaacgacagcgctcctgattatagccacgacagcgctcctgactatagccggaccgtccgaacacctgtattctgggaacaaactttcttctacagcgcatgctccctatatcgagagaagacgagcagatcgtgaatgaaacaagagattgntatgagtaaccgactactaggtttgtgatgcattcgtctgcggtactgtatccaccaaagacccttgaggacaaccatcatcatggactttttgcattacgcgtcactatgattcagaacgctcctttgggttcatcgatcccctacctagtgagctaaaaaaaaacttaggatgcactctgggcagaatcgtgtggcacgcgaaggtaaatgcagacgaacattggaatctttgaattttgtcctcttgtctgaaatttgcagagtcgctcgagatctccgcatcaatttgggaccccataataagggggaaagattaaaaaaaacgggggaacgaaatcatcagcaactcacgggacacacggggagtcacagatctcatcaactgttacaatgggcatacgcagcaccatatatatttttgttgttgttcatcttcttggctagagactcaacgaatcaagcaagagcacataatagatcaagaaacggatcgtatcaccacgcatttcttgggcggagggaggcgcggttcggtcaggtcacatcttggcgacggaggcggaggagccggaccggtcgtagtagtactcagggatcgggcgggagaaggagcggcgggcctcctcgaggtcctcctcctcctcgtcgccgtcgtcctccgcggtgtggaggtggatgcaggagcagcgctcgagggacgcgaagaaggccgacgccacgccggtcgccacccacatcgcgtagctctccatgttcccgtacgacaggaacccgccgttggggttgatgccgttcatggctgcctgcccgtgcgtcccctgcctcccgccgaacggcccggcttggtccgaggaagagagcggagacgaggcgaggcggtggtgggttaatcggtctgaaagttggtgcctttgccccggccgcgagtaaggaccccaatcgcccttaggagt

SEQ ID NO: 18788 - DNA, 1037 bp, Zea mays
ggccgcaaaatttttttttttttttttccttcttcttttttttttttttttttttttttttttttgttctttggaatcttgaaatgaccactcatctgaaatttgcagagtcgctcgagatctccgcatcaatttgggaccccataataagggggaaagattaaaaaaaacgggggaacgaaatcatcagcaactcacgggacacacggggagtcacagatctcatcaactgttacaatgggcatacgcagcaccatatatatttttgttgttgttcatcttcttggctagagactcaacgaatcaagcaagagcacataatagatcaagaaacggatcgtatcaccacgcatttcttgggcggagggaggcgcggttcggtcaggtcacatcttggcgacggaggcggaggagccggaccggtcgtagtagtactcagggatcgggcgggagaaggagcggcgggcctcctcgaggtcctcctcctcctcgtcgccgtcgtcctccgcggtgtggaggtggatgcaggagcagcgctcgagggacgcgaagaaggccgacgccacgccggtcgccacccacatcgcgtagctctccatgttcccgtacgacaggaacccgccgttggggttgatgccgttcatggctgcctgcccgtgcttcccctgcctcccgccgaacggcccggcttggtccgaggaagagagcggagacgaggcgaggcggtggtgggttaatcggtcggttggtttgcccttgggtttcagacctctcgcgtgggtgggatgtcctcgtcgtcgtggtcgctgtggttgcgatctcttttttttagtcttcccgccccgatggtcgtcccgaaattaggagtagctctcacgataaacggatcggacagaaacggacgcctccctccctccctccctcgaaagtcgaatctcacgtgggccccgcgggacgggagggtcctcccgacttgccaagtcgggaagagagggacacggtggcacggataaagccgataatcattgccgccaagc

SEQ ID NO: 18789 - DNA, 1277 bp, Zea mays
gcacgaggcggtgccggtgtgcagccttccactccgccctgttcccctgaagcgcgttatccctcgcgtggcgcgatcggcaccgtccacgtcacggtcgtgcggccgtccgatgagtcgatgggacgccggggcccacccgtcataaaccgtgggcccctcgcagccggccgaatcacatttgattcgagccagtcagccagccccggagccctggacagcagcagcgaactcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatcaaggtggatcgtgtcctttactcctctgttgtttacccacataactatggtttcattccacgcacactctgtgaggatagcgaccccatggacgtcctcgtactgatgcaggaacaagttgtccctgggtgtttcctgcgagctcgtgctattgggctcatgcctatgatcgatcagggtgagaaagatgataagatcatagctgtctgtgctgatgaccctgaattccgtcactacaaggacatctcggacctccccccgcatcgccttcaagagatccgccgcttttttgaagattataaaaagaatgaaaacaaagaagttgcagtgaatgatttcctcccagccgaagatgccatcaaagcaatcgagcactcgatggacctgtatggctcgtacgtcatggaaagcctgaggaggtgatctgctgctgcttgattgtggatgctacgtaattttctcaacagctcatcgagagtaccgtagtccgtagtacggcaaatgttaacacgcacgaactggaatcatgaccaagggatattaccttctgttcatgctgaaacgatcagcagtttctttctttgcatcatatgccacgtcaaatcaaggcacttgcctctgaaatctttgtggtcaagtcaaaccagcacttcgacagaacgattgatggatgcctcatgcctgtattactgttacataaatgtccatttgctcaacttcatttcttataaaagaagccaaaatgcctaggactcgtctgataaaaaaaaaaaaaaaa

SEQ ID NO: 18790 - DNA, 1139 bp, Zea mays
ggccgctccgccaccccgcactcgcctgtcgcctcttctcgctttcgccaccggggcagcgctccggtgagtggcgaagggcccctcccggctcccgcttccctctgccatggctggacctgctgttctcaatgagcgtatcctttcttccatgtcccagaaacatgttgctgctcacccatggcatgatttggagataggaccaggggctcctgaattcttcaattgtgtggttgagattcctagaggcagcaaggttaagtacgagttggacaaggcatctggtctgatcaaggtggaccgtgttctttattcctctgttgtttacccacataactatggcttcattccacgcacactctgtgaggataacgaccccctggatgtcctcatactgatgcaggaacaagttgtccctgggtgtttcctgcgagctcgtgctattgggctcatgcctatgatcgatcagggcgagaaagatgataagattatagcagtctgtgctgatgaccctgaattccgtcactacacggacatcacggacctcccaccgcatcgccttcaagagatccgccgcttttttgaagattataaaaagaatgaaaacaaagaggtcgcagtgaatgagttcctgccagcgaaagatgccatcaacgcaatcaagtactcgatggacctgtatggctcatacgtcatcgaaagcctgaggaagtgatctccagctgcttgattgtggttgtggatgctacaccattttctcaacagctcatccagagtaccgtagtacagacttaacacgaacgaactgtaatcgtgaccaagggatgctattaccttctgctcatgttgaaacaatcagcagtgcctttctttccattatatgccatgtcgaatcaaggcaacttggccctgaaatctttgtggtcaagttaaaccagcactttgacagaacaaggattgctggatgcctggattactgttacataaatgaccattactgaacttcatttcttgctctcagcctttggtgagatgcctagttctcatccgatgcataactagtactagttgactagtttgcgagaaactgattcagttcagtcatgggcttctgccttctagcggccacagccactgca

SEQ ID NO: 18791 - DNA, 1074 bp, Zea mays
cattgggtacctcgaggccggccgccctcgggccctcccacgcgcactgatccggcctggacctggagcgctggacagcagcagcagcagcagcatcgagctcgaggccgctccgccaccccgcactcgcctgtcgcctcttctcgctttcgccaccggggcagcgctccgccatggctggacctgctgttctcaatgagcgtatcctttcttccatgtcccagaaacatgttgctgctcacccatggcatgatttggagataggaccaggggctcctgaattcttcaattgtgtggttgagattcctagaggcagcaaggttaagtacgagttggacaaggcatctggtctgatcaaggtggaccgtgttctttattcctctgttgtttacccacataactatggcttcattccacgcacactctgtgaggataacgaccccctggatgtcctcatactgatgcaggaacaagttgtccctgggtgtttcctgcgagctcgtgctattgggctcatgcctatgatcgatcagggcgagaaagatgataagattatagcagtctgtgctgatgaccctgaattccgtcactacacggacatcacggacctcccaccgcatcgccttcaagagatccgccgcttttttgaagattataaaaagaacgaaaacaaggaggtcgcagtgaatgagttcctgccagcgaaagatgccatcaacgcaatcaagtactcgatggacctgtatggctcatacgtcatcgaaagcctgaggaagtgatctccagctgcttgattgtggttgtggatgctacaccattttctcaacagctcatccagagtaccgtagtacagacttaacacgaacgaactgtaatcgtgaccaagggatattattaccttctgttcatgttgaaccaatcaccagtccctttctttccattatatgccataccgaatcaaggcaacttggccctgaaatctttgtggttcaagttaaaccagccctttgccagaccaacgattgctggatgcctggattcctgttccataaatgccccctcctgaacttcatt

SEQ ID NO: 18792 - DNA, 1486 bp, Zea mays
ggggggtacccccgggtctggcccccgcgcccccgcccactttctgcttctcccgtattgccgtgccctcctccctctccctgctcgctctctccctctcgtcgctttctttcctggtcgcgccgcccttcatcaggtctcctccgccttagccggtgaagagcgaccaggcccaataaataatcaccatggctcatcaaaagcgtgaaggcagctacgccgatgatgatagtacatccaagcgcatcaaaggcaccgacactgcttctgaaacgggggacagtgtagagtctagtgtttcacagcaaatggatgctgaagctaggaggacctgccaaaaggaaagcgaagcaccatcggacaaatgcgtttcagatggggaatgcgctgcaaactctaaggttttgggtaagcagaagatggtattgactgttgtcgaggctgatgcggcggacgacaagggttgcaggcacactatggaggacgcctgggtggtgctccccaatgctggtgcagaatccccaggaagcttgaggtgcgtacattttgcgatttatgacgggcatggtggtcgcttggcggcagattatgcacagaagcatttgcatcagaatgtcatcgctgcaggattaccacatggatattaaagctgcaaagaaggctgtaattgaaggtttccgtagaactgatgaatctttactgcaagaaagtactaagggaaattggcaagatggtgcaacagctgtatgcgtttggatcctgggacagacggttgtagttgcgaatgttggagatgctaaagcagtattggctcgttctatttcaactgagggtgaaggtgtggttgatgagaccaaaagtcaactaaaggctattgttttgacaagagaacataaagccatcttttcacaggagcgctcccgaatccagaaggctggaggttctgttggctctaatggaagattacaaggtcgtattgaagtatcaagagctttcggtgatcgccagtttaagaaggttgggttgattgcaacaccagatgtccattcctttgaacttactaagaaagaccatttcatcattctagggtgcgatggcttatggggagtatttggaccaggtgatgctgtcgaatttgttcagaatcagttgaaggagacctcatcagccacatttgcggtgcgccgcctcgtgaaggaagctgttcgcgagaggcgatgcaaggataactgcactgctgttttgatcgtcttcaggcactagcgatcggcctaattcccttttgctttcgtcaggctggaaagaattagctgataaagaacaatgtttgaagtgtagcgagttgaacttggaactctggctttgtctgttttgatttgatgtgacctattaatacaccatccatattcatttggaaattactctatccgtccaaaagaaaaaaaaaaaaaaaaaaaaaaaaaactcgagggggggcccggtaccc

SEQ ID NO: 18793 - DNA, 2321 bp, Zea mays
gcccattatggttagggtttcccctgagtctctctctatatatgtgaccatctcctatgcaatacaacaagcagtctcattcttttacacagtttttcttcgattggtgctacctctagtctaacacatataggatattttcggactcgatcccttcttgtatagctacaaacccaacacaacctgtgcatgtcagcaacacttatctgttgaacatggcatgttttttaggccaaccttctgcaccatacaacacagtaggcctaattgtcgccctataaaactttctttttatcttatgtgatattctcttgtcacatagaacaccagatgctagacgtcccttcctccatcctgctttgattctatgtctaacatcttcatcaatatccccatctatctgtagcattgatcttaaatacttatatgcttagcaagcttcatagtatcccatacaggggcagagatctaggatctgatcacacatgggccagtctatttaatctactagggttctaatatattttgacctaaacataatcaagttatgttcagatatacggatcatgacccgggccacagaccgggtgcctgccccttgtatccgtccctgatcccatagcttcatcgacttaattcccaggtagttagtacaacttccagtatctcctagtcctttcccagtgctataactaaagatatttcttccaggccaaaaaaaagacgaatttgaagagaaattcccgagatgcaactcaaaaaggctcccacatagcagagcttcaccaacaaaataagatttggccaaaaaagtaacagatttgctgacaggtggcagcgtgagaaactactggcagcaacttaatcatctacatatactaattatacccaaacaaaacaaactataaaacagaagcaggatgtgtttgcagcataaaagttgaagagccaaaccgagggcgacttccattctataaaggtgtcacagtcaacatcgcatcgtatctaatctagatattttggttgggggctggggggcttggggccaaggaacgaaaatgtggctagccgtgccccatggtctaatctctaacccatattagatcccagacctgaaagtaaatcaacgaattctaatctgtcctagaacaaatcgccagagcgagcgatccgcgggtaggttgtagcagtaagcagtacacgcagtgtgcgagagctcaaaatacctggaactcccaaggaccggtcaaaggtctcctctgagctgagcaagtgagagcactggacatggcgcgagaagggatgcgagcttggctaactcacatggagttggcgtgctggatgtcggcctcgagcaccttgagcgagtccctgaacgaccttcccatggacaccacctacgggagcgctccgcgaccatccaagccccggccgccctcctcctccaggagccagtcctcctcctcctccttccctcgccctgcgctctcgctcaaaacctcacccagacaaaccctatccgaccgcgctcctctcctctgctctcgatcggcgtcggcccaatccactccacgccgtgagggggccgcgttgtgttgtgctccggtaaacggcacacgggcgggcgggcgggcgggcggctctagtctagactctagtggcggtggttagcttcgcggccatttaaagctctgccccctcctctcgctttcgtttcgtcccgggggggtgccttgcgtgtacgggagggcgcgcggggaggggtgcagggagccagtgacgccaccgacgcgtggggtcggaggatgaggacccacctgccggtgagagtgcgtaaggtggcggaggcagggtctgccacgtacgtttctggaaggtgcggggtgtggtcgctagctgggctggctgggcatgtccgcatcggtttccaagtcgtatacacgggccaaattacacgtcatcatacatgcctatctgatgctgctgttgctgatggataaccgatcaaccgtatcatattcctttgcagcgaggtggtggtttaagatgtgtgattcaggtaggcctgttggtggctaaatgtttccaacatttataccaaatcgacggtttgacggagctttgaccgagatcgtcaggaataacgtgaacaagacggccggggacgctttcagcactaggcctcaaaccggcctcgtcgatcggtctgcttctgtctccgtcgattccgcctttttttttattgcacggataggatgggggccatgcatgccgtgctggagcctctgccctctagtcgttctcccatgataactaggacg

SEQ ID NO: 18794 - DNA, 1245 bp, Zea mays
ttgccataaccactgacatatatacagcgtcaaatgctaggaccctaaaccaccatacaggccgaaatcgttttttttttttttttggaacaagttctacgtacattcagtgtatattagcctcctcggctcccagttgcttcgaaactctttaaaaaaaaggcacaacagcaccagaggcccaggaatcagcaccagtagacgtagcaaatacataaaacaactggcagacgtgctcaactgcgtcactttacatgggagtcgtagacgtcaaatacagattctgggatgacggtgggcagcttgtctatgtacatgaagagtcgcctcaggttctctcttcggactgtcgccatatccacgatgtccttgctgtccgtgtatatccacaggtcagcagagtttaccctcttgaggctgtcgcggcagaacggacaggactgggaccttgacctccattcacgatagcatttaatgcacatagcgtggctacaggttggaagaacaactttgacatttatttccatgcatatgccacattcctcctctatattatcatcaatctctgataccacagttttcggatcctcatctcgtcttctgtacctctctagacatattgctttctgttttctatcctccacttcattgattctttcatgtaattgcatcaaggagggaaatatgacagcataaaattccctaatgcttgcttttctttcatgagtacacatggtggttgtcccatcagcgtaaaccttataaattagaatcctcaacagcccaagtgcaccagcaaggttgcagtctgtccactgcacaagaaaaaggaaaaagtgggcagcagggcaatatgccatcctcatctgaagggaggcgccatcatattccctcctaaattcagaagcaatggagttggcgtgctggatgtcggcctcgagcaccttgagcgagtccctgaacgaccttcccatggacaccacctacgggagcgctccgcgaccatccaagccccggccggcctcctcctccaggagccagtcctcctcctcctccttccctcgccctgcgctctcgctcaaaacctcacccagacaaaccctatccgaccgcgctcctctcctctgctctcgatcggcgtcggcccaatccactccacgccgtgagggggccgcgttgtgttgtgctccggtaaacggcacacgggcgggcgggcgggcgggcggctctagtctagactctagt

SEQ ID NO: 18795 - DNA, 736 bp, Zea mays
atcctatgatatgagccaaagctccgaactccatcccagttcttctccacctcgtcctcctcctgctcctgcattctcgcccgtcccccaaattcacctcggccaccctccaccacctcgtcggcgcgggcagcagttcgcctcatcgtcctcccacctgacgacgtcgcggttcgcgctctcgcggcgtgccgcgcacccattcctcgcccacgtctcccgcgagttccacgccttctgtgccacgcgccacccggagccactgttcgccgcgccctccgcatctctgacctctacatctccatccgcggaagcagaccacctcgaatccttctctttcacgcagtcattgcttgcctccttagcccaactgttggtaccagaggttcatgtttcatcataaggaatgaacagtagtcgacaaatggaactccactacataaacactggatttccatacacaatcaccgagagcttcatggatttctttgagggtctcacttatgctcatgctgactttgctctcacggatggctttcaggatcagggtaatccatactgggcaatgatgcatacaaactcgtacaaatatggatactctggtcctgggaactattacagttatgctgatgtctatgacatagacgattacatgcatagagccaatggtgagcgccagaatatgggataacactacacctgtaaacaatgtcgattctgccaatgttgtcctgca

SEQ ID NO: 18796 - DNA, 1449 bp, Zea mays
gcgattgggttcctcgaggccggccgggttctactatcctggccgccatgcccactcctggtatcctatgatatcaaccgcatcctctattccagttcttctccacctcacctcgtcctcgtgccttctcgcccgcccccccaaaattcacccgtccaccctctaccaccacgtcggcgcgggtagcagttggtctcatcgtcctcgcacctgacgacgtcgcggttcgcgctctcgcctcctgccgcgtgcccattcctcgccctcgtctcctgcgagttcccacgccccccggtgccgccacccggagccagtcctcgccgcattgttcttgttcccctcctcctggtgatcccgcaccgcgctgtgtcctctccatcttcctccgccgccacgctcatcgccggttcatgtttcatcttaaggaatgaccagcagtcgacaaatggaactgcactacataaacactggatttccatacacaatcaccgagagtttcatggatttctttgagggtctcacttatgctcatgctgactttgctctcatggatggctttcaggatcagggtaatccgtactggacaatgatgcatacaaactcatacaagtatggatactctggttctgggaactattacagttatgctcatgcctatgacattgacgattacatgcatagaactgatggtgggcgcagaacatgggataacactacacctgtaaacaatgtggattctgccaatgttgtcctgcagggtggtgaagctccccgcacaactgcaaatactactagtgaggattgcatccaacaggtacaccaaagtccgggtagtcctcaggttgtttggcaagacaacattgaccctgacaatatgacatatgaggaactcttggatttgggtgaggcagttggaacccagagccgtggtctctctcaagaatgcatttcattgcttcccatcactaagtataagtgtggattcttttcaaggaagaaaacacgccgtgaaaggtgtgtgatttgccaaatggagtacaggagaggaaatttgcagattacgcttccatgcaagcatgtataccatgccagctgcgtgacaagatggcttagcataaacaaggtatgccctgtttgctttgctgaagttcctggcgaggattctctgaggcaatgattcatcagttgtgatgccactatgaagttgctgctctgggtactgcgcccccaatggacgcatgatttctgctttgaaggcagcttgttgtccccactttagaattgtgtattagcgccatattaccaaataggttattacttatcagatgtatttaggtagtgtttggtttcagaatatggtaggatggagtcactttgctcctaatttattgttgtttgaattgatttcatgtaggacatagtaactctaaaaatggaaaaactatgctt

SEQ ID NO: 18797 - DNA, 996 bp, Zea mays
  misc_feature (861)..(861): n is a, c, g, or t
  misc_feature (867)..(867): n is a, c, g, or t
  misc_feature (870)..(870): n is a, c, g, or t
ataggtgagcgtaccaccaaaactgagggcaccaatttaaaataccaaaaaataaattatgtagaaaaaaaaaccacttctcatctctctcaaacctgtccccacctatggcaccatttgcctgccattgcactcctggtatcctatgatatcagccaaagctccgaactccatcccagttcttctccacctcgtcctcctcctgctcctgcattctcgcccgtcccccaaattcaccttggccaccctccaccacctcgtcgacgcgggcagcagttcgcctcatcgtcctcccacctgacgacgtcgcggttcgcgctctcgcggcgtgccgcgcacccacgtctcccgcgagttccacgccttctgtgccacgcgcgcacctggagccactgttcgccgcgccctccgcatctccgacctctacatctccatccgcggaagcagaccacctcgaatccttctctttcacgcagtcattgcttgcctccttagcccaactgttggtaccagaggttcatgtttcatcataaggaatgaacagtagtcgacaaatggaactccactacataaacactggatttccatacacaatcaccgagagcttcatggatttctttgagggtctcacttatgctcatgctgactttgctctcacggatggctttcaagatcagggtaatccatactgggcaatgatgcatacaaactcgtacaagtatggatactctggtcctgggaactattacagttatgctcatgtctatgacatagacgattacatgcgtagagcggatggtgggcgcagaatatgggataacactacacctgtaaacaatgtcgattctgccaatgttgtcnctgcanggntggtgaagctccccacacaacgacaaatactattaacaaggaatgcatccaacaggtacaccaaagtccaggtagtccctcaggttgtttggcaagataacattgagcctgataatatgacatatg

SEQ ID NO: 18798 - DNA, 1635 bp, Zea mays
cccacgcgtccgcacccttcaaaagtttgtagatcggcagtctgagttagtccgagtttaaggatagaaaatgtattttgtcctctttgggttagaaccagccagaggagtcgtgaatccgtgacaaccggcggcggcgagggaagaatcgaagagcgccgcagccgcaaggaaggaaaccgagaacaactcaatccgctggctatggcgttgctgatggagcccggcgctgagcccctgactgagagcgagcaggccgacctggccggcatcgccgccatcaaggagtcggcggcgcgcgaatacaaggagcaggggaaccagttcgtccggatgggccggaggcactacgccgcggcggtctcctgctacacgaaggccatcgctcagatggagcccctctcctccctcgacgcatcagccgctgctgacgcctccgttctcttcgccaaccgagcacatgtcaacatcctcctcggtaaccaccgacgggccctcgacgacgccgagcaggccatccgcctctctccctccagcgtcaaggcgtactaccgagcagtgaaggcggcgcttgcgctggacttgttaacggacgcggcgtccttctgcaggaaggggctcgaacaggacccccctaacgaggaattcaagaaactgttgtcggaagtggattcaaaactgagagagcaagatcgtcagagagcgaaggttgcacaagcaatcgccaaagccaaggatcttgctgctgctatgggaaagagaggggtgaaacttgggaaggcagcctatcaagagctgacaggggtaaagaagccagtgctggatgagcagggcgtgctccactggcctgttcttctgctctacccagaggtcatgtcgagtgacttcattgaggattttccagatacagatactttctcgccccaccttgatgtcatgttctcagaaacttctccaccattgccatgggatgataaccatgtttacacaagggactcaatcgaattatattatcagggtggtttcggcaaacctttgtcccgaagtgaggtattaagatatcttctagaaggcaatgtagattcgaaggcgcttccagatagccttcttgacggggaagacgaagaacatgacagtaccaaatgtaccactgttacatcaactgatagctccagtaagtggatcaaggtaaaagaaggaaaaacacttcaggaggtgctgcaggataaaggctatattgttcctgcaattcctgtgttcttcgttgtttcaaggaagtccacattctataaagacttcaaggctggaaactggtctttgccatgaaacagaaccggacactaaggttcagcttaaatcgatctctgagacgggcagcggatatggcaagaaagcagaagatgccctcttgtgatcatggtcatttggtttaaaaggagtgtgcttttttcagtgtctgcagactgacagccttttgttaccgagatagacagaaaagacgaggcaatgtaatatgaatttttatgtgaaccgattcagcgtttagcatggtcgtagtatgttaagtctcggttgaaacgttggtgtttctaacggatggtcttgacagtagtgtctgcaaaaaaaaaaaaaaaa

SEQ ID NO: 18799 - DNA, 1779 bp, Zea mays
ggatcctttaaagtcgacctgcagcggcggcggcggccgcgtcgaaggcttggcggtgagctctcgcctccgttctctctgcgtgtttcattctgttaagtttggttggttgcgtgtacgcgtccttcagctgagttggtcttgccgaggagcgtgcagaactgtagattgattggttcggtgcgtaaattggggaattttgggagcacgtggcgcgaaaataggatgctcgaattgatgattaggcccaagcgatgagcgaaaagtttcaagggctcgtatggcttgtgctgtgaaatatccaaaattgccttgctaggttttgttttaagcatgtggctagagcattgttcataggagtggactagttatgggctgttttcttatggatggagttcaactgttccaaacagggcacgactaatatccaagcaggtaatacgtgcaagcacacaagcagacattttgatccgttagatctagatccaatggtatgtcatattgagcacttaaacccttccaccaccacctggtatagctttataaaaaacctctaacaaaccataattgtatttaccgttggatacagatctaacaggctaaaaagtctacttacacgcttgcacctagtatccgcttgcatattagtcgttgcccttagcacaatcaaccattcacctttccctgtctgagtttctgccataactcaattgtgctttcctatcctgatatagggactccacatatttgaccaagaggcagacgagccaccagccaaaaacagcatggccaacagacttgatactaactgcattccagttgctaacggatgcaacacgggaacctccgtagagaaggaacctgtaaacggcattgacccgcctcatgagcatactggcatctgggtccctgtttctgtcccgccaatgacagcgcaggaccgcgaggagtggcacagggggtttagttgcaatggcaggaacttcccagaagaagagttcagctgggagctggatgaagagaacattgagatgacaatgtgggatgtgtttgctgatatggttgttgcggcaaaagataaggtggtatctgctgcaacatatgattttgggagatatgggatgtcggtggtgtccaacttttttctccaagaggcttggaacgatatggcacaaacacttgcggatgcaaacactggtattgtgaacgagcttcttgacacagagccaactaagtggttgcctgacagtgctgctacctcttgcatgctctgcggcgtgcgatttcatccaataatgtgctctcgccatcattgtcgtttctgtggtggagtattctgtaatggttgttcaaagggtagaagcttgatgcctccaaaatttaggactgcagaacctcagagggtttgtgatgtctgcggagtacgtctagagagtatccaacctcaactgatgaatcagatcagtcgggccacacaacttcctactcgagatgtcacagacctgagtaccttgaggtcatggctgaatttcccttggtcacacacaatggaatatgagatttacaaggctgcaaattctttacacagttattttaaggtgggaagactgaaaccagagaagtatatcctgatactattcttagacaagcaaaaggccttgctatagttactgtggtgaaggttgggatgatgggttaccttacaaacttggcagtgggctggttgtttgctccgaagagtggatggctcctggttccaccaccggccaaccaatctcc

SEQ ID NO: 18800 - DNA, 888 bp, Zea mays
ctcgaggccggccgggccgggctctagtcttccggcgtctcccttctttccccttcgctcgcttctcttctttgccgtccagtcgtcgtcgtctcctcgtgggctcgcggccgtggcgcattaaggattcgaacccactcgtcaaagagaatccatccgcaaaatcgaaagcaacagcagctgattattaaagccccgctttttcaaaagccgcaagggctatacccctagttgtaaattggcggaaaggaaattcgcctcctcttctccaattgcagctgcagttgcgtgctcgagaggggtgaagaacctagaagccctgccagcgcgcggcgccggcgccttgtttactctgcgacggcacgctgattgcattggtactgttcttctcctgatcaccacacatgacaagggtcatccatgactccggagatgacatgcagaaggaggcacttgatttggtctcatctgacgttaatttccccaagggccatttcccagactataggattggaccaaacaaccaaatcattgatccagaggagacacatgaggctgtacctctcaaggagattgttgcaaaggaaacagcgcagctgctagagcagcacaagcgtctttctgtgcgtgatctcaaggagaaatttgagaagggtctatctggcgcttccaagctttctgaagaggccaagcggcgagaagccgcttcattagacaggcaggttcttcttaagaagctcagagatgttttagacacactgaaaggcccggtgtggctggtcgaaacagagacgatgctgaggaagctatctcactggtggaggcactagctgtccagttgacacaacgagaagggggagttattttatgagaaggctgaagtaaaaa

SEQ ID NO: 18801 - DNA, 1505 bp, Zea mays
attcaaaagcgatcctgaccttccactcccgcagtcccgccagaaagaaagaaaaggagaaggaacagggaagcaaaagcacaagaggtggccgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgcccgcgacacccgcaagcgcgtcgtcggcgtcctcctcggcacctcatcccgcgggtccgtcgatgtcaccaactcctacgccgtgccgtttgaggaggatgacaaggatcctaggatctggttccttgaccacaattaccacgagtcaatgttctccatgttcaagaggattaatgccaaggagcatgttgttggctggtacagcactggcccaaaactaagggagaacgacttggatgtccatgcattattcaacagttatgttcctaatccagtcttggtgattattgatgtccaacccaaggagctgggtataccgaccaaagcgtactacgctgtggaggaggttaaagagaatgcaactcagaaaagtcagaaggtatttgtccatgttccttcagaaattgcagctcatgaagttgaggaaattggagttgaacaccttctaagggatgtcaaggacacaacaataagcacacttgctacagaggtcactagcaagcttgcagccttaaagggactcgatgcaaggcttagggagatccgaagctatttggatcttgtaattgacgggaagctcccactgaatcacgaaattttgtaccatttgcaggatgtctttaatctccttccaaatttgaacgtaaatgagctaattaaagcctttgcagtgaaaacaaacgacatgatgttggtgatatacctgtcttctctgatccggagcgtcattgcgcttcacaatttaatcaacaataagatgctaaacaaggagcacgagaaggccgaggattcgaaaccaaccgccattcctactgctgccggaagctaaacgtgcttttgatcactgattggtggctaagaaaagggaagaaacttgtgatgacatgttagcacggttgtgctcgaaccaactgtcttgaccttgaatggacattttttatgtttattttatgtatgatcaggtcaacggcaagagaaaccaattacactgtatgagctttagatcacacctcaagttttctgtagatcttggtgctatttcatctgatgggtcatgtttcatgatgttgactccgtttcctgtgattgatttatagcgagcctgtacgttgtatgtcatgcaattcatctatgtccatgaatgatttgtagcaagtcttaagaaaaaacaaaaaagaccgatcctgtttgataagtaaacatgggctgtttggtttcgtggtcc

SEQ ID NO: 18802 - DNA, 1558 bp, Zea mays
gggtacctcgaggccggccgggccgttattcaaaatcgatcccgaccttccgctcccgcaagaaaggaggagaaaaggaacagcggaagcgaagcacaagcagtcagaggcggccgccgcagcccgccgcagtagcgacacgcaacccccccttcccctatcacgccacccggctccacggaggagcgagaccgcgcgccgcagatccttggtcgccgctagggttccggcgagatggacgtggtgaaggcggcgcagctgtcggggcggacgctggaacgtgttgtggtgcaccccctggtgctgctcagcatcgtcgaccactacaaccgcgtcgcccgcgacacccgcaagcgcgtcgtcggcgtcctcctcggcacctcctcccgcggctccgtcgacgtcaccaactcctacgcggtgccgtttgaggaggatgacaaggatcctaggatctggttccttgaccacaattaccatgaatcgatgttctccatgttcaagaggattaacgccaaggagcatgttgttggctggtacagcactggcccaaaactaagggagaatgacttggatgtccatgcattgttcaacagttatgttcctaaccctgtcctagtgattattgatgttcaacccaaggagcttgggatacccaccaaggcgtattacgccgtggaagaagttaaagagaatgctacacagaaaagtcagaaggtatttgtccatgttccttcagaaattgctgctcatgaagttgaggaaattggagttgaacaccttttaagggacgtaaaggacacaaccataagcacacttgctacagaggtcactagcaagcttgcagccttgaagggactagatgcaaggctcagggagatccgaagctatttggatcttgtaattgaagggaagctcccactgaatcatgagattttgtatcatttgcaggatgtctttaatctccttccaaatctgaacgtaaatgagctaattaaagcctttgcagtgaaaacaaacgacatgatgttggtaatatatctgtcttctctgatccggagtgtcattgcgcttcacaatttgatcaacaataagatgctaaacaaggagcatgagaaggctgaggattcgaaaccagccgccattccaactgctgccggtggagggggagctaaatgagcttttgatcacttattgatggccaagaaaagggaggaaacgtgattacatgcttaccacggttgtgctggaaccaaatcgccttgaccttgaatggatattttcatgtttacttcacgtatgataaggtcaacggcaagaaaaatcatttacgttgtatgagagcattagatcatacctcaagttttctgtagatctcgatgctatttcatctgatgcatcatgttttgtgatgtagacttaagttttattattattatgattgatttatagtgaacctgtacgtcatacaaaaaaaaaaaaaaaaaaaaaaaaatgtagcaaaaaaaaaaaaaaaaaaaaaaaaaaaagaaaaaaaaaaagggggggccgctctaaa

SEQ ID NO: 18803 - DNA, 1458 bp, Zea mays
attcaaaatcgatcccgaccttccgctcccgcaagaaaggaggagaaaaggaacagaggaagcgaagcacaagcagtcagaggcggccgccgcagcccgccgcagtagcgacacgcaaccccccttcccctatcacgccacccgactccacggaggagcgagaccgcgcgccgcagatccttggtcgccgctagggttccggcgagatggacgtggtgaaggcggcgcagctgtcggggcggacgctggaacgtgtagtggtgcaccccctggtgctgctcagcatcgtcgaccactacaaccgcgtcgcccgcgacacccgtaagcgcgtcgtcggcgtcctcctcggcacctcctcccgcggctccgtcgacgtcaccaactcctacgcggtgccgtttgaggaggatgacaaggatcctaggatctggttccttgaccacaattatcatgagtccatgttctccatgttcaagaggattaacgccaaggagcatgttgttggctggtacagcactggcccaaagctaagggagaatgacttggatgttcatgcattgttcaacagtgattattgatgttcaacccaaggagcttgggatacccaccaaggcgtattacgccgtggaagaagttaaagagaatgctacacagaaaagtcagaaggtatttgtccatgttccttcagaaattgctgctcatgaagttgaggaaattggagttgaacaccttttaagggacgtaaaggacacaaccataagcacacttgctacagaggtcactagcaagcttgcagccttgaagggactggatgcaaggctcagggagatccgaagctatttggatcttgtaattgaagggaagctcccactgaatcatgagattttgtatcatttgcaggatgtctttaatctccttccaaatctgaacgtaaatgagctaattaaagcctttgcagtgaaaacaaacgacatgatgttggtaatatatctgtcttctctgatccggagtgtcattgcgcttcacaatttgatcaacaataagatgctaaacaaggagcatgagaaggctgaggattcgaaaccagccgccattccaactgctgccggtggagggggagctaaatgaacttttgatcacttattgatggccaagaaaaaggaggaaacgtgattgcatgtttatcacggttgtgctggaaccaaatcgccttgaccttgaatggatattttcatgtttacttcacgtatgataaggtcaacggcaagagaaatcatttacgttgtatgagagcattagatcatacctcaagttttctgtagatctcgatgctatttcatctgatgcatcatgtttcgtgatgtagacttaagttatttattattatgattgatttatagcaaaaaaaaaaaaaaaactgcggctgcgccttcgaaaaaaaaaaaaaaaaaagcggcc

SEQ ID NO: 18804 - DNA, 1195 bp, Zea mays
  misc_feature (1063)..(1063): n is a, c, g, or t
tcagctacgtaggcccccccccccccgccccaaaactgcatagcattttctcatgagttctgcttgaaattctatgtgcactgccctagcactggtttttggcaaaagaaaaggtaatcaacctgagtcaaataatattgttgggtcaaactaaatcatgtgctttgagagccatcataccttttgatggtttaggaacttcaaatgttttttacatttcattttcttcatccttgtctagggatgttggatatgatgatcaaaggattatattttctgtataaagttaatcctgatagcttgaacactgggtgctcatactgtattacctggggctcttttcgctgctgtttattccaattattcctttccaatttgcagttatgttcctaaccctgtcctagtgattattgatgttcaacccaaggagcttgggatacccaccaaggcgtattacgccgtggaagaagttaaagagaatgctacacagaaaagtcagaaggtatttgtccatgttccttcagaaattgctgctcatgaagttgaggaaattggagttgaacaccttttaagggacgtaaaggacacaaccataagcacacttgctacagaggtcactagcaagcttgcagccttgaagggactagatgcaaggctcagggagatccgaagctatttggatcttgtaattgaagggaagctcccactgaatcatgagattttgtatcatttgcaggatgtctttaatctccttccaaatctgaacgtaaatgagctaattaaagcctttgcagtgaaaacaaacgacatgatgttggtaatatatctgtcttctctgatccggagtgtcattgcgcttcacaatttgatcaacaataagatgctaaacaaggagcatgagaaggctgaggattcgaaaccagccgccattccaactgctgccggtggagggggagctaaatgagcttttgatcacttattgatggccaagaaaagggagcgacagcaacgacatgcttaccaacggttgtgctggaacccaatcgccttgaccttgaatggnatattttcatgtttacttcacgtatgattagggtcaacggcaagaaaaatatattacggttgtatgagagcatttagatcataccctcaaggttttctggtagaatcttcgatgctattttcatctgatgca

SEQ ID NO: 18805 - DNA, 1293 bp, Zea mays
  misc_feature (1278)..(1286): n is a, c, g, or t
cccacgcgtccgctctccgcgggccgaacaaccccagactgggccggccggccggccgtcgcattttccttccttttgggaaaatccttccgcacgaccccgcgttccgccttcgtttctctgcctctcgcctagtgtcgcggtccgacgaccggtgtcgccgccgtcgccgccgccgccgctctaacgccaggtgctgaggccttcgccagcctctttgccggcgacgaaaacccaccagatcttacagtcctttcaggatgaccaagtatacgaggaacaaaaaaagttcatcttctcacagtagttccagattcaaaagagtttccagaaaggagatgtcatttgcagtggagaaatacgcatggacaaatgcaacttgtccagtatgcatggaattcccacacagcgctgttcttctactctgttcgtcacatggcaatggctgccgtccatatatttgtgcgtccagctaccagcactcaaattgtcttgatcagcttgtaatgtcatgcagaaaagaagcctctgaggacccagatgcaatagagcttatgtgtcccctatgccgtggcgaggtcaagggatataccttggttgagcctgctcggaagcagctgaatcgcaagaggaggagctgcatggaagacggctgttcgtacatgggcacatacagagagctctgcaagcatgtccaaaagaagcaccctactgcaaacccacgagctgtggaccccttgcatgcttacagatggaagcggcttctatttcgaagttcattgcatgatatgatttgttcaactacttcagaggctatgcgaaggttttgttctcacatgctgcagattgaggaggttgtggctgctttgcgagagggtggtgatcatcgtggcgctaccgatgacgatccactgatccatgatctcttgacctctcgctgaaatgtgagaacctgtgttgatcctgcaggcaatctttgcatgaatccccaacttggcacccctgccggttcacaatttctgacccgacaaagcaaactagtcttcatctgtcctcaatgaaacagactgttaaagctttgatggatttattcattcacagtgataatggctggttgaatggcacggggcttttttttctactcatctagcctctagtgtgtcatgcgatgcactgttcctgtgcaccctcccactgtatgactatgacataactgtttcttatggaacgcaatgtgttcctgttcataaaaaaaaatcttgccccctcgagcccggnnnnnnnnnaaaaaaa

SEQ ID NO: 18806 - DNA, 1966 bp, Zea mays
aaattcatgtgattgaaaatgtattttgaagcaacacataaccctctggtcagtcactcagtccatccaacaatcgaagcgcattccaaatcaaataaatgaaaaagaatcaaaatgcccacctacgagacggccaacccaccaaagtagcaaacaattgaagcccattccaaaccgtcctcccccgagtccccccctcaccagtcctgaaaagcgggccccctttctcttcctcttccttccaggaatccagacgtcctctgtccatggcctcccatcctgagcacccggcggaaccgcgagcaccgcccgccccaacgaccataggcgatctctccgacgacctcctgcgcgagatcctcctccgcctcccttcccttccttcactcgtctgcgcctccctcagctgccgcgccttcctggccgccgtccgctcctcccgcgccttccgccgccgcttccgcgcgctgcacccgcctcctctcctcggcttcttcttcgaccccgacggcaacgaaaatcccaccttcatgcccattcgccgcggctccgaccggggccacgcggccgccgtccgcggcctggacgccttcctgacccgcgtcccgcacgaggacgacgtcttccccgggtggcagataatggagtgccgcggcggctgccttctcctcctcaactggagaaccaagcagctcgccgcctacaaccccctcacgggggccttggatctcgtccccaaactgcctgacgacatctgcaaagggcaccgcggcaagttcatctccggtgattttttcctggtagtccccgacgacgaggctcccgacaggcgttcgttccgcgtggtctcctcctgccacgacaagtaccgggtgcgcgtcgccgtcttctcgtctgccaccaggaagtggcagattctcccctggtcggagcctgtgccgacacagccggcgagcggtaagtactggcttctctcggggaggcaggtgagtgggttcctgtgctggtcacaccataagaatgcctacaaggtgttgctggacactgcgaccctgcaattctccgtcatcgatctgccgtatggcttgagtgggcaaggtcacctctacaggactggggataccaaggatgggaagctctgcatcgttgccgcaatcgatttctcgctgttcgtttggttccggacaccagacgccggtggcattgacaggtgggtgctccgacatgtattgcagctggaggatgaggttcttgaggccaccgagggctcacggaatgaacttgaacagcttaaagtgtttgcaattctggacggcatcgtgtacatgacgacatttgagacgtttagagatgctaccttgccttgttggtacctatccttctgcctggaaacaaggaagctggaaaaactcttctatgtaaaagctaatggccatgctcatccctacttcatgccatggcctactgctttagtaggtaacaatttgagcccctgactaggaggaggtgcttgttcaagtgaaactggttacagtaacatgtaagtttcttgttctgtctagactcaacagtttgttcacttatcctcttatatactagtaacgggtgcgcgctttgcgtggcaaaaaaaaaaaaaaaatgtcagacgattaaagcgagggagattttttaagatgatacagagcatgaaagacaatttagaacacaacagatttatataaaataaaatatagttaaagtgagcattggcagaaggtaatatgtttgttgcaatatttgaagctaccttgttatatttatatgaaatgtttttagaagagttgagcagttatatataattacatagagggcattctacaacctaaaaagctgctgataatctgagaaatcttcagtttttggaagatatggtgtccggcttttctttgatgcacagagggtcatgtttgaacctgtatagttgaga

SEQ ID NO: 18807 - DNA, 2855 bp, Zea mays
ccccacacacacacagtatcagtggttggttctactgagccagcgtacttccccacattgtccaaaataatatttattttcactggatttgtgttctgactattactagtgcccaatgttctacatgaccatacattcagagcatagtatttcagagtaccatataatgtgtacacaataaaccactcgcatactcaatggagaatttgaagacattgatgaacaaccatatgcttgcttatgtctgactatttggcttaccaactgcagaaactgaggaacacggcaataacacgagcaaattcagcttgtcttccaatgggggatcgtgttggtgtcaagtacaacagcatcaatgaggctgaagagcataagggagggcatggcatccccaaggtttccatgatacccctcatattcctcatattttatgaagtttcagggggtccctttgggattgaggatagtgtcaaggctgctgggccactactggcaattttgggctttcttctgtttgcactcatatggagcgttccagaagctctaatcactgctgagatgggcactatgttccccgagaatggtggttatgttgtctgggtttcttcagctcttggtccgttctggggttttcagcaaggttgggcaaagtggctcagcggtgtcatagataatgccctctatccagtcctatttctggactatgtcaagtccagtgttccagctcttggaggtgggctcccaaggaccttagcggtgcttatcctcacagttgcgcttacatacatgaactacagagggctgactatagttggctgggtggcagtctttcttggggtgttctctcttctcccgttctttgtgatgggattgatagctattccacagattgaaccttctaggtggcttgaaatggacttggggagtgtggattggggattgtatctgaatacactattttggaacctcaactattgggattcaatcagcacattggctggtgaagtcgagaatccaaagagaaccctaccaagagcgctttcttatgctctagttctagtggtgggaggatacctctacccattaatcacttgcacagcagcagttccaatcgttagggagcactggtcagatgggtatttttcagacatcgcaagaattctcggtggcatttggttgcactcatggattcaagcagcagctgctttatccaacatgggcaattttctcactgaaatgagcagcgattcttaccagcttcttgggatggctgagcgaggcatgctccctgacttttttgccaagagatctcactatggaaccccgcttattggcatcctgttctctgccttcggtgtgatcctactgtcctggatgagcttccaggagatcatcgctgccgagaactacctctactgcttcggcatgatcctggagttcattgccttcatcaagctgcgggtgtaccatccgaacgcctctcggccctacaagatccctttgggcaccattggtgctatccttatgatcatcccacctggtctcttgatcattgtggtgatggcactcgcgtcctacaaggtgatggtggtgagcatcctagcgatggtcttcggattcgtgctgcagccgtgtttggtgtacgtggagaagaagcggtggttaaggttctccatcagtgcagacctgcccgatttgcctgatgtgcaggaaattgctgaagatgatgctgtcccactcgtggtctaatattcggccattgtgctctggaggtgttgttcccaatcgagacatcctaggatggaatgtgacacactgggattcacgaccttgtatctcctgaatgagttccaaagccagaggtcttagacatcttgtataaggacacattatgttttcaccgtgctattgaacatcatgatggcatcatgcatcaaacagaaatgtaagccccagacagtgttcatcaaaggagatcatccagattatcaaatacttgttgcatctgctgtcagctgtcgcttaacttgtctatatactagggtcgatccatgacatgacatgaggttactcatctgggatcgccttaaaatgggtgaacgttaactcttgataagaggcagtagaggttctcgacctgcagattgtaacctggtttccattgcataaactgttatcagtaattccatcttttgcgtacagttttgtgttataaatggagcatcggcgtaattgtccttggaagttagttgccattattctgcaaatctgcatggttcgactcattttcgcaaacaatataaaatgtttttcgcaaacaatataaaatgttgagttttatttcggaagggtactatttttttcgatttttgaatcccaaagtttcatcattagaaattagtacccatgtgaccatgtggggtcactgctggcatcaattccttatttagcagcgtgattgatttaaggaataaggaagttcatatcttctcacttctcatagtcctttctttttagtttgtggaatgaaataaattgattcatcactattttattttttatagtctaataattagtaataatatgagaaatgaatttgtggactggactcattatacatctcatctagaattgatcaactcctcaaaccaaacaccgctaagtgttttaaatagattttttttttaatttaaatcattacaaggatgttttgtttaaaaaattaatccattctagatgaagtggtgcatcatgagtcaatttcacaaatttggtggagtgtactcattttacaaaccaaacaaaaaagtaagaagtaagaagattaactaccctattcctctggtggagttgta

SEQ ID NO: 18808 - DNA, 1061 bp, Zea mays
  misc_feature (28)..(28): n is a, c, g, or t
  misc_feature (992)..(992): n is a, c, g, or t
  misc_feature (1028)..(1028): n is a, c, g, or t
cccacgcgtccgcggacgcgtggggcangacatgcacgctcccacgcggccagcgtgcgacgaattctttggttccgcaggcctggagccttgtgtggggctactcttgctccaccgcccccggactcccggctcgccccgctgccactgccagatctcctctcctctccactgaggactctgaccagtgggactaggatattccttcttcttcacccacgactccgccttcctagttcttgggcggccggcgaggacgaacacggactcgcgctctcgctcgcgccatcggagggaaggagatccactcggagcatgcgggccgccgcgcggtagatgaaactgaggaacacggcaataacacgagcaaattcagcttgtcttccaatgggggatcgtgttggtgtcaagtacaacagcatcaatgagactgaagagcgtaagggagggcatggcatccccaaggtttccatgatacccctcatattcctcatattttatgaagtttcagggggtccctttgggattgaggatagtgtcaaggctgctgggccactacttgcaattttgggctttcttctgtttgcactcatatggagcgttccagaagctctaatcactgctgagatgggcactatgttccccgagaatggtggttatgttgtctgggtttcttcagctcttggtccgttctggggttttcagcaaggttgggcaaagtggctcagcggtgtcatagataatgccctctatccagtcctatttctggactatgtcaagtccagtgttccagctcttggaggtgggctcccaaggaccttagcggtgcttatcctcacagttgcgcttacatacatgaactacagagggctgactatagttggctgggtggcagtctttcttggggtgttctctcttctcccgttctttgtgatgggattgatagctattccacagattgaaccttctaggtggcttgaaatggacttggngagtgggggattgggggattgtatctgaatacactnattttggaaccctcactattgggggatcatcag

SEQ ID NO: 18809 - DNA, 1221 bp, Zea mays
aatctcgaagcccacagtcaaagcccccacatctctccactcccaaagaacaggccgagccacccagacctagccactccccagcaggcaagcaacctcgccaaaaccctacgccgctcaactatgctcatccggcgaccgctccaaaccctcaccctccccctcctccgccgccacttctccgccgccaccgtcgaggcctttgtgtctcccgaccaagccaccgacccgctctccccgccgtacgactacctcccgggccacccgaggccagacgctaagcacaatgaggtgatcctcgccgtcccgcgcgcctcttcggggcgccacgtagccgccaaggagcgcaaggccgggcgggtccccgccatcgtgttcgagcaggagaacggacaggagggcggcaacaagcgcctcatctccgttcgggccaatcagatccgcaagctcgtcgaccacctcggccggtccttcttcctctccaggctgttcagtctccaggtctggtcagaacatgccgggcagggcgaactcatcgaaagcgtccgcgtcctacccagaaaggtacacctgcatgcaggcactgatgaaccgctgaatatcacatttatgagagcaccttcttctgcacttctcaaaatagatgttcctctgatgttcattggagaggatgcctcgcctggtctcaggaaaggagcttacttcaacaccataaaacgaacagccaagtatctgtgccctgctgacatagtaccaccatacattgaagtggatctaagtgagttggatgtaggacagaaattgctgatgcgtgatctgaaagttcatcctgcgttgaagctgcttcattcgccagatcagcccatctgtaactttaccggatcaaggtctccagaatagaagaagggaaaataacttgcttctttgtatgagctgttttgagcacaataaggttttgtttcgtacttgagtgattcaggtgttacttgtcctactgttaggatgaattgtagccagagacacctatttttacctcaggaagggatcttttgagcaggtagatgctactacagctagacgcacttgcaaagtttcctaaatatggtcatctagtgttaacagaaacttatggtgctgtgagcaatattgaaaattgtttgcaatctaattgtttaaaaaaaaaaaaaaaaaaaactcgagggggggcccggtacccaatcg

SEQ ID NO: 18810 - DNA, 2849 bp, Zea mays
gcacgaggcatgaatgaagattttcttcttattgtcttaaaggatcttcttccacgtcgccctgagctgaggcttatattgatgagtgcaacccttaatgctgagctattctcttcatactttggtggagcacccatgatacatatacctggttttacatatcctgtccggagtcattttctggaagatattcttgaaattactgggcactggttaactccatacaatcaaattgatgactatggtcaagaaaaaagttggaagatgcaaaagcaagctctacaaaagcggaagagccaaatcgcttctgttgtggaagatgctgttgaagctgctgatttgagggactatagttcgcgaactcgtgattccttatcctgttggaatcctgattcaattggttttaatttaatagaaaatgtcttatgccatatttgtcaaaaggaacgatctggtgcaattcttgtatttatgactgggtgggatgacattaatgcattaaaagagcagctccaagcaaatccattgcttggaaatccaagcgcagttttgttgctcgcttgtcatggctctatggccagttcagagcagaaattaatatttgataagcctgagcctggagtaaggaaaatagttcttgccacgaatttggctgaaactagtattactatcaacgatgtagtttttgttgttgattgtggcaaagcaaaagagacatcttacgatgcactgaataatactccctgtctgcttccaacctggatctccaaggcttctgccagacaaagacgaggacgagctggccgagtccaaccaggggagtgctaccatctttatccacgatgtgtatatgatgcatttgctgactaccagttaccagaacttcttagaactcctctccagtccctctgtttgcaaataaaaagcttgaggctgggaagtatatcagaatttttatccagagctttacaatcacctgaatctctatcagtacaaaatgccattgaatatcttaaagtcattggagcatttgatcagaatgaagaattgacggttcttggaaagcacttgtctatgcttccagttgaacctaagttaggaaagatgcttatttttggggctatttttaattgtctggatcccatattgaccatagtttctggacttagtgttagagatccctttttaacccccttcgataagaaagattgcggtcaaggcgtcaagtgtttgtgactggagatcttgcagagtcagctaagttgcagttttcatgccgggactacagtgatcatcttgcacttgttcgtgcatatgatggatggagggaggctgaaagagaccgtgctggttatgactactgctggaaaaattttctttcggtgcaaacattgaaagcaatagattctcttcggcggcagtttctctttcttctgaaggatactggtttggttgacgaaaacatgactatgtgcaataaatggagtcgtgatgaaaatctagttcgggcggtaatttgtgcaggactgtatccaggtgtttcctctgttttgaacaaggagaaatccatctccctcaagacaatggaagatggacaggttatgctttattcgagttcagttaatggtaaagaaaccaagattccattcccctggctagttttcaatgagaaggtgaaagtgaattctgttttcctccgggattcaactgctatatctgattctatactgttgttattcggaggctgcataaaacaagggggcttggatggacacttaaaaatgcttggaggttatcttgagttcttcatgaatcgcgatcttgcttcaacttatgtgagtttgaagagagaacttgagaatttaatccattgcaagctccaaaacccaaggatggatatccaaacgagtgaagagctgctatcagccatccgtttgctggtgactgaggatccatgcagtgggcggttcgtgtacggccgacaggagccaagatcaaagaaagcaaagacgatgctttcgccatcctctctgagtgaggctggtggcaacggaggggataatgccaagaaccagctccagacttacctgacccgggccgggcacagcaaccccacctacaagacgaagcagatcaagagctatctcttcagatcgacggttgagttcaacggcatgcagttcgtggggcaaccgtgtgcaaacaagaaacttgcggagaaagatgccgcgagcgaggcactgaactggctcacaggagatggtggagcgattactgactctaggggggctcaggatgcagaccccatgtccttgctgatgcaaccaccgcgtaggcgtcgacatagccatcgtcggaggaactgattagcacgacatgcttttcttcctttttgatcgttttcttatttatgtagcattcgagaagcatagttaagcatagaaggtagcgaggaaaaaatgttatagactcttgaaatgtactacaatagttttgacgtgcagtgcctgtgaattttagagcatggttcgtcagtggtgacggtgagtgatgggctgatggcgtgcgagaatcgcagagaacactagctgtaacggtcgaagggtgatccaatttttttttttgctgtgggtactgaattcattatttgttggcgccatattaactgaagagttatgcgtagtgggcaagggcagccacgatgtatgtatttagactaaggtagtctaaatgagggggctcgtgtcaggtatcattgtatgttgtcagatgcggagaactggagactaagactatccgccggttttctctaaatttctaactctatatcaattttttttgcctcctcc

SEQ ID NO: 18811 - DNA, 681 bp, Zea mays
  misc_feature (681)..(681): n is a, c, g, or t
cgtcatccatctctcgttttggcaaccggatcaccttccaatccaacccgcgtctataaatttcctgtcccccgcgcggcccgggccggcaattcgtttatagcgagcacaccagcgaaccagagattcatcagagtggcgatggccccgagcgcgtcgatgctgttcctgagctaccaccagctccacaggccgacggaggtggggacgccgccgccgccgccgcgcagggaggcggctgcccccggcggcttctggaggaggatgagcgtgagcagcgtgctctcacccgctttgttgcagtggcggccggagggggaggcgacactgcacgagcgcgacgccggcgaggagatcaagtcatcggcgccggccgacgctgataaggagctggaaagcaagttcgaggaggcgctgcgcctcagctgctggtcttcatgagcatccatccatcatggggaacggagagacgcgagcgtgccgccgaatcgaagcgacctctcctctaaacagccgtcctgtatatcttcctccgtgtatcaaaatccacccttttgctttagatttttgtacatttgtaatcgtcacatccgctcaaatatgttatatatattttagtttggagcaaaaaaaaaaaaaaaagcgccactgaacaaaccgaccctcgagggccccgcccgn

SEQ ID NO: 18812 - DNA, 1207 bp, Zea mays
cattgggtacctcgaggccggccgggactaccgtcgggccctcgcggccggcccgggaccgcgctctccctctccccagtctccgtgcggagttctcttctctcgcgtgctcgcatagtcgcatcgttagggcgcgtcctgggagagggaggccttcgctacctccgtggcagcgacagacgaccatgaaggcgctggtggtgacggtgcttctcctcctctcttccaccctcgccgcggcacagtggtgcgtgtgcaggcaggacgcgtctcaggccgcgctgcagaagacgatcgactacgcgtgcgggtcgggggcggactgcaactccatccacgagacgggggcgtgctacaaccccaacaccgtcgcggcgcactgctcctgggcggccaacagctactaccagaacaacaaggccaagggcgccacctgcgacttcaccggcaccgccgccctcaccaccagcgacccaagttcttcaggctgctcttaccctaccggtgcaagcgccgttggaaccatgaccccgaccactgcaggcaccatgggaggaggaaccgcagggacctccacaggcacaggcacagccggcgctggcatggggacaggcactgccaccggaactgcggggtacggggttcggcggcctaggaccaggcacggacgctagcatggacaccgcggcggcggcgggcttgctcctccccacaagagctgggtgggctggccctggccaccgccctcgtcgcgcttctcctctccgccatggtgctcgcgtgacgcttggtatggcctcggaaacatggcctgcctgttgctagtagaaagctagcactgcccttttggtaagggcgtttcaggagtactgtggtggactatagagagaaaggctcctcctctgtgactgtgaccacctcacgttctgcgtactctgtaatctggtaggatgcctgtctctatcatgattcatgaaggacgattggcctgtctttttttgtcgtgctgtttattaatcgtgtgtaaatgtagtactagcgaagggaaggcactggtagctaggttagctcgagtccggatggaatgagaatgctactaatacaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 18813 - DNA, 1280 bp, Zea mays
gcccgcgcgcccccgcgcacaaggaagcacgcactcccccacacttgccagcccgctgcactgcacgtctgcagactgcacacagtcacacacgccctcccacatcgtctccaactctccatctaccggcggggcaaacggcaagcccgaccgctctctccctctccccagtctccgtgcggagttctcttctctcgcgtgctcgcatagtcgcatcgttagggcacgtcctgggagagggaggccttcgctacctccgtggcagcgacagacgaccatgaaggcgctggtggtgacggtgcttctcctcctctcttccaccctcgccgcggcacagtggtgcgtgtgcaggcaggacgcgtcacaggccgcgctgcagaagacgatcgactacgcctgcgggtcgggggcggactgcaactccatccacgagacgggggcgtgctacaaccccaacaccgtcgcggcgcactgctcctgggcggccaacagctactaccagaacaacaaggccaagggcgccacctgcgacttcaccggcaccgccgccctcaccaccagcgacccaagttcttcaggctgctcttaccctaccggtgcaagcgccgttggaaccatgaccccgaccactgcaggcaccatgggaggaggaaccccagggacctccacaggcacaggcacaggcacaggcacagccggcgctggcatggggacaggcactgccaccggaactgcgggtactgggttcggcggcctaggaccaggcacggacgctagcatggacaccgcggcggcggcgggcttgctcgtccccccaagagctggtgggctggccgccgccctcgtcgcgcttctcctctccgccatggtgctcgcgtgacgcttggtatggcctcggaaacaaggcctgccttgttgctagtagaaagcactgcccttttggtaagggcgtttcaggagtactgtggtggactattgagagaaaggctcctcctctgtgactgtgactgtgaccacctcacgttctgcgtactctgtaatctggtaggatgcctgtctctatcatgattcatgaaggacgattggtctgtctttattttgtcgtgttatttattaaccgtgtaaatgtactagcgaagggaaaggcactggtagctaggttagctcgagtccggatggaatgagaatgctactaatacaaacaatgccgtggtgtggtgtgtgtgtgtttttatcaaaaaaaaaaaaaaaacgtcggggcggccgccaccgcggtggag

SEQ ID NO: 18814 - DNA, 1148 bp, Zea mays
ccggccgggatcgtctccgaaatctcttcatctaccggcggcgcaagcccgaccgcgctgcctctctctctctctctctccctcttccctcgcgccccgcggggcccgccgcgctcgcgtgctcgcatatagtcgcatcgttagggcgcgtcctgggagagggaggccttcgctacctccgtggcagcgacagacgaccatgaaggcgctgctggtgacggtgcttctcctcctctcttccaccctcgccgcgtcacagtggtgcgtgtgcaggcaggacgcgtctcaggccgcgctgcagaagacgatcgactacgcgtgcgggtcgggggcggactgcaactccatccacgagacgggggcgtgctacaaccccaacaccgtcgcggcgcactgctcctgggcggccaacagctactaccagaacaacaaggccaagggcgccacctgcgacttcaccggcaccgccgccctcaccaccagcgacccaagttcttcaggctgctcttaccctaccggtgcaagcgccgttggaaccatgaccccgaccactgcaggcaccatgggaggaggaaccgcagggacctccacaggcacaggcacaggcacagcacagccggcgctggcatggggacaggcactgccgccggaactgcgggtaccgggttcggcggcctaggaccaggcacggacgctagcatggacaccgcggcggcggcgggcttgctccttcccccaagagctggtgggctggccgccgccctcgccgcgcttctcctctccgccatggtgctcgcgtgacgcttttagtatggcctcggaaacatggcctgcctgttgctagtagaaagctagcactgcccttttggtaagggcgtttcaggagcactgtgctggactatatagagagatgctcctctgtgactgtgaccacctcacgttctgcgtactctgtaatctggtaggatgcctgtctctatcatgattcatgaaggacgattggtctgtctttttttttaaaaaaaaaaaaaaaaaacgcgtgagtgtactagcgaagggaaggcactggtagctaggttagctcgagtccggatggaatgataatgctactaatacaaacaatgccgtagtgtgtgtgtgtatttatc

SEQ ID NO: 18815 - DNA, 1115 bp, Zea mays
gactacttcgactgagctgaacacgccctctctctcgctcagtcgctccccgctatagcctcgtcccaaccccgcgcccccccgggaatctctccatctaccggcggggcaaacggcggaaacccgaccgcgctgcctctctctctccctctccccagtctccgtgcggagttctcttctctcgcgtgctcgcatagtcgcatcgtcctgggagagggaggccttcgctacctccgtctccgtggcagcgacagacagacgaccatgaaggcgctggtggtgacggtgcttctcctcctctcgtccaccctcgccgcgtcacagtggtgcgtgtgcaggcaggacgcgtcacaggccgcgctgcagaagacgatcgactacgcctgcgggtcgggggcggactgcaactccatccacgagacgggggcgtgctacaaccccaacaccgtcgcggcgcactgctcctgggcggccaacagctactaccagaacaacaaggccaagggcgccacctgcgacttcaccggcaccgccgccctcaccaccagcgacccaagttcttcaggctgctcttaccctaccggtgcaagcgccgtcggaaccatgaccccgaccaccggaggcgccatgggaggagcaaccgtagggaccttcacgcccggcgctggtggcatggggacaggcactgccaccggaactgcgggtacggggttcggtggcctaggaccaggcacagacgctagcatggacaccgcggcggccggcgggcttgctcctccccccaagagctggtgggctggccgccgccctcgtcgcgcttctcctctccgccatggtgctcgcgtgacgcttttggtatggcctcggaaacatggcctgcctgttgctagtagaaagctagcactgcccttttggtaacggcgtttcaggagtactgtgctggactatagagagagatgctcctctgtgactgtgaccacctcacgttctgcgtactctgtaatctggtaggatgcctgtctctatcatgattcatgaaggacgattggtctgtcttttttttatcgggctatttattaatcgtgtaaatgtactaacgaagggaaggtacttgg

SEQ ID NO: 18816 - DNA, 3879 bp, Zea mays
  misc_feature (583)..(583): n is a, c, g, or t
  misc_feature (2560)..(2560): n is a, c, g, or t
cggaaaagttgaacgtttggcggtccgcaaccgcttttgttggagagaaggtgtaaaaagataaaacaaaccgggcatatatctactggtcctgcgctatacggtgtgactatcaactttgagcacgtgtatattgtgcttctcaaaaagaaacttttcaaaaaaaaaaatgcaaccgaaatgtaaaaggcagtccgtttttttttcaaaaaggaaaatgctactactttgtttgtgttttttcaaacacacggcagactcgggccctcacgtacacacggcacactcgcgtccgtgttccacacgtgtgccggcttaaaagggcagcaaccttgccacaaggtggacggcaagtcggcaattcgcaacgagacccggaagcacctgggtttacaactttcttttatttttgttgtctttggtgcaaagcagattctaggtcattttccccttgttcttttaagaaaaaagagagagaggagaagccaatgctgtattaccagcaatggaaggaggcgcgaaaggacggggacgtcgctttgtgagtcaggccgggcagcggcagcggcggcggcgaaaaganaacagagttgcgaagaaagctctccggccggggtgggatctctggtggcagcagcgttcgtccacgaggatccgattcggccgtcggagtagagggagcagtaaagaaaaggaagggtcccgactcccgagggatcaaagtcaccgacgccgcgccggcgggcgcagtcaccaaacagggacagagtactacagactggtccctgtcctgtacgtagccgctactgctcagctcggctcaccagcagcagcagacgccagcgccagccttgagctgctgtgccgaagcggccggatcctgggtccgtcccctccattcccccactataaactaggcgtgctggtacagaggtgcacgcgcactctctgccccagctacgatctgaaagaaacccgccaccagctctcgtccttccttctctccaatccaaccgcgatcctttcagcttcagcttcttctgctccttctctggtgaggaggcgtggcgagagactgcgactgcgcgatggaggcgtcgtcgtcggcgttggcgctcgtggccgccgtgctcctcctctcctccccgctcgctgcgtcaggtttctgcagcgtagcacgctgctgctgaccagcctgtctctggacgcccgtctccatttcgaagctaaactgactcgcgcgcgcgcgggggcagatttctgcgtgtgccgttcggaccagccgacggcggtgctgcagaaggcgatcgacttcgcgtgcggcccgcagggcggcgccgactgcacgcccatcctgcagggcggcgggtgctacagcccggacaccgccgccgcgcactgctcctgggccgccaacacctactaccagaacaacaaggccaggggcgccacctgcgacttcggcggcgcagccaccgtctccaccaccgacccgagtacaaacgattcctccaccaccgacacgagtataatttcttaatggtaacggcagccatctcgttgttctgaaacattgcctgtcctgtccacacttgatgcaggtttctccgggtgcactttcgcttccagtgccaccaggtacacactactactactactgcgttattagtcttggagaatacggacgggtgaatgacgtggagatggttgcaaattgcaatgcatgcagcgccggtgctgggactggaaccgggacggcgggcagcagcaccttcagccccagcgcgggcaccggcttcaacggcaccgggaacgggatgggcggcagcactactaccggcctgggacccacgggcaacgcctttgacgccgccgccgccgccgcgccgggcctgctccccagcgccgcgtccctcggcctcgcactcgccgtcctctccttcctaacctagccctgccgcgccattaacggcagcctcccctcgtcttatgtctggtcgtgttcagtaccatacctctctgaacatgagccagctgctgctgctacttggcttgctccatggcggaaggggacgggccggggagctgtacgtactgcgacgaagaagagtgcggtggaactggctggttggttggttttggttccagcttcattttcacctcacaccccacactgctagtggcgacggtggttggggttgcggggtgcggtgcgtgccttttttgatgaatcctagctacacgacgggatggcgtgtggtttattcgctggtaggatggctgtctcttttcctccgaggaccattcatgtcttccttgtttgtacgtacctctcttcttttcttgttttatgtacaagacttgtcgctagccctttgtttgtttgtttctaatcaaactctttgttctgctgccaaaaaaaaaaaaaaaaaagtttaagcctagagcaacccggccggtggtttcggttcagcttcagcattagctggagtgagcacgcgtatctagacggatcttaggtgtctcagtgtctgtcggtccctactcttctatctggaangctggaagctcttttatcctctgcggctgctgctgcctgctggtggcttcttgtctcgcacagaacagaatcttgcggcgctcccactttggtgtcggaggacggcatgtggccagccatgtggattcgcggcccacttgacacgttaaattccatgataactgcttgttttctatttcttcccgattcatcagtcttttacgtaacgtggtgtctgatctatctgaaaatcagcacgaagcttcgaggctggatgcaaacagaatttcaagtttgttgtagctaattaagctcagcttctttttaccttcggttttactccctccatcctaaaacataatttattttaaactaatcacatattcattaagtaacataggaatatagtttctacgttgttgggcaccatattgagccaccggacggtccgcgcgcgcagaacagattagggttccgagtttcttgctgtgtttgttgacgtaattcatggaattagctcgggagtttgtctgtaacgggtccagccccctcctctataaaaacagaggaatacagccgatttggaatcattaatcgaatcaataaccagtttatctcgcatttatttcttatacaattaggagtaggtctagtctagttctagtttagccttctaatccccaaattccccgcttctcttcgactctacgtcgattagagaaatctaggtcggcctgccgagcctagacaacacctaggatctatcctacccgacgggttccctcccgggagcgagatccaggcgccgccggcgaccttcgccgcccctgcacacgcgtggaccgtccggccgtcaggcaggaaaacctaagccctgcgccaggtcacggaccgtccgctcctgtacagagagcaccgtcgcggttcttgtttagtgattggcgcccgaaaaaggcaccaacacacttttggcgactccgttggggacatcacatatgtaccatcaaatcggccctcaatggccggatcaagggatagctctgaagtctcccccaacaacatcatagagccgacttgggaaaccttgtcggctgtcgaacaactccagttcgaggagcacaaggagcagctgatccaagaggcaaaggcaaagttcctggccaacttcaaggtggacaggaacaacaaagtcgttcggcaacgggcgacggatccggcttcgctccgacccacaccagatatccccaatgtaagtaacacatgcgagctacaatctcttaagaattatgtagatggacagcgagaacaaatgcaaaatatcatagggggtatgcaaaaat

SEQ ID NO: 18817 - DNA, 1169 bp, Zea mays
ctcgctggccgcctgtgtatcggccagtacttccagctagaatctgaaagaaactcgtcaccagctcgatctcgtccttcctcccttcgctcgactcctctgcttctcccccatccggtacgtgcggtgcggggaggctagccgggcggccggagctccaaccgcaatcggtctcttgctctgctgctgcgatggaggcgtcgtcgttggcgctcgtggccgccgtgctcctcctgtcctccacgcttgccgcgtcagatttctgcgtgtgcagttcggaccagccgacggcggtgctgcagaaggcgatcgacttcgcgtgcggtccgcaggggggcgccgactgcacggccatcctgcagggcggcgggtgctacagccccaacaccgtcgccgcgcactgctcctgggccgccaacagctactaccagaacaacaaggccaggggcgccacctgcgatttcggcggcgccgccgccgtctccaccacagaccccagtttctccgggtgcactttcgcttccagtgccaccagcgctggcgctgggaccgggacggcgggtaccaccaccggcaccacgaccgcgggcggtgcgacgacgggcaccctgagccctggcgtgggcatcggcggcctcaacggcacggggatgggcggcagcaccggcctgggaccggcggacaacaccctggacgccgccgcgcccggcctgctccccggcgccgcatccctcgccgccgccgccgccgccctctccttgctcgccctgctgcagcattgattacgtgggctagctgcttgctctgtggtccgtgaaaaagaaagggggcacgggggattgtactggagaatgtgaattggttcggttggttggaggacggatccgatttcacttcacccatctttgttagtagtggcaggcggtggttgggggcggtgtattctttctttcttttccttatgcctttttgatgtatggtttatttagcggtaggatgccagtctctttcctacaaggaccattgtctctcctctctctctctttctttttaaattttgtttatttataaaagttgtacttgctatcctcttttcttaacctctctgtttttattagaccagtttcaataaaaattcttaagaagtatgttttaaaaaaaaaaaaaaa

SEQ ID NO: 18818 - DNA, 1785 bp, Zea mays
  misc_feature (1757)..(1757): n is a, c, g, or t
  misc_feature (1769)..(1769): n is a, c, g, or t
attgggtacctcgaggccggccgggtttttccggcctccattcctcgcgcggcgaccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccatgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcatacactggggtcctcgaggccggtctcgggactctctgactcagctacgatctgaaagaaacccgccaccagctctcgtccttccttctctccaatccaaccgcaatcctttcagcttcagcttcttctgctccttctctcgtgaggaggcgtggtgagagactgcgactgcgcgatggaggcgtcgtcgtcggcgttggcgctcgtggccgccgtgctcctcctctcctccccgctcgctgcgtcagatttctgcgtgtgccgttcggaccagccgacggcggtgctgcagaaggcgatcgacttcgcgtgcggcccgcagggcggcgccgactgcacgcccatcctgcagggcggcgggtgctacagcccggacaccgccgccgcgcactgctcctgggccgccaacacctactaccagaacaacaaggccaggggcgccacctgcgacttcggcggcgcagccaccgtctccaccaccgacccgagtttctccgggtgcactttcgcttccagtgccaccagcgccggtgctgggactggaaccgggacggcgggcagcagcaccttcagccccagcgcgggcaccggcttcaacggcaccgggaacgggatgggcggcagcactactaccggcctgggacccacgggcaacgcctttgacgccgccgccgccgccgcgccgggcctgctccccagcgccgcgtccctcggcctcgcactcgccgtcctctccttcctaacctagccctgccgcgccattaacggcagcctcccctcgtcttatgtctggtcgtgttcagtaccatacctctctgaacatgagccagctgctgctgctacttggcttgctccatggcggaaggggacgggccggggagctgtacgtactgcgacgaagaagagtgcggtggaactggctggttggttggttttggttccagcttcattttcacctcacaccccacactgctagtggcgacggtggttggggttgcggggtgcggtgcgtgccttttttgatgaatcctagctacacgacgggatggcgtgtggtttattcgctggtaggatggctgtctcttttcctccgaggaccattcatgtcttccttgtttgtacgtacctctcttcttttcttgttttatgtacaagacttgtcgctagccctttgtttgtttgtttctaatcaaactctttgttctgctgtcattatttacttgtgattagtttaagcctagagcaacccggccggtggtttcggttcagcttcagcattagctggagtgagcacgcgtatctagacggatcttaggtgtctcagtgtctgtcggtccctactcttctatctggaaggctgngaagctgctttnaaaaaaaaaaaaaaaa

SEQ ID NO: 18819 - DNA, 1040 bp, Zea mays
aaacacgtgcacagtgcacgcactccgcataccggcagtgccactgtgccagccagccagccgctctgcttgtcctccagacagtccaggattgaccgccagcccctgcggtacccccacgcccgcccggattcaccctccccccaatcgcctccgaatctctctgcctcattctctctccaccggcgacggcgagtccgaccgcactgctcctctccgtgcggagatctctcgcgtgctggcaggcgcgtcctggtgactgggacacgggagaagagaccttggtgggtggcagcggcaggccatggaggcgctgctggtgacggtgcttcttctcctcctctcctctaccctcgccgcagcacaatggtgcgtgtgcaggcaggacgcgtcgcaggccgcgctgcagaagaccatcgactacgcgtgcggctccggggcggactgcaactccatccatgagaccggggcgtgctacaaccccaacaccgtcccggcgcactgctcctgggccgccaacagctactaccagaacaacaaggccaagggcgccacctgcgacttcgccggcaccgccaccctcaccaccagcgacccgagctcttcgggctgctcttaccccaccaccagtgcaagcgccgcgggaaccgtgaccccgaccaccggcggcacaatgggaggagcgggaggcccagggaccttgacgcccgccgggacaggcgcaggcacagccggcactaccggcatggggactgcaggcactacgggtaccgggttcggcggcctaggaccagcaggcatggacacagcggcggcggcggcggggggcttgctcctcctcccagaggctgggctgtgcgctgccctcgtcgcgctcctcctctccgccatcgtgctcgcgtgacgccttcacatgacctcggaaacaacaacctactgcctgcatgctagtagtagtagaaagcgctgcccttttgggaggtgtatgtagttcaggagtactctgattatctatggagaaagggtgggaattattgggc

SEQ ID NO: 18820 - DNA, 4579 bp, Zea mays
  misc_feature (604)..(604): n is a, c, g, or t
  misc_feature (2738)..(2738): n is a, c, g, or t
gtttttgtgacttattttttatgtggataaatacaaaacaaaattacaacctatatttagagaactattggagaactcacattttttactccaaaagtcatttagcaactttttaaatatgtgatttagagagctaaaatttacataactattggagttgctcttattattatatacctgggctgagaccgagagacatgcatgctatagtacaactttcatttattctcctggggcctggtgtggaacatgaactgaatgctgttagatgcgtttgtgcgccccagccccgtttcgtacaagctccccttgccagatgccagccagcccgggcgctgctcagtagaggctgatttggtgatgaagatctatgggtgaggaatcccggtgcagaccagatgtctctcgctgggcttttctgagagaggacgaaagaaaggggggttgctgcctgctgggcatcattcttcaggtcgcggcgttccttctgattaatactaatattttacgcatggatttgaagcgtgcggcgcatcaattgaggcaccagatcccccaccctagctctctctctctctctctctctctctctctctctctctcntatctctctcttttctacagcactcgcgggaatgaaacctggccgaagattgccgccgctcggtttttcactcgtggtgccctgccaatggaaaaacagactcggcccttttggcgtggggcgctagtgctgcgatgggcattggccgccgaggcaacctgactgacacacctctctgctttgacgcgacataatcctgattgttgcacggacggaggtcctggtgatgtgatctagttctcagaaaattccgcggagaaaaccattggctgacgctagaaaagctgcccggcggaggagatactgccgctgtgggagttgtctgaattctcaggctgtcaggcaggctgctggaaaaaaaaattgtacgcgaagcgattgctggcagtgtcagcgcaacgggctcgctcagcattttgcatttcgccagtcgccacggactaggactagcccagaagttaaaaaggtattgggccgtttctgttcgaccttgtgaggaaaccatactattattaatagaagtctacatacagatgggacagtacaattgataaggtgaagattctgggtagccatgcctactgcgtattgggcacgcgcacttggagttggaaggagagttcagagttaccgatgagttggaactggttggtatcatcaccttcctggacctggaggctgttgtccctcagtccctggctccctgcagacgtcaacgcagccagtgatgaagccattgaaccttggggtgcattggtagagcattgcacaggccaggctctcacgaatggatccacctgatcccccaccattacgagcaaactggtcttccctgcgcttgctccttcttgccccagggcagctcgccctccagtccaggcaatgccgccgcggccctcccatgtcccatcccacaaccactgcgccgttccttctacgcgctcgcagcctccaggacacttgtttctgctttactactgtatttaatacaaagatgcatgcttctcacgcgtgtgcttcaaagaatacactcgtaactaatcagagtttcaattcagattctgaaattctaatgcccaaagccagcttcaggaatcagtattttactctctggttgcaagaacccaaactggggtgcaatccattttggcctctgtttacatcaatactgtactggtgatcctgcagactgagttctgaactttatctgcacttgctcagtctactgtggaagagtcacaaagaagatgaagggaggcaaaaggttcaaccattgatatggcaatgtgagtgctccagcacaattttcatcgcattttggttttcttgattatgtcttgtattgcctataaatgtcaatatgcaggctgccacactttctaggtgtataaaaattattatcagtattctctatataaataagtacatttgtggaaatatattatatcattcatctaaggtcccgtttgttttccttcgttttaagaaattagaatctaactaataaattagtctatttttttattttagaatataacattctacaactttccaaattttatatataagactcatatttatagagtgagagatgaaaattgatttttataaatttacatgctacttttttaatgtataacttatagaacacttttctagttgtttttctatagtataaatatagtgtgtaactatatttcatatatgatttaagataacatacaaatatattatatataatttaattagtttgtttaaattataataattagaatagaatttaattctaaataaataaacggagccttatggtaattattaatattaaaaaatgtatggtcagctgatttagactaaagggaacgaaggtccagcccagataactcctctgaggccaaaagagaatcccggcccgtgtccagaagacgcctcagccaccgcaaaatccccaaatccgcggcggagaggagagagccggagagaggggcgcagccagagagatcggagaaggggaagaagatggtgcgggtggcgacctacttcgcgatgaccttcggggcgttcctcttctggcagtccatggacagggtccacgtctggatcgcccttcaccaggacgagaaggtactttgcnggtgccgcatctgtggcgcgatctcttcccttctccctccttgtgaattcaaatcggttccttgttactatgcgggtgtagcttgtaggttccattatcaccttagattgttagatctggtttgtctatgccatttgattagcagttgctcgaaccacatgaatcattgaatacattgttggatccgacttgacctaaggtactgtagattcggtaaagaacttatgctataactgctgagtgtgataaaacgaatcccgaggttacatcttcccaaaaaacactagtggtaatttaagcaccagaacattagactattagtgtgtaataaaagaacctgcaaatgaaagacaatggaaatttcaaacaatagaatgggtacactactatactgcaggaaagaaacagcatatgtcaccgttgagggctttgatacaatgaatttgcaactatggcacccaatttttgcagctgtagttgtagtgttgcttctgttatcagtcaggtctacatgtatcaaaatagttctagtgttccatggctccaataaaatgtgaattggaagttaatcttaattgcatcagctgccccatgatgtacggccgtacgggttgtaagattatggtttgttctgaatcctgagtgcctggtctgcagttcgaaagccatttagattgagaggtacattgccagggaaacttgtaacctgtttgaaaacacatcatttgtgataataactgtctgtgttcacaacattacactacgatagtacgatactatgattgcattttggtccccattgtaccccaaaggttcattcagagcttttatttctgtagtatgttcagtcttttttggatccctgttcttcgaagatggtgctaagacatgggagcattatgtacctccgctgtgctagacttaaacacagacagaatcacttgttgtatgctctgttccaaccaagaacaccatcctcagttcatcacacaaaacacacctggccaccaaaaccaccatggtctatttgtgcaaatacatgcactgtcagcgtctatagtttattataccttcggggcgttcctcttctggcagtccatggacagggtccacgtctggatcgcccttcaccaggacgagaagaaagaaaggatggaaagggagctggagataaagagaatgcaggcagagttactggcccaagctaaagagaatgaatcatgattgtcatttgtccaatggtttcaggcagttcctttatcgtatttcctctgctgtattttccatgcaatatcttgactgatgtatgctcatgctcagcacctccaataaagcgagacatgctatagcattgttgaatgcaagtgggtatgcagtttgcagtatgcttatgttgaattgatgtaacttagccgaactgaaagaggctgccccagcttgattggaacagaggaatttgctgctgtttttgttcttattacggaacaacacaagtcaactctaaaaaaaaattgtttatgagtctggttataaggtgttgttttgtactgagatttcattgttcacttgaagaaacctctgtcggaggagcagaatgcttggtgctgtttaagttggctcgtgttatattgctcatgttctaagtatacatatccaacatgtcagtcacttttctgttgtgccattctaagttaatatatgtaatgctatttctgcaccggtgtagttttgatcattgtcttatgcagcagtatctttattttctttggaaaaaaatccttttatttcgcacggggtttccgatgattcaatgcagctttcatctgtttgtttggctgcag

SEQ ID NO: 18821 - DNA, 897 bp, Zea mays
  misc_feature (842)..(842): n is a, c, g, or t
  misc_feature (856)..(856): n is a, c, g, or t
tgggacaactcctctgaggccaaaagagaatcccggcccgtgtccagaagacgcctcagccaccgcaaaatccccaaatccgcggcggagaggagagagccggagagaggggcgcagccagagagatcggagaaggggaagaagatggtgcgggtggcgacctacttcgcgatgaccttcggggcgttcctcttctggcagtccatggacagggtccacgtctggatcgcccttcaccaggacgagaagaaagaaaggatggaaagggagctggagataaagagaatgcaggcagagttactggcccaagctaaagagaatgaatcatgattgtcatttgtccaatggtttcaggcagttcctttatcgtatttcctctgctgtattttccatgcaatatcttgactgatgtatgctcatgctcagcacctccaataaagcgagacatgctatagcattgttgaatgcaagtgggtatgcagtttgcagtatgcttatgttgaattgatgtaacttagccgaactgaaagaggctgccccagcttgattggaacagaggaatttgctgctgtttttgttcttattacggaacaacacaagtcaactctaaaaaaaaattgtttatgagtctggttataaggtgttgttttgtactgagatttcattgttcacttgaagaaacctctgtcggaggagcagaatgcttggtgctgtttaagttggctcgtgttatattgctcatgttctaagtatacatatccaacatgtctgtcacttttctgttgtgccattctaagttaatatatgtaatgctatttctgcaccgggtagttttgatcatngtcttatgcagcantatctttattttctttgcaaaaaaaaaaaaaaaaaaaaaaa

SEQ ID NO: 18822 - DNA, 1765 bp, Zea mays
cagcaatgacggcgactacgagcacacgtccgcagccgcagccgcagccgcagccggcggcggtggcggaggcaggggcggcggccgccgcctctgggtcaaggagcgcgaccacgagtggtgggaccggatgagcagccccgcgtgccccgaggacgagttccgccgcgccttccgcatgtcccgggccaccttcgaggccgtgtgcgaggagctgggcgccgccgtcgccaaggaggacaccatgctgcgcgccgccatccccgtccgccagcgcgtggccgtctgcatctggcgcctcgccaccggggagccgctccgcctcgtgtccaagcgcttcggcctcggcatctccacctgccacaagctcgtcctcgaggtctgcgccgccatcaaggccgtgctcatgcccaaggccgtgcagtggcccgaggcgcccgacgccgccgcggccgagtccgccaggttcgaggccgcgtcggggatcccgggcgtcgtgggcgccatgtacaccacgcacatccccatcatcgcgcccaaggccaacgtcgccgcctactacaaccgccgccacacggagcgcaaccagaagacgtcctactccatcacggtgcagggcgtcgtggacgcgggcggtgccttcacggacgtctgcatcggctggccgggctccatgtccgacgccgacgtgctcgaccgctccgcgctctacctgcagcgaggcgccgcgggcctgctgcaggggcagcgcctggtgggcggcgccgggtacccgctcatggactggctgctggtgccctacacgcaccacaacatgacgtgggcgcagcacgtgttcaacgagcgggtggacggcgtgcgcgccgtggccagggacgccttccagcgcctcaagtcccgctggggctgcctccagaagcgcaccgaggtgaagctgcaggacctccccgtcgtgctcggcgcctgctgcgtcctccacaacatctgcgagcgcgccggagacgccgtcgaccccgacatcgcgttccagctcttcgacgacgacatggtcgccgagaaccccgtgcgctccacggcggccgtcgccgcgcgcgacagcatcgcccacaacctcctccaccgcagcagcagcagcagcagtagcgccgccgccggccccaggttcgccttcaattgaactctgacggcgggggcgaggaaaagcacctcgctttctcggcgggatcagagaagacgacgccacgagggcgaggctcagcaatctttcaccgtttttttcgcttgaatgaaattgtaataagttgggaacatagcaacgggggttgatagcgaaacatacatagggttcaaagatacagtaggtgattggttgataggatttgagattgttctgcattttttttttgtagagtcaaaggttcaatcatcatttttcagatttggtgagaccgcgtagcctgtgtagtcaatactgtgcaggctattttgccaccagactttgcaatcaatcggtttttagccaaaaaaaaaaaaaaaaaaaccgagagtacttctagacgcccgggccaaaaaaaaaaaaaaaaaaaaaaaaaaaaaaaaaaaaaaaaaaaaaaaaaaaaaaaaaaaaaaaaaaaaaaagggggggccctttttaaagacccaaattttattccccggggtttgaaaaaaaaaattttttttttggggcccccaaaataaaattccgggcccggtttttaaaaccctgggaaggggaaaacccttg

SEQ ID NO: 18823 - DNA, 1371 bp, Zea mays
  misc_feature (34)..(34): n is a, c, g, or t
  misc_feature (37)..(37): n is a, c, g, or t
  misc_feature (52)..(53): n is a, c, g, or t
  misc_feature (91)..(91): n is a, c, g, or t
  misc_feature (183)..(183): n is a, c, g, or t
  misc_feature (197)..(197): n is a, c, g, or t
  misc_feature (204)..(204): n is a, c, g, or t
  misc_feature (219)..(219): n is a, c, g, or t
  misc_feature (1314)..(1314): n is a, c, g, or t
  misc_feature (1316)..(1316): n is a, c, g, or t
  misc_feature (1323)..(1323): n is a, c, g, or t
ggaggacaccatgctgcggggcgccatcccgtgncgnccagcgggtggcgtnntgcatctggcgctcgccaccgggggagccgctccgctncgtgtccaagcgcttcggcctcggcatctccacctgccacaagctcgtcctcgaggtctgcgccgccatcaaggccgtgctcatgcccaagnccgtgcagtgcccngaggcgnccgacgccgccgcgnccgagtccgccaggttcgaggcacgcgtcggggatcccgggcgtcgtgggcgccatgtacaccacgcacatccccatcatcgcgcccaaggccaacgtcgccgcctactacaaccgccgccacacggagcgcaaccagaagacgtcctactccatcacggtgcagggcgtggtggacgcgggcggtgccttcacggacgtctgcatcggctggccgggctccatgtccgacgccgacgtgctcgaccgctccgcgctctacctgcagcgaggcgccgcgggcctgctgcaggggcagcgcctggtgggcggcgccgggtacccgctcatggactggctgctggtgccctacacgcaccacaacatgacgtgggcgcagcacgtgttcaacgagcgggtggacggcgtgcgcgccgtggccagggacgccttccagcgcctcaagtcccgctggggctgcctccagaagcgcaccgaggtgaagctgcaggacctccccgtcgtgctcggcgcctgctgcgtcctccacaacatctgcgagcgcgccggagacgccgtcgaccccgacatcgcgttccagctcttcgacgacgacatggtcgccgagaaccccgttcgctccacggcggccgtcgccgcgcgcgacaacatcgcccacaacctcctccaccgcagcagcagtagcagcgccgccgccggccccaggttcgccttcaattgaactctgacggcgggggcgaggaaaagcagctcgctttctcggcggaatcagagaagacgacgccacgaggctcagcaatctttcaccgtttttttttcgcttgaatgaaattgtaataagttgggaacatagcaacgggggttgatagcgaaacatacatagggttcaaagatacagtaggtgattggttgataggatttgagattgttctgcattttttttttgtagagtcaaaggttcaatcatcatttttcagatttggtgagaccgcgtagcctgtgtagtcaatactgtgcaggctattttgccaccagactttgcaatcaatcggtttttagccaaaaaaaaaaaaaaaattcgcctctcctgggtagntnccgtcgnccttgtcccctttttgtaagttggaaactggaggggtgaaatgagttt

SEQ ID NO: 18824 - DNA, 875 bp, Zea mays
  misc_feature (764)..(764): n is a, c, g, or t
cattgggaccttgggtacctcgaggccggccggggtcatcccaaacgccggtggagtcactcgagcccgcccgggtctcttcctcttccattgattccattcaagatcactactgttaccagccagccagtcgttcgttaagaagagagcgagcaagagagagagagagagagagaaggggggagagaacgaagagagggagatgagggggcaaacgcagacagcttccgcggggggccggtggcgaggcgacggcgctgcggcgtggtggtggtggtgggtggccgtggtcctcctcctgcttggccatttaccgagctacgcgcgcgcggggctgctggagtccaacccgggcctggcctacaacttctacaagaacagctgccccagcgtggactccatcgtccgcagcgtcacctgggcgcaggtcgccgccaaccccgccctcccggctcgcctcctccgcctccacttccatgactgcttcgtcaagggctgcgacgcgtcgatcctgctggacaccgcgcagagcgagaagacggcggcgccgaacctgtcggtgggcgggtacgaggtgatcgacgcgatcaaggcgcagctgggagagggcgtgccccggccgtggtgtcgtgcgccgacatcgtggcgctggcggcgcgcgacgccgtgtcgtaccagttcaaggcgtcgctgtggcaggtggagacggggcggcgcgacggcacggtgtcgctggcgtccaacacggggggcgctgccgtccngcccctcgccggggcttcgcgggcctgctgcagagcttcctcgggcccggggctgaacctgacggacctcgtgggcgctgtcggggcgcacaccatcggcgtggcaagctg

SEQ ID NO: 18825 - DNA, 1632 bp, Zea mays
caggcacccgacggacggatgggctggggcggctataaacatcggggcgtccctcccggccggcgggatcaccaaacgccggtggagtcactcgagcccgcccgggtctcttcctcttccattgattccattcaagatcactactgttaccagccagccagtcgttcgttaagaagagagcgagcgagcaagagagagagagagagggagaagggggaagatcagaacgaagagagggagatgagggggcaaacgcagacagcttccgcggggggccggtggcgaggcgacggcgctgcggcgtggtgttggtggtgggtggccgtggtcctcctgcttggccatttaccgagctgcgcgcgcgcggggctgctggagtccaacccgggcctggcctacaacttctacaagaacagctgccccagcgtggactccatcgtccgcagcgtcacctgggcgcaggtcgccgccaaccctgccctcccggctcgcctcctccgcctccacttccatgactgcttcgtcaagggctgcgacgcgtcgatcctgctggacaccgcgcagagcgagaagacggcggcgccgaacctgtcggtgggcgggtacgaggtgatcgacgcgatcaaggcgcagctggagagggcgtgcccgggcgtggtgtcgtgcgccgacatcgtggcgctggcggcgcgcgacgccgtgtcgtaccagttcaaggcgtcgctgtggcaggtggagacggggcggcgcgacggcacggtgtcgctggcgtccaacacgggggcgctgccgtcgcccttcgcgggcttcgcgggcctgctgcagagcttctcggaccgggggctgaacctgacggacctcgtggcgctgtcgggggcgcacaccatcggcgtggcaagctgctccagcgtcaccccgcgcctgtaccaggggaacgccagcagcgtggacccgctgctggactcggcctacgcgcggacgctcatgtcgtcgtgccccaacccgtcgccggcgtcggccaccgtggcgctggacggaggcacgccgttccggttcgacagcagttactactccagggtgcagcagaagcagggcacgctggcctccgacgccgcgctggcgcagaacgccgccgccgcgcagatggtggccgatctcaccaaccccatcaagttctacgccgccttctccatgtccatgaagaagatgggccgcgtcgacgtgctcaccggcgccaacggccagatcaggaagcagtgccgccaggtcaacacctcctgatcaacaaggcgtcacagggaggggccatggtttttccctcttcgttcttctctttttctgcaccgcctggtattattgttccatgcatccggtttcggctcggcttcggctcggcgcgcatcaaatatatttcgcccccgcgccgtgattgagggccctcctccgacgaaagaaatccattgctttctttgttatttatattagtttactcactgtcctgtgttccattgtcttgccttgcaaaaatgtaagaaagattaaagatgtaagcaaaaaaaaaaacaatgcggatcatccactctaaaaaaaaaaaaaaaaaaaccgtccttttttaaaaaaaaaaaaaaaaaa

SEQ ID NO: 18826 - DNA, 1329 bp, Zea mays
  misc_feature (1325)..(1325): n is a, c, g, or t
cttaatgccactgtgaccacaccaaacgccggcggagtcgtcagtcgtgcgtgccggtgcccgtcccgttctgccccgctcccctcccccgactccctcactcttcctctttccgttccattcaagatccctgcagccgtccgtccatccatccattcatccgctaagaggagaggggaggccggccggccggccggtggagcggagatgagggggcagacagagacaggccggtggcgaggaggcgacggcgttgcggcgtggtgggtggccgtggtggccctgcagctgggccattcgctgagccgcgcgcgggcggggctgctggagtccaacccgggccttgcctacaacttctaccagagcagctgccccagcgcggagtccatcgtccgcagcgtcacctgggcgcaggtcgccgccgaccccgcgctcccggcccgcctcctccgcctccacttccatgactgcttcgtcaagggctgcgacgcgtcgatcctgctggacaacgcgcagagcgagaagacagcggcgccgaacctgtcggtgggcgggtacgaggcgatcgacgccatcaaggcgcaggtggagaaggcgtgcccgggggtggtgtcgtgcgcggacatcgtggcgctggcggcgcgcgacgcggtgtcgtaccagttcggggcgtcgctgtggcaggtggagacggggcggcgggacggcggggcgccgtcgctggcgtccgacgcgttgggggcgctgccgtcgcccttcgcggggttcggcggcctgctggcgagcttcgccaggcgcgggctcaacctgacggacctggtggcgctgtcgggggcgcacaccatcggcgtggccagctgctccagcgtcaccccgcgcctgtaccaggggaacgccaccagcgtggacccgctgctggactccgcctacgcccgcgcgctcatgtcctcgtgccccaacccgtcgccggcgtccgccaccgtgggcctggacgccggctcgcctgccaggttcgacagcgggttctacgcccgggtgcggcggggccagggcacgctggcctccgacgccgcgctggcgcagaacgccgccgccgcgcaggtgatggacgacctcgccacccccgccagcttctacgccgccttctccatgtccatgaagaagatgggccgcgtcgacgtgctcaccggcaccaacggccagatcaggaagcagtgccgccaggtcaacacatcctgattgccttgcctgatgcctccctcccattcatcatcatgcgtcgattcggcgcgcatcaatatatttcttcgtcgaaaaaaaaaaanaaaa

SEQ ID NO: 18827 - DNA, 1412 bp, Zea mays
agaggcccagcccacggtcagtgtcacctctgctatttcttcacccgtccgttcacctgcgttcatccggcctacgttaaaatctctccatcccggcgacgactggcgacagccgctgccggcctactccaggtccccaggtctacgtcggacccttcgccgcggcgagcaccaccagatggcgagcacggggcggtcgatgctgctgtcactgctcctcttcgcagtgacgctgtcgctgctggagatgtacagggccaagttcgcctcgtcggagctcatgaccatcgccggtggattcgtctgctccctcctattcctgctactcctcaccgtgcgtttctccttgtagttcctgttgtttctaactttctttctcgttcctcgaatggtgcattggtgcagaagccattgacattggaaatatttgcaatttcgccacccccaagtggtgttgacactttgctagtttgccatctatgatttgtgggttcggtggcaaattagcgaagtccactgtcgaatgtcgatggtggcaaagccattgcccctctttctgatttgctaaattgaagtggtaatgtacggccacagcgaagtagtaaataaacatagggcgtgtttggtcaggaaccagccttagtaaatgaggtggtgtaccatgcatgactttatcccatgaaatttatttggtgggatgactccatcctcatgcgtcgtggtggattaatccatttcggcatttcattctaaaaaccaaacaaaaaagtgagtgagatgacgataaccatccccttatgttggtgtggatatccgttttatggttgcttctgtgttataacattaattacttctggattcgtcggctcttcatcaagattcaagaagtgtgcttactgcttggaatttttccttattatgaactgataattggaacaactgttgcagtttattggaaactatcaagaagctagtggagatagaactgggtggggtgcagttgttgtagcacaacttgtagctcttattgtagccggcactgtccaccgtgtctgtatcacaacatgcttcctgttttccgctggactcctttacgaggttgacaagctctctggcatgatccttgcgaggagtgagtctaaggtgaggcggcactaagcacagaagcagcacagagagatgatacattgatatttttatgtaagatgacatattttgtatgtcaaactggagtgttggttcgcgctggccatcaggccttttctgctagccatataggggctctggattctggatactggtgcgtttgcaccgaggtcacactctgatgtttgtctaatcaattgactaggtgatttaccaccttttgccggttgccggttaaaaaaaaaaaaataaaaaaaaaaaaaaaa

SEQ ID NO: 18828 - DNA, 752 bp, Zea mays
aaaccgagcacccaaaccctaatttaagctatttgtattcggatctgatctaattactacaagtggatatatggcgagcacggggcggtcgatgctgctgtcactgctcctcttcgcagtgacgctgtcgctgctggagatgtacagggccaagttcgcctcgtcggagctcatgaccattgccggtggattcgtctgctccctcctattcctgctactcctcacctttattggaaactatcaagaagctagtggagatagaactgggtggggtgcagttgttgtagcacaacttgtagctcttattgtagccggcactgtccaccgtgtctgtatcacaacatgcttcctgttttccgctggactcctttacgaggttgacaagctctctggcatgatccttgcgaggagtgagtctaaggtgaggcggcactaagcacagaagcagcacagagagatgatacatcgatatttttatgtaagatgacatattttgtatgtcaaactggagttttggttcgcgctggccatcaggccttttctgctagccatataggggctctggattctggatactggtgcgtttgcaccgaggtcacactctgatgtttgtctaatcaattgactaggtgattttccaccttttgccggtttcatgatgtcattttccttcagccatactcgcggtgcgttgcatctgtctgtgcaatatagttttgccatcttttgtcgctcaaaaaaaaaaaaaaaaa

SEQ ID NO: 18829 - DNA, 845 bp, Zea mays
taccccgaggccggccgggaccacggtgtcagtgtcacctctgctatttcttcacccgtccgttcacttgcgttcatccggcctacgttaaaatctctccatcccggcgacgactggcgacagccgctgccggcctactccaggtccccaggtctacgtcggacccttcgccgcggcgaacaccaccagagatctgtcactgattttgcagtcctcttgtcagatggcgagcacggggcggtcgatgctgctgtcactgctcctcttcgcagtgacgctgtcgctgctggagatgtacagggccaagttcgcctcgtcggagctcatgaccattgccggtggattcgtctgctccctcctattcctgctactcctcacctttattggaaactatcaagaagctagtggagatagaactgggtggggtgcagttgttgtagcacaacttgtagctcttattgtagccggcactgtccaccgtgtctgtatcacaacatgcttcctgttttccgctggactcctttacgaggttgacaagctctctggcatgatccttgcgaggagtgagtctaaggtgaggcggcactaagcacagaagcagcacagagagatgatacatcgatatttttatgtaagatgacatattttgtatgtcaaactggagttttggttcgcgctggccatcaggccttttctgctagccatataggggctctggattctagatactggtgcgtttgcaccgaggtcacactctgatgcttgtctaatcaattgactaggtgatttaccaccttttgccggtttcatgagaaaaaaaaaaaaaaaaagcggccctcgagctc

SEQ ID NO: 18830 - DNA, 887 bp, Zea mays
aaaagatgttttccgagctgcaccagaggcccagcccacggtcagtgtcacctctgctatttcttcacccgtccgttcacctgcgttcatccggcctacgttaaaatctctccatcccggcgacgactggcgacagccgctgccggcctactccaggtccccaggtctacgtcggacccttcgccgcggcgaacaccaccagatggcgagcacggggcggtcgatgctgctgtcactgctcctcttcgcagtgacgctgtcgctgctggagatgtacagggccaagttcgcctcgtcggagctcatgaccattgccggtggattcgtctgctccctcctattcctgctactcctcacctttattggaaactatcaagaagctagtggagatagaactgggtggggtgcagttgttgtagcacaacttgtagctcttattgtagccggcactgtccaccgtgtctgtatcacaacatgcttcctgttttccgctggactcctttacgaggttgacaagctctctggcatgatccttgcgaggagtgagtctaaggtgaggcggcactaagcacagaagcagcacagagagatgatacatcgatatttttatgtaagatgacatattttgtatgtcaaactggagttttggttcgcgctggccatcaggccttttctgctagccatataggggctctggattctggatactggtgcgtttgcaccgaggtcacactctgatgtttgtctaatcaattgactaggtgatttaccaccttttgccggtttaaaaaaaaaaaaaaaattcagccatgtcattttccttcagccatactcagcggtgcgttgcatctgtctgtgcaatatagttttgccaacttttgtcgctc

SEQ ID NO: 18831 - DNA, 894 bp, Zea mays
  misc_feature (837)..(837): n is a, c, g, or t
gcacgaggtcagtgtcacctctgctatttctttgggtgcctcgtgaccggccggcatccggcctacgttaaaatctctccatcccggcgacgactggcgacagccgctgccggcctactccaggtccccaggtctacgtcggacccttcgccgcggcgaacaccaccagagatctgtcactgattttgcagtcctcttgtcagatggcgagcacggggcggtcgatgctgctgtcactgctcctcttcgcagtgacgctgtcgctgctggagatgtacagggccaagttcgcctcgtcggagctcatgaccattgccggtggattcgtctgctccctcctattcctgctactcctcacctttattggaaactatcaagaagctagtggagatagaactgggtggggtgcagttgttgtagcacaacttgtagctcttattgtagccggcactgtccaccgtgtctgtatcacaacatgcttcctgttttccgctggactcctttacgaggttgacaagctctctggcatgatccttgcgaggagtgagtctaaggtgaggcggcactaagcacagaagcagcacagagagatgatacatcgatatttttatgtaagatgacatattttgtatgtcaaactggagttttggttcgcgctggccatcaggccttttctgctagccatataggggctctggattctggatactggtgcgtttgcaccgaggtcacactctgatgtttgtctaatcaattgactaggtgatttaccaccttttgccggtttcaaaaaaaaaaaaaacttcgcccccactcgcggtgcgttgcatctgtctngtgcaatatagttttgtcaaaaaaaaaaaaaaaagcggcctcgagctcagctttgtc

SEQ ID NO: 18832 - DNA, 853 bp, Zea mays
ccgggccagccacggtgttagtgtcacctctgctatttcttattgggtcccgctccgggcccggccgggcatccggcctacgttaaaatctctccatcccggcgacgactggcgacagccgctgccggcctactccaggtccccaggtctacgtcggacccttcgccgcggcgaacaccaccagatggcgagcacggggcggtcgatgctgctgtcactgctcctcttcgcagtgacgctgtcgctgctggagatgtacagggccaagttcgcctcgtcggagctcatgaccattgccggtggattcgtctgctccctcctattcctgctactcctcacctttattggaaactatcaagaagctagtggagatagaactgggtggggtgcagttgttgtagcacaacttgtagctcttattgtagccggcactgtccaccgtgtctgtatcacaacatgcttcctgttttccgctggactcctttacgaggttgacaagctctctggcatgatccttgcgaggagtgagtctaaggtgaggcggcactaagcacagaagcagcacagagagatgatacatcgatatttttatgtaagatgacatattttgtatgtcaaactggagttttggttcgcgctggccatcaggccttttctgctagccatataggggctctggattctggatactggtgcgtttgcaccgaggtcacactctgatgtttgtctaatcaattgactaggtgatttaccaccttttgccggtttcatgatgtcattttccttcagccaaaaaaaaaaaaaaaaaacgggccggccctgtgcaatatagttttgccatcttttgtcgcgg

SEQ ID NO: 18833 - DNA, 751 bp, Zea mays
gcacgagaaccgcccagaacagccgccacaagcccttctcaactcaagtctcatctcatcatctcccacccacctaaactaacagcccacggccaacttgcaggacgcatgggcgcatggcatgtgggtgtggcggcatataaatggaggcagccgagcccgcagcctccccacacgcctctcttgctcaccattctcttctaaccagccaagccaaggcgcatctagcgagctgagcagcaatggcggctgctacttcttctaggcgccctgcagctgctctgctggtcctggcagcagccgtcgtggccctggcggccgagggggccaggtacccgccgctggcgccgggcctgtcgttcgacttctacaagaagagctgccccaaggcggagtccatcgtgcgggagttcctggcgtcggcggtccggcagaacgtggggctcgccgcggcgctgatccggctccacttccacgactgcttcgtgcagggctgcgacgcctccatcctgctggacgccacgcccacccagcccagcgagcagcagtcgccgcccaacctcacgctccgccccgccgcgttcaaggccgtcaacgacatccgcgcccgcctcgaccaggcctgcggccgcgtcgtctcctgcgccgacatcgtcgcgctcgccgcacgtgaatccgtcgccctgggtggcggcccggcgtacaagttgccactgggcaggcgcgacgggctggcgccggcatcgaacgc

SEQ ID NO: 18834 - DNA, 3406 bp, Zea mays
accgtcgcaacgcacgggtacctacctagtacgatcatatatgagtcgaagttgacccccccgcgcccgaccgattttcacgtgagtcccaaaaccgatagcggaacaaacaaggggctaaactgcaataagaactttcccctcggaactcaccggctggcggctgcagggtcgacttcaatactttatccaagctccattttctctgaggaagcgaaccttccctttccccaggcacagatccggctctccgccgccgctatggccgctcgccgcctcctccttctcctcgccgttgtcgccgcgtccctcctggctgccgacgcgcggccgtgccacggcttcctcgtcgccatcccgtccgatcccaaccccgaccccagcagaggcgacggcgccgtcaaccgccacctcggcgctccccacgtcgccacggtcatcaccgtcttccgcgtccgccgcctcggtccacacgtcccccacggccaccgcaaccaccaccacctccattctatccccgccaacgttcagatccatcgccccgatctcctgcaccccgccacggccgcggccgccgggccccaggagcgcgtcagggacatactcgtggtggtcgtggggctcctcttcggcctcgcctgcggcgcgctcaccgctgcctccgtgtacctcgtctggtccatggtcgccggcgccgccgcggcttccccgtacgacgagctctatgaggacgaggacgagtcgtctgacaccgagagccccaagaaggtcggatacgtcatcatccaggagctcgaggtgcatgaaggcggtaagaagtagacccagatctagtggcgttcgtgctcccggctcccgggtgctagggcaagttcctgtagtgggatgacctattgccatatgattatgtgttgagtgaatcttaatgtctgtatgactatgtagtgggtggctgggacttgggagccttagggttttgccctccatgtgaatatatgatcgtgaagcacgcttaagctacgaaatgtgtttgtttctgatgaacttatcaatcaatttcatgcgccattgtgaaatgttcttctcaaacactggcatttgatctggtgtctaatgtgctgtggcctgtactccagaacagagttctcccggccgttttttgcctggtttgtgtcccacttattggtgttatgcaatgacttgtctttcctgatgcaccgaagcttggctgatgggttcgttgaaggttatgtggtttgggtatgctcgcttgctcgtgtgtggactaataatggactagctgataggtagttctgaatttgtggataatccgtttgttttgttaatatgttatcaccgacaaactatttattgatttcagtgttctctgcattttcatatgccaatcttcgatttgtgactgtaatatggtagtcagggggtggttacattattgacaacagcccaacatgttgtaatcaggttatatcatttgacatgttagttgaaactatttggcattcatatcgtttgatgcacttatggccacgagcacaaaatatttgcatcagacatgtttagctgaattagtagtgaaaatttttgtggatgatagtcatggtttttaaagcggtaaggcggtccaaggcgttggaccaccgcctggacgcctaggcgaggtaggcgggcaaggcgcctaggcgttagaccaccacccggacgcctaggcgacgccttaagaacagtgatgatagtcatcttcgcaatgcgctggtatagttctataacagggtagtcattttgaggatgcagattagtgatatcatatggtggttggccttagatttgctatgtcttgaagtgttgtctatgcttttgtttgagatttcagagtgttgtcggttatgcttttgtatctgtttgagcagttcgttattgatgagctatcaccggaatttcatttttttagttcagtctgagcttaaatattgtccttggctgcatccaaactatttgttctgaaatatatgttatatgattcgtcaatttgcattcctcaagtcaggaatatgtgagggcttgttttcagaaactgtttttgtgagccctcagattggtttcaccgcagaacccacaatgtgacgtgcgtgatctcgcacaatgccagttgtgccttgtgtgtcactgtgtgcgtcaaagacaggaggaacctgaaaaacgcatcctctttttagggcaatctgaattacgtcctgcaagtttggaaataaacttgaaccagcaggtacgcacaaatgaccatcagatatggctaaattgaataatattgtaactgtcagggacctgatctttctgaagcaccaatgtgtagcatagaaaaagaaatatcaaccgagtaaaatgcagtctctgtccataaacttttaaagtatgtttttaatgttaaagtatgtttcttaagtgtctattcacgcgtggtggtctgttgaccgtgtcgacccatctctccttcccatgctgtgacacgccaccggcttggaacaacttatggcttccctccagggttgttcctgataactcggggacctaaagcaagacttaaaatagaacaactccttattttaaatactcaaatatgtataaaattattcaccataagtatatatataatatggttatcttaaaattttcttaaaacatgtcttgatgtgaagtcattgatgatgatatcaatatcaattttatccactaatatcttctcgatatataaagtagtcaaactatttagtttttagcgacattttaggtcttaaataattcttcagtaacttcaactttaaaaagctccttcaactttaggtgatacaacaatcataagcacaattgtaggtgtcacaaactcgtttgaaaagcgttctactaatggtggcaccactaggtgatgcaagacgagacacatgaatcgttgtacgtgggctaaatactataaatcagttatttatcataaagatcacttaaaagctaaaactaaatattgaatatgtatagtactatgttactgatctgatttacgagccatggtggcgtggaccacgtgaccaacaactaattttgacttccaaaacggcgagataatgtaaaaactttgtattacctttcaacttgaaaaatatcaattacaggtaattactataccttatcactcattgtcttcccactttcattcttcctttatacggcatctacaaaaccttgaaacaaactcacttctttatgaatagtactccatcgatgcttcaatgatgaccaattgcgctctgattcaaatgtcttattgtcatgaaagtatttttcaactctttccccaaaatctaccatctttttgatcccttccaacaacagcatc

SEQ ID NO: 18835 - DNA, 2254 bp, Zea mays
ccggtccggaattcccgggtcgacccacgcgtccgcgccactcggccccaggcccctcctcttccccgcccgtaccgcccggccggccgcgacttccgggaaaaaggctcccaatctgttccgagccagccggccatggcgattagggctggccgctcgccccttctccacctcctcgccctcgccttcctcatcctcgccgcctctccctgcctccaagctcgagtggaccatcgcaaacagatatctcactggactgggcaacccaactttgacctgcagaatgtctcatcgggtcgaaaggatggccctcatctcctgggtagatcaaaggaaataacacacatgaaattaaggagagttgctgtaaggaagaaaatggaagtagtgcagcaggatgatgaagcgttagttaaacttgagaatgcaggtatcgaacgttcaaaagctgttgactctgctgtgctgggaaaatacagcatctggagacgtgaaaatgaaaatgaaaaggcagattcaagggtccgtttgatgcgagatcaaatgatcatggccagaatatattctgttcttgccaaatcgagggacaagcttgatctctatcaggagctgcttgcaaggctcaaggaaagccagcgctcccttggggaagctactgctgatgctgaacttcccaagagtgcttcggatagaaccaaagcaatgggccaagttttatcaaaagcaagggatctattgtacgattgcaaggaaattacccagcgtttgagagcaatgcttcagtcagcagatgagcaggtccggagcttgaagaagcagagcaccttccttagccagctagcagctaagacaatcccaaatggcatccattgtctttccatgcgcttaacgattgattattatcttctctctccagagaaaagaaagttccccaatagtgagaacctggaaaatcctgatctttaccattatgctcttttctcggacaatgttttggcagcatcagttgtggtcaactcaaccatcatgaatgctaaggagcctgaaaaacatgtatttcatcttgttactgacaaactgaactttggggccatgaacatgtggtttttgctgaatccacctggggatgcaacaatccatgtggaaaatgttgatgacttcaaatggttaaactcttcttactgccctgttctgaagcagcttgagtctgcagccatgaaagaatattatttcaaggctgatcgtccgaaaacactctctgctggttcttctaatctgaagtatcgaaacccaaaatatttgtccatgctcaatcatctaagattttacctcccacaagtctatcccaagctgaataaaattcttttcctggatgatgatatagttgtccagagggacctaactggactctgggaggttgatcttaatggaaatgtaaatggagccgtggaaacatgtggagagagttttcaccgatttgataagtacctaaatttctcaaacccaaatattgctcagaattttgatcctaatgcatgtggttgggcttatggaatgaacatgtttgatctggaagaatggaagaagaaagacattactggaatttaccacaaatggcagaacatgaacgagaacaggctgctctggaaactggggacattgccaccagggcttctaactttttacaagctgacacaccctctggacaaatcatggcatgtgcttggcttagggtacaatccaaccattgagcgctcagagatagacaatgctgctgtcatccactacaatggtaacatgaagccctggctggaaattgcaatgataaagtatcggccttactggacaaagtacatcaattatcagcattcctacattcatggatgcaagatcagccaatagaaaccaccctcagatattcttctgtgatgaacattgaagttggatgggactcaaaatgaaatcagtataactatcacatgttctttattcgtgttatattagatttgttagttatcatgtgtatgtagtttcgtcgcccttttgtggtgctttctcccctagctcattgttggttcttgtctctttttgtcatgaaaagaacgatgagctctatgattctcatcagctgataaatgtaatgtctgaatttctgtcggtgacaaattaatgatcccattcaaacggtatcaaatgttcaaacattcatgcaaactcgagcccggattctactactactacataaaaataaaat

SEQ ID NO: 18836 - DNA, 2237 bp, Zea mays
ccggccgggactgaggggcctcgtcaggcacagaagggcggagcagtgccagtgtactggccgccaccactcgccactcgtccccctccccccgaaagccggcacgagccctcccttcccttcctccaacctgttccgatccgccccgagccggctggccatggcgatcagggctggccgctcggccctccacctccacgctctcgctttcctcatcctcgccgcctccccctgcctccaagtccaagctctagtggaccatcgcaaacaggtatctgactggggtaggcaacccaactttgaactgcagaatatgtcctcgagtcaaagggatggctctcatctcttgggcagatcaaaggaaataacacacaggaaactaagggggagaattggtgtaaggaacaaaatggaagtagtgcagcaggatgatgaagcattagttaaacttgagaacacaggtattgaacgctcaaaagctgttgattctgcagtgctgggaaaatatagcatctggagacgtgaaaatgaaaatgagaaggcagattcaagggttcgtctgatgcgagatcaaatgatcatggccagaatatattctgttcttgccaaatctagggacaaacttgatctctatcaggagctgctagcaagactcaaggaaagccagcgctcccttggggaagctactgctgatgccgaacttccgaagagtgcttcagatagaatcaaagcaatgggccaagttttatcaaaagcaagggatctgttgtatgattgcaaggaaattacccagcgtttgagagcaatgcttcagtcagcagatgagcaggtccggagcttgaagaagcagagcaccttccttagccagcttgcagctaagacaatcccaaatggcatccattgtctttctatgcgcttaacaattgattattaccttctctctccagagaaaagaaagttccccaatagcgagaacttggaaaatcctgatctttaccattatgctcttttctcagacaatgttttggcagcatcagttgtggtcaactcaaccatcatgaatgcgaaggagcctgaaaaacatgtgtttcaccttgttactgacaaactgaactttggggccatgaacatgtggtttttgctgaatccacctggggatgcaacaatgcatgtggaaaatgttgatgacttcaaatgggtgaactcttcttactgccctgttctgaaacagctcgagtctgcagccatgaaagaatactatttcaaggctgatcgtccgaaaacactctctgctggctcttctaatctgaagtatcgaaacccaaaatatctgtctatgctcaaccatctaagattttacctcccccaagtctatcccaagctgaataaaattcttttcctggatgatgacatagttgtccagagggacctaactggactctgggaggtagatcttaatgggaatgtaaatggagcggtggaaacatgtggagagagttttcaccgatttgacaagtacctcaacttctcaaacccaaatattgctcagaattttgatcctaatgcatgtggttgggcttatggaatgaacatgtttgatctggaagaatggaagaagaaagacattactggaatctaccacaaatggcagaacatgaacgagaacaggctgctctggaaattggggacattgccgccagggcttctaactttttacaagctgacacaccctctggacaaatcatggcatgtgcttggtttagggtacaatccgaccgttgagcgctcagatatagacaatgccgcagtcatccactacaatggtaacatgaagccatggctggaaatcgcaatgacaaagtatcggccttactggacaaagtacatcaattatgagcatccttacattcatggatgcaagttcagccaataggaactacctaaacattcttctgtgatgaacactgaagttagagggcactcaaaatatagtcctctcttagtagtataactatcacatgttctttcttcgttttatattaagcttatcatgtgtatgtagtagtttcatcgcctttttgtggtgctacttagtccgttgtcggttcttgttttttttttgtcatgaaaaggacgatgagttcaaagattctcatcagctgataaatgcaatatatgaatttctgttggtagcaaaaaaaaaaaaaaaaaagcggccaaaaactagagggggggcc

SEQ ID NO: 18837 - DNA, 1695 bp, Zea mays
ccctccaaaagccgcacagcagcaaccgccggcgcgcgcacctcacttccatgatccatcgcagaggagagcagcagccagacgtcgcggcgtgaccgtgactccgtgagagcgcgcccgctgcactgcactgcatctgaatgaggagctgggcgagggcggcgctgggcgtcgcggagctgctcgtcagcgcggccatccacctgggctacgccttctacatcttcggcaccgcggtcgccgccgacgtctcagcctccctcgtgaagggcctgatggccggcggcggcgtggccaaggacgtcgccgtcgatggtgaggacgaggccgcggcggtgctcgacgacggggccgtgccgcccatcgtgctggtgcacggcatcttcggcttcggcaaaggcaggctgggcgggctgtcgtacttcgccggcgcggagaagaaggacgaccgggtgctggtgccggacctgggctcgctcaccagcgtccacgacagggcgcgggagctcttctactacctgaaaggcgggcaggtggactacggcgaggagcacagccgggagtacgggcactcgcggttcggtcggacgtacgcgcgaggccactaccccgcgtggggacgaggagcacccggtgcacctggtgggccactcggccggcgctcaggtgatccggctgctgcagcagatgctccacgaccgggagttcgaggggcacggcgacacctcggagcgctgggtgctgagcgtcacctccctctccggcgcgctgaacggcaccacgcgcgcctacatcgacgggatgcgcgccgagaaagaaggcggcgggcggtggctgcgccccgtctgcctcctccagatctgccgcgtcggcagcgtgctctaccactggctggacctcccctggctgaagcgctactacgacttcggcttcgaccacttcggcatgtcgcggcgcgtcgtgggcgtggcggggctcgcggagatcctgctcgacgccggcagcggcggcgggcggcgggggcccttcgccacgggggactggatcctgccggacctcaccatccagggcgccgcccggatcaacgccagggtgcgcacgttcccggccaccttctacttcagctacgccagccggcgcaccgccaggtcgccgccaggcagcgccggcgccacggtgccgtccggggtgacgaggatccacccgctgctcttcatccgcgtcctgcagatgtgccgctggcgctaccccgccggcgctgacccgccgtaccaggggtacagggacgaggactgggaggacaacgacggcgcgctcaacaccttctccatgacccacccgaggatccccgtcgagcatcccagcgtccaggtggagaaggatgaggattgccgtccgctgcgcccggggatctggtactacaagatcgtggaggcggaccacatgacgttcgtcatcaaccggcggcgaggaggcgtgcagttcgacctcgtctacgacagcatcttcgacaactgccggaaacatgtcttccggactgccccgccgccgacgctaccggtccagagctgattccacaccaacgacgtccgcgagaggccgtacaccattattccagcggtcgttccgactgattgacattatttgtgaatatatcgtttgttattactgtcaaaaaaaaaaaaaggaaatatc

SEQ ID NO: 18838 - DNA, 2775 bp, Zea mays
cgtggtagggtgtagtggtggagggtgttatttataaattacaataatcaaccatagacattaaatttgagaaatttgagataggtagtgatgatttaatatatgcactatgtacactaagctttcatgtgtaccaaatatattctttaggataaaatagatttaaaattaaagttaagctcttccaaacaggactaaagtaaagctgtcagccaatgtgacggaatttggtacgggagcctcacaccaaaccaaacgaaatccttgtggaccagacagcacgggaatggcgtggagttgtttgtggccaactcagcttgcctctacaaactaccagacttctccagacggatttccctcaaaaagccgcacagcagcaaccgccggcgcgcgcacctcacttccatgatccatcgcagaggagagcagcagccagacgtcgcggcgtgaccgtgactccgtgagagcgcgcccgctgcactgcactgcatctgaatgaggagctgggcgagggcggcgctgggcgtcgcggagctgctcgtcagcgcggccatccacctgggctacgccttctacatcttcggcaccgcggtcgccgccgacgtctcggtctccctcgtgaagggcctgatggccggcggcggcgtggctaaggacgttgccgtcgatggcgaggacgaggccgcagcggtgctcgacgacggggccgtgccgcccatcgtgctggtgcacggcatcttcggcttcggcaaaggcgtgcgtagtagcttctgctttttgttaccggtcgttcgctttgtcacaggctcacaggtaggtcgtgtgcgttgcagaggctgggcgggctgtcgtacttcgccggcgcggagaagaaggacgaccgggtgctggtgccggacctgggctcgctcaccagcgtccacgacaggtatcatccatctattctactgctgctgtagcctgatgagccatcacgctagctgtggcgtttccattccattccatcgatgaacgtaactccgatccgatcagggcgcgggagctcttctactacctgaaaggcgggcaggtggactacggcgaggagcacagccgggagtacgggcactcgcggttcggtcggacgtacgcgcgaggccactaccccgcgtgggacgaggagcacccggtgcacctggtgggccactcggccggcgctcaggtgatccggctgctgcagcagatgctccacgaccgggagttcgaggggcacggcgacacctcggagcgctgggtgctgagcgtcacctccctctccggcgcgctgaacggcaccacgcgcgcctacatcgacgggatgcgcgccgagaaagaaggcggcgggcggtggctgcgccccgtctgcctcctccagatctgccgcgtcggcagcgtgctctaccactggctggacctcccctggctgaagcgctactacgacttcggcttcgaccacttcggcatgtcgcggcgcgtcgtgggcgtggcggggctcgcggagatcctgctcgacgccggcagcggcggcgggcggcgggggcccttcgccacgggggactggatcctgccggacctcaccatccagggcgccgcccggatcaacgccagggtgcgcacgttcccggccaccttctacttcagctacgccagccggcgcaccgccaggtcgccgccaggcagcgccggcgccacggtgccgtccggggtgacgaggatccacccgctgctcttcatccgcgtcctgcagatgtgccgctggcgctaccccgccggcgctgacccgccgtaccaggggtacagggacgaggactgggaggacaacgacggcgcgctcaacaccttctccatgacccacccgaggatccccgtcgagcatcccagcgtccaggtggagaaggatgaggattgccgtccgctgcgcccggggatctggtatatatcgtgctccttccgtcgccgtccgtcccaaaactcactgcttttcggtttcaacggcaactcgatcaaatgcatggggcgcgcaggtactacaagatcgtggaggcggaccacatgacgttcgtcatcaaccggcggcgaggaggcgtgcagttcgacctcgtctacgacagcatcttcgacaactgccggaaacatgtcttccggactgccccgccgccgacgctaccggtccagagctgattccacaccaacgacgtccgcgagaggccgtacaccattattccagcggtcgttccgactgattgacattatttgtgaatatatcgtttgttattactgtctaacttccgctgccgcctgaaattaacaagcctactcaatgagtataataaccccatcaaaattcatcttgatgagatcacacgagccacgaaccccgaagcaactgggctccacgtccgtcatggtttcgattcgatgcatacgcctcgtcgtctcagatacgaccaggatatagatttgaatctttcctacgcggtcagaaacgaaaaatgtagcggaattcgctaatctcgaacggggaaattttattttttaaaacgaaatcagtatatttaggaggaaaattcgttttttttttttgcagatttcgtagaatttgaactgaaaaatgctgatttgggtgggggggggggggggactaaaaattcgaaacgattgaaatgtgtataatttacgttgcacaatgaataataatagtttcaagcaaaattcgttcactggattcacaaagatatatatatatatatatatata

SEQ ID NO: 18839 - DNA, 3542 bp, Zea mays
tggctcagtgggaaggcttctcaacactgagctaggcctatcccttctgcgccaatttttatatcacaagcattttattttgggcttcaatatcatagctggggaagcatataggacaatagcaatctgctctgtagctcaaggcctcaagtgtatagagaaaaccctttgcatacgcagattacgagaaattgaaatgttttttgtagatatatacatgtacatatgttactccttaattgcatagctctgatattctatttccatccattttttcttcttctcaacgagcagcagctgcggctcaagcagcagcacatgcagctggtgcacaggtgacagcttcgcagcctgggacagctcaagctaccacggtttcagcagcagcagccacagactcatatgcaggtgcatataccagctacccccctgcatatcagcagggagcccaggctggggcatatcagcagggtgctcaggctggggtatatcagcagggagcccaggctggggcatatcagcagggagcccaggctggggcatatcagcaggggggccaggatggggcatatcagcagggggctcaggctggggcatatcagcagggagcccaggctggggcatatcagcagggagcccaggctggggcatatcagcagggtgctcaggctggggcatatcagcagggagcccaggctggggcatatcagcagggggcccagtctggggcatatcagcagggggcccaggctggggcatatcagcagggagcccaggatggggcatatcagcagggagcccaggatggggcatatcagcagggtgctcaggctggagcatacaactatgcttatgatgctggcacggcttatgcatatgcaggttactctggctatccagttgcaggctacgcgcaaagtgcagtgcccaactattcctatgctgcacctccgcagccaacaagcagcggtgcagctacgaacgccgcaggaggccagtatggggcagttggtagtgctggatatcctactgggcaagttcagccgagcagtggcactgcaaatgcagcgcaagcacctcctcctccaccaccaccggcagcaccatatccccccagcacatatgaccaaaccagaggagcccagagataaaatctgggatgtaagccagatggatgtttgccatgcacatttgttgagcagacaaatatggtgaaatctgggatgtaaaaccaagatggctgttctgtgcctccatcccattgactagggcgtattttcaccaatattgtgcctccagtgcaatttcttttgtgttatatatcaccaccatttgttgagcaccgtagaaatgagttccagacggccgggacagcaaccccacatgtgtctttacatcaccaccatttatccacagcgcgtaatgtaatggcatcaacatcaatatatatggttcctggctgaccacatcatcaacatccatggaacactagcggctcgtcaataaatcgaacaaatatgcttttctttcttttttccagtcacttggaaaacaagcggacgtacaaaatgacgcctttaggaattaccggagatgctccaacatacaaactgcaaaaagaaagatccaaatacaaaaccagcctgcattgtcgcttgcgaggcccctgaacccaaattccaaaccggtgcaagctagtagagcacacggaaaagcctctggatgcagccacgagccgcccgcatagaaacaaacagaggagacgaagccaagccatcgccgtccaagacgacggccacaaataagaagcgtgagggccgaggccgatcgactcatcccatacgccccgaactaaataagaaacgtaacagcggggagccggccgagccgagctggcaaggataatcctgatcaagtactactactagcagtagtttacacgatgggggcaggcaataatgcgcgccaagtaaaccaaacaaccatttcatgttgccttggtcggcactttcagtttttcttttgatgaatagaatagcggttgacgggcggacagcgaagaccgcattgttcaagggcgttggatgcatgctaagctatgctccggatatgcgagactgattcccgcgaaattcttgcggttttttttttgcaagtgacaacgagggagacataacgctattttcttttcccttgatggacataattctattttcttctacaatatttcgtgtctatgaattgaagctgctgcagcagccggtgctagatttgggagggtatttatttattttttgtcaagaacatctctactcgtatagatcagaaatgatatagaaaacctctttgagctgctcttaaaaagaataaaatatggcatatggcctctaagtaatcccttccttggtgtcgccgatcgcgagagccaggacgagacggcgacatattcgacctcccccgcccggcatattacatcagccagaaatgcttctacgcttcggcatgaccagagccgtcatcatctgcttgcactagtaattagcttccgtgtttaaaaaaaacgatgttctatatcaatctgtctctgtattaatttgcctttaagtttttttttgcatggatggagtatattatttacacgcttagatggccaatgcatggtaatggtgttatcaaaatatcaatgtccttttgtgctgcatttcaagtccagcttgtaataactgctactagtatatttgtagcgacaataggctggtagatcaaccacatcttcctttctattgttgagagagagagagagagagagatagacgacggagcagcaaccaccgtcctgacggtttccaagccgatgcaccacgaaattccacttggatcagggcaatggctcgtctgccaagccaagtagccaacgctggatgcaggcatcgctgacgccaccggccgtttcgtttgaggaaagcccgggcacgcacgccatcttgtacgcgcgttgccactctgatatggatccaacagcactgcgagcgtgcggcgtgcctgtccatttctgatggaccgccacctctctttattttgacaggtaaacgacggcagtgacacggcatatgatggggggctgacacgcgccactacggccctacgggctcgtgtagtggttgcgaatatgacgtgccaatggtgtttacatataataactgcttgctaaaaaacatttagctctagttgactttataaagtggtttacagtggctataatagaccatattgatcaaataaagacgacggttgactgagtcgagcgaagacgccagagaacttaatgatctggtggtaacatacattgaaatcacaaacatgacgtatcagatacgttactcaccgttgagcatcatctgtggcactagacacggttagatagtctagccctgagactcgaacggtccggctcgcggggtccgtgcatagacgcggacggtccgcgcgtagacacggacggtccgcgcgaatagatcgaatcagacggctaaaatcctatc

SEQ ID NO: 18840 - DNA, 2643 bp, Zea mays
atacatgcattataccttttatcggggtgtaggtgtacatgtgtacactcatgtcctttattggacatgcctctgatttgatgtatccagattctacttatggattttcaggacacaatatctaggataatggctcaccgtggacacctagatggactgactgcccaagctccagcactgatgcgccatggttccttcgctgcaggcagcctttctagccactcacctttggagtcttcatctacactggagatgctggagaacaagcttgccatgcaaactgcagaagtggaaaagcttatcatggagaatcagcggttagcatcaagccatgtggtcttgaggcaggacattgttgatacagagaaagagatgcaaataatccgcactcacctaggtgaagttcagacagagactgatttgcatattagagatttattggagagaattagattaatggaggcagacatacatagtggtgatgcggtgaagaaggagcttcatcaagtgcatatggaggcaaagagacttattactgaaaggcagatgctgacccttgagacagaggatgtgactaaagaattacagaaactctctgcctctggtgacagtaaaagccttcctgaattgctagctgagctagatgggctaaggaaagagcatcttaatttacgatctcaatttgaatttgagaaaaatacaaacatcaagcaagttgagcagatgcggacaatggaaatgaacttgatgaccatgactaaacaagctgagaagttacgaggtgatgtggcaaatgctgaaagacgggcacaggcagctgtggctaaagcaacagggcatgcagctggtgcacaggtgacagcttcacagcctgggacagctcaagctacagcggttccagcagcagctacagacccatatgcaggtgcatatgccagttacccccctgcatatcagcagggagcccaggctggggcatatcagcagggagcccaggctgggacgtaccagcagggagcgggaacccaggctggggggtaccagcagggagcccaggctggggcgtaccagcagggagcgggagcccaggctggggcgtaccagcagggagcccaggctggggcgtaccaacagggagcccaaactggggcataccagcagggagcccaagctgggacatatcagcaaggaaaccaggctgggacatatcagcaaggaaaccaggctggagcatatccctatgcttatgatgctgccacggcttacacatatgcaggttattctggctatccagttgcaggctatgcgcaaagtgcagtgcccaattattcctatgctgcacctccacagccaataagcagtggtgcagctacggacgccgcaagcctgtatggtgccgttggtagcgccggatatcctactgcgcaagttcagccgagcagtggccctgcaaatgcagcgccaccacctccaccaccaccggcagcaccatatccaagcacttatgaccaaaccagaggagcccagaggtgaaatctgggatgtaaaccagatggctgtttgccatgcacatttgttgagcagacaaatatatagactctgtcatgccccatttgtagactgattactggttcagttatgtagatccagttacgggtagattaatttacatcacgacggaagagttgatgtatgcttaactgtgttggtatttgggttgatcggagcagtgcggcattaaaccaaaaaaaaaaaaaaaacgttgttctctattcttttataccatttattttcaagtatagtgtaggactgtaggtcatggtttgtgcatatgctgatgtagtcaggtctggctcaatggcttcctagagaattgttttgtgtcacgaggcaatgatgtaggcctcttcaaacattagcccctcagtttctaaaagatctgttagacgctggcttgttagtaaacacatcaaaaccctacacgcaaagatgcagcaagcacgagctgggtatagctgcaggcttctagggtgagcgtggtctccattagatgtgctgtaactattgttggatctggttgcatgacttgcatctctgtttttgccatatcataacttgtagcctagaatggaatgggtgctacatgtgtaattttatgttatcttcagttgcttctgtttcccgcttgtaacatttatagacctactctaatcctgagttaggtgaatattatatagagtgttaggtggggctaaagtccattacggtctagtttggatactctagtattgaccttaatccacatatattgatgtagattgtgtattgatgtggattgaggtgtaatttaagctaattaacactctaatccaactcaacacatatgaattgagatcaatactaaagtattcaaataaagactacatggggaaacaggaaactgagggaaacccctaaccctatacagcactctaacagtagccaaccttagagtttaaatgtgaatgtcatgttccatattgaatggaagaaattaggtgtcaatgtgctgggtagggtgctgcaaagtgcgctctattttttagtggaatcaatggactagccatctcggtacaatgcagcaatcggtgttgaacacacaga

SEQ ID NO: 18841 - DNA, 2503 bp, Zea mays
gagctttgtgttaatgtgtatgtgtcatgtttttccctttccattggaagatctcaatttgaatttgagaaaaatacaaacatcaagcaagttgagcagatgcggacaatggaaatgaacttgatgaccatgactaaacaagctgagaagttacgaggtgatgtggcaaatgctgaaagacgggcacagggtaaatattctcttccttttgatgttggcctgcaaattatcctcattcctgttattgttaggttttgagctgaaccttactgggctgtacacctagataggagcagtattatttttattccatctgttttgtgtttagtttgtgaagactgctagtttttttgtcctagtagtgtgaatctcaaaactgctcgctcataggcttcccatttgaatcatgatttccctattttcaacagaatttgcgatgtgatgttatcatttgtaggtcttgccgtcttagtaggggcggagggtagtggaggtgaatctgggtctccgcatacatggcctatagatcctcaataggctgaactgtaggcctaatgtctcaccatggattactgttggaatgaacacccgccctcctactattggcccaatacatgccatcactgcatcttcggttaacgacatgtggattgaatgtatttggataaagcgtggtgcaaagataaaacttttgcccagtgtgtgctgcagagcactgctttttgtgtgtgtgtgtgtggggggggcgtctaatgtaataatgcaatatagttgcagttgcatgcagattgcttttgaaatgtctagttggatatccagcttggcattttttaagaagagtgaatataggaacaaactgagtctgttgttcaccagtctacattctgtgttagtagctcagtacaatgtgtagtaaccactgccattgtatgactggttctcattatagttcaattttgtgacacggcataaagtacatagccatattttcctctggaaatgaataattgtgttgtttacagtgtagaaaggcaggcataagttacgtatcaatcatttgaaattgtccatgattttattgcgctttagtgcatactaatctatcgttagcgatgcggcatcaaaagtgattggcctaaactaagcttcaacttatctagcaaatttgctgcacctgatctttgtggtgcagcttaactggaagtgagtgttaggttttctttttcagattcacctgaggagatatgttccctaagctttgccaaatttcatataacaagcattttattttgggcttcaatatcatagctggaagcatatatgacaataggaaactggtctgtagctcaaggcctctaatgtacagaaagaaaacatttgcatatgcaatttacgagaaattgaaatgataattttatgcgcatgaaatttcttgagatatacatgtacatattttactcattaattgcataagaccatactctgatattttatttccaccctttttttctcaatgagcagcagctgtggctaaagcaacagggcatgcagctggtgcacaggtgacagccccacgcccccggacagctcaagctacagcggttccagcagcagctacagacccatatgcaggtgcatatgccagttacccccctgcatatcagcagggagcccaggctggggcatatcagcagggagcccaggctgggacgtaccagcagggagcgggaacccaggctggggggtaccagcaaggagcccaggctggggcgtaccagcagggagcgggagcccaggctggggcgtaccagcagggagcccaggctggggcgtaccaacagggagcccaagctggggcgtaccaacagggagcccaagctgggacatatcagcaaggaaaccaggctggagcatatccctatgcttatgatgctgccacggcttacacatatgcaggttattctggctatccagttgcaggctatgcgcaaagtgcagtgcccaattattcctatgctgcacctccacagccaataagcagtggtgcagctacagacgccgcaagcctgtatggtgccgttggtagcgccggatatcctactgcgcaagttcagccgagcagtggccctgcaaatgcagcgccaccacctccaccaccaccggcagcaccatatccaagcacatatgaccaaaccagaggagcccagaggtgaaatctgggatgtaaaccagatggctgtttgccatgcacatttgttgagcagacaaatatagactctgtcatgccccatttgtagactgattactggttcagttatgtagatccagttacgggtagattaatttacatcacgacggaagagttgatgtatgcgtaactgtgttggtacttgggttgatcggagcaatgcggcattaaaccacaaaatagtgtagtgtcgttgttctctattcttttataccatttattttcaagtgagtacttctaaaaaaaaaaaaaaaa

SEQ ID NO: 18842 - DNA, 1609 bp, Zea mays
  misc_feature (1346)..(1346): n is a, c, g, or t
  misc_feature (1350)..(1350): n is a, c, g, or t
  misc_feature (1365)..(1365): n is a, c, g, or t
  misc_feature (1384)..(1384): n is a, c, g, or t
  misc_feature (1400)..(1400): n is a, c, g, or t
  misc_feature (1421)..(1421): n is a, c, g, or t
  misc_feature (1433)..(1433): n is a, c, g, or t
  misc_feature (1436)..(1436): n is a, c, g, or t
  misc_feature (1438)..(1438): n is a, c, g, or t
  misc_feature (1440)..(1440): n is a, c, g, or t
  misc_feature (1575)..(1575): n is a, c, g, or t
  misc_feature (1586)..(1587): n is a, c, g, or t
  misc_feature (1608)..(1609): n is a, c, g, or t
aattcggcgcgtgccgcgaggccggccgctgccttttggtgttttttcttctcccgttcaagtcgcgtgctgctttcttctctcgttcacctcgcgtgcgcgaaccaactagggcgaccgctgccgccctacggcctacgcccagctgctcaggtcttattcgggcctttggcggcgagaaccgaccgcgccaggataatggctcaccgtggacacctagatggactgactgcccaagctccagcactgatgcgccatggttccttcgctgcaggcagcctttctagccactcacctttggagtcttcatctacactggagatgctggagaacaagcttgccatgcaaactgcagaagtggaaaagcttatcatggagaatcagcggttagcatcaagccatgtggtcttgaggcaggacattgttgatacagagaaagagatgcaaataatccgcacccacctaggtgaagttcagacagagactgatttgcatattagagatttattggagagaattagattaatggaggcagacatacatagtggtgatgcggtgaagaaggagcttcatcaagtgcatatggaggcaaagagacttattactgaaaggcagatgctgacccttgagacagaggatgtgactaaagaattacagaaactctctgcctctggtgacagtaaaagccttcctgaattgctagctgagctagatgggctaaggaaagagcatcttaatttacgatctcaatttgaatttgagaaaaatacaaacatcaagcaagttgagcagatgcggacaatggaaatgaacttgatgaccatgactaaacaagctgagaagttacgaggtgatgtggcaaatgctgaaagacgggcacaggcagctgtggctaaagcaacagggcatgcagctggtgcacaggtgacagcttcacagcctgggacagctcaagctacagcggttccagcagcagctacagatccatatgcaggtgcatatgccagttacccccctgcatatcagcagggagcccaggctggggcgtaccaacagggagcccaggctgggacgtaccagcagggagcgggaacccaggctggggcgtaccagcagggagcccagtctggggcgtaccagcagggagcccaggctggggcgtaccaacagggagcccaaactggggcataccaacagggaacccaagctgggacatatcagcagggaacccaagctgggacatatcagcaaggaaaccaggctgggacatatcagcaaggaaaccaggctggagcatatccctatgcttatgatgctgccacggcttacacatatgcaggttattntggntatccagttgcaggntatgcgcaaagtgcagtgnccaattattcctatgntgcacctccacagccaataancagtggtgcagntangnangccgcaagcctgtatggtgccgttggtagcgccggatatcctactgcgcaagttcagccgagcagtggccctgcaaatgcagcgccaccacctccaccaccaccggcagcaccatatccaagcacatatgaccanaccagaggagnncagaggtgaaatctgggatgnn

SEQ ID NO: 18843 - DNA, 1504 bp, Zea mays
agcataccgtctgtacttccagcagcagcatcatcagccgccgccgccgccgccgcgcttccactttgtcttgagccctgccctcaacgacgactcgcgggccggcagcacagcacgtatagctatggaaggaaacggtggcgcgggcggcggtagcggaagcgcggcaccgccctgggatctcgccatgcactggccacccgccgtgtcgtcctacccgccgcagcccttggagctgcagcagcagggagcttacctgcctcaagctggggaagcggcccgcctgctgctgggcaggggcgccggggccgggcaaccaagcggcgcaggtccacggcaatggcggcgctggtggcgcagctgctgagggtaagaggaaggagaaggcgcctgccgcggcggccgtgccgaggtgccaggtggaggggtgccacctgtcgctggcggacgccaaggagtaccaccggcggcacaaggtgtgcgaggcgcactccaaggcgcctcgggtcgtcgtcctcggcgccgagcagcgcttctgccagcagtgcagccggttccacgcgatctcggagttcgacgacgcgaagcggagctgccggcggcgtctggccgggcacaacgagcggcggcggaagagcaacgccagcgaggccatggccagaggcgttgcgcacccacacggggtgacggctttcggcccacggcggcttcctgccctcgcgcggcctccccgcgccgcccgcagggtccccggcggcggctggtgctctctctcttctgtcatcggccagaggcagcgtggcgggcgccagcgggccctggctggtcacggcggcgcgggaggacatccccgcgcgctccagcgcggcgctcgacgaccttatcgccgagaaccgcgccgccgcgctcctcgcgcggcagtacttcgtctccgaccgctcgccggcgcccagacgggatttcgtcgcctcttcgacggcgggttgcgccctccagcagcagcagcacccgcccgatcacacagccggctggcacccgcacccccacccctacagtggcgttggcgttggcgttggcagcggtggtggccggtaccagtaccaccacgtggcgccgccgagcgcgtggcacacgacgaccctggatcttatgcagccgacagcaagcaccgccgccgctccctccaccgccggcgcagcgttgtggccagcagtgtcgccggagagggcgggcgcgaggtcgtctcgctctcgcagcaagaccaaggatggcgacgcgtcgggatgtagcggcttggacgcgtgggcgcccactggtggagctcgtgtgctgtgatcgccatgcaatcgacgagcgtgacggccattatatatgttgcgcctgtactggtcgggtgttgcgtggtgcctgatctgtcccaaaagggatgtgtaatccaatgtacttcgggatgtgcttttttttttagtaatgaatcgtgtttttctcaaaaaaaaaaaaaaaa

SEQ ID NO: 18844 - DNA, 796 bp, Zea mays
gcccgcggtcattccaggtgtgtctagtctctagtctagctaggcactactctagctcccaagtggccaagtatactcgccagagtacgtagagtgtagttgagcgtcgtccaaggatggcgtggacctcccgccgcatggtcgcgtccgcgctcgtcttcctgctgatgctgctcgccgcctcagagatggggacgacgagggtggcggaggcgaggcactgcacgtcgcagagccaccggttcgtcggcgcctgcatgagcaagagcaactgcgagaacgtctgcaggacggagggcttcccgtggggcgagtgcaggtggcacggcatagagcgcaagtgccactgcaagcggatctgctagtaattaactagccggctggccagcgcatgcatgcacgacgaccgacctacctgctgctggtccgtttgcgtttgtttcttgtcctttgggccttgctgtggcgcgcagtcttgcgtacgtgcgtgtgcgtgtgtcttttcagttactctcaattagtcatagcagacgtgcgtgggtgcgagcgtgtgtctcgttgcattgatgaaccggcttcacgtgctgtggttttacagtttctgatgtgttttagctaatctcgaataataaataataaggccccgtcttcacgcagttgcgtactgggtgcttacgtacaggccggttgttactttcgtcacgcagttgagtggatgtattagtcaaaaaggccggaatactggttggttgattgtggaatgcaataacccttcgaaaacaaaaaaaaaaaaaaa

SEQ ID NO: 18845 - DNA, 4172 bp, Zea mays
  misc_feature (90)..(90): n is a, c, g, or t
  misc_feature (153)..(153): n is a, c, g, or t
  misc_feature (256)..(256): n is a, c, g, or t
tccccgtgttggagagaacttccccgggtgattggacgggtcaagagagagcttttccgaagctgggtgtccacgtagaattcgtccacnggaaaaaaggtcgagtcaccaagaattggctttcctagactagtctctaaggccttgtttggnagaagggtaatgtagagaattgagggggctaaaattccttattattcaaaattctcgaggagattttagcctccctcccttacccttgatgccaaacaaggcntgaggtttatttggttcgtggattttcaaacaagctccctactagccattaactatggtccgggatattgaaaatcggacgcatggagggacgcctgtgctaggtaaatttgctcaggcaaacaataagcaaaatctttgtgtggattttctttaacatgaatgttcaattagcagtatttcactccttcccatttaaatatatacataaaaaccccataaaaacttgtgagatttcttccatgctgagaattcgcagcagcggcatcattgcgaaatagccaggagcatcccttgagcagttgagctggtggttctacttctaggagcataggttggctcagctgcctcgaaaaccgaaaaggagtaaaaaaaatacaactccattctcgcttgtaagttcgaaacacatttttctaaaaactataggcactgagtgtgttcacatatttctaatgcatttttgcccgtaacaacattgtgcctactactacagtgtacagtactaccctccagaaaaggtttattcagcatcgttatttaggatattctgctctcaaacaatattttgacacacctccgcgtattgcacgggattgcccacggtgcctcggaatttccatccgcatatgtaagcatccactctgacacacctgccgggtttgttgtttctgcgccatgcggaaactgcacactccatctgcgtcagcgtcagctctctataaagttcctggccatgacgttacaagcaggcgtcgtctcttgccattgtctccttcgtcgcgccaaatgggcgcctgcttatataaggccgtcgcgagctgagcactggtggattcctccctcccctcgtgccaaccccagcctcagctcaagcttgcaagttgcgacttgcgagtgcgaggcggcggcaatggcgctggaaaagctgcaggtgctgcacgcgctggacgtcgcggacacgcagcgataccacgtccgcgcggtggtcatcgccggcatgggcttcttcgccgacgcgtacgacctcttctgcatcaccctggtgaccaagctcctaggccgcatctactaccacgtcccggggcgggaggagcccgggaggctgccgcccaggctggaggccgccatcaacggcgtcaccttttgcggcatgatcgtggggcagctcctcttcggctggctcggcgacaaggtcggccggaagaagttctacggcaagaccatcatgctcatgatcatgggctccttcctctcgggcctctccttcggcaacagcgccgacggcgtcatggccacgctctgcttcttccgcttctggctcggcgtcggcatcggcggcgactacccgctctccgccaccatcatgtccgagtacgccaacaagcgcaccaggggcagcttcgtcgccgccgtcttcgccatggaaggcttcggcgtcctcgccggctgcattgtcaccctcgtcgtctcggccaccttccaggcgcgcttcagcgcgcccgcctacgaggaggaccccgccgcgtccaccccgccgcaggccgactacgcgtggcggatcgtcctcatggtcggcgccatcccggcctgcttcacctaccactggcggatgcggatgccggagacagcgcgctacacggcgctggtcgcgcgcgacgccgacaaggccgcgcgcgacatgtccagggtgctgcaggtggacatcacgggcgagccggacaaggtggagaacatcacccgggacaggggcgactacggcgccttctcccgccgcttcgcccgccgccatggcgcgcacctcgccggcgccgtcgcctgctggttcgtgctcgacgtcgtcttctactcccagaatatcctccaggaggggatcttcagcgacgtcaactgggtccccagggcgcgcaccatgagcgccctcgaggagacctaccgcgtcggccgcgcgcacgccatcatcgcgctctgcggcacgctgccgggctactggttcaccatcgccttcgtcgacgtcgtcggccgcaaggcgatccagttcctgggcttcgccatgatgatgggcttcatgctcctcatcgccgccttctacgacagcctcatcagccccgggcggcggatctggctggtgctcatgtacaccttcacattcttcttcgccaacttcgggcccaacagcaccaccttcatcctgccggcggagatcttcccggcgcacctgcgcaccacgtgccacgggatatcggccgccgcggggaaggtcggcgcgatcgtcgggacgttcgggttcatgtatgcggcgcagaaggccgacggcagcgaggcggccgagacagggtacccgtcgggcatcggcgtgcgcgcctccctgttcgtgctcgccgcgtccaatgcgctggggatactcttcacctgcttcctgccggagcccaaggggcggtcgctggaggaggtgtgcggcgaaggcgccgagcccacgatcagagatgacactgacgtcggtgactccaagattctcccgctgtagatgtccatcttcatcttcgttaccggcgctcatggctgacgggtcactggatttaatttgtgctcatgaatttggaagaaatctaaaacaacaacctgtctccgacacgtttttttctaaaaaaaaaaaaaaaaagcgcagtgcattataattctttctaggccatttcttccggacgcattcgaattaaggataatagatatggacatatatataaaccatattcataagttgattaataaatgtagatttagtctaaaataaactatattttgaaacgaatggagtacttaataaattagactaattagtttagaatttgacattccatctcttttcaaatttcatatataagtctatcacaaattcagagtggtgatgaaaattgattttatgtatctccatgctatatttctactttgtaatttataacatactcttcggcttgctcccctataggagaaatacaatacataaatgtctccgtcatatggccaacagtgctacacaaaatatattttgcttaaaatcatattagcttaattgatctttgtctaaattacgattattgtaacgaaattcaattataaggatccaagaaataagatttaaatagccatgaatcttgcatagagagtaagtggatagcaaaccgccaattcttaggataaaaattatcatgccaacatttgtctttccgtgggtttataactccctaccactagcttatttatacttatttaaatttgagctagtgattagtgttgttcttgtaactaatttacttatatagcaaagtagttgttttgatgtgctagtaagctaagcttgagtagcttagcaggtttgcttaatttatatagttaagatgtttaccactttagtttagcttacacagttttgccggtcgagtagtgccagtgtgctgtgtgcttagactttgtgtgttttgttcactagtatatgtaaaagctctaaatttgattaagtactagttgcctagagaattgtttagatgagtttagacctgagtatggaccaaccgacccaaccaatacaacgggcgtatatagaccataatttttaacctgtaacaatccacaaggcggacatgggccatgatttttttacccaaaatccaaccaacctggcccaacatgcccaacagagaagcacgggtcaacctgacctgacactaggtatgagtcggatacgggttgtgccaaacaacccatgatccgaccttgagttgacctaaacccgacctgatgatcaatgtttgaacagatctaaatgagctctacctggctcgacaccttagatatttagccaagatctttataaggtgctagtaaacaatagaaggaatataatattggctagaccaatt

SEQ ID NO: 18846 - DNA, 2412 bp, Zea mays
  misc_feature (2313)..(2313): n is a, c, g, or t
ggatgaactaataagtgatgaactgtgttaatttgttgttaaattgatgtggtttatgatattgtgagtataattgctcttttctaatgttaaactagtgtagaattaactagtaattaattatattgttgtatatatatttgtatattatctttagttctggctcgcgagctaaacgagctagctcgagctcgcaaacgagccgagctggttctctggctcggttccttaacgagtcgagccagctcgagcttgaccgagccgagtcgagtcgagctggctcgatatccagccctactccagtgcccttctacaatggctcttccctaggctctctgcttgatctccctccatacttggtcacttggacttgccaaagacaagtctagtgcatgtccacgcagggtacatgctattacagaacaaattttggactcgcaagtccatataacactgatccaaataacatttgtgtggttggctgaatttggttttaggaaatctgttttttttataaagctcagtatccatttttaaaacgttttctttttaaatgtactccctgacacaatcttgctcttgtataggttgaagctgagaaaaagcaaaaagaagagaagaaagcgaagaaaaagcacaagaagcatcaccaccataagtcaaagagtaagaggcatcactcagatgagaattctgattcagatgaaataagtgatggcaaagatgagagaaggaagaggtctcattcttctcttcataagaaagaagagaacatgtccaggcataagaagcagcacagagaagattcatcagattcagacgatgaaccgcagagaagaaagcaggatgtatcagaaaatgatgaaccgaggagaagactacatgacgacaatgaaccgaggagaagatggcaggatgacgttgaaccgaggagaagactacatgacgacgatgaacccagaagatggcaggatgacgttgaaccgaggagaagaagacaggatgatggtgaatcaaggagaagatggcaggacgacgatgaactaaggggaagacggcaggttgatgagaaaccaagggaaagaagctacgttaatcgtccaagatatgaccgctctgacgctgatgataggaggagacaccattcacctcgagacactaagcccaaaagagtggatgatggccacaaaactggaaattccacttctgaacaccattcccgctctgaacaaggctctggcgagcagacaaggcaagagagcgaacatgacaggaatagtggtccttcattgaaccgacgacgcggtggtgtccaccatatgtcagaagaggagaggttagctcgtctgcaccagatgcaggctgacgctgaggtccacgaggagcagagatggaagaggctcaagaaagctgcagacgacgatgctaaagaggcaacaactgtgaatgcaaaccagttcaaagggaagaacttcttggaagatgaaaagaagagcatatttggaacagataagggtggcagtgccacgattgaagagagcatcaggcgccgcgctttctactcgcagggtgggcgtgatgccgagggcaatgccttcaggcggtgaatatattgttttgttgtttgctgccttgttggactcatcttgccgtcgtgttcgttttattattgtacgtgaaagttgagaactatgtacaacaatttctcaataacagcaattttatatgcaacttcaaatttttgatacggaatttggcctaaactgcaccgaagagtgattgcctcggatttgatcttgctgacgtttcttctgggttggtaatgcaaaaaccttgcttattagactgtctccagccgcgccccctaaattctatcctctaaaggacagagaatattcctttagaggatagaatttagggggacgttgctggagacagccttataggcaaggttcaagcgctgcatgcatagtggtggtgggtcccgccaccgcagccgccggtgcaggtgatggctaagactaactgcaacactaccgtctgggcagcccctcctcttgcatggcgcctgtaggggtactttaccgctgcagcgctgccccctacagcgctccttacgcgccggcccctttctcggctaactgcaacgctgccccctgggtagctctctccccttgcatggcgcctgtagggggcactctacggccgcagcgctgccccctacagcgccccttacgcgccggcccctttctctctctctagatatagcgtgtcattgtttatcccccaaacactgtgttgtgggtccatgantaattgttagtagataaaaaattgatagttgatatagaaaaatgatattttatagttgtagtgggatataatgggagtattttgggggaaccgctgcaa

SEQ ID NO: 18847 - DNA, 2121 bp, Zea mays
ggggcctcgatctgaccttctcttcaatcgcatccgcccgcgtcgtctcgtcacccccgttgtggtcgcctgggaagaggagggaggccagcttgccgctagggttagggtttcgggcgggagggacagaggcggggctgcagccatggcgctcaagttcctgaacaagaagggatggcacacggggtccctccgcaacatcgagcgggtatggaaggcggagcaggcggaggaggcggagcgccgcaagacggaggagctcaagaagcaggtcgcggccgagagggagaaggccgagttccgggccatgcaggagcgcgccggcctcaggccggcgcaggagaggctcgacttcctctacgagtcggggttggccgtcggcaagagctccgaagggttccaggcgctgcagcaatctgcaccgggggcagctgccgcgtccacttctgcacaggcgagtgcggctgattcttccaaggcagctacaccgggagctttatttgaggataaaccccaatctgcaaatgatacatggagaaaactccactctgatcctctactcctaataaggcagcgggagcaggatgcgatttcaaggattaaaaacaatccaatcaagatggccgagataaagaaatctgttgaagctgagaaaaagcaaaaagaagagaagaaagcgaagaaaaagcacaagaagcatcaccaccataagtcaaagagtaagaggcatcactcagatgagaattctgattcagatgaaataagtgatggcaaagatgagagaaggaagaggtctcattcttctcttcataagaaagaagagaacatgtccaggcataagaagcagcacagagaagattcatcagattcagacgatgaaccgcagagaagaaagcaggatgtatcagaaaatgatgaaccgaggagaagactacatgacgacaatgaaccgaggagaagatggcaggatgacgttgaaccgaggagaagactacatgacgacgatgaacccagaagatggcaggatgacgttgaaccgaggagaagaagacaggatgatggtgaatcaaggagaagatggcaggacgacgatgaactaaggggaagacggcaggttgatgagaaaccaagggaaagaagctacgttaatcgtccaagatatgaccgctctgacgctgatgataggaggagacaccattcacctcgagacactaagcccaaaagagtggatgatggccacaaaactggaaattccacttctgaacaccattcccgctctgaacaaggctctggcgagcagacaaggcaagagagcgaacatgacaggaatagtggtccttcattgaaccgacgacgcggtggtgtccaccatatgtcagaagaggagaggttagctcgtctgcaccagatgcaggctgacgctgaggtccacgaggagcagagatggaagaggctcaagaaagctgcagacgacgatgctaaagaggcaacaactgtgaatgcaaaccagttcaaagggaagaacttcttggaagatgaaaagaagagcatatttggaacagataagggtggcagtgccacgattgaagagagcatcaggcgccgcgctttctactcgcagggtgggcgtgatgccgagggcaatgccttcaggcggtgaatatattgttttgttgtttgctgccttgttggactcatcttgccgtcgtgttcgttttattattgtacgtgaaagttgagaactatgtacaacaatttctcaataacagcaattttatatgcaacttcaaatttttgatacagaatttggcctaaactgcaccgaagagtgattgcctcggatttgatcttgctgacgtttcttctgggttggtaatgcaaaaaccttgcttattagactgtctccagccgcgtcccctaaaggaatattctctgtcctttacagaacactctaaaagattctgtcctctatatattctccgtctccagcagcgtcctctaaattccgtcctctaaagctacagtgttaacagattcacattttccatttctttttcatttttctttgttttgttcgcatttcacgctgcataaatgatacgtaaaaattgtattcattat

SEQ ID NO: 18848 - DNA, 1642 bp, Zea mays
ttgagctattgcctattggaactactacaaaaacaggcgtttccgtagccgatgtgcaggtgacacggagtaggtacaggtgtccgttgtagccgatccctgaacatggagttcatcaggatcgttacctcttgtctaatctgctggactcaaacatggtacttacgtacggatacgatgctgcgaccgccaaggtgggtgcaatctttcccgtacgcatgaatgcacgagagagagagagagagagagagagagagagagtacagcacagccaagcagcagggtccggagagcttcaagaatcatggttgcattttggttccagctggtgtttgaacgcgctgtagtgtagactgtagagtgtgttttgtcacgtacgaagcccaaggactgaaaccataaaaacaaatctgccagaagctgacgttttggagctagctagcgttttcatcggtgaaaaatcagggaagacagacgttgctaattaagctaattaaacaacccttgtggccggggagtctgacacctccaaactaattgcaatcatgcacgcaacaggccctaaatctactgcattatttgccatgacgccatgaactggcccttcgagtcgatcggccacgcttcatgtcacgactcatgcctgctgcatcgatccgtgcacggattgtctccggctcctgctagctctgcagtcgtttacccttccgaaatactattgtatgcacgtacgtacgcgctacaagttgaactgtgcaattctatatgtgcaatgattgtgtactaacaaactataaagagcctctctggtgaacataatcttatatacaaacaaacagcttgatcatgaccctttctagtttcactgaacatcttctcctctatatatatattcatctaacatctctcaccaaaaaattcttgagtcttgactacacactaagcttgatttcacattctgctctagctttgcgacgtgcgtgcccgagtgctgtttttgacgtgcccatgcttgagaagaagctcacggtcacgggcacgggcacggccatggccatggccacggagaaaggaaggaagccggggctcatcacgaagacgctgggccggtgccgcggcgcgcggcggaggagcaggccgccggcgccggaggggtgcttcgcggtgcgcgtcggcgcggggcggcagcgcttcgtggtccggacggagtgcgtgaaccacccgctgttccgggcgctgctggaggaggccgaggaggcgttcgggtacgcggccgccggcccgctcgtgctgccctgcgacgccgacgccttcgtgcgggtgctggagcagatccaggaggaggaggaggacgctgctggccaggcggcggcggccgtggcgaggtgcggcctctggcgggggcctctccgcgtaccgactgctgctcgtccccgcccgcccgctcctcgtcgtccggtcatagtctgtagtcctcggctccggccggccagcctgggagtcgtaggtgacgacgacgatgcttcacctcatgattgcgccgagagcgagatggatatgtgtactgaatactgatatgagtagtgtgaaaaccgtgtagtatgtttgtagatgccagccgccataggtgggtggtgcctgc

SEQ ID NO: 18849 - DNA, 1749 bp, Zea mays
acgtccccttgtctgtgttcgacacggtcacgtaccagatgcagatggccatcatctacgctttcccgccgccggcgccgtccacggctgccatcgagaaaggccttgcagcggtgctggccgagtaccgcaccttcgcggggcagatccgcgtgccccgtgacggcggcacgcccgcggtgctgctgaacgaccacggcgcacgcatcgtggaggctaccgtggacgccaacttcgtggacttggcgcccgccaagcccaccccggagctgcttctgctgcacccggatctggagcaggagctccaagagatggtggtcctgcagctgacccggttccgttgcggctccctcgccgtcgggttcacgtccaaccacgccgcggccgacggccacgccaccagcaactttctcgtggcgtggggacgcgccaccaggggcctcccaacggggctgcctccccccatgcacaaccaggtggggctcttggagccgcgctcaccgcgccgcgtccactatgaccaccgcagcagggagtactgccacctgccgccgccgtcgcccgccgagaagagcgtggtggcggcggacgagaacatggtcgtgatccacaaggcgcacttcaccaaggagttcatcgcggggctccgcgccaaggcgtcggaaggccgcggccggccgttcagccggttcgagaccatcctggcccacctgtggatcaccctgacgcgcgcccgcgggctgaaccacgacgagacctcgcagatccggctgtccgtcgacgggcgctaccgcctgggcctgcccgcagagtactgtggcaacctggtcctctgggcgttcccgaccgcgacggtgggcgacctgctggggcggccgctgaagcacgcggcgcaggtgatccacgacgaggtggcccgcgtggacggcaactacttccggtcgttcatcgacttcgccacgtcgggcgccgtggagagggaagggctggcgcccagcgccgtctgcaagagcgtgctctgcccaaacatatcggtggacagctggctgacgttcccgttctgcgagctggacttcggcacgggcagcccgacctacttcatgccgtcctactaccccagcgaggggacgctctacctggtgccgtcctacaccggcgacgacagcgtcgatgccttcgtgcccgtcttcaagaacaacctcgacgcgtttaaggagtccttttacgccatgcactaggatagatatgatgggcggaggcttatcttaagtctaattattatatattttaagttaatgtcatgtagacgtcgtcattggtagaatggggaggggaatgcatgcgacagatgaaaattactgtgtagttactttatatatgtgtattgttcgtagtagttattttatgtatattaactgccgcggccggtgtgtatatatttcatgtaaacctccgtttttataagcgcaatgtctgcaccactgcgtcgtcataccatacaaaaaaaaaaaaaaaagtatatataataggcctttgacatgtgggcgatcatctattttgttaataagatcccgtcgtctataatgttactccaatattattatgcaaagcgcaggatgatatatagctaggtggacccggacaatacttacctaccacacacggtgtgatgcatccaagtggcgcaacttatataaaatacgctaggatcgacccaagaaaagtcgtcgtagctctccgatccagggg

SEQ ID NO: 18850 - DNA, 1009 bp, Zea mays
ctatgaaagtctgaaaatagctagtggattgagcggagcgtgcctctgcggtccgataggcgggttcgcatccggccatccgatactctgccagtgcggccgcgcggcggcggagcaaccacgcgcgcagaccgccgtcgccacctcctccctccctccgctccccggcgtgcgtccgatccaccaggaatcgaaggctcccacacgcccccacgcgatgctgcgcaacttcccgcaggcccggaggctcctcaggcggatggggttcgagaaggaggacgcctacttctggaagcagatgggcaaggccatgctctgcacgtacacgctcttcggcgtcgtctggctctggaacgagacgtcgccgctcgggtggtggacgctcaagccgcgccccaaggaagaaagagagatggcacacctctacgagcgcaggaagttcccgtaccctggcgatgatgaggcggtcgaggagtttgtaaagagcggaggtgctcttggaaccacaattggacccaggggattcgctgacgccaatatggattctgaaaacatgcagaagcagctgcagtctaagaagttcgagcaggaagcacagaaactgtggattcggatgaggaatgaggtcgtacaggagctccaggagaaggggtttgatatcgagtgaatttgaaacctgcagtatggtcggcgctgaggatgttaaaacttaaaaccacttgccatctaaattggagaactgtataacttaggaataaaagagtttgtagctatctttttaactaactatctggtgctgcattcttggtgctgctagattgtaccgaaaataaattttgatgtcttgtggagaaccgaggatctcatttgaatatttgatccctcttttaatgtttcttattgcctgatcaccaaattactcatgttttgatgttggtgcatgcaacctatatgtgcagcattgaggatgcgttggtacttggcatatatgctagtccatgattatttc

SEQ ID NO: 18851 - DNA, 3301 bp, Zea mays
cactgagtcattataggtatataacttgattctaacatacatataagatgtatctatatttgtcctggaatctaagtgtgacataagaacatctcaattttaacatttgttttttaaaatgtagacttaaaatttgatatataaagaaagtaaataaggaaatacatctataaatatttttaaaacatttcttattgtaaataatttgattatatgacgattgtagggaaagatgaattgtaccaccgttttttccttctctatgaaagtctgaaaatagctagtgcggagcgtgcctctgcggtccgagaggcgggttcgcatccggccatccgatactctgccagtgcggccgcgcggcggcggagcaaccacgcgcgcagaccgccgtcgccacctcctccctccctccgctccccggcgtgcgtccgatccaccaggaatcgaaggctcccacacgcccccacgcgatgctgcgcaacttcccgcaggcccggaggctcctcaggtgcggcgcgcgccctccatccatcgccggcggcggttcctcggcctgcccaccttctctgctcgcccttgccgacggtatctgatattctgatcctgcgcccgtgcgggcgggtggttgggcgcaggcggatggggttcgagaaggaggacgcctacttctggaagcagatgggcaaggccatgctcttgcacgtacacgctcttcggcgtcgtctggctctggaacgagacgtcgccgctcgggtggtggacgctgaagccgcgccccaaggtttctcaacttcctcctcccgtctcgtcttctctcgtcgttcattgggctgccctgtaatacaatactgcggaaagtccctattttgttgcaagtgattagatgcagtttgtgcccctgtgacctgcaccattgcagtcctctttgtttgttcaaattagattttaaactccacacctcatggaatttgagtatttcagggctttcatgattgaaaatgtaccccaaattagcttataccccgaatcgtatggccctcttctgactggtgaagaagaagtaattggaggtgctggaactcgcaacgcgtttccttgccccatttctcttatttgtcggtaactactaatttctattgtgctgacaaggaggcatatcaagcattgacaataattcctctgttgcgaaatttttttggatggaggctatgcttgaaaacatgttggcatgttgcctttatacagtgacaacattgacttcgctgttaagttttcttagctttcaaaatgcatagaaagaatctctcattttcttttgatcagaagaatctctcattttccatttctctatctcaggtgcatcacatcatcttagccttggatgtcatagatgattagtgtgaatggttgcccatctgctagtttctgggttccctaagacaacatatgctcaacatctcgcaggaagaaagagagatggcacacctctatgagcgcaggaagttcccgtaccctggcgatgatgaggcggtcgaggagtttgtaaagagcggaggtgctcttggaaccacaattggacccaggggattcgctgacgccaatatggattctgaaaacatgcagaagcagctgcagtctaagaagttcgagcaggaagcacagaaactgtggattcggatgaggaatgaggtcgtacaggagctccaggagaaggggtttgatatcgagtgaatttgaaaacctgcagtatggtcggcgctgaggatgttaaaacttaaaaccacttgccatctaaattggagaactgtataacttaggaataaaagagtttgtagctatctttttaactaactatctggtgcattcttggtgctgctagattgtaccgaaaataatttttgctgtcttgtggagaacagaggatctcatttgaatatttgatcctcttttaatgtttcttattgcctgatcatcacaaaattgtgcttctggaaattactcatgttttgatgttggtgcatgcaacctatatgtgcagcattgaggatgcgttggtacttggcatatatgctagtccatgattatttcaaagttcaaatctatattcccaatggtatcacgtgcattcatgggcatggtctggtctccaaacatggtgacctgaatactattttatgtacccgttcggttccttaggaaggtgatctggaatgatttctagccggattgcacgtataatttgtataagtttttgatcagctgaaacgattttgagtttgaatctgacgaacagggccttagcacccacatccctgacttcaaaatctgaggacttgctttgtttggatgcccatatatctatgttaagctatgcgtgttggtatagttaaaatttaaacacatgatttgatgtggatacatgaatatctgagcaaggcctaaagtggaatgtaaatgtaattggatgttgacggcgtaagatagtaccaagaaacatttagggctaatttggtaactctatttttttaagggatttctattttcacaaggtaaaatgaactattaggaatcccttggaaaaatggggttgacaaactagcccttaaaagaaaacgcataaacagttttgcgggaaaaaaagcttttgaaacaggagtgcgtgcacccatatttttgattggacagcatcaactttgttaaacacagcgtcaaattaaagagagaggaaaaaacacacagccatatatggcaaagcaggatgcagttgactttcagcttttcaagcacagcgtagagcatggagattctgcaacaccagcacactcgatcttcgttgacagtatttcaatgctctctcgagaaagaaaaggaaaaaaagagcattctcggcgttcatgtgacggccgatgccgacatgatgcagttgccaagcccaagatgttcttcaggtcacactcatagcgtctggcaatcatcacgcagttaaaatattcaatggacagcagataaacacaagcatcatgttatgagaaccactcccaggcctcctccaagggtaagcaaacaatgggggggggggggggggggcagacacggtacacagtgaacttctgaagaacacaccaccagttcagttcctacgcatcatgacactacatacctttgctatttagtaatagcagtggcttgtggattaagctacaagtactagggtacggatgccgggcgtggcttttgttaatggcctggtatgatgagtgctcgctgcctaagaaagatgatcacgcagcgcaagccatcc

SEQ ID NO: 18852 - DNA, 3208 bp, Zea mays
  misc_feature (190)..(190): n is a, c, g, or t
  misc_feature (769)..(769): n is a, c, g, or t
  misc_feature (2062)..(2062): n is a, c, g, or t
cagactagttctaactttgtcttgtgttaagagaattggaccgtacgtagtacctttccatggctgatgattgcagttaccataccgctggaagcatactggtgtctgatacgggcgccataggccttgtctgcacgcttgtcggcgatgagcagttcgacactgctgagtggtcgctcacggtcactcnggccggtgtgcaccagttcacggaacactttcttgcaacggtggtttctcgccaaaactcttcctccctccaacagaaaatttctctctgtcctagcgagtcgtgctgataacgtgttgtaatctactcagtggcaaagagagttcagagagagacaaatgatagttctctactttattgcagataggatctcttatatacaatggatgcactgtctcccaaggcgtgtgtcccttgggagaaaactgtcagatagggattgatcactttgtacacaatattttgtaacacggaccacgtgccgaggggccgcggccgacgcggttccggggcaagcaagcggcctcgtcggccctcggcacaggagtaccggcgcggcgacaggcacgtccacgtgctcggacaggcccaggtccgtcccctggccggcctctcgtggtgtgtgtgatgccgcgacgatgacgtctgacgtgggcgcgataggctttgacctgctgcgctgttggctgccgccgcgccgttttgtcctgcggcttggcgttggcggggcgtcggtcgggcgcggcatcaatacctctnttatactgttggtaccgaacggcatctgttggtaagaatctggctctaggcgggatgtagtagtagtaaacatgttaggctgtctacgaggggtcgttctgtcatcgccgattattgtttattatatttaaaaaaaccaacaacgtattatacttattttttttcagttttttggtgacccaatcagcagtacataacacgagaatttaaaaaatgaagatctaaacttatttattagttttttttcagaatctaaagtttaaaaattagagacaacaaaatggtttttaataatccgaaatcggttcgaacaggtgttgtcgtcttgctctagttccagtcagcaaaggagatgggagtagccgataccgtagcatcgtttgtttgtttgctcgtgtgctccatcgtcggtgacgcatgccatgtgaggtcgtgagccatgaaggtggaggtagctgcggacgatttcttcaggctggtttggtgaccagttaattgtacagaagagattttcttccaatttaaaattaaatattaaaggatttttttctctatggatcatctccaattttctgatcactaaatcatcctttatgattattggttataaacgacggattaaactcgccaagaaaaaagtgttaagcgaaggcctcaagaagcaccagcaagcttgcaacagtttgctcgtgtggtgagccttgttcatattgaaaactgtgcagagatttctcggccaaattctaatctaaaataacagtgtaatggttgctagttgtagatgggctgaacaacatgttgctcacactttacgaaacgcggtgcgcaccgtttgtgtgccagggttgcagccggcccaggatggcagctctgataggcccattgttagtttcctgtgcatcctattcctagatgacggcctatataaagttggacaccgtagcccagaacagcagatcgcaccatcatcatgacttgaaaacccgatgccatcgggccaggtctatagattgagcccaggcgccctgctgcgctcctttccgtcaatttagacggattatctgtaaattctatacggattatcgtatatttagaataggacatccagcaacatttattgctacctgccttactttagggtttgtttgggagtaaaggtaatagagtagattggagggcatataatcctccactattcaattttagatagcaagggattatagtcctatcaatacccttcattccacttgctcccaaacaagcccttagattgtagattggtaaagagatatntacctgttgccgatactttttggctgggtctggtccctgaccgtagaggacagaaaagaaataaaaggtgttgcaacggcacatgaggtaggagtaggcccccctggtgctgcactgcacatgccgacagagacagctcacgtccgtgacctgtttcttccgctggacccactgcgcagtgcatgggccgtccgtcgctgcagatagattcctgcggctgcggcactttaatggtgactcacactcacaccgaaagcgcctcaactctgaaggcgctacagcaacgtcgccacttcactcacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcaggtaacttttcgcctcccaatcttaccgaaccattgcagggcgagatcctctctcctttctgtaaatacttgactacaccctgtgtgtgcattgcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgagtgcccctgctacagggacatgaagtcccccaagaaccagcgccccaagtgcccctaggccctaccgctctaagggagggaggatgacccaggatttcgctcgcgatcctgcacagcttctactactagtttagcgcgcgagcgtcggaatgtcgcgacggttccttccgtgcttgtgtgctgtgtatctcctcgttcgtgctagaacctagaataataaccaatgcactggatctgcgtgcttgtcttttgggatgtgactgatggctcttcaacagtagccgccgaagagaacagggatgagcaagaacgtccttaataaaaaaaatactaggcaagagaatcaagcatgccctgaaaagctttgaagacaaataccctcggcactcaaataaatattacagcatttccgtttaaaaaaaaaaaaaaaaaa

SEQ ID NO: 18853 - DNA, 707 bp, Zea mays
tcgagtcagctacggccgccccccccggggactcacactcacaccgaaagcgcctcaactctgaaggcgctacagcaacgtcgccacttcactcacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgagtgcccctgctacagggacatgaagtcccccaagaaccagcgccccaagtgcccctaggccctaccgctctaagggagggaggatgacccaggatttcgctcgcgatcctgcacagcttctagtcttgtactgctagtttagcgcgccgagcgtcggaatgtcgcgacggttccttccgtgcttgtgtgctgtgtttctcctcggacgtgctataacctagaataataaccaatgcactgtatctgtgtgcttgtcttttgggaaaaaaaaaaaaaaaaaagcccccaaaaaaaaa

SEQ ID NO: 18854 - DNA, 635 bp, Zea mays
gactcacactcacaccgaaagcgcctcaactctgaaggcgctacagccacgtcgccacttcactcacgattggagtctcacctcggcagccagccagtggttcctcggctcggaggaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgagtgcccctgctacagggacatgaagtcccccaagaaccagcgccccaagtgcccctaggccctaccgctctaagggagggaggatgacccaggatttcgctcgcgatcctgcacagcttctactactagtttagcgcgcgagcgtcggaatgtcgcgacggttccttccgtgcttgtgtgctgtgtatctcctcgttcgtgctagaacctagaataataaccaatgcactggatctgcgtgcttgtctccaaaaaaaaaaaaaaaa

SEQ ID NO: 18855 - DNA, 1220 bp, Zea mays
atctggattatggcagcaccggaggggagtacatctctgttagttcttcacaactctagactctcagttatcttacggcggtccaaaacccgcaaactgcaggtccgtcgcgcggtacttatcccgtgacttgccatacgagctgtcgcccgacgacgtctacctgacgaacggcggcgctcaggcgatcgagatagtgtgctcggcgctggctcgtccgggcgccaacatcttgctcccgaggcccggctacaagctctacgaggcgcgcgccgtgttcagcgggatggaggcccggtacttcgaccttgtacccggcgaaggctgggaggtcgacaccgacggtgtccgagctctcgccgacaagaacacggttgccgtcgtcatcatcaaccccggaaacccgtgcggttgctgagactgcgcggaagctcggcgtgtttgtcgtagcggacgaggcttacgcgcacttgacgtttggagagaggaggttcgtgccgatgggcgtgtttggggccgtggctccggtcatcacgctggggtccatttcgaagaggtggctggtgcccggctggcggctcgggtggatcgctaccagtgaccctagtggcgtgtttcagagaaccaaggtagccagcagcatcaagacctaccattacatctgctctgaccctacgacgtttgttcagggagcggttccaaacctcctggagaacacaagcgaggagttcttccgaagaaacatcagaactctaaaagaaagcgcggacatgtgctgggagaagctgaagggcgtcaacgggatcgcatgcccaagcagaccgatggggtccatgttcgtaatggtgaaactggacctgtcctgcctgcaggggatcgaagacgacatggacttctgctgccggctcgccaaggaagaatcggtggttgttctgccagggcgtgttgtgggatgcgaggactggctccggatcaccttcgccatcgatccgtcctctctcgaagacggcctggacaggctcaggtccttctgctcgcgacacagcaagccggcggcacagggttctgctgcctctgtagtctagtagtttctgttagaggatctgaagcactccacgtcttggaaacaatgaagtttgggtcaatatgagaacgtaataataaagttgattcagacaaatgtaagggccctttttttcgtgcagatcgcgttcaaccat

SEQ ID NO: 18856 - DNA, 602 bp, Zea mays
atgtctgtctagctaaacgagatttgtttctgttcgttcgttagggagcggttccaaacctcctggagaacacaagcgaggagttcttccgaagaaacatcagaactctaaaagaaagcgcggacatgtgctgggagaagctgaagggcgtcaacgggatcgcatgcccaagcagaccgatggggtccatgttcgtaatggtgaaactggacctgtcctgcctgcaggggatcgaagacgacatggacttctgctgccggctggccaaggaagaatcggtggttgttctgccagggcgtgttgtgggatgcgaggactggctccggatcaccttcgccatcgatccgtcctctctcgaagacggcctggacaggctcaggtccttctgctcgcgacacagcaagccggcggcacagggttctgctgcctctgtagtctagtagtgtctgttagaggatctgaagcgtgtccaggactccacgtcttggaaacaatgaagtttgggtcaatatgagaacgtaataataaagttgattcagacaaatgtaagggcccttgtttcgtgcagatcgcgttcaaacatagaattggatcttgattca

SEQ ID NO: 18857 - DNA, 2263 bp, Zea mays
aggccggccgggccgggttccaaaatggggtcgccacgaaggaaaaattcagtcgcggccggccgggccgggcccctccgtctccccctaccccgacccgaaccaccgcgcattaaaatctgccccctcctgccactgccagcgaccaatccaatccctacctgcccgggaaccacccgtcgggctcctcccgcccccctcgccgcatctgcatgcggcggggatctccgggctcgctccgtcaccggagccccaatcaccgccacctcatccaagcccccgaatcccccgggcgcgcagcacaaccttgccgcgatcgcgcgcgggaaccgccgctgattgggtcgtgaaagctcgattttgggcgattttgattcggagaacccgccgtcattcgattttggcgcgcgttgcgagccgggatggggttgcagcagtccaaagaggaactgctgtaccagcaggtcaactacggcaacgtcgacgggattcgcacgctccgggggcaaggcgctggtctcgagtggattgacaaggaagggaagacgcccctgatgcttgcctgtatgcgtcccgatctgttcgacgtggccaaggtgctgatcgagttgggagctaatgtgaatgcctacaggcctgggtcacactgtgggacagcattgcaccatgctgccaagaaaggacttcagcagactgtccatttactactctcacatggagctaatccgttcataccaaacgatgattgcaatactgccctcgaattggcaagagaaaagggtcatgtgaatgttgtacgtgccatagagggacgactttgtcttttttgcggatggatgagagagaactatgctcctgcttttttggatgcaattgctccacagttcatgacaagaaaaatttgggctgttgttttaccccgtgaagtgcgaactccaaccaggcctcttaagttagagatagctatatatcctgaattacaggcatctaaaccacgtgctgtacttaaactatggaaatgccaaattgagcaaccaaagcttaatcaggctgatccttctattatcatttttgacaaaggaacaaagactagatacaagatcttaccggcctatgaaggtgacaaacagcagcttcaatggttttataatgcatgttgtggcatggcacaggttttgaacacggctccagtagcaccagcaaatctccctatgccaaatccagcaccggcaatttcatctgtggcgccttcagaacaatctgcacccagcaaggaggatgttgaattagcaatggctatcaatgcctccattcaatcagctattgcagagggagtatcagtgcccaatgttcaaccaaatgcatccacccccaacaacaatggctgggctgcccctccaagtaattctcacaacggatggggaccaccagccactcctgcaccatcaaagacgagcggtcagtcccaggtccgggtagacgccccaagcagcagcacttacaatggatgggatgtgcccggaacaagctctagtcaaagttcatcgaaaccccaccaaacccaaaccaaccctcctccagtcttgattccacaggaagcacttcaggctctcccaaccccaaccgcgccaccatttgctgaagaaaccttctacaacggtcctgttcactatccatccatagactctacgcctgtcgatgtaaccatgccggctaccactggaggcggtagtacaacagtcatcgcaacggcagcacctacagaacagttagaaaatgaagctgatgcaagtgacagcggcaaaactccctctggtacttgcgttatatgtctggatgcccctgtggaaggcgcctgcatcccgtgcggccacatggctggttgcatgtcctgtttgaaggacatagaatccaagaagtggggatgccctatctgccgtgccacgattaaccaggttgttcgcctctatgctgtttgaggagttgaaacggtgggttcagaaagttggcaatggattggagggttctcgcaacaaatgttgatgggaacgtctctatctcaaaattgtgcaattatgctattttgcacttcgtactgcactacaaatatgacttccgtgtaatgtatgtgggctgacgcctttatgtacataggtagtactatacaagacaattttataaaaatctgggtattgttgcaagttgcaactcacgtacaaagttgcacgattgtggagcttttccaataaaaaaagaaaaaaag

SEQ ID NO: 18858 - DNA, 2850 bp, Zea mays
ccggccgggcgtcccccggggccggccgggagtttctgtagtctcggctgcgagcctgacccagacagacacacaccagagggagagggagacggagagaagggcgagcggcactagcaagcatggcggcggccgtcctagcgcccaagccgcctccttcgctgcctaccagggcctttccttcctcatccccctcgcggtttgcccctgccttcatctccccgcgtcatcccctgagaagattgctcctccgccccattccgtgcgcctcatcgccgtcttccgtcttgatgccgaacccggacctcgagactgagcctgcccacgatggagatggagatggagatgaggcgccgccggagtccaggccccgccgcatcgcccttttcgtcgagccgtctcccttcgcctacgtctccggctacaagaaccgcttccagaacttcatcaagtacctacgggagatgggcgacgaggtgattgtggtcaccacgcacgagggcgtgcctcaggaattccacggagccaagctaattggctcatggagcttcccttgcccctggtatcaaaaggttccgctgtcgctggccctcagtcctcgaatcatcgcagaagttgctagattcaagcctgacattattcacgcctcttcacctgggataatggtatttggcgcgcttatcatagcaaagttgctctgcgtccctctggtaatgtcataccacacccacgttccaatttatatacccagatatactttcagctggcttgtcaagcccatgtggctaataataaaattcttgcaccgagctgcagacctcacactggtaccatctgttgctatcggcagggatcttcaagctgctcgtgttacagcagccaataaaatacgcctttggaacaagggtgttgactcagaaagcttccatcctcgtttccgcaacatggaaatgcgttcaaggctaacgaatggtgaaccagaaaagccacttgtattttatgttggacgcttaggagttgagaaaagcttggattttcttaagagagtcatggaccgacttccaggagcaaggattgcatttattggagacggaccattcagagctgagctcgagcagatgttctcaggtatgccggtggtgttcacgggcacgttgcaaggggaggagctatcacaggcctatgccagtggggatgtgtttgtgatgccttccgagtcagagacactggggtttgtggtgctggaggccatgtcatcaggagttccggtagtcggggctcgcgccggaggaatacctgatatcatacctgaggatcaggaggggaggaccagctttttgtacacaccaggggatgtggatgactgtgttggcaagatcaagcggctcctgtcgagcgaggaactgagggaggccatggggagagctgccaggaaggagatggagaagtttgactggcgagcggcgacgaggaagatccgcaacgagcagtacagtgctgcaatctggttctggcgcaagaagagggcacaggtgctgcggcccctccaatgggtgctgcggctgctgaggcggacaatgccaggagctgccgatgccgcagcgaagcaatcctaggagaggggggctactatggttgatggtcctcttttttcccattccttgtattatctccgttttcgaatatttgtcgtccgctagttcatttttaactaaacagcgacaaataaaaaagaacgacgagagtataaaatgggctaaggaggccatggcagatgattggatatgtttcaggattagaggggaggaaggtcaagcttcaacattccaattcactgaagaatatataatgtacgtttaggactgttaggttgtaaatcgtcaaagtgtctatgtaatgcttcttcttggcatgctacactatatagtactaatattgatcctttaacaggaattggtgtgcagtcagacaatgataataatatatcttgctctgtctttctagtatcaaaggaggtgaaacgaataaaagggtgtttcaaaattgaactaggagagtggttgcaaataaccccccccccctccttttttttggaagcttgtagagatattttcataagctttaaatacttcatttgcatttataatgcattgatctatatttagaattttctcaatttttttagaaactcggacatttttcatggtatagaaaacatctgtttttaaaaaatacaaaagatgaaaccacctttaggggctcttttggattgtaggaaatctgtaggattttttaaggaacactattcatatggaaaaatttcctatccttatatttggttcataggaattatgcatttcattttcataggaatctttccatatgttgcaattacatgggaattttagcatctacgaaaatctctttgtaaatttcctgggaagtacgaggaattctttctcatgagcctgcatgtgaatgtgtaatgcagaaaaaagaatagcagtttagttaataaaatatatattctattcttatattcctataactcatccaaacaactttctatacaaaattcctatatatttttgaatcctaaattttgcaactggtgttgtatccaattcctatattttttctattcctatactttttatattcgtgcaatccaaaagaccgctaggacttctttggaataaagaaaaagtaaaggaattttgaagaactgaaattctatagaaagttttccaatgtgacaatttggaacaaatgattgagttgctcaaatcctataaaattcctatgaaatggaacattgtggtaagattttcgaggatttttaacatgagg

SEQ ID NO: 18859 - DNA, 2277 bp, Zea mays
gccgaggaaattttccattagcatggtatgaaatacttgcagaattagccttggaaacagcgaaaatttatgagcactgactgattcatattttgtgactgttgctagcacattttttttgaggcaactatgtcttgttttctattaatttttcatttaatcctagatctgtgggaactagaagacatttttctttctttgcacaaaaggcaaatcaagacattttatctttttacatgtttttttgtctatcccttttacaaatcttataattgatacagcctataatcgttttacctttttaagtgaattcaaatatgctccgtggcttctgcctgtcgtttcccaggtggggagcaaatttggggagaacacatcgagatgggggtccatgctctctgccgggcaggttggtaagctaagtgacatccttcctggaccagcagctgggtttttctcttctttcacatctggagctcgatatgattcatagtaattgcaccatgacccttgatctttagcccttactatgcgtcgtatggaaacccacatgtgtcatcaagagaacagaagcactgttggcaggtgtagtatgcctttggaaatctgttgctcacagaatgattccacaatgctggtcccgtgttgcttggcatatcctgccgcgcctcttcgcatcttattgtgactagacagtgtcatggagaagttcaggaaattatgatggaaaagatgagatttattctgtatcggctgcccacaggttgaatgagtggttagggaaatcaaaagtttggtttcaccgtatttcctgcttgcaatttaacttggtacataggacagagaagtgcaactcgccgcggatgcctgcctcacttttttggggggaatcatgttgtggatacacggcacttgaagttgtgaaaagaattttgaggttccattctttctttcttatctttggctcggcgagttgactgattttctcatcggaacattgccggaactgtgaggttgcggttttaccatgtagggaaatttgcagaatgtgtacactggaaatataggaataataaaagtctgtatcatgcattcagaaaaaaaaaaaaaatgtccattcagcacaatgcagcgctcaagggcctgtttggttggcatgctgcttgccatggcctttctgtatttgtttacatgtgtgggtttaagttgttacagcaggtatagttgctgattttatacgtgcctcattagagcagaaattattatagcaaaacaagcatctaagcaggaccgcagaaaatttggctggcataaggctttgattggttcctcgcatctcctttatcatggcagttttggttgtatgtatcgaccgacgccgacgcctgtatgctgtatgtatgtcttatttagtgtactatactggcctgttggatgtgcccagacacaggatgagctttactgtcaccggtgaacctagctctctggttggatgcgccgcgtctcaagcaaaaaaatgctaggcctgggctcaggggaagggtcattttcacacggccattgcgagttgtaagtgcaggtgcagggccaccaaggccctgtttggttttaggggctaatttttagttcctccattttattccactttagtccctaaattgtccaatacgaaaactaaaataaagttgtagtttctgtatttgataatttatgaactaaagtggaataaaattaagggactaaaaattagtccctagtaaccaaacactccctaaatccgctcacttttcgtagcaggatcgctatatccactctgttgtttcacccaaagctgtcgcgcgcggtagatgagatgttatcagcatgtgctgcatgtggttgtggtcattgccatggattagaaagctaaggttctccgctttccgtgatgcgtatgctgtaattcgtttgattttttagaccaaatttgaccagctagtttttttttcattttttttgaaaaatcaaaaaacaaagcctaatacatgccaaacaatatcacattaaaagttagtaataattatgaagtttttgaataagacgagctgatcaaatttgataaaaagtcaacaatatcacaataaaaattaatgatgattatgattttttgaataagccgagtcgatcaaaacttgaggtaaaagtcaaaagaattataaattggaacggagtgagtatattgtaatggttcgatacaagtaaaaatgggtagttccaaagaatatggtagcgagaaga

SEQ ID NO: 18860 - DNA, 3666 bp, Zea mays
gaaaagttaaatatttgcgctaacgccggccggcctgccgtttcactagtcaccctcaccccttcctcccgatcctctctcggatctcgccgcgcgctgccgcgctcgaaggtgagcggggccgcgatgcctgcggtgcccgttcccggaggcggtggctcctccgacgccgaggagctgttccgcaccaagcgcatcccggagattcgcgcggttgagggcgccacccgacgcgagatctccgccaaggaggaggagctccggcagctcgtcgggcgcagctaccgcgacctgctcgactcagcggactccatactcctcatcaagcagtcctccgatgcaatattctacaacctcgcccgcatctccgactccttgtcgtcgctctcgcctccccctgaaccctctctcgccgtaagcgccgtatcgccgtctccgtcagctggagggcgcgcgaggctctacgcgctggccgcgcgcgccaagtacctggttgacacaccggagcacatctggggccggctcgacgagggcctgctcctggaggcggcggggcggtacctgcgggctcaggtcgtgtacgggcgactctcccgcgacgccgctgccgccgcgcggttcccactcctcgcgcaccaggcgcagctcgtggagggcgttccggccgcagatcgcccagcgagcgcgcgagcgcctcgctgaccgccgcctccctgtagcggcccacgctgacgcgcttgcggccggggccgcgatcgacgcgccatcgcttgcccctgctccggcgctccttctcttcctcacctcgcgccgcgcttggatctcccaagacctagctggtctcgcctcggatctgtcatcctacacctctgtgctgtgcgatatagcgaggatcgtgcggatcacgcttggccacgttggacagttgtttgtgcctgcactcagtgatatgccgttgttcttcaagacggtgactgagaagacgccgcctgagcagttgttcggtggcattccggaccctgatgatgaagcacggttgtggaaggagcacatgaaccagcttgaagctataatggtgctgcttaagccagatgttgttgcagcggcctgtacggattggctcaaggaatgttgcagtgaaatttttggtgtgattgctggtgagcaaaagttggttgatgccattgggagtggggagctgcttggatcagtgcaaagacttgtacgtgatgccctacccgagtgtgtgggagtggtgaggagtttggagcagtggctgaaaagtgtctttgggtcagatactgagtcgccatgggatcagatccgtgggttgatcttgaaggacgacaaggatattttcgaggattggatggaggaagcatttgtgcgacggatgaaggacatcgtgcattcagagtttgatatattgggttctagtgttaacgtgaaggaatcaattcatgctatcggtgccaatgctgatccaaaggatgctggagatttccttgcatacctgcggaaatcttcaaagggtggtggtttctggttctcagagtctaagatcaagaaaggtggagttttggcacacttgaaaccaattgctgatgaaaatgatttccgtagctgcctaacatcgtattttgggccagaagttagtcggatcaggagtgcaattgacagtaaatgcaagaatatcctggaggatctgctaagctttgtggagtcacataattcaaccacaaggctgaaggaattggtgccataccttcaggagaaatgctacaagaccatctcgggagtactgaaagaattagaagctgagctcagaaagctctctgctttgttgggaaccaaaaaggagggtaacgacatacctgcagcttctattatagcggagaggtctctcttcattggtcgtctcttgtttgcgctgagataccattcaagtcatgtacccctgatactaggttccccaagggagtgggtaaaggaggttggtggtgcagcatttgccaggttatcatcacctacagcaagacatttaagggcatcttttacacccagaaggcacacatttgacagtcccaagagtcctggaaggcaattctccgatagccccagaagacaaactattgctgctgcagtatctttgtttggagctaatgatagatctaatcctagacttgatgaactcaataagaccctgcagtcactttgcatcatggctcataatgtatggatagcatgggtgtccactgaattatctcacattctttcatatgatctcaataaagacgattcactatcctctgcaactcctttgaggggctgggaagtcacagtaattaaacaagaggaaacaactgagggtcccttggaaatgcaaatagctcttccatcgatgccttcattgtacatcatatcctttctttatcaagcatgtttggagattcataaggttggagggcacatcctggacaggattattttgcataattttgcttgggagctactgcagaaggtcatcaatatttatgaaaattttctttcatctgttgaatctgggaattctccggtttcagagaaaggaattctgcaaatactgctagacttgcgttttattggtgatgtcctatcaggaggtacaagttcttccacaaacactactgaaatgcagacaaaacaggattctttgccaagcaccatctccaagacttccttcaggagaaaacagtcacaattacatgcagactcagctgtcatagagcctataaacaagttagtcaacaggctctcgcaaatactggatcctatagactgggccacgtatgaaccttacctgtgggagaatgagaagcaatcttacaagcgtcatgttgttctttttggttttttggtccaactgaatcacatgtacactggtactatgcaaaaattaccaacaaaatcaaatacagattcaaatatcatgagatgctctcaggttccaagattcaagtacctaccaatcagtgctccagctatatcatcaagatcacacaaaccatcactacagtctctgtctagcgagtccacatctaaaaatccttggaaatcctattcaaatggagatagatctactacaccagagtttgatgataatgcaagtcttgttggtgctgctccattgcttaagtcatttgttactcaggtggggaccaaatttggggagaacacatcgagatggggttccatgctctctgatggacaggttggtaagctaagtgacatccttcctggaccagcagctgggtttttctcttctttcacatctggagctcgatatgattcatagtaatgcaacggtgaccattgatctttagcccttactacacgtgacacggaaacccacatgtgtcatcaaaggaagaaaaagaactgttggtcctttggaaatctattgctcactgaatgatgccacatcgctggtcccgtgttgcttggcatatctgccgtgcctattcacatcttattgtgcctagactttcatggggaagctgaggaaattataatggaaaagatgagatttattctaaaaaaaaaaaaaaaaaaaaaaaaaaaaaaataaaaaaaaacaaaaaaaaaccaagaacaaaaaaaaaaaagtgaaaaaagaaataaaagagg

SEQ ID NO: 18861 - DNA, 1546 bp, Zea mays
caacacccccacctttgtttaatcggccagcggatcactgggcagcgatcatcaggctcaactgccatgcccatctcctattgggcggcccgccccgccccggggaaaaaaactccccagcacatcatcaacaagggatcatccacacgaccgcacccactactactgagtgagagagctcctgtgccacaggcccacagctctcctacacgtccaccgatcatctcgcttgagctccgatctccctcagaagtcagaacctatctgaagagagacgatgcctcggttattcctcttctgcctggtgtccagccagctggccgcgaccgccgtcacggcgcggcctttcgccaccgtcctcctgcacggcggcgcgatgagcagggtagctgcggacgctccttattccgctgccgccgtcgccctacacgcgcactccctgctggaggagtccaggttcgccggatcgccgctgagctcgcaccgcggcgggcacagacctttcgaccgggcgttcgccggcggcaagatcatcgtggcggggctcgccgcggccatcgtcgtcgccgtcttctgctacatccgcatcacgaggaagaagagcgtggagccaaaagtctgatgatgactatatagaccacctgactctttctctctgcacactctctgaaagactgaaaccctttctgctctacaaactgcagagtgaggatatacgggaagaaacaagtgtaacccccctagatttgctgtaatatactacatttgtgatgatggatagatggttcagctccttcacagttcacacccaatgttacctctgcggcccccgcgcccctgagatcaattatgcccgggcgcaaaagaatgtgctttctgacgaaatacgtggatgtcagcgccccagcccccagaccttcggttcttgagctgaattggccttgtattttttttgagctggacggtgatgagttcttatcctaaaacaaaacctttctctgatttgggattctcgggactgagttcgactgggagtaaatgcaagcatgcttgatctgtctgttgtctgccaaggaaaaacaaaaataaaatgctacctgcgtatgatacgagcaagcccaagtggattgcgcttgcacccctctgagttttcgtggcaaccagatattcagatttgtctgtgatcgttatcctataaagacgagtttgagagctaaaataccagaggagattgggagtgctaaaattttcttttttcaaaattgaataaggtggaaactctattttcccaagggaaaatgaaataatttcccttggtaaaaagatattttagcctcttgaaaaaatgggattaccaaactaaccctaagaaagatattttagtccctaaatctctttcggttttgtggctctcaaactagcctcaaacaatctgtctgcgattaattagctggtccaatttgccccgctggtgctggtctcttgaatttagtttgcgaagggtccaaagatcagttcgacagaaaatcagcatcaaatgctgcag

SEQ ID NO: 18862 - DNA, 2859 bp, Zea mays
tttctcaaccccaggtggcgcaagaacaaggtgggcaaccatttgtccactacaacagagatctaaagatttggatgaattgcctcaaaatcatctatcatcggagttcgatttggcgtcgccatcgcaaatgaagctggcgtctgtgaatccccactgcctggttccatcggggttactcatagtttattaaaaaaaaactgttttacgttgttctacactataaattgcactgttcgtatattgaaattcaaattcaggtatatgtacaaaggtggataacctggacatagtctaaatattggaacgctgcccgtatctgttagagacatttttttatttttttcttaaaataagcattaaggccaggcttttaaggatctcgtggagatgctaagaagccctcacctggagctcgtttcaacaagtgttggaccagcaataaaaccaaaccgagatccggcccagcacgaagaacgaagtcaaacctctttcactaggcccgccttttccgccaaatcaccggagcttcctctcatcggcggccctcaaattcccgtgccgaggatggaatggaagcaccggtcgcgtcggcgggcgcacgagagttgcgtgctccgtcttccgcccgcgtttacggtttacccaccaccacgcagcgctgtgcaactacaacgacatgcctacgccatgtcgccgtgagcccagccacaagattttttttttttttttgacaaacgggatgttcatgatacactgtgtatatggttcgcaaaagaaagagcttattctcctcctgagtcctgatagcctgatggtggactcgagtcgactctctgcctgtgattcccagctcaacctgggtcgatcatccacggcgcaaagaatagtagaatgctatggtacactgcctcctgctccggtcggtcgatcgtctggtcaggtcacccgaaccccatgaccttgggcgccagccggagcagcggctcgagcgtgtccggcgagaacttgcgcgcgaacaggttgcagatgcctctcctggcgccgttgtagaagcaccgcctgccgccttcctccctgatctccctgatccgctcctccgtcacctcgtccgggccgtgggtgtgcgggtgccggttgacgggccgcttccagtccgcgtacgtgagcgtgcggttggcgttgcggcggccccaccccagcaggctcaccagcgtcggcaggtagtgctcgtcgatgaggcactccctccgccccacgcaaaagtcgcggaacgccgggaagcaggagccgtccgcgacggactccagcgccagcgcgcggtccatctcgaaccactgcgcgcccttgcgccaccgcgccagcgtgatgttgcgggtggcgaagaagggccggtagcgcgaccggctgccgccgttctcgtagcagtccacgaagctggtgtcggagccggtcaggaaggcgtgcacggtggggaagtcgtacaccgggatgcacgcctcggagaagagcgcgaaccgctcgttgcccaggtccaggagcgcgtttgccaggagccgccgctccgcctccaccaggctcgcgtcgccccatttctttatctgcgtgcaattgcaatgcaatagaaccaccgagatgaatgaagttaatgtatagttgcgttaaaaaaaaaaaaaaaactgggatgatcttggtaattacctggctcgggatgtagcggccgtagaacggggagtccgtcggcggcgagccggtgtaggacgggtgggcgtgcacgtaaatggagtaccggccttcgtggcccgcgaagaacttctcccacagaggccggagcggcagctcccccctgaccaggaacaagaaagccaccttgggcacgcggctgtccggcgtgcggcggaccatcggcgccatggacgctcgccagtacagctcctcgtcggtcatgttgtgcatgacgccgctcggggaaaggaagcccgccgaccgcagctgcgggttttgtggcagcggcggcggcggcggcggcggcggcgtttgcgacggtgtcagtggtgtcgtcagcggcggaggcgaagacgacggcgcagcactagagcgtaacggtggcatgaaagggaggtagtatcggatgaacatggcgttggaggaggtcacgccgagaacgaaccccaacgagacgaagagaagcatggatgccacgccgacgaccctcccgcctaagcgagacgacgcccgcgtgggcttctttgtgtccttcattgcttcatggatatggcttggcttcaagctagcttagcatgcgtgacaccgcgatggagaaacgctctgtcctggacaatggccataaaatcgcagccttatacaatggctactgctctgctgcctcgttgaggggaatcggatttcacgcacggcgccgatcgctttgctttcgatgcaaattaacatggcttgttcgtgcaaaagctgctagtgtacatgcccagcctggttcacttcgctagctgctattcttttagctgttagtaggatgcaagcaatcgatgagtcgtagttttatcttccaattgcttccgttgcgaactaccgatgcagaactgctcgggcccgttcggcagtgtaaaaacgcggcctctgctgtatctgttggtgctacattgactatggtatttagggagtgtttggttccaatcacccttctaaactttagagactaaactttatttctaaaatttctatttagaggggccttatttagtcataatctttggtagtttatgatgtggaaaccaagcaccccttatagtatctccaatagctatataaatttagcacactacattatagatttagaaa

SEQ ID NO: 18863 - DNA, 845 bp, Zea mays
ggccgcttttttttttttttttttgttttattgtatcgcttgtttttttttttttatttgcaccccatgaaaacgcagcatccaaaatactgcactgtattaacatcctccaataatctgtattcaaacaatgatttaaaatacaggtaatgcactaagccattctattatcgacctactatttatcacctaaaatgtcttcaagttgccgttgcctccttgagctttccatcatctccagttgcacttccgttaccattgtgaattagtttctcctctgaaggtagatgtttcatgatcttcctggtcggccccgaagccttccacaagtaccacacacgcgatttgggaggcggaacagatcctgccaagggagctaccaaccctggtttcccctcatctatgatattgtcaactatcccataatccttggcttccgaaggactcatgaaataatcaaacttcgtgtcttcatcaatctgctcctcagattttccagtaattctcgacattattttattgatcttaatcttttcgtacatcatctctcttatctgtagtcccatctctgtgactttcccgccagcgccacctgatggctgatggatcataatcctcgcatttggcatgcagtacctcttaccctttgtcccagcagcaagtaaaaatgcacccattgaagccgccaatccaaagcaaacagttgacacatcagctttgcaaaatttcatagcatcatatactcccatccctgctgttatagagcctccaggtgagttgataaacaatttaatatctttagtctggtcctctgcatccaatagtaggggttggctgataatgag

SEQ ID NO: 18864 - DNA, 1822 bp, Zea mays
  misc_feature (1798)..(1798): n is a, c, g, or t
  misc_feature (1814)..(1814): n is a, c, g, or t
ttttttttttttttttgttcagataaaatcctccatcaccaccaccagcaagccttcgttttcgtttgtacacgttacatccagcgctcaagtctctcttaccactccccataaattaagaagacgaaaaaacaagcagcgctgcacagtggcaatgcgcaggccatcctcgacagcagattaaataaataagattagcataaataaacaaacaaacagacaaacaagcaagcaagcaataaacaccaccacctctgtctgactgaccggcctcactcgtggcagcagcccctgttcgttcgtcgtcaccataacttatattattatctacaccaaatccacaagccgacaaagcactctcataacttagaaggaaaatccgcacgccatcgccatcgtcctgcatgcatgcgaccggaaagaagtttcaagaagcggcggcggcggctagtgcacggcgatgttgatggcgccctcgccggcgatcttgtgggcgcggtgtttcggctgctgctgctgcggcggcggcttcttgggcccggcggccggcttggcgttcgcggcctgcggcctgctcctgccgccgcatctgcagctgctgtcgaggccgtcgcggctggcgcggcagcacggcctcgtgccctcgctctccgacgacgagttggacgtctccatggaggtcgaggccgtcttcctcctgcccagcttgggcgacttgggccgggtcgtgggcagcttcttgaactcggccttcggggacggcgtcgcctcgtggtagaagctcggcatggggttggctttgaaggtcaggctcttcctcagctgcttcagtgcctcctcctgctctttcttcaacttagcctccaactgaatcttctcttcctccatagcttgatgcttctcctccagcttcatataaaattctctgcgcttctcggcccgttcagtacagcggaaaaccgggcctgatggaaccgtggcggcctttccagccgacgatttcgcgtcatcctggttacctctgttagtcaactgcagtggcttccgtgcagttgcagatggagttttcttattggttgaagccagcaccctccttgcgctctggaacacgctactgtttcctttggagttcttgccgctggactgatcaggatcaggagtgtggttgcccacatcctcaggctccgacgggagatcgtgatgacggttcggttccagggcatcctccatcgacgtgatcgaggtgccgtcgctcgtttctgtttcttccatcggaaccgtcgtctcctggctctcttgtttatcagcgctgttttcgacatcaacaggagagccttcacctcctccagcgcgctcatcaccagtctgctcggaactttcggtccccgaattcccttcgtttccaatagctccctctactacagcagatcccaggtgttcggagccgccatcgtcgtatcgctcagcatcaacaacagcgctaggcaggtccgagttcgacggatcagcacacttctcgtaggacacatccatggtatcgccaacgacagaatcaaggtcctgctttcgcgcgggcgcggggcgtccagcggtgtcgagcgctgctacgcgaggttgctggtgctggtggtggtggctaggcttcggtcgggggcgacgtttgcggcggcggcttttcgattaggatgttctaggtaatggtctcgtgcgagggggaggcggaggaggaggaggagcaggagtaggcgaagcggggggggccagggcagggagagggtggccggtggtggtgatggtncccggccaggctctgnagggtacc

SEQ ID NO: 18865 - DNA, 1907 bp, Zea mays
actcctatgggcgattgggttcctcgaggccggccgggctctttcagggccttgaaatctcgccctcgttgcggtcgtccacatccttttctctcctcctcgccggcccaacctgattgttcttcaaccaagaggaagaaaggaaggaagggaccggaagcatcagccatgtcgaactcggcgtcgggaatggccgtctgtgatgaatgcaagctcaagttccaggagctcaaggcaaagaggagcttccgcttcatcgtgttcaagatcaacgagaacgtgcagcaggtggtggtggacaggctgggggggccaggagagagctacgacgccttcacggcctgcttccccgccaacgagtgccgctacgccgtgttcgattttgacttcgtcactgacgagaactgccagaagagcaagatcttctttatctcttgggccccggatacatcgagggtgagaagcaagatgctgtacgcgagctccaaggaccggttcaagagggagctggatggcattcaggtggagctacaagcaaccgacccgagcgaaatgagcatggacatcgtcaagtcgcgagccctctgaaacagccccggccgctgcacctgcacgctgcaggggcgcatcggctcctgcatgcccgtgggtcgtcgaatccttgcttgtgtgttgggaacggtcttgtgttttcgtgtccttgttttcctggaagcaaaagccctgcattctgtatgagactgtatgccattttccatctttttctctccccatatctctgccctagtcctgctaccgctgtagactagaacttatttggtgtttgatctcgtggcattgtcgagtcttttatgtgtctgtccacgccgccgcgggaatgttacgaaatgaagaggggtctaagattaatttaatattgtagcataaagcgtaaagactaggtctactagcagataatattcatgacgttagaataaaacaaatctaaactaactcaacaagatttactcctaaaagaaaaattcgacaacgagtctaaccataagaccatcatcgtaataaacttaaaatgtagatttacttacggtgatttccacgagcgacggcgaggaacacgagtggatgtgcgtgaaggactttccagaaaacctgattcaccggcacccgtgcaggttatcagatcaccgacgacggtacggatacaccactctcccttgatctgctgcacggcagatgaagggacggcaggacagataagcgacgacgcagagaattgagatgaagaggacgagtcggttgctattcgctcgtgtcctcgactgaaggacgtctgccctttatagacgggccgccacaaccccttgattcgacctactaaattacagaaactaccccctgaaatatctctacatgcaaccgcccggagatttcgcacgtaacgtgcgtactcattactcctggttgacgtgatagtctaggtgtgatatttgataaccaaataaataaaagacaaaaattaaactgtcgtttagaactcgtcacgacgcgatcgcgtatcgtcgcaagtcacaagtcacgcgataaataacgcgaaacacgagcgagcgtggcagcctcaatagtcctttatttgtctaatgtaaagagtaggacacaatcacacatataatctggttctctcctatctagatgggcgatatgaaactaaaagtcccttgtcatctctccacaccagcttgacttttttattgaattgggtcacacgctagtggaccgattccaacaagtttaacaattatttatatgcaaaacatatagaagtgattattatgtgtatacacatccagaccataacaatactggcagacagacagcttaatggcactgtgtaattgtactgcaggtcg

SEQ ID NO: 18866 - DNA, 3568 bp, Zea mays
ctgccaacgaattgtaggcacgggtggtggcgcgcatgttggttgcgcacaaacgcttctggttctcacacaccaacggggggacgtgcttggtcaaacgtccctcccctgacgtggtggcatagcatcatgcaagcctccatccatcctgtttgcccaccccctccctctctatatctagcttcctcccccctcccccacccccctctttcagggccttgaaatctcgccctcgttgcggtcgtccacatccttttctctcctcctcgccggcccaacctgattgttcttcaaccaagaggaagaaaggaaggaagggaccggaagcatcagccatggtgagtacatccgatctgtttcttcctcacaatgtcgtcaattcaagacacattgttcttcctcacaattgttctctgatacgtggttggttctgtctgtcctcgttgcaagtcgaactcggcgtcgggaatggccgtctgtgatgaatgcaagctcaagttccaggagctcaaggcaaagaggagcttccgcttcatcgtgttcaagatcaacgagaacgtgcagcaggtggtggtggacaggctgggggggccaggagagagctacgacgccttcacggcctgcttccccgccaacgagtgccgctacgccgtgttcgattttgacttcgtcactgacgagaactgccagaagagcaagatcttctttatctcttggtcgccctgcagcctacgcatctctctttggtttggttttgttcttcgctgaaaacgttccattttccatttcatctgattcggttttgataagcgttgctatggcacgacttttgtcgctgatgattgctgccccaaatcctgagtttgcatgtgattttttttactaagaggatcatctataaatctcattgcagtttggcttgtcattgtttgtttacagcactgtttcaacctttgcgacttgatcttgtacgtacagactatcacattaagcaccagcaacaacacattataggtgtcatcaatcaatttgttttatgatgaaccattattggatctgtggttggataaagtagcaatttactaggtaaaaaaccaaagcaaaaaaaaaagttccacaaaatgaaacacatctctgcctctcaagacaaatatgactaaaatttatgtaactactaaaattgtccatgttccttcttttgaaataaatggtacatgttggtaaatatatgttttaaaaaacaaaatatcatctccaaacacgcattttagttaaacttagggtctattttgtttagctatagatttctgagaatctgattttagttgtgagctatgaaaaaactattataagatgatggttaggaaaaattaaaataaatttggttgaaacaactatcaattataaattatataatagcatgtttgctaggatggcaggaatctgaaaaatctggaatagaagatgattttgaattgaactagcggaatatattgattctcatgaatctttattcttaaatctgtttggttgagattccagattttcgtcagccaatctggttcagcacacctttaatccttcaccggttagcggttgcaggagataaattaataggaaatattaattcatgcaaaagagatgtatctcagaactagccatatacgattggccaattaccacggttaaccccaagcatcttaagaaactgaaatttagcatctcactgacgagaactgccagaagagcaagatccttctttatctcttgggccccggatacatcgagggtgagaagcaagatgctgtacgcgagctccaaggaccggttcaagagggagctggatggcattcaggtggagctacaagcaaccgacccgagcgaaatgagcatggacatcgtcaagtcgcgagccctctgaaacagccccggccgctgcacctgcacgctgcaggggcgcatcggctcctgcatgcccgtgggtcgtcgaatccttgcttgtgtgttgggaacggtcttgtgttttcgtgtccttgttttcctggaagcaaaagccctgcattctgtatgagactgtatgccattttccatctttttctctccccatatctctgccctagtcctgctaccgctgtagactagaacttatttggtgtttgatctcgtggcattgtcgagtcttttatgtgtctatgcaatgctacttgtgaatgttacaaaatgaagaggggtctaagattgatttaatgttgtagcataaagcgtaaagactagatctactgacagataatattcatgacgttagaataaaataaatcgaaactaactcaacaagattttctcataaaagaaaaattcgacaacgagtctaaccataagaccatcatcgtaataaacttaaaatgcaaatttacttacggtgatttccacgagcgacggtgaggaacacgagtggatgtgcgtgaaggacttccagaaaacctgattcaccggcacccgtgcaggttatcagatcaccggcgacggttcggagacaccactctcccttgatctgctgcacgacagatgaatgtgatatcctagctcttgtgcatggtgatatactggcccaaggattaatataattaatagaatactcataccttgggtccaaggcttaatagaattaatagaatactcataccaacaaggtgcatagtctctttggaaagtctctctcaaaagaacttcagggttaagcgtgtttggcctagagcaatcttagtatgggtgactgatcggggagtcttcttgggtgcgcatgagtcaggacaaagtgcgcacaaaagactcgtgttgatctgtggggatgatatatgattctagagggttgtcaggagtaagtaccgcgggttcaggactggacgtgatgttacaaatggtatcagagccgaccctcactgtttcacgggcatgtgtgcgctagggattcgggtatatggtgcataacgtatgtgggtccaatgtggtcacgtggcatggcatattacgactttagacatacagacgtggccaagaggggaagttcctagcttgaagttgaccgacgaggacgtcggtcttctaagagggatggattgtgatatcctgaccccagtggatggtgatatccaggttcaaggcttaatctaattaatagagtactcataccaacaagatacatcttcttttttgaaagcttgccttgaaagaaacttcaggctaagcgtgcttgacctagagtaattttgggatgggtgaccgactaggaagtcttcccgaatacgcacgagtgaggacaaagtgtatacaaaagattcgttggatggcttaggatatgtcgcagcccacccattagataccctctggtcataggattctactagacactaatgtctttggatgtctttgttggatatgtccaaactatttgactttgaccaatttttagaaaaaatggttagacatctacaagttcaaataactacgtaacaaataactacgtatcatgatatatttcatgcaaaatttaatattttgaattttgatg

SEQ ID NO: 18867 - DNA, 946 bp, Zea mays
acgccgtatacatcctatgggcgattgggttcctcgaggccggccgggctcgaaatctcgcccctcgttgcagttgtccatatcccttcctctcttcctcgccaggccaaccgctgattgttgttcagacagaggaaggaaggaaggaaggaggagatcagaagcatcagccatgtcgaactcggcgtcgggaatggccgtttgtgacgaatgcaaactcaagttcctggaactcaaggcgaagaggagcttccgtttcatcgtgttcaagatcaacgagaacgtgcagcaggtggtggtggacaggcttgggggaccaggtgaaagctacgatgcgttcagggcctgctttcccgccaacgagtgccgctacgcggtgtttgattttgactttgtcactgatgagaactgccagaagagcaagatcttcttcatctcttgggccccagatgcatcgagggtgagaagcaagatgttgtacgcaagctccaaggaccggttcaagagggagctcgacggcattcaggtggagctacaagcaactgagccgagcgaaatgagcatggacatcatcaagtcgcgagccctctgaaacagcccggcatcagctcctgcatgcccgtcgattccttcggtgttggtaacggtcatccgttttcgtgtccttgtttttcctggaagcaaaagccttgcgttctgtatgagacttctgtataccatttcccctctctctttttccccaatctctgccgtagtcctgcactcctgctactgctgtaaactagaacttatttgctgttttgtctcgtggcattgtcgagtcgcttatgtgtctatgcaatgctagttgtgagaagcctaatgtaccttagcttaatcaccgaattgctcaagtttgatgtcttcctagtcagatcattcctacaaaaaaaaaaaaaaaaaaaaa

SEQ ID NO: 18868 - DNA, 2486 bp, Zea mays
ttcgctttgtaagctcctcgcctccaacacaacaaccttctaggcctgttattactgagttgctctactctcgccgatgcctctagccccttccatgatcagatcacagcgtcacacacagttgggttcgagtccgagaaaaacaaattttttttttttttttgcaagccccctacatcagcatcagctcaagctgctcaattcaggttaacacactgatccccacacccacgccatcagccatcataccaactccatccaaccggctgcacctaaacctctccaagaacgcgccaataaacatcccctaaatctcagccacaagtcaccacacaagatctcacgccgaggggcgatccaaggcacgagagaccatgtcagcgtcgccggagaacgtcgtcgcaggcggcagtggcccgccggtcgcgtggtggagcgcggcctcgccggtgggcggcgacgtcgtcctctgcagcgtagccctcctcttcgtcgccctggccttggcgttcgtcctgtaccactactccacggccacggtcagtcgccgcggcggcggcgcgggggtgggggcggcgccaacgagcgcccagcagcaccagcagcacggcacgctgggacgaggacgcgacgccaccggcggccttgacccgtcggtgctccgggcgctgccggtgacggtttacgaggcgaaggacgaccaccgggcaggcgaggcgctggagtgcgccgtgtgcctcgccgagctcgccgacggcgagcccgccaggttcctgcccaggtgcgcgcacggcttccacgccgagtgcatcgaccagtggctgcgcggccactccacgtgcccgctctgccgcgtcgacgtcggcctgctccctgcgccggcgccggcgccgccgtcctcggccctccctccggcgctcccggcgcccgccacctaccccacggacctgccgacgaacgtcctgttctggggatcccagggcgcggtcaccgtggcgagggcggcggtccgcagcggcccgagcgctccccgtggagcgccgccgccgctggtcatccatgtcagggaaacggcaccggcaccgccaccgcctccgccgccgcgtgaaggcggcgcggcaaaagcggagggcttggcgcggctgagttctctcaggcggctgtggagccgagggaggcatgacgacgctgcggctgcgacctcccgttcctgccgccgcgccactgccacggcaactgcttaacgcgctacacctacagcacgtgttactgatgtgcaggtgcactgcaccgatcctcaactggagacacgacacgcttccatggcaacagtccacctagtatcagtcttcggtttgttccagtgatcttggtttttatgcacacagctattaatcatggtgctcaccgagtacgagcaacacaatctcgagcgtctccgcgccgcagaggctgcccgcaccattcgtgcagctggcgatgccgacgagtaggccggcgaagagcatgcgcgccgtgagcacgacgctcgcgacacatgtcgtgctggctgccgaaaccgatgttttgtacgctaataagcttcacgcccaggccgtagcgatcgcgtcaacatttggtcctccactgccgtcgctctcgacctcaccatgcccaacccaactacacgaagcagccatcgtcaacatctggtccctcaaccggtcactctcagtctcaccgtgaccgattacacggagcagtcaccgtcagcatttggtccctactccctcctccctcgctctcgacctcacggcgcccaactagctacacggaatggcgccatgcggcgcctcttcctcctcggccctcgccgtgggcatgtatgcctattggatcatatccgtcctctcagagactcagacgtacgagtccttttttggctgatcaacccaggtgggcacgagcacgatgtagtggactgccctcggctggcaccacaacacatgtgcgatcagtgcggaggccatagagtactgtagagcggtccgttgcgcgcggtgtcctcagatgtctccactgttcaggtaacatagcgaacgttactgcaaaagtgctctattctatgactaaggtcaaggcaagagtgatccgtgttccgatagaggatccaatcagaggcagcgtcttctccgcataccacaactatgaggacttgttcgaggagattaaatctctcttgctactcaaaattaatataaagtggattaatcctgtcagtattaaatctcatgagaagatctttgttatacgttttcattttacccctgtgcctaaatgtgtttctaggccatgcacaaaacttttatatcatagttccaatcctattgttgggcactgacacacgcagacgcactgtcaggtggacccaaacaatcagaaagcaggtgagatcttaggtgcgtgacaagacaaatgacaggaaattgtagcttctcgttctctgt

SEQ ID NO: 18869 - DNA, 2013 bp, Zea mays
aggaatcaacatgtcgcctgtgggagcagtgtgacaggagcgaggtttccccctcaccgtcgctacgattggtggagccgaagggcaaggcaggggaagaatgcagggcgtgaggagcagtggagcaagaccgcccaacgagcgggaggggagggccgcgtggcgaggggggagggaggtggctttaatgcagagcatgggcaggcgcatctagcgcaccacgcgtgagcgaggccgatgacggatggttagggagcagaggttgcgggcgggaggtagctttaacgtagagcttggcacacgcgaggtcgacgacagatggttagggagcggacgttgcaggcacggctagcggcaacaattggctagggaggggaggttgcgggcgcggctagcatagagcatggtttgttggagcgcggcgtataaccgtaagaatgatacatgaacacttgttcaaaaatgctgcattataatagtagagaagagatagatatagagaagagatttgaaccaccaacccaacgattgaacgatttgggtgattcatcaccacacttaactcacactcacagttagtagcaatgtgccattctttctgcctctcacagagaatcctcgaatgcatacacaattacacacacacatgcccactctctctcctcgaacacatacagcatacatgctcgctcttcctcgtctagtcgtcttggtgagtctgatccctctctccttccgtcatccaccatctctagggttttagcgccccattttcgcatcgccattcccgatcggatcgccccttccccacccaaccctccggcgccgccacccttcgtgtcagagggtcggtctccaccgaaagcctcgcaacaaatctcctccgtttcttgctccggccatttgttgcaaagatcgtgttttccccccctcatccatgcctcgcgttccatcccttccgtccccggaaatccctccgctttcttgagatctcccgttcctcgatctgacctcgcctcgtcccgccaccacaagcaacagctgttttgcgccacgatcctcagggttgcgattctcgcgtccatttgctcgccccaatacctttcgggagcatctgatctcgaacagtgagacaaagtagccacctttgtgccgttccttgcgtatcggtgggtggcggcgctgcccattcctatgaatggacgggagggagtccacggtggcgtcggggcccaacttctcgtccttcttcgcgcagcaccggggcatcggggcgccgggtgtccccggccactcgcaggggcttcacgccccgccgcccggtgggtaccggcagcatcttgatgctgtctctgcggggtatgcattccagaccccgcatgttgggggtcccagcattgggcaggggtacgaggcctcacctcatgcggcacagcacagcgccggtggcggctctggctccggtggttgtggtggtatggacattggcatgggtgcggccgtgagtgccgatgttaagggggatcaggggagtgggcctggccaggatgagcaggtgaagaagaagcggggcaggccaagaaaatataagcctgatgggtctgtgactcttgggttatcacccacttcatcatcgacgcctcactcgtccagctcggggatgggaaccatggttaacactccaggctctggatttgggtctggaggatcagggggttcaggttctggtgcaccatcagagaaacgtggcagggggcggccacctggctctggaaagatgcaacagcgggctccgcttgggtcctccgctcgcggctctgttggaacaggttttactccgcatgtgattattattcaaccaggagaggacgttgctgcgagaataatggccttctcacagcaaggcccaagggcagtgtgcatcatttcagcaactggagctatttctacagcaacccttcaccaggattcagactccggtggtgtgggtacatatggagggcgatttgagat

SEQ ID NO: 18870 - DNA, 2088 bp, Zea mays
acttcccctctctccctccgcgaacacaggcacggatacaccattgtacatgctcgctcttcctcttggagtcttgggaccgccccctcccctcttccgagtctgatccctccttccttccgtcagcgcacatctctagggttttagcgccccatttccgcatcgccattcccgatcggatcgcccccttcccacccgccgccgaccagatcccggcgcgagtgctacccaaccctccggcgccgccacccttagtctcagagggtcggtctccaccgaaagcttcgcacaaatcccctccgtttgtcggtgccatttgttgcaaagattgtgttttcctcctcatccgtgcctcgcgttctatttctgccgtccccgaaaatgccaccgctttgttgagatctctcgtttctcgatctgatctcgcctcggtatggcgtgagagttcctaggggagggcaaaatcctcggagttgagattcttgcgtccatttgctagtctcaataccgagcatccgatctcgaacagtgagacaaagtagcgacctttgtgccgttccttgtaactgagcttgcccccgcctgcgtatcggtgggtgacggcgagctctacggcgctgcccattcctatgaatggacgggagggagtccacggtggcgtcggggcccaacttctcgtcgttctacacgcagcaccggggcatcggggcgccgggtgtccccggccactcggcggtgctccatgacccgccgcccgctgggtaccggcagcatcttgatgctgtctctgctgggtacgcattccagaccccgcaggttgggggttcccacattggacaggggtaccaccatgtcgaggcctcaccccatgtggcgcaatacagctccggtggcggcaccagctccggcggtgatatggacattggcatgggttcggctgtgtgcaccaatgttaagggggagctggggagcgggcctgcccaagatgagcaggtgaagaagaagcggggtaggccaaggaagtataagcctgatggggcggtgactctcgggttatcaccctcttcatcattaacacctcactcggccagcttggggatgggaaccatggttagtgctccaggttctggatttgggtcggggggatcaggggcttcaggcttgggtgcgccatcagagaagcgtggcagggggcggccacctggctctggaaagatgcaacagttggcttcgcttggaaagtggtttcttggctctgttggaactggttttactcctcatgtgattattattcagccaggagaggacgttgctgccagaataatggccttctcacaacaaggcccaagggcagtgtgcatcatttcagcaactggagctgtttctgcagcaacccttcaccaggattcagaatctggcagtgtggttacatatgagggtcggtttgagatcctgtgcctttctgggtcatacttggtggtagatgaaggtggcggcgcacggacccgaagtggagggctttgcatagctttgtgtggtcctgacaacagggttattggtgggagtgtaggtggagtcctgatggcagctggagcggttcaggtgatagtggggagcttcatgtacggaggaggttcaaagaagaacaaggtgaaagccgagttggacgcggagcctgaggaggcgaacgccggcgaccaagaggtggcacttgcggagcacagcagcatggcccctcatcctgccatgagtggtggtggcgggtgggcatctggcatgatgaggcagatggagtcgagaactcccaacatcgatatcaactccatccgcgagtagtttgcctgtttggttgggtggatgaggaaggctcctcctccttggatgcacacagcacagcggcatgcatatgtttggttgtaggcgttgctatgttttaggactccagagtatattgtgatgtgatgttgtacttggatgttgttgtataagatcatgggaacgcttggtcgtgttattatgttaataaaaatatataatggatggtaagctacaaaaaaaaagaagattggccttgaatctagttttgat

SEQ ID NO: 18871 - DNA, 1492 bp, Zea mays
  misc_feature (121)..(122): n is a, c, g, or t
  misc_feature (1159)..(1159): n is a, c, g, or t
  misc_feature (1266)..(1266): n is a, c, g, or t
ttttttttttttttttgtttttttttttttttttttttaccatttccgtaaaaactactgcacacatgcgttctgttcttgttgcacatttgaatataaatgttttgcctactgtgcaaannaaactaaaggtttgctgctagcacttgcctggattgttggattgcttgcatcttacagctgaagtattgccttattgtttcgttctcgtctaggtttgtatccttatgctttattgttggtttggcagggccgatttgagatcctgtgcctttctgggtcatacttggtggtagaggatggtggcacacggacccgaagcggaggtctttgcatagctttgtgtggtcctgaccacagggttattggtgggagtgtaggcggagtcctgacagcagctggaacagttcaggtgagtgtgatacaagtatagaccatctgactgacctggtgtgtggtgggtgtataggcggagtccgtcggcattgcagttttggtgtcgtatggtttgttttctatgtcatcttctgcataaagagaaaggaaccgtggttttgcattgctgcaggtgatagtggggagcttcatgtacggaggttcgaagaagaacaaggtgaaagcggaggtggacatggagcccgaggaggtggcacccgcggagcacagcggcatggtccctcctgcgatgagtggcggcgggtgggaagcgggcatgatgaggcagatggactcgagaactcctgccattgatatcaactcgatccgtgggtagtagggtagcagttgttgcctggttgggtggataaaggctctgtgacaaagtcgaatcctcctcctaggacacacacagcacgcatgtactaactaactaactaacagctctgttgctgtggtttaggatactcagaactccgagtatatcgtatgtgatattgttgttgtatgaaataattaacggttggttggtcgtgttattatgttaaatatatatatgaaatgctgctgttgggtctccactccaattatatatgattccatacagatatgactgctgttgcgaaatgaatggattgagttggtactgattgttaacatttatatatatgactccatacagatatgctctgaaagtatatttatttatctatccatatagatntagcaaaactttaaaaactgtctgctttatgagccattggtattttacttgatttcgcgcgcgcgtgtggaaagaagcaacgaccaaagagaagagctgaccgcaangcctccctccctccgttgtttgcggtccttcgctgtcttcttcccaaggcgtttgacgatttggattgctcactctgaatgtcgaggtgcgttctctgcggacgatttgaattgctcttttggaaaaagtttcaaaaggaagttttcgctcgccggctttaaacaatagttcaaatttattaagcatcaattctttcctgagtttcatcaaaattggatcattcga

SEQ ID NO: 18872 - DNA, 761 bp, Zea mays
aacaccctatacggacgtcggccttctcacagcaaggcccaagggcagtgtgcatcatttcagcaactggagctatttctacagcaacccttcaccaggattcagactccggtggtgtggttacatatgagggccgatttgagatcctgtgcctttctgggtcatacttggtggtagaggatggtggcacacggacccgaagcggaggtctttgcatagctttgtgtggtcctgaccacagggttattggtgggagtgtaggcggagtcctgacagcagctggaacagttcaggtgatagtggggagcttcatgtacggaggttcgaagaagaacaaggtgaaagcggaggtggacatggagcccgaggaggtggcacccgcggagcacagtggcatggtccctcctgcgatgagtggcggcgggtgggaagcgggcatgatgaggcagatggactcgagaactcctgccattgatatcaactcgatccgcgggtagtagggtagcagttgttgcctggttgggtggataaaggctctgtgacaaagtcgaatcctcctcctaggacacacacagcacgcatgtactaactaactaactaacagctctgttgctgtggtttaggatactcagaactccgagtatatcgtatgtgatattgttgttgtatgaaataattaacggttggttggtcgtgttattatgttaaatatatatatgaaatgctgctgttgggtctccaaaacaaaaaaaaaaaaaaaa

SEQ ID NO: 18873 - DNA, 1385 bp, Zea mays
  misc_feature (1358)..(1358): n is a, c, g, or t
ccccgcgtccgccccgcgtccgccccgcgtccgctcaaaacctcggggctcaggttctccatttaaatgtatcggcatcggctttgtgcaacagatgaattctgagaaagatgaagagcttagtgctgcaaaacaacgcgcgggggaactagagggcatagcagctagtagacaaagggagatattcatgttgaatgcgaaactagcaacaacagagagcatgacgcacgatgtgattcgagatatgcttggggttaaaatgaacatgacaacctgggcggctctagctgacaaccagcaaaagctggagacaaaagagcccatcgcttctcaagcacaggaaatcaaagattccaatgagctgatgaatttgaagcggcagcttgatgaattcgttgaagagagacagagttggcttgacgaaataaaccagaagcaatcagagcttggagctgcccgcattactatagagaagttacgacaacgggaacactttatggtagctgaaatagagttgctaaaggctgagaattcaaactacaaaaccatcatccttaaccttgaagccgaagtgaagaaccttaccagacaacagaacctccagctccgaataaatcaccacgttaaaacgaaggaagagaacatcctgctgaagaggcagaacgaagagctaagtgcaaagctgaaacagctggggggcatccttacccgtacgaaggaagagctcgcccgctacagggtttcaaatggaagagatccgcacgaactgatcgaggaggaggagcttatgaggaagaaactagacgagagcgaacgagatagaagccagctggcggaaaacctatcaagcctatgctccagcattctgaaggtcgctggagtttcggactcagaatctgacgcaactcttttgaaagcatcggagtgcttggatcagctccagtgccgtatcgcttctttggaaggccaagttgaggatctaaatctaaagtgcaaactagtgcgtgaaaaggcccgcctgtgcgagctccggagcaactcgtcgtctctgcgcacaggggcgaagggcaatctgacatcgcccagtccggacacatcgccaagcatttcgtccttccgatgacacaagcggacggatacatcgccgagaagctagtgtacattagtacgtacataacacattccgtgtaactattctagtgcagccgggctgcttagggaggattagttcagtccaacaatctccctttgctgattttatatatatctgctgtacaatatatataccgtgtgtgtacttgatgcagttccattcaacactggtcttctctcttcaagaaaaaaaaaaaaaaaaaaanctcgagggggggcccggtacccaatcg

SEQ ID NO: 18874 - DNA, 1527 bp, Zea mays
ttcagttagctcttaatccatatggattaagttggattggttgggtttaaataccaagtaagtcaaactttttctaatttttttccaatttcatccaatttatgtataataggaataaccaataaggcctaatatgtacgtatggcccgagccactagccgcatgcatatgccacctgcaaatggaggaacatggcaatggactctttggtgccacgaacgcacctcttcccaagaccccaaggcaacccctacccacctccgatcctccaggccgcaagcttttaaggggccagcgagcaggcagttctcgtgtatcaacgagcaggcgtgcacatggagcccacgccagcggcgccgcgcatccacctccagtccccgcagactgccgtgccgacgcgggcggtcgagcctgggcggacgcgccgcatcaccgtggccgcgcccccgctcccaccggccgcgctgcagcggcgcactcgcgtggtgctctactaccgcgcggacgccgctggcgcggacggccgggcctcggtgcggctgtgggaggaggcgatgtgggcgaaggagtcgctgagcgaggccgtggccgaccacccggagatgggcggccggctccggcgccacgccgacgggtcgtgggaggtaaagctgaacgacgccggcgtgagattcacagaggccacggcagaggcgaccctcgacgagttcctggcgaccgcccaggacaaggaccgggcgcctagctgggaggccgccctggcgccgtgggccgacgtgaacgcggaggaccccgacgtgagcgcgctcgtctacgtgcaggtaagctcgatgtgttggagcttttggcagagcgctttcaactatgtgaaaaataacttctccaaaaactaaagaatttgcattaaatagctgacatgagtcaataatcttgtctgtgggacctctatccaacttagataatttagagggaaaacaaacagccatattattagaccaaattataaaatatggaggtcaaattatcataatctcataaggtactcagcagatgtttattctagcttatttggtaaaaagacctactaccaatggcaactttagcacaaattatccaccattcctattgctcacctaaaaatatttcatctattttttcttactcccgccgcaccacgtgcatatgattaaaatcaataatcgaagttctaataagctaggttgccaacacctacatctagattattgaatcttatatataagttacattatataatctataagctgaaacggaacaactccttagataattaggccctatctagtaggccagaatgatgataaaattaggtgcagatgtttctgaatggatatacacataaaaaattcagttttttattataacaatgtacattgactgtgaataagtttaaatttctttgcaaaacgtcaaagcactccgatgaattgtcacgttttaagcttcaatttccttttattcatcggatatgcagcctacaatataacc

SEQ ID NO: 18875 - DNA, 1593 bp, Zea mays
cccctgaatgagaagataccaaatcgttccagatatatagctacatcgaccaacaacatgtataattacataattataataccttccaatgaagaccaattatatgtccaaataatcaatcccacataaatatgtagctacaacacataacaacctgccttcactctgataaagaaactttttgtagactacaccgggacatggagtctccatcctgaaatgcaatctgcgctcaccctacctaataatggcaaagcaatgctgttttgatcatactcctctaggcactaactaataatattccctttcttgtaaactatagttcatgttgactttatccttaagtcaaactaatcccttttttgtaaactatatataatattcccatcgatagttatctccgcagcttacacatcatcctccctatatttaaacttcactctacaaacagtgaaacgatattattaaataatttctaatgataatcatctaatgctattttcctagaaatgatgggtaaactccaaatatgttgatgacttcatgcaactccagtagcgacgataccacttactcttgtgtgacctgacctgacctgacgggtgtacattatatgtttatttaattaaatatatagctaacgttctgtgttgtttgcaccatcagctgacacggttccagggagacggaggcttcgccgtgggcgtaagctgcagcctgatgctgtccgacccgctgtcactggcgaggttcctggcgtcgtgggcgcgcacgcacgccaggatgaaggctcagaacgacgccgccgcccacccgctgatgcagtacgcgagctacttccggcgcccggacgccagggccgcgcgcgcgctcgtcaagtccgtccccctcgacgccttcgcctccgccgacgccgccgagaccgtcctcttcagagccagacctaccatgctgcccgccggcgcgggcgcaccaccggcgcccgaccaccgcgcgctcgccgtcgcctgtgtcgcccaggcgcgggaacggctcggcgatggcaaggtggtgccgccgcagttcccgctcgtcgtcttcgactgcgaaggcggtgtgagcgtcgagacgtgcgcggcggcggcttacgggcagccgccgtcgccgagcggcggcgggcggtacaagattgacgttgccctgtgggaggagctcgggctggaggagctggtgctcagggacagcaagccactgcacgtgtcgtacagcatcctcggcgctggctgcgatgggctcgccgtcgcgatgcctgccggcgctgccggtgagctcctggtcgcggcgacggtccccaaacccaagtgaagatacatcggcaggcaggctctggcagctagccggggcgcgaaagttcccgtgccgtccgatatctgtggtactggtttctacggtgtttataaattaaaattacagcaaaacaaaaaaaagttatagtatttgtgtgtgaaaatacagagaataagacaatactgtaaaacaatcacagttgtggattttcaacaatattgcccatcaaataaatgcgacgtttgtgaaccaaaaaaaaaaaaaaaa

SEQ ID NO: 18876 - DNA, 463 bp, Zea mays
acgactccgacgacgccaccccggcggcctgctgcccagctccctctgccttcgcgcagtgcctcctacccttttgaatccgcgccgtgccacccgagtccaggccggcaggcccccagggtgcgagggcggcaccggcgcaggcgaaccgcagtccgcgcctccgcactccgccccatccgaagctccgagcagagcaggagcagcaaagcaagcgagcgtcagactggctgaatcgagaggtggaggcagcaaccaacaaggtagcactatgaaggtcaaaattcttcagtggcatgcagtggctttcttggacgtgggatgcacaggatgagacatgtggcatatgcaggatggctttttgatggctgctgtcctgactgtaagttccctggtgatgattgcccactcattagtacttatatgttgaatcataatattacgacttcggcgaaaaaaaaaa

SEQ ID NO: 18877 - DNA, 814 bp, Zea mays
  misc_feature (1)..(1): n is a, c, g, or t
ngccccccccggcccgccggaactccctcccgatgccctaacccacggttacgactccgacgacgccaccccggcggcctgctgcccagctccctctgccttcgcgcagtgcctcctacccttttgaatccgcgccgtgccacccgagtccaggccggcaggcccccagggtgcgagggcggcaccggcgcaggcgaaccgcagtccgcgcctccgcactccgccccatccgaagctccgagcagagcaggagcagcaaagcaagcgagcgtcagactggctgaatcgagaggtggaggcagcaaccaacaaggtagcactatgaaggtcaagattcttcagtggcatgcagtggcttcttggacgtgggatgcacaggatgagacatgtggcatatgcaggatggcttttgatggctgctgtcctgactgtaagttccctggtgatgattgcccactcatttggggtgtctgcaaccatgcttatcatcttcactgcatactgaagtgggtcaattctcaaacatccacacccctttgccccatgtgccgtagagagtggcagtttaagggctaaggtactatggacatctagaactgcaccaagcgactctcagttctcagagaagactgatgtttttctggtacttctgtgatgctttattttaactactacatattgttttccgtacttagtataaatcctgatgtcagcgcctgatcctgtgtatgcttccgagcttgtagtggaacaaatgaaattattgcttttcttagggctgacttcctaatcttatcccaaaaaaaaaaaaaaa

SEQ ID NO: 18878 - DNA, 810 bp, Zea mays
gggtacacagcctgcgctcagccactccctcccgatgccctaacccatggttacgactccgacgacgcgaccccggcggcctgctgcccagctccctctgccttcgcgccgtgcctcctaccctcctgaatccgcgccgtgccacccgagtccaggcccccagggtgcgagggcggcaccggcgcaggcgaaccgcagtccgcgcctccgcactccgccccatccgaagctccgagcacagcaggagcagcaaagcaagcgagcgtcagtggcagactggctgaatcgagaggtggaggcagcaaccaacaaggtagcactatgaaggtcaagattcttcagtggcatgcagtggcttcttggacgtgggatgcacaggatgagacatgtggcatatgcaggatggcttttgatggctgctgtcctgactgtaagttccctggtgatgattgcccactcatttggggtgtctgcaaccatgcttatcatcttcactgcatactgaagtgggtcaattctcaaacatccacacccctttgccccatgtgccgtagagagtggcagtttaagggctaaggtactatggacatctagaactgcaccaagcgactctcagttctcagagaaggctgatgtttttctggtacttctgtgatgctttattttaactactacatattgttttccgtatcataaatcctgatgtcagtgcctgatcctgtgtatgcttccgagcttgtagtggaacaaatgaaattattgcttttcttagggctgacttcctaatcttatcccatattggtttgttcg

SEQ ID NO: 18879 - DNA, 862 bp, Zea mays
gcccagctccctctgccttcgcgcagtgcctcctacccttttgaatccgcgccgtgccacccgagtccaggccggcaggcccccagggtgcgagggcggcaccggcgcaggcgaaccgcagtccgcgcctccgcactccgccccatccgaagctccgagcagagcaggagcagcaaagcaagcgagcgtcaggttagcactctgcagcccaccaggcacaaggccacggctcaccgggcgggcactggcgaccgctacctggccgccagcggcgctgtcctccaaccgctattgcgtatctactgtcttccggcttctgcgtctgagcatctcttgtgacggactggctgaatcgagaggtggaggcagcaaccaacaaggtagcactatgaaggtcaagattcttcagtggcatgcagtggcttcttggacgtgggatgcacaggatgagacatgtggcatatgcaggatggcttttgatggctgctgtcctgactgtaagttccctggtgatgattgcccactcatttggggtgtctgcaaccatgcttatcatcttcactgcatactgaagtgggtcaattctcaaacatccacacccctttgccccatgtgccgtagagagtggcagtttaagggctaaggtactatggacatctagaactgcaccaagcgactctcagttctcagagaagactgatgtttttatggtacttctgtgatgctttattttaactactgcatattgttttccgtagtataaatcctgatgtcagtgactgatcctgtgtatgcttccgagcttgtagtggaacaaatgaaattattgcttttcttagtgctgacttcctaatcttatccc

SEQ ID NO: 18880 - DNA, 1625 bp, Zea mays
gcacgagaccattacctagaacatcctaatcgaaaagaaatgaaactcgcgacagacagttcgtcctctgctccgtggaccctattcctgcgattatctggttgctcacatggacggtgatccgtgatccccggtgaccaagggtgttgaatcctcatgcaggcagaggcagaaacactgcccgaggctgatgcctgatggtgcgatcccgttccctgtcgccatcgagttcgttttttcgttgcttgacagccttaaagcggcgcacgaatgccacgagccactgaggcggcttcccagttcactccaggcccagggcgcccggtcgccatgaactcccgctcctcctccggcggcgtgcggtccgagagctcgctgtcgttgggggagcgcctctgcgcggtcttcttccccgtcatcgccatcgccgaggccgttttcttcgccttcaccgactgcctcgcggacctctgcaccgactccggctcctcgcactcgcgccgcttcggcgcgggcgcgtcctcctccgccgccaggaacagtcggagcaaccattgccagccccaccacagacctttcctacgccgcgccgctgcgggtggatggacctcccccaacctccgccagctcgcacgcctcgccgacgagtcccgatgcttctcggtgaacgaggtggaggcgctctttgagctctacaagaagatcagctgctccatcatcgacgacggcctcatccacaaggaagaacttcagctggcactgttcaaaactccaagcggcgagaatctttttcttgatagagtttttttatttgtttgatgagaagaaaaatggtgtgatcgagtttgatgagtttattcattccctaagtgtcttccaccccttggcaccaattgaagacaagatcgattttgcatttaggttgtatgacttgagacaaactgggtttattgagcgtgaagaggttaagcaaatggtaattgctattttgatggaatctgatttaaaattatcagatgacttactcgaggccatcatagataagacatttgaagatgctgatgcggataaggatggaaaaataaataaagaggagtggaaggaatttgcgttacgccaccctaacctgttaaagaatatgacactgccttatctgagggacatcacaaccgtcttccctagtttcgtcttcaacacggcggtggaagattagtcgctccaattgaaggcaataaagcagtactggggattgcttgaggtgcacaaggttcctgaaacctgacggctgttggtcgccttcaaccactgagaatccgatgtgttctgagcatcaaggcagccgccacctgaccatcactcctgctataaattataatataaattataaggctcatccggggtggcagatcggcagcgggaacttacctgatataatttcttgctgccgtttttgcgcagcaatggattgagagtcggtagctgtagatacatctagcttccattctgtacgtagggatccaggaactgtaaatacgttctatggaattgtatcggaaagttcctagtacgccagccagatctagaacaaaaaaaaaaaaaaaacttgcaaaaaaaaaaaaaaaaaa

SEQ ID NO: 18881 - DNA, 1111 bp, Zea mays
atcccgtgataccccgcccaagagagacactggtattgctagtgagaaggaatggggaatcaacttgctggacgaagccgtcaaggagtctggaataaatgaagatggaagcacttggtacagggagagtggagatgatattggcgagaacgggtaccgctgccgctgggcaagaatgggaggacagagccatgatggttccaccgaatggaaagagacttggtgggagaaaagtgactggactggatataaggaattaggtgcggagaaatctgggaagaatgctgaaggcgattcttggtgggagaaatggaaagaagttctgtaccaagacgaatggagcaatcttgcaagaatagagagaagtgctgagaaacaagcaaaatcaggcatagaaaatgctgggtggtatgagaaatggtgggagaaatatgatgccaaaggttggacagaaaaaggtgctcacaaatatggaagattgaatgagcagtcctggtgggagagatggggtgaacattatgatggccgtggatttgttttgaaatggacagataagtgggcagagacagacttaggcaccaaatggggggacaagtgggaggagaaattctttgcaggaattggttctcgacaaggggagacatggcatgtatgtcctggcggtgaacgttggtcaagaacctggggagaagaacactttggtaacggaaaagtccacaagtatggaaagagcacaaccggcgagaggtgggacttggtagtcgacgaggagacatactacgaggcggagccccattacggatgggccgatgtcgtcggagactcgacgcagctgctgtccatacagcccgtggagaggccacccggcgtgttcccggccatcgacttcagctccgcgccgccgccgaaggacgctccgccgggcatgcccccttctcctctggactgagtgaattaggcctgccagcacagacggatttttctgtctatataggctccagattttgcctgtaagggaacagcattctttgtaggaagttgacggaaccccgttcctgcgttcattggttggctcattctttgctacgcattcctttcctctggctgggat

SEQ ID NO: 18882 - DNA, 1639 bp, Zea mays
aaagggtgttgaatcctcatgcaggcagaggcagaaacactgcccgaggctgatgcctgatggtgcgatcccgttccctgtcgccatcgagttcgttttttcgttgcttgacagccttaaagcggcgcacgaatgccacgagccactgaggcggcttcccagttcactccaggcccagggcgcccggtcgccatgaactcccgctcctcctccggcggcgtgcggtccgagagctcgctgtcgttgggggagcgcctctgcgcggtcttcttccccgtcatcgccatcgccgaggccgttttcttcgccttcaccgactgcctcgcggacctctgcaccgactccggctcctcgcactcgcgccgcttcggcgcgggcgcgtcctcctccgccgccaggaacagtcggagcaaccattgccagccccaccacagacctttcctacgccgcgccactgcgggtggatggacctcccccaacctccgccagctcgcacgcctcgccgacgagtcccgatgcttctcggtgaacgaggtggaggcgctctttgagctctacaagaagatcagctgctccatcatcgacgacggcctcatccacaaggttttttatttgtttgatgagaagaaaaatggtgtgatcgagtttgatgagtttattcattccctaagtgtcttccaccccttggcaccaattgaagacaagatcgattttgcatttaggttgtatgacttgagacaaactgggtttattgagcgtgaagaggttaagcaaatggtaattgctatattgatggaatctgatttaaaattatcagatgacttactcgaggccatcatagataagacatttgaagatgctgatgcggataaggatggaaaaataaataaagaggagtggaaggaatttgcgttacgccaccctaacctgttaaagaatatgacactgccttatctgagggacatcacaaccgtcttccctagtttcgtcttcaacacggcggtggaagattagtcgttcgaattgaaggcaataaagcagtattggggattgcttgaggtgcacaaggttcctgaaacctgacggctgttggtcgccttcaaccactgagaatccgatgtgttctgagcatcaaggcagccacccgaccatcactcctgctataaattataatataaattataaggctcatccggggtggcagatcggcagcgggaacttagggggtgtttgggaacaaagtttttctacagttttgaaagaatactgcagtattctcaaatactgcagtattatatacagaatggtgtttggcaagctagctaaaatctcagtttttaaaactgaagtattgcaaatactatagtagttttaagctattctaaacttaagtctggacctcagtttttaaaactgcggtattgtaaactgcggtattgtcatgactaaagtatactgtagtatttccaaaaactttgttcccaaacagggccttacctgatataatttcttgctgccgttttttgcgcagcaatggattgagagttggtagctgtagatacatctagcttccattctgtacgtagggatccaggaactgtaaatacgttctatggaattgtatcggaaagttcctagt

SEQ ID NO: 18883 - DNA, 4528 bp, Zea mays
  misc_feature (482)..(482): n is a, c, g, or t
aaaaaatatagttcccagactagcctaaaaattataggtctataaggttttttttttgccatcgagctttatattcctgcaaaaggattatcgaatattgaaatgaaactcgcgacagacaggtcgtcctctgctccgtggaccctattcctgcgattatctggttgctcacatggacggtgatccgtgatccccggtgaccaagggtgttgaatcctcatgcaggcagaggcagaaacactgcccgaggctgatgcctgatggtgcgatcccgttccctgtcgccatcgagttcgttttttcgttgcttgacagccttaaagcggcgcacgaatgccacgagccactgaggcggcttcccagttcactccaggcccagggcgcccggtcgccatgaactcccgctcctcctccggcggcgtggtaggtgccaggtggctgcaatgtccacccttctcccggcgagtatccccagcgggttnttggtagatctctcctcttctctggattcatctcatggttcctcgtctgttttcttccctggcagcggtccgagagctcgctgtcgttgggggagcgcctctgcgcggtcttcttccccgtcatcgccatcgccgaggccgttttcttcgccttcaccgactgcctcgcggacctctgcaccgactccggctcctcgcactcgcgccgcttcggcgcgggcgcgtcctcctccgccgccaggaacagtcggagcaaccattgccagccccaccacagacctttcctacgccgcgccactgcgggtggatggacctcccccaacctccgccagctcgcacgcctcgccgacgagtcccgatgctgtaaaaaaaatcgatccaagcctactccaccttttgctcttccttggtttctccgcctccatctcgcaatgccgtttcatctgactctgtttcgattgaactgaattggactaaatgaagtctcggtgaacgaggtggaggcgctctttgagctctacaagaagatcagctgctccatcatcgacgacggcctcatccacaaggtgcatccaacaaaatccctcttcgattccctgtatctaccgtccatattcttgtcattcatgacgtgatttggggttaatttgaacatctatttctttgagtgaagtatttcttgctgtacttggaagatgcgattttttttgtttttttagcctgcggacaattgcctccttggctttaaatatggaagaaatagttacataagacctgggatagtgacactctgtcatccccgcatgattgacgagtatattaggccattgagggcgacgtgcaatttagtacacaaatccatctttaattttgcagggcatgcagtggattggattattttctgagggctggattggttaagacaatgtaatattcttctttttgagttgattggagaccgtcatgtgacaagcacacatgacaaaattttaaaagtttgtttgacagcccattaagattgctcgcctgaattttcccatattccgtgtgccattatatcctaggataacacctgcatctcggtatgcttggatccctgtatgcatgattgaagagtaggtgattgaggacgatgcttaacttagtacatagatccatgttgatttgttgcactacacgcaatggattggattatttcttgaggactgaattagctaagacgacatcttattcttctttttgagtcgattggagactgtcatgtgacaggccacatgagtgcattataaaactttgtttgacagcccataggatcacttgtctgaattttcccatgttgcgtgtgcaattgggtcgtaggataacacctgcatctcagtatgcttggttgtcatgttccttcctctgccataccaaggttgaaggttttgattggtgaagcatgtgatcacattttttttattaaactaacacagcagcaatttttgtgtgcgtgtgatgcggttcaaaatcagagaaatatttttcagccttacattttcagcagcatcttctatgtgtgctgtgtgcacaatagtccaattagaaaataaaatatgaatgtccttgctcgtttttgtatgcaactagacgaatggccaatgtcatattgatttttcttaaccattccactgctggatggttcttcatcaggaagaacttcagctggcactgttcaaaactccaagcggcgagaatctttttcttgatagagtgagtatttactgtgcttttctctttgtatttgttttcataataattcttgatttatttactacgccatacacagcgcttctccatttctttgctgattatcctcaaaatatttatatcgcatgctgtcaacatagataatggcacgaaactaagattgtctccgtgatccaggttttttatttgtttgatgagaagaaaaatggtgtgatcgagtttgatgagtttattcattccctaagtgtcttccaccccttggcaccaattgaagacaagatcgattgtatgtatgctaactgcagaaacggtggtcaatataataataataataatatgtaggcttttttatatttatatttgcagcatgcatttcgtatgtttcagttgcatttaggttgtatgacttgagacaaactgggtttattgagcgtgaagaggtaagctcgcaaagatgttctgtatctatgcataccttttatgtggattcttttctagtaaagtggctaattgccatgccttgccttataggttaagcaaatggtaattgctatattgatggaatctgatttaaaattatcagatgacttactcgaggccatcatagataaggtaggcaataatcagctggaatgcccccaggattttttttttttttttgtgggcgcagtgctgatgtttttgtactcaatttcccagacatttgaagatgctgatgcggataaggatggaaaaataaataaagaggagtggaaggaatttgcgttacgccaccctaacctgttaaagaatatgacactgccttatctgaggttcacccccgatctcctgatctttatgaaaagtaggttagcctgatgtcctgtcaaacatattaatatgtgcagtccttccaaaaaaaggaactgcacagaaaaaaaaggggtgatgcgtaattacaaggcagaacttcaggagagcttactttgctgcctttttgttttttgttaacgcaataattgactgattccgtggtccttaaaaatctgagggacatcacaaccgtcttccctagtttcgtcttcaacacggcggtggaagattagtcgttcgaattgaaggcaataaagcagtattggggattgcttgaggtgcacaaggttcctgaaacctgacggctgttggtcgccttcaaccactgagaatccgatgtgttctgagcatcaaggcagccacccgaccatcactcctgctataaattataatataaattataaggctcatccggggtggcagatcggcagcgggaacttagggggtgtttgggaacaaagtttttctacagttttgaaagaatactgcagtattctcaaatactgcagtattatatacagaatggtgtttggcaagctagctaaaatctcagtttttaaaactgaagtagtgcaaatactatagtagttttaagctattctaaacttaggtctggacctcagtttttaaaactgcggtattgtaaactgcggtattgtcatgactaaagtataactgtagtatttcaaaaactgtggttttcaaaaactttgttcccaaacaggacctaaaactgtgaaaaaactttactcccagacacccccttagtttagtataaaggtacacagaccaccaaaaagcacagagaacggaggcagcacagatttccttctcccacaccactacaatgcctcgcacactattctttgttcaatgccgttcatgcggtgaagccgccacccttcttcgtgatgactctgcatattgtgtcctttccctactcccctatagcactccacagcactagccctgcccggctgcccccttgcttgcttgctgtgctactgcccctcagttagtctgaatgctgggtgtgctacccctctgctactctgcccgcgcatccgtggagtcccctgcacgcgagtgggtcgtctctcctgctcagccaccgtcgctgtgctttgccgtgcagtcacctgcacgcgaccgctcggttcccgacatcatcaactcctcccgcccggccgccgcgtctcctatctccgtcgtggccactgtccaggaccggtgttgcggccgccgtctaggtctcttgcctggccgctgtttcgtcgcggcctccgtccatcggccaggaccagcatcgtggccactgtcctgggtgaggtctctcgcccagccgctgtttcgtcgcgaccttatttcgcctacgacttccacttctgctgggccaccgtctaggcctggtttcgctgtgagtctctcaccgtgtggcccctgca

SEQ ID NO: 18884 - DNA, 1726 bp, Zea mays
cctgtaattctgttcgtgtgcgtgtaatttccgtgcaaatacacgcacgccgattttcgatcgcggcctggccgggaaaaaaaaggcgacggcaaggaatcccccgattaggaaagattctccgctccccgccttcaaatcccccaccggccaccacccccccgctggattcgcctacgctctgtgctgccgaggtcgggattggtgctggaattcggtgcgccgagttgttccttgctcgattagacttccggttcggttcgcttcgttccaatcggggtttgctgcttccgccgccaccggtgcgctccgagctgctcaagctgggcgccggataccctctcgggctgcccgatctgattcagtccccaacaccacccccgctccgccgctgtggctgccgctcccctccccgctgactccggcgccatttcgacccgcgcggccggatccttggatggttccgatcgatccgggaccaagagacccaaggcttcgtcacctcacccgggccccggcgccggtggatccatggccggggagaaggcgccgcgcgcgttctccatcgaggagctcccgggccacctcatcggggaggtcctgacctcgggtgggctcgctgccgccgacctcgcgaggctcgaggccacctgccgcgcgctcaggccgctcgccgagtacgccgcgtccaagctctgcgccgcgcgggcgggcgttcgctgccatggggccagccgcccggggtgagctgctggagaggtgccggggaagctggaagagggggctcaggttcctgcagtccgtagagcagtcgtcaggcaccgtcgagacctcatcgggcagcgtgagcacttttttcccctttcacttcactctacgaggtctaatgaaaattcaatctccatagtatgtacggacatgagattatcttgtgttttagaagggacttgctaaaattcaggtgcttgaattttagttttcattcaggcgatggttattgcacatattttatattaaaattgcaggcaactttggtagacacaatctatattttttttgcttccgtgaataagaaacccattagacaaaatcataaacccgacgatatcttatttgtattggaacaaagacaattaataatgcacaattatttctatattcagacaaggacaaaaattgatatgttgggacataaagacatcacaaaagtaacaatttacttatactagttggtgatgcatgagtattacctgagatcatcttaaaattcaggcacctgaaagataggataggtggtcttagaaattttcgcctcacactctgaaccctgcccactttggaatattgtaattaccaagacttgtttaataatgctggcttatgtgctaaagctttaaaagaagctaatgatttgaagctgataagcacacccatgtctggcttaaatgggataactagcacatgttagtcattataaacagatttaagacattctttgctaggcaaatatggatcaagtttttaacaacttatctcagattgattaacatgttaatgctgccgtgcatcgacatgctgttatgcattttcctgtgtcaaacaatggtaacttcgtaatatactgcacaattacactctaaaactgtttgaaagtgattatttgtgatggtgaaatcctggtaaatttagttgctattgtgcaacaaatgttctaattactttaaat

SEQ ID NO: 18885 - DNA, 1417 bp, Zea mays
  misc_feature (3)..(3): n is a, c, g, or t
ccncccgccgggagttgtcacgccccaaagaccggcaccccgccgggtccgaggggcatcgcggcatcggcatcgccacaaagcccatctcacagccccgcagcctcttctcctcgtccatctcttccgcctccctccccgcgccgccgttcgccgaagccccgcgtcgcgtcgcgtagagtgcttgatggctgccgcaaggggcattaaccagcttctgaagagaattctccacaaccagtccgctggtccatggctgctttcttcatttcggggaaatcatgaagagtcctctgctggattgagagcattggcgcttcttggagttggtgcctccggtcttttgagttttgctacaatagcatctgctgatgaagctgagcacggtttggcagccccagattatccatggccacatgctggcatcatgagctcttatgatcatgcatcaattcgccgagggcatcaagtttacacacaagtttgtgcttcttgtcactccatgtccttgatttcataccgtgatttggttggggtggcctatactgaggaggaaacaaaggcaatggctgctgagattgaggtcgttgatggtcctaatgatgagggtgaaatgttcacccgccctggtaaactcagcgatcgctttccacagccttatgcaaatgagcaagcagcccgatttgctaatggtggcgcctacccgccggaccttagtcttatcacaaaggcaaggcacaatggtcagaactatgttttcgctcttcttactggataccgtgatccacctgctggtgttcagattcgtgagggtctgcactacaacccctacttccctggtggtgccatagccatgcccaagatgctcaatgatggagctgttgagtatgaggatggtactcctgcaactgaagcccagatgggtaaggatgttgtatcattcctttcatgggcagctgagcctgagatggaagagagaaagctgatgggagtgaaatggatctttctactatcactagcgcttcttcaagctgcatactaccgccgcatgaggtggtcagtcttgaagtcccgtaagctggtcctggatgttgtcaactgaggactaccattacccttttttatatttaaatatgagctgttaaggagtattcaaaataatgaatttgtgatgtacaattttgccactgggggctaggttccatgcctagagattattttgttttctttactctgctgagctgcaaaagcatttcaccaacgggtacatttcacgttttttttggtttgcaatgcctcgatgttatcagcaaccttgtaacttaacagctgatgagagttgataaattcttgtgctatgaaatacacctatcgtatgtcttggtctaaacaagagactatttctctctcctcgtgc

SEQ ID NO: 18886 - DNA, 1460 bp, Zea mays
caaacccaaagaccggcaccccgacgcgtccgggttcgaggcgcatcgcggcatcggcatcgccacaaggccctctcacgctcacgcccccggacccttctccccgcgccgccgctcgccggagctccgcgtctccgcccgcgccacaccctgtagaatcctcaatggctgccgcaaggggcattaaccagctcctgaagagaactctctacaaccagtctgctggttcgtcgccgcttttctcatttcggggaaagcatgaagaatcctctgctggactgagagcattggctcttcttggagttggtgcctctggtcttttgagtttttctacaatagcatctgctgatgaagctgagcatggcttggcagccccagattatccctggccacatgctggcatcatgagctcgtatgatcacgcatcaattcggcgtgggcatcaagtttacacgcaagtttgtgcctcttgtcactccatgtccttgatttcataccgtgatttggttggcgtggcctatactgaagaggaaacaaaggcaatggctgctgagattgaggtagttgatggtcctaatgatgagggtgaaatgttcacccgccctggtaaactgagcgatcgcttcccacagccttatgcaaacgagcaagcagcccggtttgctaatggtggtgcataccctccggaccttagtctcatcacaaaggcaaggcacaatggtcagaactatgttttcgctcttcttactggatatcatgatccacctgctggtgttcagattcgtgagggtctgcactacaatccctacttccctggtggtgccatagccatgccgaagatgcttaatgatggagctgttgagtatgaggatggtacacctgcaactgaagcccagatgggtaaggatgtcgtatcattcctttcgtgggcagctgagcctgagatggaagagagaaagctgatgggagtgaaatggatctttctactatcactagcgcttctccaagctgcctactaccgccgcatgaggtggtcagtcctgaagtcccgaaagctggtcctggatgtcgtcaactgaggactatcattaccctttttttattgaaatatgttgagccgttaaggagcattcaaaataatgagttggtggtgtacaattttgccactggggctaggttccatgcctagaaattaatttgttttctttactctgctgagctgcaaaagcatttcaccaagggagtacatttcacggttttttttggtttgcaatgcctcaatatcaccagcaatcttctaacttaaaagctgatgggtctcatgctatggaatactcatatagtcctatcgtacggttgggcctctcttaaagtcatattttgtgttcgcttatattgggttgcatggttatggttaaatataatcatttggagccttgaaaaaaaaaaaaaaaaaaaaa

SEQ ID NO: 18887 - DNA, 1355 bp, Zea mays
ttgggaccctcgaggccggccgggaaaagcccgtgcacgcccgacgggtccgagttcgaggcgcatcgccatcgggatcgccacaaggccctctcacgctcacgcggtcacgcccccggacccttctccccgcgccgccgctcgccggagctccgcgtctccgcccgcgccacaccctgtagaatcctcaatggctgccgcaaggggcattaaccagctcctgaagagaactctctacaaccagtctgttggttcgtcgccgcttttctcatttcggggaaagcatgaagaatcgtctgctggactgagagcattggctcttcttggagttggtgcctctggtcttttgagttttgctacaatagcatctgctgatgaagctgagcatggcttggcagccccagattatccctggccacatgctggcatcatgagctcgtatgatcacgcatcaattcggcgtgggcatcaagtttacacgcaagtttgtgcctcttgtcactccatgtccttgatttcataccgtgatttggttggcgtggcctatactgaagaggaaacaaaggcaatggctgctgagattgaggtagttgatggtcctaatgatgagggtgaaatgttcacccgccctggtaaactgagcgatcgcttcccacagccttatgcaaacgagcaagcagcccggtttgctaatggtggtgcataccctccggaccttagtctcatcacaaaggcaaggcacaatggtcagaactatgttttcgctcttcttactggatatcatgatccacctgctggtgttcagattcgtgagggtctgcactacaatccctacttccctggtggtgccatagccatgccgaagatgcttaatgatggagctgttgagtatgaggatggtacacctgcaactgaagcccagatgggtaaggatgtcgtatcattcctttcgtgggcagctgagcctgagatggaagagagaaagctgatgggagtgaaatggatctttctactatcactagcgcttctccaagctgcctactaccgccgcatgaggtggtcagtcttgaagtcccgaaagctggtcctggatgtcgtcaactgaggactatcattacccttttttttattgaaatatgttgagccgttaaggagcattcaaaataatgagttggtggtgtacaattttccactggggctaggttccatgcctagaaattattttgttttctttactctgctgagctgcaaaagcatttcaccaagggagtacatttcacggtttgtttttggtttgcaatgcctcaatatcaccagcaatcttctaacttaaaaaaaaaaaaaaaaaaaggcca

SEQ ID NO: 18888 - DNA, 865 bp, Zea mays
attgggacctcgagccggccgggaaaaaaaaaaaaaaaccctggaatctcgcccaccgccccactcgccgcccccgctggtcatccctccacccaaccccgctcctcggggaccgctcgtcgccggagccgccggcggcctcgagcgatagggatcgacagcgagcgcgcgagcccgtcccgcaacctgatctgcgaggaccaccgggtgggaggctgcgagatcgacgacgggctcggttcgattcggctggcgcgagcaccagcctatctgagacgggcatcggcggcggagagacctggcgcgcggcggaacgctgagattatcttgtatagttgtattctcgtcaagacaactctcttccctcagagcactgaacaatcattgtgatttatgactaactctgagtggtgaaagaattaagaaaatacagaacactgcaatggctgttagatgctcctgtattgctcttttccctctactcttctgttttatgatctgtcagctttgctatggcacaataactgatatccaatgtctgaagaagctgaaggcatcagttgatcccgacaataagttagaatggacattcaataacaatacagagggatccatatgcgggttcaatggtgtggagtgctggcatcctaatgagaacagggttctttcgcttcatcttggtagctttggtcttaagggcgaattccctgatggacttgagaattgtagtagcatgacttcgctggatctctcaagcaacagcctctctggccctatcccggctgacatctcgaggagacttccatttgttacaaaccttgatctgtcatttaatagcttctcgggagagataccagaagcgcta

SEQ ID NO: 18889 - DNA, 849 bp, Zea mays
gccggccgggctgccctagactttagtccacgggccccccgggccccaaaccctggaatctcgcccaccgccccactcgccgcccccgctggtcatccctccacccaaccccgctcctcggggaccgctcgtcgccggagccgccggcggcctcgagcgatagggatcgacagcgagcgcgcgagcccgtcccgcaacctgatctgcgaggaccaccgggtgggaggctgcgagatcgacgacgggctcggttcgattcggctggcgcgagcaccagcctatctatctgagacgggcatcggcggcggagagacctggcgcgcggcggaacgctgaggttatcttgtattctcgtcaagacaactctcttccctcagagcactgaacaatcattgtgatttatgactaactctgagtggtgaaagaattaagaaaatacagaacaccgcgatggctgttagatgctcctgtactgctcttttccctctattcttctgttttatgatctgtcagctttgctatggcactgtaactgatatccaatgtctgaagaagctgaaggcatcagttgatcccgacaataagttagaatggacattcaataacaatacagagggatccatatgcgggttcaatggtgtggagtgctggcatcctaatgagaacagggttctttcgcttcatcttggtagctttggtcttaagggcgaattccctgatggacttgagaattgtagtagcatgacttcgctggatctctcaagcaacagcctctctggccctatccccgctgacatctcgaggagacttccatttgttaccaaccttgatctgtcattttatagcttc

SEQ ID NO: 18890 - DNA, 2259 bp, Zea mays
ttttgttgtgtctggagctcgtacggtagaagggtattatgataatctggcagcagagggtgaattagataacaaacgttcagattctcgaacctcggaaggtgttcacgagaagtggattggacaaatagagaaggatttgcccagaacttttcctggtcatcctgctttagatgaggatggaagaaatgctttgagacgcttgcttatagcttatgcgaaacacaacccatcagttggttactgccaggcaatgaacttttttgctggtctcttgcttctattgatgccggaggagaatgcattttggacattggttgggattatggatgactattttgatggctacttttctgaagaaatgattgagtcacaggtggaccagcttgttttagaggagttagttcgagagaagttccctaaattagcaaatcacctggattaccttggacttcaagttgcatgggttactgggccatggttcttatccatcttcacaaatgtgcttccttgggaaagtgttctccgtgtctgggatgtgcttttgtttgatggaaacagagtaatgctgttccggacagctcttgcgctactggagttctatggccctgctcttgtgactacaaaagatgctggtgatgcagttacccttttgcagtctttagctggttccacttttgacagcagccagcttgtcttgacagctcgcatgggataccaatccgtaaatgaaacaatattgcaagaactgagtaataaacaccgcccacctgttatatctgcaatggaagaaagagcaaagggtctaggtgtttggacggataccaatggtcttgcatcaaaactgtataacttcaaacgtgaccctgaaccgctggtttctttaagtgattcaacagaccagttgagtgatgtgggagatggggataccaatcaagaaagtgatctgggaaacatggatgacgagtatggtggtgtaatagtgaattctgagattgattctttgcctgatccaaaggaccaggttgcctggctgaagttggagctgtgccgactcatagaggagagaagatcagctgttctcagagctgatgaactagaaacagcacttatggaaatggttaagcaagataacaggcgccaattaagtgcaaaggttgagcagtttgaacaagaaatatctgaactaagacaggccctgtcagacaagcaggagcaggagcaagcaatgtttcaggtcctgatgcgtgttgaacaagaactaaaaattgcagaggaagctcgcatctcagctgagcaggatgctgctgctcagagatacgcagcaaatgttctacaggaaaagtatgaggaagctatggcttcacttgcccaaatggagaacagagctgtaatggcagaaacaatgttagaagctacactgcagtaccaatctagccagcagaaagcactgtccccttgcccttctccaagaccatcgatgctcgacgcatcccctagtcagtcaagccagaattcatcgcaggagttccagccaagaaggaaaaacttgcttggcccattttccctgagttggcgtgataagaacaaggaaaaaccgaacaacgctgatgactccaccaacacagtttacaaacaatgatgaaatggtagaaacctccaacacaaatgatgagaagcatagagaaacactagatctagatagtgaacagagagcggaatcacccaaagcagatgtcaagatgagagcagagacacctgagaaagacaacgacctgacaggggtccaactagtcacggacgatttgaatgggcaccacgaacagatgcaagaaataaaattggattgataagcattaagcacaatgctcccagtccaaatatcttcgccaccacgtaagtaatatcagagtatttatgatctgatcacacggtgccagttggtgacagcactgagggtggctaagttttgaaatgctactggtctcccccctcctctcccctttccctttgtggttccccgaattctttttgccaccacatctaggttacatgtcgtttctctccattttttataattttgaggagaaaatgagcaagttatatatggttgtccattcgttgctgcctcccaatgtaaatgcattggaagaactgtgagaaaaaagatgagaattgtgggcaattatgacacccttattcttgtaaattatcatatcatttagagtcaaaaaaaaaaaaaaaaaagaattcctgcag

SEQ ID NO: 18891 - DNA, 3994 bp, Zea mays
  misc_feature (691)..(691): n is a, c, g, or t
  misc_feature (3958)..(3958): n is a, c, g, or t
ccggtgcgagagtgttgaaccaaactattagtaagttttaaggcaatatctttgccacatacaagaggtacttttcttgaactatatcatagtctagaagtgtttgttttatgtagaaagtttgcacacaacaagcacccacgataacttttttaccggttaacaaaaagcactattttgttttttagatgatcatgaaaccagtgatctaccaagtatatgacaccttctagatgtgttttccctatgtattttacaactcacataattcgaattagaatagccaacaagctcaaaactagctcctttgaaataccaaagaccaatgattggtgtatgctttaggtacctaaagattcttattacgacacttgagtgagattccttgggattatcttaaaatatagcacatatacatacactaaatatgatgtcaatgctaaatgcagttaaatattacaaactacttatcatataacgttggagagtttgattaactcgtttacctcccttatctgggcccaaatgtgatggcatcggagtcttgattggcttacattcatgtatcttgaatatttgaggaagtccttggtgtacttttattgagagatgaaatttttactctctcatttttttgacttaaaagtcaagaaagaatgtaagatttttgggaagcgtcctcatgcgactnctcgcaatcttctcgtcgatcgtgctatcgacgcagtcatcgatcctgttgctttcacgtcatcgaccttggcgacatcaatatcaatcagtatgtttaatcaatacacatcatctgatctgatatcatactttagtttatatgtcgttatagatgcgttctgcgtactgcttactagctgtgagggaacatactgctagtttatttattgttggtcatgatttatatttagaatttaatctagaaaatgtctaattattcaacactctcaactttacaagcgcacacaattaccatctatttaagctgggtcgatctttactcaaatcttaaatgaaacaaagactttactttcacctagtatttaatttaggtcatacaatctatttgaatttaattgcatacagttatgcctcgtctaattaaaatccaaggacctagagccatagttacttgtgctttcttctttgtcaaagttatacaggtaacaggaagggcggaggcaatgccgatcttctcaagctactttctgcacattcttggctcttctacaactctcatctttcatccgaaaaggtgaagatcctagtgtgagggcattatttagtctaagatatgcactgcacccactcgtgggccggctgcctatatactttccctacctttcgaaacgattccagagtaggagtgagccagaaggattccaaaaccacagctctatccaaactacgaagtacgaacgatgaacagacgcttagcgccattcaaagaactcgctgcgcgcggcgcgccacagctcgcgtgcgtcccttgcgcccgaaagcctcagggccactccagctacagcctgtcttgacccgtgtcgaacgctcctctcgccactcaaagtatcgtgctagagctctgctcactatatagagcggccactgctatgttcgtgatgaatcgctacgagcacagctagctagctacgacgtcgatccagaactgcacgccagtctagctagtgggccaggcttcgtcctcgaccagaaagttaaaccgggcgggtgctgctagctggtccgatccgttggagagagacgatggcggagcccagacgcacgcggccgtcgacgttccgatgcgccgcggcgacggtgctggcgctgctggtggtggtcgtcgtcatcgtcctcctgtggctcttcctccacccgtccaagctctacttctccgtagaccacgccggcacgacgggcttcaacttcacggccgccggcgggctcgcgggcgcgttcgacctcaccctgcgcgcctccaacccgaacgagcgcgcgagcgtgtcgtaccgctgggtcgacgtcggggtctggtacaacggcacgtacctcgcgggcgcccacgcgccgggcttcttccagcggcccggggacgagacccggctggacgtggtcgcgcgggcggcgccggacgcctgggtgctgccgcggggcgtggaggagggcatgaagaaggagcgcacggccggcaagctggcggtggacgtgcacgtcgtcgccaaggtgcggttccgctacggcgtggtgcggacgcgcaagtacaccgttcgcgccagctgccccgcggtccccgccgagtttgtgccgccgacctcgttcgaccgggtgaactgccacgtgcacatatgagttttacgaaaccctgcgtgagatggtccaagggattaagctctgggtggattgattggttggttggttttatcgatgccttcttttcgtgctatcttggtttgcttgttgtctgcatgcttatttaatttcttcgcttaattactctattgttttattttatgcaaactgattttcatggattggcgatgtaattatctgtaagaaaatttaatttgaaccaacgtacggaggttgcatgaaaaaaaaaaaaaaaacagctcgaggctattttttgctgagaattttggaccaactagttttcgtgtgacaggttgttccccatggttggctgagttttttcctttcatttcagtgaggctgtcgtttggcccaaacaagaaatgacagtttaaataggagcctaattttaataaaattcttctaaacgttttggagtctaacttagagcttgtttggatgcgtctggatcgaaggagattagagaaaattaaatctctctatagttaaaattaaatagaagaggatttaacccttatgatctagacccagcgggacccgcctttaaagagtactatatttggatctcagagaaggatattttaggcttcttcttcgccgccgacatctgctcccgatccgccgccactcgacttccctatctcccctggtctgtctccttgccgcccattcccagctcgtgtttgttcccatctcggcaacgtggaagcctcccgctcttccccatcctcgtgcttcttctggtctgtctctttgctcccctccctccttgctcccctcctcctattctgcttcgtgcctgagatggattgaaggccgacgtctccaagctcacgttcatcagcgaggtctagatggttttccttgaacacaactctagatacaattagagctgtgtcatcgctcatcggccgcccgtgaagcgtcttgtgaggttccaccggcgtctcatcgccgtgcgtcaactagcaccatcgaaccacgttctacatctcaaccgtcaccccaagcaccatcatctatcatggatgcctaggtatatacaagtttttttgttcttatggattccagattttagtgttgggcatggctgagaagtccacatggtcatcatgtgtcgacataaaaatactactggattcttttagttcgtcaaactgccaaagaactatgtgaatatgtggaagacaataatagcattgaaagactctgatagaccaaagaaagtatgttatatacataaatcggtagaaacactacatctattataataactggttctttcacatgaccacattacatgcctttttaagttgtaggacaaattttccacttccaatatatatggtcaacactaccaaacattccaaaaaaacccacgttgttccacaatagtaagaaacctagtcgtatcattttcatttagaggtctcagatattctggtccaaaaaccacatatagtgacctgataaatttccgtaggctctcgatactcgtgctttctccaatccacaaatactcatcaaatagtatgctagaacaccacagacaagttgtctaaaagctacaataacnttttgaagacaggaaaaaccaagagcaccgacatca

SEQ ID NO: 18892 - DNA, 1476 bp, Zea mays
gttactccaggtctccagcccaaccaacgccacgtacaggtacagtacctgtagagaggcagaggcagaggcagaggcagaggcaccaaccttttggacatccctcctccactccctaccaacgacctctgctcatcctaagtttgccaatttgccgctccttcacttcacagttacagtagattacctccatctctcagacggaacggaggaggagagccatgtccagccccacgcacgccaggctcgcgcagcaaggcaaggccggcgtggcgctgcgcctgctcctctccgccgcgctcgccggcttcctcctcgtcttcgccgcgcgcaccctggtcacgtcgcctgtcccggcatcgccctcgtactcgtcgcagccgcatccgctgccgctgcccgtggcggaggcgctggtgcactacgccacgtccaacgcgacgccgcagcagacggcggaggagatcggggtggcgctgcgcgtgctacagcggcgcgcgccctgcaacttcctggtgttcggtctgggcctcgacagccccatgtgggcggcgctgaaccacggggggcggaccgtgttcctggaggaggacgcggcgtggatcaccagcgtgcggggcaggcacccggcgctggagtcccaccacgtggcctacgacacggcgctggccgacgccgacgcgctgctagggctccgcgcccacccggcctgcgtcgcgcagcccgacctcgcggcggccgccgccgcgtcctgccgcctcgcgctccggggcctcccgcccgtcttcgccggcctcgactgggacctcgtcatggtggacgcgcccacggggtggacgccccgggcgcccggccgcatgggcgccatctacaccgccggcatggcggcgcgcgcgcgcaggccaggggccggccccacccacgtcttcgtccacgacgtcgaccgccccgtcgaggacgccttctccagggcgttcctgtgcgagggctacctcgccgagcaggtcggacggatcaggcacttcgtcatcccgtcacaccgcgacaaggacggcacgccattctgcccttgatcaagtttgttctgctttggtttggatcccacggtgcccattgccaaactactacagtactattattgctgcatagatgttgctttgcagttgctcattctacactgatgagtgcctgagatttgggtagacgattacaatgtaaaatcgacaacttgctttgtctgttactcggatgaaaaactccagggtacaaaaaaaaaaaaaaaaaaaaaaaaaaaaaacctcatcctaagtttgctaatttgcctctcctcacttcactagttcacttcacctcacttgcgcaatcgcccccgccgtcacgacaccacccagccgcaacagtagattacctcgatctctcagagggccaccaaggcggaggaagaaagccatgtccagccccacgcccgcccgcaag

SEQ ID NO: 18893 - DNA, 844 bp, Zea mays
  misc_feature (712)..(712): n is a, c, g, or t
  misc_feature (753)..(753): n is a, c, g, or t
  misc_feature (764)..(764): n is a, c, g, or t
ggaggcgaggaggcgctccggattgatccatcctacggccgcgcgcaccaccgcctcgcgtcggccgcgtgggggctaggacacattgaggatgctctgaagcacctgtcacttgcaatcccacagcctgacctcctagagttgcacaaattgcaaacagtggagaagcactttgggagatgtctggatgcgcgaaaggctggtgactggaagagtgtgctaagagaaagtgatgctgctattgcggctggggctgactcctctgctctgctcttggctgctagagcagaagcccttttccgtctcaatttacttgatgaggctgatgttgcaatctctagtgcctccaaattgaattatacatcttcatgctccccagacaccaaattttgcgggtttattgccaacgcctacctcttttatgtacatgcccaagttgacatggcattaggaaggtttgaccatgcggtgtcctccatagataaggctagaataatagatccaggaaacactgaagtgataaccatgcataacaaagtgaaatctgtggccagagcacgatctctagggaacgagctcttcaattctggaaaattttcagaagcttgcgttgcttatggtgaagggctgaaacaacaccctgtgaataaagtcctgtactgtaataggggcagcttgtaggttcaaacttgaaccggggtgggagaagtcnaattgaggactggtaatgaagctctcaagattcaacctaanttataccaagngctttgctcaggcgggcagcatcttatggcaagaatggagcgatgggcagaaatctgttgaagggattatgagattctca

SEQ ID NO: 18894 - DNA, 1392 bp, Zea mays
gcccttctccgtctcaatttacttgatgaggctgatcttgcaatctccagcgccgccaaattggattgtaggccccccccccccatcttcatgctcctcagacaccaaattttgtgggtttcttgccaacgcctacctgttttatgtacatgcccaaattgacatgtcatcaggaaggtttgacaatgcggtctcctccatagataaggctaggataatagatccaggaaacactgaagtggtaaacatgcataacaaagtgaaatctgtggccagagcacgttctctagggaacgagctcttcaattctggaaaattttcagaagcttgcgttgcttatggtgaagggctcaagcaacaccctatgaacaaagttctgtactgtaatagggcagcttgtaggttcaagcttgagcagtgggagaagtcaattgaagactgtaatgaagctctcaagattcaatccaattataccaaggctttgctcaggcgggcagcatcctacggcaagatggaaagatgggttgaatctgtgaaggattatgagattctcagaaaagaacttccaggtgacgcggaggttgctgaggcctatttccacgcccaggttgctctcaagtcatctcgtggtgaggaggtatccaacatgaaatttggaggagaggttgaaacaattataggaatggaacagttccagatggccacatctttgccaggtgtttcagtcatccatttcatgacgccttcaaatcagcagtgctgcaaggtttccccattcgtgaacacactgtgcgccagatacccatctgttaatttcctcaaggtcgatgtgaacgagagccctgctgtcgcacgcgccgaaaacgtgaggacaattccaacgttcaaaatctacaaaaatggtattagagtcaaagagatgatttgccccagccaacagctgctggaatattcagtgaggcattttgggatttaggccatgaagccccccgatggttcgatgttcgtttccttctgcctccagctagcttctctggagcgagcacagcacaggctttagccgggagcagaaccagtcaagctcatcttgacgaaggcaagcatgaaaattggaaagcgaagagcaactcttcctcggcattttccacccccacagccccttacgtttttcgtcctattctccatttgttgattacctgcttaatttattctttcaatctgtctcgtccgtacatcattgttgccaaatttctttagaacaaaagaaacatcctctcctgattcatgtgaagaatgactgtacatttttttacttccatgtttaccagacaaccaaggaaagaaaggtatagattgcattttgtacgcaagctaattacatcgctattgcct

SEQ ID NO: 18895 - DNA, 1132 bp, Zea mays
ggcaaagaaaaaggaactatctctggagaactttctagcaggcatgtgggttcttgttgccgcgtggaaaagaggggctttaggcatatctgatttgaatgttgacgaccgaactgttaacctagctgatataactaacagcacaaaggagaacaaaggtggaaagaattttgctctagttgagaagcaagcatcagaagattctgtgaagtcactgagttcagaagaacatacaagtccggagtttgaaccacttcttgttcgtctgaaggctaaaattcaggagatgaaggaaaaggacattgatcccctgaccgataaagatgggaactcacatgtctgcaaagtttgtttcgaatctgcagccgctgcagtattgcttccttgccggcatttctgcttgtgcaagccttgctcgcttgcctgctcggagtgccctctgtgccgcacaagaatcgcagacaggataatcaccttcacgtgagctgcgttctagcttcaggtcattctgaagcacacatcctcttgtaaaatcttcaatggtatatgtttctctttttccttagcaaagaaggtgccttttatgttccttctgtgttgtatcgccattctttgggttccccttcccctatagcttcacgccttcaccttacgttctttgttgtatcgaggagttacaaatgatgacttctcgctctgcaaatatgtatagatacgcaactcgacgctgtaacacattttgattctctactcctgaagaaaagcagcgaacgacatgatgacgtgtgtaaaaaaaaaaaaaaaaaaaaaaaaaaaaaaaaaaaaaaaaaaaaaaaaaaaaaaaaaaaaaaaaaaaaaaaaaaaaaaaaaaaacaaaaaagaaaaaaaaaaaaaataaagacaaaacatattaagaaaacctatctcaagaaaaaaaaaaaggtggggccgggtttataagggtccaaagtttactgccatgctccttgacaataaaatttttttttttggggacgcaaaataaaaatagaggggcggatatttaaaaaatgcgaagggggaaaaaccccgggtccccaaaaattaatcacctggacaaaaatcccttttttcaccgggtgttttaactaaa

SEQ ID NO: 18896 - DNA, 939 bp, Zea mays
gtataaagggtcgtacaaccagtaggggtagcgacgaggttgggacgggcgcccccgccctgggggcctggattgttgtgctacaggccagaagacagagggaggctgctttggaagctgctttggcagagaaggagcttctcgaagaggagtacaagaaaaagtttgacgaggcaaagaaaaaggaactgtctttggaaaacgatctagcaggcatgtgggttcttgttgctaagttaaaaagaggggctttaggcatatccgattttaatgttgatgatcgaactgttaacctagctgatataactaatggcacaaaggaaaacaaaggtgaaaagaattttgctctagttgagaagcaagtttcagaagattctgtgaagtcgctgagcacagaagaacatagaagtccagagtttgaaccacttcttgttcgtctgaaggctaaaattcaggagatgaaggaaaaggacactgatcccctgagcgataaagatgggaactcacatgtctgcaaagtttgcttcgaatctgcaaccgctgcagtattgcttccttgccggcatttttgcttgtgcaagccttgctcgcttgcctgttcagagtgccctctgtgccgcacaagaatagcagacaggataatcacattcacatgaacggcgtgctagcttcaggctattctgaagcatggcgcactcttgtaaaatggtcggtggtatatgtttctcttttttccttagcaaagaaggtgccttttatgttccttctgtgttgtatcgccattctttgggttcccctatatggctatatagcttcaccttacgttctttatcaaggagttgcaaacgatgagaccccattggaatgcaggaattgtacaggaatttcacaaaagttcattttcatagaaaaaacacaacaaacaggcacaccccaaaa

SEQ ID NO: 18897 - DNA, 1606 bp, Zea mays
ttgggaccctcgaggccggccgggatggggatgcaagcaactcggggaacaggggggagtgcgtgggatcctctagcgaacctacaagaaatatggagaaaggagaagtggtagaattcactctgcctttccattcccccatccgccatggcggcgccgccggagctcgttgacgacacgatcgccgagatctgcctccgccttcccccggacgagcccgcgcacctcgtccgtgccgccctggtctccaggcgctggcgccgcatcctctccggcggggccttcctccgccggtaccgcgcgttccacggggcaccccctctgctcggcttcgtcgacaacaccatcgggctccacggcgccacggcccctcgcttctcccccaccacctcatccggctcccctttccccaggcggacgttcgactgcatctgctgggaggccctcgactgccgccacggccgcgtcctcctcggcctcttcgccgagagggtcaacctcgtcgtgtgggaccccgtcaccggcgaccactgtgggctgcctgaccccggggtgctccccggttactacagcgcggcggtgctctgcgccgcgcgcggctgcgaccacctccactgccgcggcggcggcccgttccgcgtcgtcctggcgggcatggactacttctcaagggacgccggcgtgcgggcgcgcctctactgctcggaggccgctgcctgggtcgcctctgctcagctggcctccgattcccatgtcatgcggaagcccagcgcgctcgtcggagacaacgtctacttccagctcatggagggtgacgtgtttctgaggtacgacatgggcaggaaccgtctgtccaccttcgaccctccggcggcgcacgtcgacgaagggggcgtcgtgctcatgcccatgggcggtgacggctcgctggggcttgccggcgtcaggggatcaaggctttgcctgtggtcgacgagtgtcggcgcagaggggattggaggatgggttcgacgcggggacattgagcttatgacacggatcccctttatgccctatagcgaagcacatgtgattgcttctgcggagggcttgggtttcggtacaatcttcttggtctcaactgaggttggcctcttcgcggtcgacctcaaatcagggcaggagcgcaaactaagcgagcctgggaactacaacgacttcgctgtcttccccttcatgagcttctatactccagactgtacaagcggcaaggtaccgtcacccaggaggacacactaatcactgtaatactgaggcgaagaatggtattgcctggctcatctacagatccatcaagttgagtttgcaggtgctgtcatctttctgttgcaggaatgacgtctcgcaagaaacacaagccatgaagccaacatattggtcgcttatgctcctatgctctctagctgattcttagatgcataatgtatacgcagccttttttttgttctcgtaatatgtgtgttgtttggttcacatatttgtaatataataggtaacagataacgttaaattatgtttgtttaaatccaaaaaaaaaaaaacaacctactaggaattgataccggcc

SEQ ID NO: 18898 - DNA, 2633 bp, Zea mays
  misc_feature (22)..(22): n is a, c, g, or t
  misc_feature (30)..(36): n is a, c, g, or t
  misc_feature (40)..(41): n is a, c, g, or t
  misc_feature (51)..(51): n is a, c, g, or t
  misc_feature (76)..(76): n is a, c, g, or t
  misc_feature (79)..(93): n is a, c, g, or t
  misc_feature (2540)..(2544): n is a, c, g, or t
  misc_feature (2546)..(2549): n is a, c, g, or t
  misc_feature (2633)..(2633): n is a, c, g, or t
gggggggagaaaaaaagggaanaaaaaagnnnnnnngggnnaaaaaggagnggggggggggaaaaaaaaaaaaagnggnnnnnnnnnnnnnnnccattatggacaggcttggcaaaatcctcagatgtttggtactagagaaaacacaaatctaccacaaggtcttgggccaagagcttttgtaagaccaatggtgcctcttggatacatcaatggaccaccatatcctgggcctatccctcccatgtattattacatgcccactgtgcctatggattcgatgagaagtccatcacactacattcaaaatcaaccagctcctaatcctgttttatccccagaagctgctgagttaagatctaatatactaactcaagtggagtactacttcagtgatgcaaatctggagcgtgatgatttcctgaaatctttaatggatgagcatggttgggttccagtttcaaaacttgcagatttcaatagacttaagaaaatgaccgcagatatacacctgatattggatgcactgacaagctcaagtcttctagaagttcaggatgacaagattagaaggcgttatgattggtcaaagtgggtctcgctttctggtacatcagttgcgagcccatcatctgccagtgtgaatagcagtgtgggtgagaagaacattggtggtttttcaaataaggatgcttattctgaagatcaaaagacgcattgtcaatccaaagatattagatgtaatacagatattggtatgggggaaaaagttatcgatgaacaagtgcaagattcacatggttgttcattgaataacgacttttctgtcatcagtattgatgaaaagactaagaacctttctgcacatccttcacgcaaatatggatcttcttttagatttggtgaagttcagaaaacaaggtcgaagatagtacctaatgctcagagtgaaagaggtttctctattggtttcccaagtgccttctctagctttggtggtggtggtgaccagagcactttcttgcttgatgaggagttggaactggaacatgtcgaccattcacgtgatgacctccattcacataaaaggggtgatgatgaagatgaggacttctttgttgatgatcaagacgttagtaggctaatgattgttacacaggatactaggttagaaaaggatgacaaaaatcgcacaagtataccacaggcattttcaactgaggaagcttcaagaataagtgatgccttatactgctatgagaaactgcatggtcgatgcactgataatcaaagaagttcccaggctgatcctgcagatgctgattctaaaccaaccagtggttcaaagggaagccatattcgcactgggactaaagttactgaagaagcaggacagcccattccacgtaggcgccaaaataaaggcaacagaaaagcgcacagctcacgtaaacagagattctttgctggtaattttgtgaataatcctgatcagtatggtggtgtgtcagaaagccctccaggcaattcagttggatatttctatggatctactccagaaaatcacagttataaaagttcaaagctgagttcatctcctcatggaattcctactgggagctcgcctgttgggtctgtgcccaaatcttctccacaatctcagcatcttacttttcatcttttagaaaaaaataaactccagccgcaaaggtacaataagttcaaacatcactgccttatggagcgtaagaaattaggcactggccagagtgagcaaatgaactcactgtatcgcttctggtcatactatctgagagataattttaatgaagatatatacaaggattttaagaaactcgcactggaggatgctgcagcgagctacagatatggtctcgagtgtctattcagattttatagttatggtttggagaaaaaattccaacccaatgtatatgaagatttcgagaagcttactttcgaattctaccgtaatggtgatctttatggactcgaaaaatactgggcatttcaccattaccgaaatccagatagcggtcctgtagataaacttccagagctggagaggcttctgagggaggagttccagaccctagaggacttcaaggcaaaggagaaagcccgagcgacgacggagaaaggaactggcatcagtagcagcagtgtggtggtggccgcaagtcatagcaaggctgagactaagcaggtctgagtcccgcatgaaaattttcggtggtcgccccagcaaaaagaggaagtagcgttttctttttctttgcgaagaagtaatgattcgggtagacatgtgcagattttgctatatcccctgccagtgccgtgtgttgtggctgcccagaaattttccctccttttctcattaccttcctggcaccaatgtcaatgtgggagttgtacatagatattttttttcctctcttgttaaatggacatatcatagagaatggagtttaaagccaaaaaaaaaaaaaaaaaaaaaaacccgcgggggcgcccggtannnnnannnngaaaaaaaaaaaaaaaaactccggggggggcccgggacccaattcccccataggggggggaataacatttcgggggccgggttn

SEQ ID NO: 18899 - DNA, 2373 bp, Zea mays
acagagagttatgtttttggttgtatgaactaagacagcggcgacgatccgatgcgatcgtctctcgagtcgatcgtacattccacccaccataattacccgaattcgatttgagtgttgtcgtgttgctcgattgctaacaccctccctcctcgaacagcgcccgacatctcttaaggtagtgtttggttctggagttaggtggggtggagtcgttccattctactttttgtgttgttgagttgtattccggttgaagcagagtggctcaaattctagaatatacccttgagatgcggcatcccgtggctcctcaaaattaatcggatttggctgctcgtgagccgagcctcccattcccatcccatctcttccctgatgctcgacataagctcacccaagtttgtttcaattttcttctatagataaattacttggggcagtttagaatttgcacgttgtttatgtgagactacgtctattagctatttcttaattataaaactcaatgcctactgatatgtatgatataagtatgtttttattgatcattgagttaacatatgagaaacgaaaaaaaatatactctattttgtatttatcaaccaaatattagatgaagtcattgtaaaattaaattatcaaacatagaacagagtgactttgttatcaaaatctataatggagccatttcatctaaatgagcaccagaaccgaacactgctcagagttccaagacaaggtgtcccggcccaatgagtcgcctgcaactgtaatcgagtggttgggcttgggcccgagggcctatcggccattcatcatcaccgtctctctttgcctgggccgctccaatgtgacatgacctgatgtgacgcgacgtgatacgatcccaccgcgcggcgcggagcacacgggtggctagtagtgtagtagggccggcagggcatcttttctgtgggcctgtggctggtgcagggagagagatgaggtaccggcgctgagtcgctgacgggtggggcccgggtcggtgccgaaggagggggtggggtggtggcgcgtccatcccacgcgactctcccacacaaataccatcacccttcgctaccattgcttcaccatcaccaccaccccgcggctgcagctcagcagctccagacctcaccagaggcacctaccacaccgcccgccgccgatcccgtcacccgtctcctccccgctgcggagcgtctccagccctgcccggtgcccgcccagatggcaaacgcggcgtcagggatggccgcgccacgcccgtccgccggcgccgcgatctgcattttcgtttgctcgatcgacggatctgccatgctcttcttcttcacctccctcgtcttcgtctccactgcctctgaatcttgtttcgcctcctctcccccgggttctgcaggcaaacgcggcgtcagggatggccgtggacgacgactgcaagcgccggttcctggagctcaaggccaagaggacgcaccgcttcatcatctacaggatcgacgagaagaagaagatggtggtggtggagcaggtgggcaagcccgtgctcggctacgacgacttcgccgccagcctccccgccaacgagtgcaggtacgccatcttcgactacgacttcgtcaccgaggagaactgccagaagagcaagatcttcttcatcgcctggtatgccacgtcgttcctcgccgctgtccgtctgtccagtccaccctggcttttgaagtgctcgccactcacggacgcagttgcatgatgtgtgtgaatgaaggtctcctgacacggcgcgcgtgaggagcaagatgatctacgccagctccaaggagaggttcaagcgggagctggacggcattcaggtggatctccaggccaccgactccgccgaggttggccttgacgtcatccagggccgtgcaagctgaggatgcccagcgatgaactgcccatgccagaggatgtatgagcatcatcagttcagatgagaacttgactgggcgggctatgtaaaaactgcatccaccgcagtgatgaaatcaatctaatcaatctaccaccccctccagcgtgcgtgttcttgctacatatcaacaacagcattatgatggtggaattctggtaatcagaatttcttgatgatccatggcactttttgccttgtgcgacctcaggacctggttgaaggatatgcagaggttgaagtttgagcatgacttctcagcggttgaaaaagacacaaagtccagaacataaaattccagcaaatcaaacatcattaggcagtgtataacttgagttcagaacatccataacttctcagaagagtccaggttaaaccgttaagcaaagcca

SEQ ID NO: 18900 - DNA, 848 bp, Zea mays
gggccccgccggccgggccggcatggggcttcccggccagggccgcaccatcaccaccaccccgcggctgcagctcagcagctccagacctcaccagaggcacctaccacaccgcccgccgccgatcccgtcacccgtctcctccccgctgcggagcgtctccagccctgcccggtgcccgcccagatggcaaacgcggcgtcagggatggccgtggacgacgactgcaagcgccggttcctggagctcaaggccaagaggacgcaccgcttcatcatctacaggatcgacgagaagaagaagatggtggtggtggagcaggtgggcaagcccgtgctcggctacgacgacttcgccgccagcctccccgccaacgagtgcaggtacgccatcttcgactacgacttcgtcaccgaggagaactgccagaagagcaagatcttcttcatcgcctggtctcctgacacggcgcgcgtgaggagcaagatgatctacgccagctccaaggagaggttcaagcgggagctggacggcattcaggtggatctccaggccaccgactccgccgaggttggccttgacgtcatccagggccgtgcaagctgaggatgcccagcgatgaactgcccatgccagaggatgtatgagcatcatcagttcagatgagaacttgactgggcgggctatgtaaaaactgcatccaccgcagtgatgaaatcaatctaatcaatctaccacccccttcagcgtgaaaaaaaatgaaacatatcaacaacagcattatgatggtggaattctggtaatcagaatttctgatgatccataaaaaaaaaaaaaaagcggcccta

SEQ ID NO: 18901 - DNA, 838 bp, Zea mays
acaaataccatcgggctacctccgggccgggccgggatcaccaccaccccgcggctgcagctcagcagctccagacctcatcagaggcacctaccacaccgcccgccgccgatcccgtctcctccccgctgcggagcgtctccagccctgcccggtgcccacccagatggcaaacgcggcgtcagggatggccgtggacgacgagtgcaagcgccggttcctggagctcaaggccaagaggacgcaccgcttcatcatctacaggatcgacgagaagaagaagatggtggtggtggagcaggtgggcgagcccgtgctcggctacgacgacttcgccgccagcctccccgccaacgagtgcaggtacgccatcttcgactacgacttcgtcaccgaggagaactgccagaagagcaagatcttcttcatcgcctggtctcctgacacggcgcgcgtgaggagcaagatgatctacgccagctccaaggagaggttcaagcgggagctggacggcattcaggtggagctccaggccaccgactccgccgaggttggccttgacgtcatccagggccgtgcaagctgaggatgcccagcgatgaactgcccatgccagaggatgtatgagcatcatcagttccgatgagaacttaactgggcgggctatgtaaaaactgcatccaccgcagtgatgaaatcaatctagtcaatctaccacccccttcagcgtgcgtgttcttgctacatatcttggtcatgcttgccatgatcaacaacagcattatgatggtgggaattctggtactcagaatttcttgatgatccatggcacttttgc

SEQ ID NO: 18902 - DNA, 1492 bp, Zea mays
tttcgcccccttcttacaccatcagtcccaaaataatagtcgttttagaaaatcagtaggtttatatttattttttgatgcatatgttttatatgtatctagattcatcgtcattaatttaaatatagacataaaaactcaaaatttaaacgactaaagtacattttacctttttttcttccctcctacaaatcttctcctagattttgacatacaaattggcacgtccatgagcgtgcttcattgttggccccagtcattcggtccgctcctgctgctagttctagctttctcgcgccgcatgcccgcatgcaccgtctgggttatgtgaagtgaagctgaagtgtcacgtgcgtgagatgaatacgcttgtttcccctctctcgttcgtgacatggagtagtatataaagacaataggcggaggagattcaggattcagaacgcactagcatttccacgcggcgttccacttccacccgaaaccccaatcaagcgtgcactgcatctgcgtagcccgttcaccacgcactcgcttccctccctaccgtgcgatctatggacggcgacggcgcgacgtgggggcagccgatgctggagaagcggccgagccaccgggagcggcatttcacggcgggggaagtggtgcgggacgtcatcatgggggtgtccgacggcctcaccgtgcccttcgccctcgccgcggggctctccggcgccagcgcgccctcctcgctcgtcctcaccgccggcctcgccgaggccccgccggcgccatctccatgggactcggagggtaccttgcggcccagagcgaggcggaccactacaagcgggagatgagaagggagcaggaggagatcatcgccgtcccagacaccgaggccgctgagattggagagatcatgtcacggtatgggctcgagccgcaggagtacggccctgtcgtcgccggactcaggcgaaaccctcaagcttggctagacttcatgatgaggttcgagctgggactggagagaccggatcccagaagggctctgcagagcgccttcacgatcgcagtgtcctacgtggtcggcgggctggtccctctcctgccctacgtgctcgtctccgcggcgaaggatgccatgctcacatccgtcggagtcacgctggccgcgctgcttttcttcggctacgtcaagggccgcttcacggggaactggccgttcgccagtgccgtccagaccgctgtcattggagcgctcgcttcggcggcggcgtacgggatggcgaaggctgttcaggcgaggtagttgtttgttggtgaggcggcggcgtcaggcgttttgggaaccagagtttcagtaggatgcggtaaaactgaagaaagctgtataattccgatcctttgggggacttctcgtttacagtgttaatcgcgggatctagtgctagtctactcttttgaataaatctaggggaggataagaacaaaaaaaaaaaaaaaa

SEQ ID NO: 18903 - DNA, 1793 bp, Zea mays
ctaattgtgctaaaaataactaatagttaaactattatttaggaggtgtttgaatgcactagaactaatagttagtagctaaaattagctatagacatccaaacacatcttgaactattagctatttttagtaaattagttaaaagttagctatctatttgttagctagctaatttcactagcaattttttagccaactaactattagctatagtgcattcaaacaccttttagactaattggatgttttcaactaactttagcagctacctctttcatttaaaaaaaactatatcagtctatggagtaacagggctgtaaatagaatgaagtaaattgatgatagaaaacgggatgagatgaacaatagtactctcttcgtttagtaaaaaaaaataacgcgcgttaaatattcgtaaataaaaaacaactaatatccaatcaccaattttaccgagtccccaccggcagaggaacatacagccttccagccttatatataatcataggcctccgtgcatcccaatagccccaccaggaggcacgagccggccccacctctcagccccaacttcacctccgattcgaaatgtcttcctcatcatccgatctcgtcctctacaacctcgtccccgctccccaaaccctaaaccctcccccaccacacgtcaccgccgcccctgatctctccatctccaccgccgtcgcggcggcgccagaacccgtcatccgcggccgggttcgccgcccggtgggctcctccgccgaccgccacgccaaggtcgccggccgcggccgccgggtccgcatcccggccatggtggcggcgcgcgtcttccagctcacgcgtgaactcggacaccgcaccgacggagagaccatcgagtggttgctgcgccaggccgagccttccataatcgccgccaccggcaccggtgtcacgaccgaggaggcgcccccgtctctcgtccccgtcgcccccatcgcgtcctcagtgtcccttacgccggtcccgtactacaccgcgctcctcatgcaaccaccgcccaccgccaatgagtcccctgtcgcctctgcatccgtatctggcactgttgcggataacaactaggctaggtggaagaggattatcaaatggcagttaggctaaaagttagttagtggttagggtttattatgtgtgctatgtggtcatggcttattaccttgggagaggattacggtgatttagctagcaaaactgattgagaatgtaacaacagaaggaatgacatcttttaaagtgttttttgagacaaaaaaaaaaaaaaaaacgaagtcttatctcttgtgatatgtctagtgcttctgatttctatttcttggtgcttcaattcgtggcgcggccttttttgttgttgttgtgtgtatatatgattagttgagcacttatctcattgttatttggctcttctatcaaccggatttagttatgcagcataggaattcaccatgattggttcatactgaaggtcagggagtaactgaagatggaaagctacaaagttaactttcttcttgctttcctggtatcgtttgtttctgcatttttctctgttacaaaaaagacatttagctgcagttagttgcctctgctttggtagcaaggctatatgcttcatgatggtatttcgttgcacctggcaaaagggtggtactcatggaaaatacgtgtttgcacatatggtttacttgtttgccttgtgaggaggaatcttcatagattgctgcaacaatcagttaccaactaaccc

SEQ ID NO: 18904 - DNA, 797 bp, Zea mays
  misc_feature (797)..(797): n is a, c, g, or t
tcgcgactactggcggtgaacagcgagaacctaaacaggacagcgaacacgactcgcctaacctccggacagccacgtctttccccactctccggacgaaccttcccgatggcgacgccgacctcccctccagctgcccccgcgtccaccgccaccacctccgtctcgcgtctccggccactgcgccctttccttccgcgccttcgcttctggccagcaccagtggcggccgccgccgctgtgcctttctcgattgctctgggcccaggctgtcgtcccttgcccggcatacgctgtcgagccgccgccgggccctcgccgccctcctcagagccccctcctccatccccgcacggttggcaagagaggctgtcaagtttgcaggatagagcaaggatcttctttgccgttctgttctggatgtcattgtttttctggggaagtgcttgggatggaagtaacaactcgggaggcaagaagcggcaacgatttcgaaagaagtcaaagtgaagatgctttaagattggcattttttcatagggatatagccttctatgttcaaggagacaaggacttgtgaacattcaatggtgcataatgaaggtgtaggcatagaaagttgtcgtgtcgtgttacatagttgtatttcagcagccggtaccctaaagtaaattgcttggtcctgctgtatatactgccaatcatgaatcatggagacatgggtgacatcataatggactaaggagacatatacgtctgtcgcttcttgtctaaaaaaaaaaaaaaaaaggccctan

SEQ ID NO: 18905 - DNA, 1429 bp, Zea mays
gatcatggctgattggtcgtcctcgtccccggcttgtcgttgagcagaccactcgtgactcgtggcctcgtggggtgggggcagaaaccagccctttctgtcctgtcagctactacccactggccactgcactagccgtctgcggagccgagtgttcctttctagccttcacttctcagcacggcagccttcgacccccgactgcagccgccagccgcgccatggagcaagccgccatgccgcaggttccccgcgtcaagctcggcatccaggggcttgaggtgtcgaagctggggttcgggtgcatggggctcacgggcacctacaacgcgccgctcggcgacgaggccgtggccgccgtcgtcgcgcacgccttccgccgcgggatcaccttcttcgacacctccgatgcctacgggccccgcaccaacgagaccctcctggggaaggcgctcaagcagctgccgagggagcaggtgcaggtggccaccaagttcgggataggtcagggcgccgctggcatgaccgtgtgcggcacgcccgagtacgtacgcgcctgctgcgaggccagcctgcgccgcctcgacgccggctacatcgacctctactaccagcaccgcgtcgacaccaccgtccccatcgaggatacgattggtgagctcaagaagttggtggaggaggggaaggtcaagtacatcggcttgtcagaggccagcccagacacaatccgccgtgcgcacgccgtgcatcccatcaccgccgtgcagatggagtggtcgctctggtcccgagacatcgagcccgagatcgtgccactctgcagagaattggggattggaattgtggcttacagtccaattggccgtggattttttggtggaagaggagtgacacagcaagtttcttctgaatctagtctgcaaaggcatccaagatttacaacagaaagcttggagaagaacaagcagatttacctgaaaatagaagatttggcgaagaagtaccagtgcagcccagctcagctagctctagcctgggttctgcatcaaggggatgatgtggttcctataccagggacaacaaaaacgaagaacctagatgccaacgttgactccttgaaggtgaagctcacagctgaggacctgaaggaaattggcagccagatacgtgcagaagatgtggctggtggaagacaatacaattcctatgcacatacctcctggaagtatgcagatacaccaaaaaagtgaagttctggtcctggaaaccttgtagcaatcacaggcgtatgcaaatgttgaactatttccctgcatttgagccggaatcgtacgatgatgcatcttgtgaacatgcggcactaataaatcgagacgaagaataatgtgttttccatcagtgattatgagcagatgatgatttttatccg

SEQ ID NO: 18906 - DNA, 954 bp, Zea mays
  misc_feature (11)..(11): n is a, c, g, or t
gggtggatcanacagagcgttttgtcctgtcactttgccacctcctgcccgccggccactgcactaggcgtctgccgagccgagtgttcctttctagccttcacttctcagcacggcagtcttcgatccccccgactgcagccgccagccgcgccatggagcaagccgccatgccgcaggttccccgcgtcaagctcggcacccaggggcttgaggtgtcgaagctggggttcgggtgcatggggctcacgggcacctacaacgcgccgctcggcgatgaggccgtggccgccgtcgtcgcgcacgccttccgccgcgggatcaccttcttcgacacctccgatgcctacgggccccgcaccaacgagaccctcctggggaaggcgctcaagcagctgccgagggagcaggtgcaggtagccaccaagttcgggataggccagggcgccgctggcatgaccgtgtgcggcacgcccgagtacgtacgcgcctgctgcgaggccagtctgcgccgcctcgacgccggctacatcgacctctactaccagcaccgcgtcgacaccaccgtccccatcgaggatacgattggtgagctcaagaagttggtggaggaggggaaggtcaagtacatcggcttgtcagaggccagcccagacacaatccgccgtgcgcacgccgtgcatcccatcaccgccgtgcagatggagtggtcgctctggtcccgagacatcgagcccgagatcgtgccactctgcagagaattggggattggaattgtggcttacagtccaattggccgtggattttttggtggaagaggagtgacacagcaagtttcttctgaatctagtctgcaaaggcatccaagattttacacagaaagcttggagaagaacagccgagtttaccctgaaatagaaagattggcgaaagagtaccagtgcagcccagctc

SEQ ID NO: 18907 - DNA, 2700 bp, Zea mays
gtcgtagatggaaagaagggattagttactagttacggtttaaatacaatcagttttaagaataaaagggaggaggggtgtgtgagattcggccgtccgggccccgcccgctccagcggtaggtgcatagatagatgcatctccgccgcccgctgccgcggtcggtgctgcgtgctgcccggctccggtgtaaacggcgtgggaacgcggcgatcgctgttggcgtgggaacgcatccgcgtcgcgaccatgaagacggcaacagcgggagagagacggtgaccgcacgagggggtccccttgcgaaacagcagcctgctagtgccacagccttcagccctacaggtagctaggcgtgtgtccctgtcggccgtagagtacagtgtgtgctcttcggttggacgtacggttccatccgtttccagcagcaggggtcccggacacgaggcttggagtccaagggagtgatcatgcgatgagagtctagctcccaccggcggcagtacggtggtggtagtgcagtggtggccacttaatgaccgacgacgccaccccgcgcggactttctggtctccgatcactagcaggggccggcgcggcgacgaccgactggatcggattcggatgagggtgcagcttattcttcttcgacattttgtctgcaaagagaccacgatgaaaactactcgcactcgtcggggccaggccatgcactcctccatcgggctggcggctcactcgttccgtcgttcggtcggtcattctgctcacattccttccttcggtcagcagtcgtcagtagtactgaccttctggaactcctacctggctgggcccaccgactccccctcccctccactgaccatgtggcgactggcgagacatcagacatggcatccccgccgctcaaacgcccagggcccccccacccgcgcctcctccttccttcgtaatcataggcatatataaacacgcgccggcctcgcgcttcttatcccccgcaccgcacgtctcagcccacctcctcctaccaccctcgccgcggccgcgccacacaaaagcgtcacgccgtctgacagcggggaaaaaaaaggaggccatggaggagaacattcctcacccgagggaggcacaagggcccaccgtcgcccaaccggccccggcggtcgtcacgccccgcgacgacgctctagctcccgtagcccagctgctgtcgtcctcgggcgatgatgagtcgtccgacgacgagctggaggtcgacttcgagttcccgttcgtctgcagggactcccccgcgggcacggccgccccggccgacgagctcttcgcggacggccggatcagggccttctacccggtgttcggccgcggcacggccgggtgcgtcccccgtggcggcggcggcggcggcagcggcagctgctgcacggcgctgccggccgctccgccgcgggtgaggggccagctgggtcgcctgttccaggaggagacacgggagcgcagcacctccgccagctttacggcgtcgtccgggcccgccacggacgaggacggcggcctggatggcgcggcgccggggagctactgcgtgtggcgcccgggtccgtccgcgtccgcgtcgccctccccgccgccgccgccgccgcccaggaagagcgggtccacggggtccatggcgcggtggcgccgcatcagcgacctcgtcgtgggccgcagccacagcgacggcagggacaagttcctcttcctcgccgccgcgcccaggagggggcccaaggacaaggagcctgccgccactgccccgcccgcggtcgccgcccaccagatggcggcgtacctcgccaggggcgtcccaccgcggcgcacgttcctgccgtaccgcgaggagctcgtgggcttcttcgccaacgtgaacggcatcagtcggagccaccaccgtccgccgttctgacgtcttgtcagtggcctatgccatcggttaattaccctgattaattattcggtaatgtgattagcacttttcttagcagtagtggataagtaggcggtttgtataggtaatgattttgggtggatcacgcgacgcgatgaatggagaggcgttttctgtcgaaaaaaagtgaacgcctacgcggacgtggcacatatgagtggggatgctcggtgaccggtgctttacggaaacaacccgtgccgctttgcgactacgaccacgaccatgggcgcgatgccggtggacggggcgctgcaccagggtgccgtgcgtgcgccgccagcctgggcgacggcgacaccagggggtctggtctggtctggtccgttgccgtccgtccgtctcggcccctcctcacgggtggaatatactctgtgcgtatttgggaggaacttgcgcccttcgatttggtcgtctgtctcatctcatggtaaatctggaaaggaagaaatgctgggattttgaatcgcgggagttagcctatactcagctgctgtacgaaataaagaacgaacgtggagcatggatcaaattttaaacatcttacgattttgacatgtatacggatgatgagagttttttttacactttctgttcagttttcggtacaatctactggcctatcttgtcacccttttttaatatacagtaacgggctacatcgaccgagttcaaaagaaaattttctacacatcaaagaagaatcc

SEQ ID NO: 18908 - DNA, 1303 bp, Zea mays
atcccccgcaccgcacgtctcagcccacctcctcctaccaccctcgccgcggccgcgccacacaaaagcgtcacgccgtctgacagcggggaaaaaaaaggaggccatggaggagaacattcctcacccgagggaggcacaagggcccaccgtcgcccaaccggccccggcggtcgtcacgccccgcgacgacgctctagctcccgtagcccagctgctgtcgtcctcgggcgacgatgagtcgtccgacgacgagggggagctcgagctggaggtcgagttcgagttcccgttcgtctgcagggactcccccgcgggcacggccgccccggccgacgagctcttcgcggacggccggatcagggccttctacccggtgttcggccgcggcacggccgggtgcgtcccccgtggcggcggcggcggcggcagcggcagctgctgcacggcgctgccggccgctccgccgcgggtgaggggccagctgggacgcctgttccaggaggagacacgggagcgcagcacctccgccagctttacggcgtcgttcgggcccgccacggacgaggacggcggcctggatggcgcggcgccggggagctactgcgtgtggcgcccgggtccgtccgcgtccgcgtcgccctccccgccgccgcccaggaagagtgggtccacggggtccatggcgcggtggcgccgcatcagcgacctcgtcgtgggccgcagccacagcgacggcagggacaagttcctcttcctcgccgccgcgcccaggagggggcccaaggacaaggagcctgccgccactgccccgcccgcggtcgccgcccaccagatggcggcgtacctcgccaggggcgtcccaccgcggcgcacgttcctgccgtaccgcgaggagctcgtgggcttcttcgccaacgtgaacggcatcagtcggagccaccaccgtccgccgttctgacgtcttgtcagtggcctatgccatcggttaattaccctgattaattattcggtaatgtgattagcacttttcttagcagtagtggataagtaggcggtttgtataggtaatgattttgggtggatcacgcgacgcgatgaatggagaggcgttttctgtcgacagtgaacgcctacgcggacgtggcacatatgagtggggatactcggtgaccggtgctttacggaaacaacccgtgccgctttgcgactacgaccacgaccatgggcgcgatgccggtggacggggcgctgcaccagggtgccgtgcgtgcgccgccagcctgggcgacggcgacaccag

SEQ ID NO: 18909 - DNA, 2386 bp, Zea mays
aattcggcacgaggggcatcgtgtggaccgcgccctgcacacctggcgcgtgggcccgcctcctccatctccccctgccgcgtggccggccgcgctccgtccccaccgccccccggcgtcggaatatcatacgaaaaccctcgcggcgaggagcgctctccgtcccacacacgcgcgccgcagcctccgcagtccgcacctgcctccacgacttgtcgtgctcgtgcgctactctcctcgagcgcggcgcggagcacggggacatcaaatggcggcagcggcggagatcggtggtttcgcggcggcgagagtggcggtggcgacgctcaggccggctgcgcacccagccccggcggcggcggcggcaccgcagcctaggagggcggtggcggcgcagtcgctgcagacgaccgccaccgaggcgctgacggcggatctcgccggcacgaccaacggcgctgtgcatgctcggatgaatagtaaggctacaagtgaaatcacttcacaggcagttactgcaaattctaggagaaagacaaagatagtctgcaccataggtccctcaaccaacactcgtgagatgatttggaagcttgcagagactggaatgaatgtagcgcgccttaatatgtcccatggtgaccaccagtcgcaccagaaggttattgatttggtcaaggagtacaatgcacagaacactgatggcaatgttattgccattatgctggacacaaagggtcctgaagttagaagtggggatgttccagagccaatcatgctcaaggaaggtcaagagttcaacttcacgattaaaagaggggtgagcactgaagacactgtcagcgtgaactatgatgacttcataaatgatgttgaagctggcgacatactattagtggatggaggaatgatgtcgcttgctgtgaagtctaaaacagccgatacagtcaagtgtaaagtagttgatggtggggaattgaaatcacggcgccacctaaatgtccgtggaaagagtgctactttgccatctatcactgagaaggattgggaagacataaaatttggtgtcgaaaacggtgttgatttctatgcagtttcctttgtgaaggatgccaaagttatccatgaattaaaagactaccttaaaagtgctaatgccgatatacatgtcattccaaaaattgaaagtgcagattcaataccaaacctgcagtccattattgctgcttcagatggggcaatggtggcgcgtggagaccttggtgctgaacttccgattgaggatgttcctttgctacaggcagagattgtccaaacatgtcgaagcatggagaaaccagtcattgtcgctacaaatatgttggaaagcatgattgaccatcctactcccactagggcagaagtttctgacatagctattgcagttcgggaaggtgctgatgccatcatgttatctggcgaaactgctcatggaaagtatccactaaaggcagtcaaggtgatgcacactgtggcactcagaacagaatccagcctttataacccaactacttctcctagtcttgttgcatctgcacagggtctacagaatgaggacttctccgcaagccagctaagtaaaatgttcggatctcatgcaacgatgatggccaacacccttcgcacaccaatcattgtatttacacagacaggctccatggctgtcctcctgagccactatcgtccctcgtctacactatttgcatttacaaacgaggaacgagtgaagcaacggctagcactctaccagggcgtcatccctattcacatgcagttctctgacgacgcagaagaaactttctccagagcaattagcagcttgctgaaagcacaatatgtgaagaagggagactacgtcactcttgttcagagcggagtgacttcaatctggagagaggaatccactcaccacatccaagtgaggaaagttcaggtctgatgtgccggtgggaattggtcgtctgagaaattttgatagcgccgcctgatgtgttatcatcattatatgtgtaattttactgttttaccaggagattgctacgtcgagttatatgttgtgtcgaattcacgtgtaggctctgaatcttgactgtgttcgttcattttcgcttgtttcacactgaagtgttataagctcaactttactgcttttgttttcttgtgaaacttgagtttagtttcttgttacaaaaggagctagcactaacagggtggtgagttttgtaaacggggcgaggactgttgagttaaaactgttgtaataatgatatcgttcctgcaagacgacacatgcatggccagaaggccaaagtctgaactcttttctgccgggacaagacaggatgcc

SEQ ID NO: 18910 - DNA, 838 bp, Zea mays
gggcagaagtttctgacatagctatgcagtcagggaaggtgctgatgccatcatgttatctgggaaactgctcatggaaagtacccactaaaggcagtcaaggtgatgcacactgtggccctcagaacagaatccagcatttataacccaactacttcccctagtgttatagcatctgcacagggtctacagaacgaggagttttccccaagccagctaagtaaaatgtttggatcccatgcaactatgatggccaacacccttcgcacaccaatcattgtatttacgcagacaggctccatggctgtcctcctgagccactatcgtccgtcgtctacactatttgcgtttacaaacgaggaacgagtgaagcaacggctggcactctaccagggggtcatccctattcacatgcagttctctgacgacgcagaagaaactttctccagagcaattagcagcttgctgaaagcacaatatgtgaagaagggagactacgtcactcttgttcagagcggagtgacttcaatctggagagaggaatccactcacaacatccaagtgaggagagctcaggtctgatgtgaatcggtcgccggagaagttttgatagcgccgctagaagtgttatcatcatcatcaccattatatgcgagtaattttaatgtttttaccaggagattgctacgtcgagttgtatgttgtgtcgaattcacgtgtagactctggacctttaactctgtattcgttcattttcacttgtttcacactggagtgctataagtcaaaaaaaaaaaaaaaaaatatcgataccgtcgacctcgagggggggcccggt

SEQ ID NO: 18911 - DNA, 2280 bp, Zea mays
ttcggcacaaggcgccctctccctctgcggcgtataagaagcgacccacggccaccgccacggcctcgccggaatatcatacgaaaaccctcgcggcggggagagcgctctccctcccacacactcgcgccgcagcatccgcagtccgcacctgcctgcctccacgacttgtcgtgctcgtgcgctactctcctcgagtgcggcgcgggagcacggggacatctaatggcggccgcggcggagatcggtggtttcacggcggccgcgctcaggccggttgcgcacccagccccggcggcggcgcctaggagggcggtggcggcgcagtcgctgcggacgaccgccaccgagacgctgacggcggatctcgccgccagcacgaccactttgtggtgtatgctcagatgtatagtgaggctagtagtgaaattcttttattgtcagctattgcaaattctagaaggaagacaaagatagtatgcaccataggtccctcaaccaacactcgtgagatgatttggaagcttgcagagactggtgggaccctcgcgccccgccgggtgtcccatggtcgaccaccagtcacaccagaaggttattgatttggtcaaggagtacaatgcacagaacactgatggaaatgttattgccatcatgctggacactaagggtcctgaagttagaagtggggatgttccagagccaattatgctcagcgaagggcaagagttcaatttcacaattaaaagaggggtgagcactgaagacactgtcagcgtgaactatgatgacttcataaatgatgttgaagctggtgacatactgttagtggatggaggaatgatgtcgcttgctgtgaagtctaaaacagctgatacagtcaagtgtgaagtagttgacggcggggaattgaaatcaaggcgccacctaaatgttcgtggaaaaagtgctactttgccatctatcactgagaaggattgggaagacataaaatttggtgtcgaaaacggtgttgatttctatgcagtttcctttgtgaaggatgccaaagttatccatgaattaaaggactacctaaaaggtgttaatgcggatatacatgtcattccaaaaattgaaagtgcagactcaataccaaatctgcagtccattattgctgcttcagatggggcaatggtggcgcgtggagaccttggtgctgaacttccgattgaggatgttcctttgctacaggcagagattgttcaaacatgtcgaaacatggagaaaccagttattgtcgccacaaatatgttggaaagcatgattgaccatcctactccaactagggcagaagtttctgacatagctattgcagtcagggaaggtgctgatgccatcatgttatctggtgaaactgctcatggaaagtacccactaaaggcagtcaaggtgatgcacactgtggccctcagaacagaatccagcatttataacccaactacttcccctagtgttatagcatctgcacagggtctacagaacgaggagttttccccaagccagctaagtaaaatgtttggatcccatgcaactatgatggccaacacccttcggacaccaatcattgtatttacgcagacaggctccatggctgtcctcctgagccactatcgtccctcgtctacaatatttgcgtttacaaacgaggaacgagtgaagctacggctagcactctaccagggggtcatccctattcacatggagttctctgacgacgcagaagaaactttctccagagcaattagcagcttgctgaaagcacaatatgtgaagaagggagactacgtcactcttgttcagagcggagtgacttcaatctggagagaggaatccactcacaacatccaagtgaggagagctcaggtctgatgtgctggtaggaatcagtcgccggagaagttttgatagcgccgctagaagtgttatcatcatcatcaccatcatatgcgagtaattttaatgttttaccaggagattgctacgtcgagttgtatgttgtgtcgaattcacgtgtagactctggatctttaactctgtattcgttcattttcacttgtttcacactggagtgctataagttcacgcttactgcctttgctttaaaaagggcggccgcgcgcaacttgattttagtttcttgttacaaaaggagctagcactaacagcgtgttaaattttgtaaaacggggccttcttgctccgagaactgctcagttaaaactgttgcaataataaaaa

SEQ ID NO: 18912 - DNA, 755 bp, Zea mays
ctcgccggaatatcatacgaaaaccctcgcggcggggagagcgctctccctcccacacactcgcgccgcagcatccgcagtccgcacctgcctgcctccacgacttgtcgtgctcgtgcgctactctcctcgagtgcggcgcgggagcacggggacatctaatggcggccgcggcggagatcggtggtttcacggcggccgcgctcaggccgcttgcgcacccagccccggcggcggcgcctaggagggcggtggcggcgcagtcgctgcggacgaccgccaccgagacgctgacggcggatctcgccgccagcacggccaacggcgcggtgcatgctcagatgtatagtgaggctagtagtgaaatcccttcacaggcagctattgcaaattctaggaggaagaccaagatagtatgcaccataggtccctcaaccaacactcgtgagatgatttggaagcttgcagagactggaatgaatgtagcacgccttaatatgtcccatggtgaccaccagtcacaccagaaggttatcaatttggtcaaggagtacaatgcacagaacactgatggaaatgttattgccatcatgctggacactaagggtcctgaagttagaagtggggatgttccagagccaattatgctcagtgaagggcaagagttcaatttcacaattaaaagaggggtgagcactgaagacactgtcagcgtgaactatgatgacttcataaatgatgttgaagctggtgac

SEQ ID NO: 18913 - DNA, 1771 bp, Zea mays
cacgagaccattacctagaacatcctaatcgaaaacaaaattagaaaggaaggaaaagatcgaagacaaaaatggaagtataattcaatatttccattcccagctgatccaggaaatgaatgtattgcatagaacagtctcaacctcggtctctcaacaggagagacaactaaaagcacttgaagaagagatgcagtcttttgtcacctcaaagggcaaggttgccggaggacttcaagagcatgtaagaaagctcaaagagagctttaattctaggatagcagaattgcatggttttgcaaatgaactcaagcataaatctatgttgagctttgaaaaccttaattcgcaagttaccacacacacatctagccttgaggattgcatgaaggacctattggttgatgccgatgaactactcattgcactacaaaatgggctttctcagcatgaagtgaactttgctacgtttattgagcaacagcatgaggggctctctagaaatttagagggaacaaagtttgtttcggcaactacaatgaacttcttcagaactatagattcacatgcattgggactcctaaagattttggaagaatcaaagatggaacatcaaaagcaactcttccagcttcagaagaagtttgaggccgttgttgctgacgaagagaagtacttgatggagaaggttgcagggttgtttgcagaatcaaacgctcgaaagaaaaatatggttcaagatgacatatgcagcctcaataggactgtttctgagagttcgaacaatttacaaaccgaaactaccaagctgcatgattttacatcttctatgaaagagcaatgggaaggctacatgaagaaaactgaagaggcattccagcaaaatgtatcatctattgaacagaaaagaggcttcttggcagggaattttcagcagtgcaaggaaaaggtagaatcatgctcagaacaatggattactgcacaaaatttggtgttggcacttggaagaaggaatgcagaagccatcggtttggttataagtgatgggaatgaggtgagcaaccaactgggtgcaagaatttcatctgctgttgctgctggatttgaagataatgacatttcaagcaaatcccttctaagttgtattgacgattcattgaagttggaccatggtattcgcgagaatgtgaaatccatcgtcatgacatccagagcacaacttcatgacttggaacatggtcactatgagatgacaaaagcaataacagggaatgccgataggtctctgggagaagattataaggtggatgaagcaacttgttcaacaccgagaaggcgtgagataaacattccggacagccaatcgatcattgagttggtaacccccctagaagatatcgtgaagtcattttgggacagcagaacaccgacgaagcctgctctaaatgcaaaagggaagcagcagttggtagggtcgacgacccctgaaacacaaagagcccctctttccgcaataaattaggagtttcattactgtatatactacaaacattcttgtgtggtcaagtaatgttgatcaagaatgttgagagaagttactggtaaaggagagctgtgtattctccagattcatccaatgtatgaacggaatcatacatccaatgtattttggagtggagtgcaactccaaaatacagagcaaatcgagcatgaccatttgtcaagttccgtgaaatgaactcatttatttgtatctaaaaaaaaaaaaaaa

SEQ ID NO: 18914 - DNA, 2016 bp, Zea mays
  misc_feature (1)..(1): n is a, c, g, or t
naacatcctaatcgaaaaaaagaattttttttccgcataggctcagggttgcgtggcagcgtggagcatattcaacaccgccgtcagcccgtcaccgcaggccgcagcaggctcgcttcgcttgcgcctccccccttccccgccgtcgccgccgccgccggagccatgtccggctcggcgttgcaggcggtggagccccgcccagcggcagccgcgacgactgccgcggcttctccggccgccacggctcagcccgcggcggtggcagcggctaggggagcgagagggtgtggcggcccagcgcgtgcatcggggccggaggcaacgatggagcacgtgctgctggcgctgcgggagacggaggcggaacgggaagcgcggatccgcggcgtcttcggcttcttcgacgccgcggggcagggccacctcgagcacgcgcagatcacggccggtctcatcgcgctgcgcgtccccgaggagaccagcggagcaggcgccgaggccgaggactacgcgcgcgcgctgctgcgggcctgcgaccgggaccgcgacggccgcgtcggttatgacgacttccggaggtacatggacgacaaggagctcgagctctaccgcatcttccaggccatcgacgtcgaacacaacggatgtatcctgcccgaggagctctggcacgcgctcgtcaaggctggtatagaaattgatgatgaagagcttgcaagatttgttgagcatgtggataaggacaatgatggtattattacttttgaggagtggagagattttcttttgctttatcctcatgaagcaaccatggaaaacatatatcatcactgggaaagagtctgccttgtagatatcggagagcaggctgctataccagaagggataaacaaacatgtaagtgcgagcaaatatctgattgcaggaggcatcgctggtgcagcatctcgcactgcaactgcacctcttgatcgcctcaaagtaaatatgcaagtgcaaacgaactgtattgcagttgtagatgtagttaagggtatatggagagaaggtggtctactgggattttttagagggaatggactgaatgtggtaaaagttgctccagaaagtgctataaggttctatacctatgaaatgcttaaagaatacataatgaaaagtaaaggagaaaataagggtgacattggtacttctggacgtctcatggctgggggtttggctggtgctatcgcacagacagtgatttatcccatggatttggtgaagactcgtctgcagacttatgagggaggcagaattcctagccttggcgcactatcaagggatatatggacacatgaaggtcctcgagcattctacagaggccttgttccatcattgcttggcatggtcccttatgctggaattgatcttactgtttatgaaacactgaaagaaatgtccaggacatatgccctcgtggacaaagatcctggccctttagtacagctgggctgcggaacagtctctggagcgctaggagcgacatgcgtttatcctttacaagtcatcagaacaagaatgcaagctcagccagccaattcagaggatccatatagggggatgaccgattgtttccggataactctgcgtcgtgaaggagtttctggattttacaaaggccttgtaccaaatcttcttaaagtggtgccagctgcaagcattacctatcttgtttatgagacaatgaagaaaagtctctccctagattaagtgactttgtagattctggatatcagcgactgactctatagatagtgtcgaggcatgatcttccttgatgagtaggttctaacttaatgggcctgaggtgtaagatagtagtatttttggcctcaggatacagatgatgcagggcattttcattattattggtagaaataaaacgcgatacctgtcagaacaaaaaaaaaaaaagaaaaaaaaaaaaaaaaaaaaaaaaaaaaaaaaaaaaaaaaaaaaaaaaaaaaaaaa

SEQ ID NO: 18915 - DNA, 1897 bp, Zea mays
  misc_feature (1877)..(1879): n is a, c, g, or t
  misc_feature (1882)..(1888): n is a, c, g, or t
ttttttttttttttttagcatcctcaatccggcccatatgtttgcttactaggcccaccggtgatccgacgttttgcagttgggcttggcctatcagcatcatcagcaccaatgcctgcctccctcgttgcctccaaccatgaatgtagtttgggaatacaagtgtagcaggggtttccaagattggtgatttttgttgctatatataagcggtggcgatcgatccatatgatgagctagctagcaagcctccgatggcgccgcctcgttggccttggccggcaccggctcaacattgccggcagaggccgcccctgcccgggtccgcgccttctctgcctcggccgcccagtccatgcgcacgatgaccgtcaccagcaccgccaagctgacggcggcgcccaccaggaagccggccaggaggccctccagcccgaggccggccttgaagccgagcgcgacgcccaccggcagcgccaccacgtagaagccgcccacgacggcgtacatgcccagcagcggccgcgccgtgccccgcacgatgccgccgcacacgttgagcgggaagttgaccacctccagcagcgccatcaccttcatggcccgccccacgccgtcccgcacctccgggctgcgcgtgtatatgcgcgcccacggccggcgcgccgccagcatgagcaggcctccggcgaggcccgccaccgcgccgcccgccaccgacaccctggcggcgcggcgcgccgtggcggcgtccccggcgcccagctcgttggacacgcgcaccgacgcgctgacggacagcgacagcatggccgcgaacagcaggtagtcgaagttgagcgtgacggcgaccacgcccaccgtgcggcgcgcgtcggggaggcgccccgtgaggagcaccaggatctcgtaggaccaccactcgaggcaggtgttgaggcagcaggggacggccaggcggaggagcagcagccacccggcggccgccgccgccgctatcggcttcgacgtcgtcccccgctggcgccggaggtcgtgggcgagcgcgtaggcggcgagcatgagcgccagcgcgaggtcgccgagccagacggcggcggccacgccccggacgcccatcctggcggagagcgagacggtgagcgggatgtggagcgccagcgccagggcagcggcgaacagagtgggcagcgtggcctcctgcgcgctgaggtacgccttgagcgggttgagcacggaggtgacggcgaggtccgggaggaggcagagcacgtaggtcctggccgtggccgcgatgtcgggctgctggccgaagcgcagcagcacggcgtcgacgcgcgtccagaggagcgcgatggggacggaggcggccaggagcatgagggtggccctgagcagcgtcccgcgcaggagggcgacgtttccggcgccgtgcgcctggccgcagatgggctccatggcgccgcagaggccgctgaggacggcgaagccggtgacgttggcgaagctgtagccgagcgtgccggcggccagctccaggtcgccgaggcggccgaggaaggccgtggtcacggcctgcttggcgaaccaggtgaggttcatgccgatgagagggagcgcgatgccgcgctgcgcgcgcacctcggacgcaacagcggccaggccatgctgctgccttggcggtggtgtcgtcatggtcatggctgctgcgtgagcgagcgagcagatggagatggagtttggtttgctttggtttgttggggttacaggcagcacatatccacatactagtattctttccgttctggggcggcctgcgttattgctgctttcttccatgaatggatcgtaacggttctgcaaaaaaaaaaaaaaannnctnnnnnnnaaaaaaaaa

SEQ ID NO: 18916 - DNA, 1189 bp, Zea mays
cctcgagccggcggggtacttaacagaacaattaggcccgactagcacaacaagcggcacgcacggcgttaacctccccagcgtgaaataattgctacctatttctctcgccggcgacgagcctccgcggaaaccagtgccaagccagaggtgcttctttctccgccagactgctgctccgcgcgagaagagccaccacggagtctgcgtgactcgggacagtggagaaaatcagcggcacagcgtgggtctcgcgacctccagcgaacgagatccctaagtttcgatccactgtcccagtggatttgggactgcgatggaggagcagttcatcctccgcgtgccgccatccgtcgcagagcggatcgagcgcctcatgaatgaatccgccgcctcctcctccaaccccgacgaggcctccctggacctctccttctcagaggatggaagaaatggcacatttatgatcggtaatgagagctttcctgcatctctcttggatctacctgctgtggtggagtcatacaaaacatatgatgattctgtactaattaaaactgctgatgttggtcagatgattatggtaagagaagaaaatgatcctgctccagaaggagtcgagtacaagcatgggcttactcctccaatgagggatgcacgcaggcgacgtttccgcagagaaccagacttgaacgcagagctggttaaccaagttgagaagcatcttatcagtatcatgcatggagtatctgtcaaccagaacgccagtgcgacaggaggcgaagaaggtggtgatcgtaagaaacctccagtagctcgtgcagcaaagcagcctggggttcaggagcccgccgcgaatggagaggaagctgatcctgagaggagcgacagtgatgattcagataactgaaatggaggacctggactgggtgcagcctcagtggtccaggcgagccatgccaaacttcgcaatttgaataaatcagaatgtatatatttgtaacaaacaatgtgtttgttgttcgctgaagcatgtactgtcacggtaaacatgatgtgacgctataatgccaaacaagatgatgttactgcatgtactagcaaaatagttataaataacaactgctaagtagcattttattggatttaaaaaaaaaaaaaaaaaacacggaattcgagctcggacccg

SEQ ID NO: 18917 - DNA, 1186 bp, Zea mays
  misc_feature (5)..(5): n is a, c, g, or t
  misc_feature (1154)..(1154): n is a, c, g, or t
ctcgnagccggcccggcggctccctcgcggccggccgggacgcacggcggtaacctgcccaccgtgaaataattgctacctatttctctcgccggcgacgagcctccgcggaaaccagtgccaagccagaggtgcttctttctccgccagactgctgctccgcgcgagaagagccaccacggagtctgcgtgactcgggacggtggagaaaatcagcggcacagcgtgggtctcgcgacctccagcgaacggtgagtcgagatccctaagtttcgatccactgtcccagtggatttgggactgcgatggaggagcagttcatcctccgcgtgccgccatccgtcgcagagcggatcgagcgcctcatgaatgaatccgcctcctcctcctccaaccccgacgaggcctccctggacctctccttctcagaggatggaagaaatggcacatttatgatcggtaatgagagctttcctgcatctctcttggatctacctgctgtggtggagtcatacaaaacatatgatgattctgtactaattaaaactgctgatgttggtcagatgattatggtaagagaagaaaatgatcctgctccagaaggagttgagtacaagcatgggcttactcctccaatgagggatgcacgcaggcgacgtttccgcagagaaccagacttgaacgcagagctggttaaccaagttgagaagcatcttatcagtatcatgcatggagtatctgtcaaccagaacgccagtgcgacaggaggcgaagaaggtggtgatcgtaagaaacctccagtagctcgtgcagccaagcagcctggtgttcaggagcccgccgcgaatggagaggaagctgatcctgagaggagcgacagtgatgattcagataactgaaatggaggacctggactgggtgcagcctcagtggtccaggcgagccatgccaaacttcgcaatttgaatagatgagaatgtatgtatttgtttgtaacaaacaatgtgttcgttgttcgctgaagcatgtactatcacgttaaacatgatgtgacgctctcatgccaaacaagatgatgttactgcatctactagcaaaacagttataaataacaactgctaagtagaatttttataaaaaaaaaaataaccaanaacatattacaactccattataaatgatttag

SEQ ID NO: 18918 - DNA, 790 bp, Zea mays
tgtgggtgtttgccattggaggcttgccggaggggtcgccagggaccaactggttaatttgtgcgggtgtaatgccggccacccgcccagagggctcccatctccggccacgtgacggaccgcttcttctgccccacgacgaggagcgaaccgccctgcttcctcgccgcctccactatcgccggcccccggtccttgccgccctccgccagcgaaagttccccgcacacctctggtctcttggcctggcagatgctcctcaaggcctccaggtgcggactccctctcggatcgcgtcctgatcgagacgaccacgcaacaaaaacaaggaagagccatctccctctgttttcaagcacgcgacggagcctgtactgtaaccagcaggacttaaaatagatggttattggtcacacgcagcttacgcacgtacggttcttgccgctggcgacgtcgagcaggaccaccgtgtcgcagggccggacggcgtgcgacagcgcccactgcagcgccgtgcgggcctcctcgccgccgccgtccgccgccgccaccatcaccttcctccccacgacgacggcctctgcgctgcccttctcgttagcctcctcccactcgtccttttgcttgccatcctttagggacctgctctctccgccgccgccgccgccgccgtcgtccttgttggcgcatatcgatggaggcgcggcggtggacgcggtgccgccggacctgatccggtggaggcagaaggaagagagcggcctggacatggaggatgctcgctcgtttt

SEQ ID NO: 18919 - DNA, 916 bp, Zea mays
ggttttttttttttttttatgctgcttgatttttattgcaaaaacgcaatccatgatatcatgtcagttctaaaacagcaacaaaacacagcccacagcaatctactgcattaattattatttttgcggcccataaatactatgcctataaacctgagccactccgttcgctattccactatagtcaagccaggagccagaaatccctctgccgcctggtggtgatgaggtagccgccccctcgccggctcttgcgccggacggccagcgccatgcacgccgcgtgctgcacgcagtagtcggcggcgctggtgtagccgcccccgcccccgcccttgacgccggcgatccacatggacagcagccgccacgtgacggaccgcttcttctgccccacgacgaggagcgaaacgccctgcttcctcgccgcctccactatcgccggcccccggtccttgccgccctccgccagcgaaagttccacgcacacctctggtctcttggcctggcagatgctcctcaaggcctccaggtgcggactccctctcggatcgcgtcggttcttgccgctggcgacgtcgagcaggaccaccgtgtcgcagggccggacggcgtgcgacagcgcccactgcagcgccgtgcgggcctcctcgccgccgccgtccgccgccgccaccatcaccttcctccccacgacgacggcctctgcgctgcccttctcgttagcctcctcccactcgtccttttgcttgccatcctttagggacctgctctctccgccgccgccgccgccgccgtcgtccttgttggcgcatatcgatggaggcgcggcggtggacgcggtgccgccggacctgatccggtggaggcagaaggaagagagcggcctggacatggaggatgctcgctcgtttgc

SEQ ID NO: 18920 - DNA, 2959 bp, Zea mays
catgtggttcccccgggctgaggaattcggccgcacgagaccattacctagaccctccttcgcgccttccactccccatcttcccaaaccgccccacgcttcatcctcgcaagcctccccgaccccccagctcaacgagatccggcgagcgaattccatcttccccgaccaccagatcgcagcgatggagccggatcgggtcgccgcgggggcatcctcctcgccgcagccctcaccagcgccggccatgttcctgccggggcaaacgcgagaccatgagcggggagcggtcgactgcgcggatcccggcggagacctgaatcccgcaccgcctcagcaggctacagttgaggatgccgcggtgggcggcgatgtggagcaggaggagccaaagaaggaggcgatggcaggagtaggggaggctctccggagcttcatggaggagtttggggatcaaggagaggactccattatcttgtcaccgcggctgcaggagatttgtactcctgaccgccccactgccctgcgcttcttagggaagaaatataataacctcatggagagatacaagaagcaggtggtcaagtgttctgaggagtgtgaccctagatataacggcttgaagaagaagtacacagacgagtgtgcagagaggcggcgtctgtacaatgagcttattgagctaagaggtaacattagggtgttctgcagatgcagacctctgagctccaatgagctcgcccgtgggtgttcatcagtagttgagattgactcatcacaggagactgagctgcagtttgtccccaatgaaaaagaaaggaagccctttaagttcgaccatgtttttggcccagacgatgaccaagaggccgtgttttcagaaacagtgcccgttgttgggtcagtgatggatggtttcaacgtatgcatctttgcatatgggcaaacaggaaccgggaaaactttcacaatggaaggggttccagaaaataggggtgtaaattatagggctttggaagaattgttcagaatctcagagaaaagaagtgcatctgttgcatacacattttccgtaagcatcttggaagtttacaatgaaaagatcagggatcttcttgatgagagcaatgatcaatcaaaaaggttggatattaagcaaaatgctgatggaacacaagaagttcatggtttggttgaggctccaatttataacatagatggtgtgtgggagaaactgaagtttggcgctcaaaataggtctgttggctcaaccaatgctaatgaactcagcagccgctcccacagtttggttagggtcactgttaggagcgagcacttggtgacttatcagaggagcagaagccacatgtggttggttgaccttgctggaagtgagagaatagctaaaactggggtagaaggagataggctgaaagaatcacagttcatcaacaaatcactatctgccttgggtgatgttatatctgcccttgcctcaaaaaattcccatattccatacaggaattccaagctgactcatttgctccaaagctctttaggcggagattgcaagactctaatgttcgtgcagataagcccaagctcaatggattcaggagaaactctcagttcactcaattttgcgagtagagtccgagctgtagaacatggccctgctgctcgtaagcaagcggatccagctgggagtttgaagttaaagcagatgactgaaaaacttcagcatgaggaaaaggagaatgcacagctgaatcaaagcttgcagctgatgcaactgaagtatgcttctcgtgagaatgtcttcaggacactaaatgaaaaggtgaaggatgctgaacaagcatgcagaaattatcagcagcggattagagagctggaaaatgaattaggcaatgagaagagggcttctagggattctgctagatcctcaaggcccccacttgttcctacgagacagagacaacctcagggaaggactaacagcttcgcaccaccttcaggcccttctagatggaggctcaaagcccccgcaaaacacaacaaagagaacattcctgtggcgatgaataaaccaaatgctggggatgatcctaataagcctgtcggcagagcaaggcgtgtttcacttgctccggtgattcgacaaatccccatccagcccaagaggcgatcttcgatggcagtgctaccatccgtgagagagcatctttctgtgctaaacgacaagaaagcaggatctcgactgtcgcaagccaacatggcaagaggatcacttggggcatttggcttgaatttggttccaggaacacccctagcaggacatggtggacctgttgatgctacaccagatggagcaaagttcaggagatttgatttcggaagcagcagcaagttcacaagccctgccccaaatgtgggcatgtggaacaaaatggtcacgccgcagcagaagctgggaatggcaccggcaggagcgaagctgtgtttcagcatccagaaaagagttacgcctccacatgttcgggcgaaacctggattgggcatcttcgacccagctctgcgtgagaatatggtcgtggggagagccggcaatgcgctgcgggtgctcaaccccaagcgaaggcaatctgttatctaactcttgaagccaaaggtacagcagatgtttggacgttcaaacggagcgtgtggttcttagtgaaaccgtgaagatgttcttttcagcatctttaaatggattctgcttggttgttactagttgataggaaagctatgttaatactgttaatggaagttgttaattgtatttgttcgttactaagaatcgcttcagaaaaaaaaaaaaaaaaggacttgtttggtagagtcccgcttcacaattctctaatagagtgattctgattgattctctaccgaaagtgaatctatttgacgaaaaaag

SEQ ID NO: 18921 - DNA, 2774 bp, Zea mays
gattcccaaactgccccacgtctcatcctcgcgagtcgcgacctcgcaagcctctccgacccccagctcaacgagatcgggcgagcgaccccctcttccccgaccaccagatcgcagcaatggagccggatccggtcgccgctggggcatcctcctcgccgccgccttcaccagcgccggccacgtccccgccgtggcaaacgcgaggagtttggggatcaaggagaggactccattatcttgtcaccgcggctgaaggatattagtactcctgaccgccccgctgccctccgtttcctaggggagaagtataacaaccccatggagaggtacaagaagtacaaggagcaggtggtcaagtgttccgaggagtgtgaaccaagatataatggcctgaagaagaagtacacagacgagtgtgcagagaggcggcgtctgtacaatgagcttattgagataagaggtaacattagggtgttctgcagatgcagacctctgagctccgatgaggtcaaccgtgggtgtttatctgttgttgagattgacccatcacaggagactgagctgcagtttgtgcccagtgaaaaagaaaggaagccctttaagtttgatcatgtttttggaccagaggatgaccaagaggccgtcttttcacgcggggtgcatgttgttaggtcagtgatggatggttttaacgtatgcatctttgcatatgggcaaacaggaactgggaaaactttcacaatggaaggggttccagaaaataggggtgtaaattatcgggctttggaagaattgttcagaacgtcagagaaaagaagtgcatctgttgcatacacattttccgtaagcatcttggaagtttacaatgaaaagataagagatcttcttgatgagagcaatgatcaatcaaaaaggttggatattaagccaaatgctgatggaacacaagaagttcatggtttggttgaggctccagtttataacatagatgatgtgtgggagaaactgaagtttggtgctcaaaatagatctgttggctcaaccaattctaatgaactcagcagccgctcccacagtttggttagggtcactgttaggagtgagcatttggtgacttatcagaggagcagaagccacatgtggctggttgaccttgctggaagtgagagaatagctaaaactggggtagaaggagatcggctgaaagagtcacagttcatcaacaaatcactatctgccttgggtgatgttatatctgcccttgcctcaaaaaattcccatattccataccggaattccaagttgactcatttgctccaaagctctttaggcggcgattgcaagactctaatgttcgtgcagataagtccaagctctatggattcaggagaaactctcagttcactcaattttgccagtagagtccggactgtagaacatggccctgctcgtaagcaagtggatccagctgaaagtttgaagttcaagcagatgactgaaaaacttcggcacgaggaaaaggaaaatgcacagctgaaccaaagcttgcagctgatgcagctcaagtacgcttctcgtgagaatgtcttcaggacactaaacgaaaaggtgaaggatgctgaacaagcatgcagaaattatcagcaacggattagagagctggaaagtgaattaggcaatgagaaaagggtttctagggattctgctagatcctcaaggccgccacttgttcctacgagacagaagcagcctcacggaaggaacgcgccaccttcaggcccttctagatggaggctcaaagcccccacaatccacaacaaagagaacattcctgtgacgatgagcaaatcaaatcctggggatgacactaataaggctgttggcagagcaaggcgcgtttcacttactccggtgattcgacaaatccccatccagcccaagaggcggtcttcgatagcaatactaccatctgtgagagagcatctttctgtgctaaacgaaaagagagcagcttctcgactgtcgcaagtcaacatgccaagaagatcagtcgcgacctttggtttgaatttgggtccaggaacacccctggcaggacatggtggacctgttgacgccaccccagacggagcaaagttcaggagatttgatctaggaagcagcagcagcaagttcacgagccctcctccgaatgtcaccccgcagcggaagatgggaatggcaccggcgggaggtcctccaaacgcagccaagctgtgcttcagcatccagaaaagagttactcctgcacatgttcgggcaaaacctggtatgggcatctttgacccagctcttcgtgagaatatggttgtggggagaaccggcaacgcgctgcgggtgctcaacggcaagaggagacagtctgttgtctaactctggtactgcaaacgtttggacgttcgaacggagctgcagtgtggtgagaatgatggtgcctttcagcttgttcttagtgaaaccgtattaggacagaagatattcttctcagcatccgtaagggcttgtttgggtaatattggagtggagtggattgaggtggtataaagtgtatcgaagtgtaatatgaactaatttccttttcaatccctaaaatacacttcaatccacttcaattcctctttatccaaacaaggcctaaatagattttgattagttcttactagttgataagaaagctatgttatggaagtcgtcgattgtatttttcgttactaagaatcgcttgctagtgc

SEQ ID NO: 18922 - DNA, 3316 bp, Zea mays
tctatagtcgacctgcagtttgtgcccagtgaaaaagaaaggaagccctttaagttcgatcatgtttttgggccagaggatgaccaaggtatatttgactgaaactgtacctagctgacttgtcaagtatgctagtagtatacatgtttaagggtgacatatttatcggttgctttccaacctttttgtgcagaggccgtcttttcagaaacagtgcatgttgttaggtcagtgatggatggttttaacgtatgcatctttgcatatgggcaaacaggaactgggaaaactttcacaatggaaggggttccagaaaataggggtgtaaattatcgggctttggaagaattgttcagaacgtcagagaaaagaagtgcatctgttgcatacacattttccgtaagcatcttggaagtttacaatgaaaagatcagagatcttcttgatgagagcaatgatcaatcaaaaaggtataattccttcctttgtcctcttggtgagaaaagattcattgctttaacaatgttatgttgttgcaattcaaggttggatattaagcaaaatgctgatggaacacaagaagttcatggtttggttgaggctccagtttataacatagatgatgtgtgggagaaactgaagtttggtgctcaaaatagatctgttggctcaaccaattctaatgaactcagcagccgctcccacaggtgagggctttggtgtttcatgatgcgttatgtgtttattctaattaattaagttcataatccaggatataattccactttgtaaggttgaccactatgatttagattcagtttttgtcaattatcattactatactatattactatagcactgagataaaacattttgcctcttgcaatctatttgcagtttggttagggtcactgttaggagcgagcatttggtgacttatcagaggagcagaagccacatgtggctggttgaccttgctggaagtgagagaatagctaaaactggggtagaaggagatcggctgaaagagtcacagttcatcaacaaatcactatctgccttgggtgatgttatatctgcccttgcctcaaaaaattcccatattccataccggttagtgctatcacatactaaggcacctactttgcttagctgcttaaattatcttggtcttattacctccatttcctttttgctgtcaactaggaattccaagttgactcatttgctccaaagctctttaggtaacttttcttcttttgctacttatgtggcaattgcacttttgtttttttagcaaactgttgaagtttcatatcctgttgatttcatcagtgtactagaatgtatcaaaaaaaaaggccagttggtggtgaacttgcttgttctatgtttttacaggcggcgtttgcaagactctaatgttcgtgcagataagtccaagctctatggattcaggagaaactctcagttcactcaattttgccagtagagtccggactgtagaacatggccctgctcgtaagcaagtggatccagctgaaagtttgaagttcaagcagatggtaatttgaatctcccacactgaatagtcatgacacgacatgatctggttgcatcaactatatataaaatctatttcagactgaaaaacttcggcacgaggaaaaggaaaatgcacagctgaaccaaagcttgcagctgatgcagctcaagtacgcttctcgtgagaatgtcttcaggacactaaacgaaaaggtattgcctcgattctcattgtattgatttgtttggatcctattggatacatgctgtcatggaatcaaatgttaacagaagaaatgttttgcaacaggtgaaggatgctgaacaagcatgcagaaattatcagcaacgggtaagtaggggagccagttatttctagttcctaaagactctgagcccctccgtgtattctaacctttacttgtgaaatgtactcctctgtacagattagagagctggaaagtgaattaggcaatgagaaaagggtttctagggattctgctagatcctcaaggccgccacttgttcctacgagacagaagcagcctcacggaaggaacgcgccaccttcaggcccttctagatggaggctcaaagcccccacaatccacaacaaagagaacattccggtgatgatgaacaaatcaaatcctggggatgaccctaataaggctgttggcagagcaaggcgcgtttcacttactccggtgattcgacaaatccccatccagcccaagaggcggtcttcgatagcaatactaccatctgtgagagagcatctttctgtgctaaacgaaaagagagcagcgtctcgactgtcgcaagtcaacatgccaagaagatcagtcgcgacctttggtttgaatttgggtccaggaacacccctggcaggacatggtggacctgttgacgccaccccagacggagcaaagttcaggagatttgatctaggaagcagcagcagcaagttcacgagccctcctccgaatgtcaccccgcagcggaagatgggaatggcaccggcgggaggtcctccaaacgcagccaagctgtgcttcagcatccagaaaagagttacgcctgcacatgttcgggcaaaacctggtatgggcatctttgacccagctcttcgtgagaatatggttgtggggagaaccggcaacgcgctgcgggtgctcaacggcaagaggagacagtccgttgtctaactctggtactgcaaacgtttggacgttcgaacggagctgcagtgtggtgagaatgatggtgcctttcagcttgttcttagtgaaaccgtgttaggacagaagatattcttctcagcatccgtaaatggattttgattggctcttactagttgataagaaagctatgttaacattgcccatggaagtcgttgattatatttgttcgtcacaaagaaagctatgttatggaagtcgtcgattgtatttttcgttactaagaaccgcttgctagtgcacttctaaaccatgttcccggaacacacccagattctgccgccgacataataataatgtttgttagtgatcgatcacaggttatggcaatcacattcccgttcattttccaattttaaacgtgtctttaggtagaccgtgttagatagaagatgctcttttcagcatctttagaacttgttcgattatttcaattccatgtggattagagtgtattagaatggattatggtagattttgacttgttataggcttaaatcgacttaataccatccaattcacatggatta

SEQ ID NO: 18923 - DNA, 1515 bp, Zea mays
ctttagggtttttattttactagacttataaatatgcaaaacaacagaactccccactatctaggaaaaagaaaagaaaaattaaggaaaagagagggtaacacctgaatttggtggatattagaaaagaaattttatacccctaaattccgggtgttacatgagtctacttgggagagaaaagaacaacttcgaatagaatttccccacctcttccctagttcttcctaatctcgaggtcgagattatttttagtggggtaggatttgtaatacctaaattgtaaataataagaaaagagttgatctccttatatgttttgccctctacttatcagaacatgtgaataatcatatttaaaaaagagataatttaatgaatgacacataaataacctatgcatcatgttggagtttatttgattgtgaatttataaataatgataatgataatatcaataaaaatatattaatgtccaaatttggaaataatacttaatttgcaatttagagtttggagaaaagaaggaaaaatgatatacaaaataaagaaaataaatatacaaataaatataatctgttcatactggtatttaaatttaagcatttaacctaagtacgaatttcacaacaaatatgaattcaaatttgaaacctaaatttgaaaaagaaaaaaagaaaagaaaagaaaaggcaaagagagagaaaacctatctgggccgccaaccacaattcggcccacctggccatttcttctcttcttctgcgcggcccaatctcgccataccggcgtcgacaagtaggctcgggacgtcagcctctgcgcgcgcgcgccatctttgctgtgtatcattgactggcgggctcgcatcgccagtcgctccctccgccccgtggctgccgtgtgggacctgctcctgtgtgtgcgcgcggtctctgccagtggagcccacgcgtcatactctgcctcgccgtcacaaccgccgcacgcaacggattccgtggaaatcgggcgccgtgctgaccgtccgcagcttgggggagcccagtactcctctttctcatcgaccaagtccccgccgccaccctcatgagggaagagaagtggccgccacctgccattttcgccctgccatcagttcgacctcggggaaggcgctcagggcgtcgatgatagaccgtgggagcacatccgagactcacctgcgctcggggaaatcgtgcattgtcggaatttctcatcggtgcgggcctctgctccgacatccgccccacaccatgggcgagggaaccgcatcgtcggcaccggagaagaacaggtgctctaggaggagccttacaacgaagagtatgagctcatctaggtggtgtctcccagtcagctttatgacgccaaggatttatgtttagttcgctttattgttctcatttatttttgtaagactcccgctatgtaataatgatatttgtgatatttattgttctcattatatgtgatgcaaaagaaaaaaaaaaa

SEQ ID NO: 18924 - DNA, 900 bp, Zea mays
aaatcaatgttagctttcttccacccactgtggcagtcacagagccgccgcgatctgctggccccaaaaccctagcttaatgggagccgccgctgccgccgcgggtgctgatcctcctccctcggaggctgccgctacaccagccagagaagatcaacagcactacgtcgccgccgcgactggcggcgtttcaggcgaatcgtgcgatgcagcggcgcctcctgctggtggaggcggcgcagacgatgccgtggagcctgtggtcatcgatgcctccgcggtggccggcggagcaggggaggaggagcaaggggagtgcgggttctgcctcttcatgaagggcggcggctgcaaggacgagtttgtcgcgtgggagaagtgcgtggaggaggcggaggccgccggtcccagcgtcgacgtcgtggagctgtgccaagacgccacggccgctctgcggaagtgtatggatgcgcacgccgcctactacgagcctatactacgggccgagcgcgccatggctgcggacctcgagtcatttcagaccgaagaagccgcctcccactccgcggcgtcggcgttggcgtcggaggaaggccagagataggcggcggcggcgcgatcagacgaaggccagaataagcaggtggctgagacggcagtttcggaggagagcagagatcccgcactctgatcgagggaaacggcagtcggcgtctccatttttttttgagggatttgaggatatgaattccgtttattctttcgagcatcaatcaacatgtttttgataggagagcatagatttctgtcctcttctctctacatgaatatgtgattgactgaaaatcaaaactatacacgtgttgccaggctaatcatacactaaaaaaaaaaaaaaaa

SEQ ID NO: 18925 - DNA, 677 bp, Zea mays
attaagaaaaatgctgcagcctgtcttttactactcatttggtagccggccgacttaaatgcctgcaccaacacacagagagagtgtgagggaatcagcgaagcccataaagatgggcctcctcgccgcccccaaacgcattccaacactacacacccacctagcctagcaaccagccgccgacctcctctctaccatggatatgtgccttggagccaaaagatccatcatcaccaatcttttcctcttctatacctcctcatgccgcggcatggatctccttgttcgtttgtcatctagctaggagtatctggctagctcgccggccggccggaggaggaggccggagaaagaaatggaagtgtgactatggtgttggctcggctcactcagaagttgaagccgaatctaaatggtagctgccggcgtttctgattgagccgtgccaatatctcagtactctttcatgctgatctcgcgtcacgccagcatcgatctcttcctgaagtgttgtagtctctctctcgtactctcatgcatcttggtcatgtgttcttatactgtctcttttgcttctgctgcctgccagtatgtgtggactgcacacgtacattgcttttatttcgattcgtttataaagtttcatggcacggtttgtgtgaaaaaaaaaaaaaaaa

SEQ ID NO: 18926 - DNA, 883 bp, Zea mays
  misc_feature (831)..(832): n is a, c, g, or t
  misc_feature (873)..(873): n is a, c, g, or t
attatatattcaccccccagcatccatttgtcgcccgccggcggccaccgaacccgttcctcccccgtccgcttgcgcctccctctgccttcgcgcatcccggccagagcacgtgctcctgtcccgcgccgccgcacgcatcccccgagactctgcgttccgttgctagaccggggtgcgccgatccattccgacttcggcctatctatccgttgtgataaggggccccctcgtgcttgggtcgatcgttgaaagatgaactccgtccttgtcttcgtttcctttgattggagcaatcgaatccacatcgttctctaatttctagaatggtgctccaatcagctcagcttgttgatttggtgaccgctaaatcccgactgtgttctgcatttctttggaggttcacccctatgtcatctccactctattgtgattcgattcggataattaatccctttttatcttccgttcataatcctgtgtgcgcggtagcaattagtcttccgatcgtttgggatttcgctattttactgttctgtttacttccagtagagttctatatatgttacatgtgactgcatctgtggctgattggtcctgcttttaatgcgaagtctagcaaaaattagcatctcggatagcttgtaagtaaatctgtgccaaattagcatgatttattttttgtgtcgctttaatttaacaaaatattcctagatcgatatccctagtgctaaaccttttcagccttgctttcgcagctagtggaatcgaactgtttttgagactgtacaaagagttccttatagttaatctacatattgacacccgggnncatacgataagggaatgtgttgatttgatattattgcaaantgggcgatgg

SEQ ID NO: 18927 - DNA, 1536 bp, Zea mays
  misc_feature (121)..(121): n is a, c, g, or t
cgacatctctgtatgttttggaccactcaactgctgtggctaaccgtattagtcgggcttagtttatcttggatcctggcttgtatggttcatcttattggtagaccatgcttttgtactngtgtctgcacatgttagcagaacatgtttgtactgccgagtccacagatcgagatgccatctacttctcccctttgcctcagacgtggtatacgacggagaacaaattcaccttagactcttagagcgtactcgcatgttctggtcaaagccgggcaagaattcctgttgccgcaaagtgcaggataaacaaggacacttgccatgttattaaattgagcactcctccttttgtttttgtataaaccagagatcgccggacatgttgccatggcgccgctcgatcggacattattattataattattattttgtcgctggatccaacagcttcccagcctgctaatctacataaatcgcttagacagttgggtgtgaactgttttcagcatctctcacaaaaaaaagtctccggttcgacctcctgcctctgctgctcgcatggccagcctcgtgcaccaggcgtccatgccggcgatggcgccgccgccgccgccgtgcgacgacgagttagtcccgcagggcttcagctgcttcggccgctcgctgtcgcgggcgtcgtcgtcgagccgcctggagtacagggcgctgcagggcgaggagaagcgtaacgccgcgcaggacgcgcggtcggcgcgcgccaagctgcgctggaaggcggtggcgcacgagctcatggccaagggcggcggcggcggcggcggcggcgcgcggcggaggaagcagcagctgggggccttcagctacgactcccggagctacgcgctcaacttcgaccagggcgccgacgagtagcagcagcgtgctgagctcgctagctgctgcgggcggcgggcctgctcctgcttgcggccggctgaccctacgcgcggtgcggatcggagcccgaaacagcgggggttgcacgtgcgtgcggtgcgacccgaaggagcagccacgagtgaccgcccagcgagggaacaatggcgatctaatctactacccaaggaagaagcatgggttttactgtgtaaagatctactgctccgtagtagaaatcaagtccggtcattattgctcttttcttttcttttctttttttcattcagatggcacgaccatgtttgggcgattcgtcatggaatgttcgcctcctcagagcagtttcatcaaatgttcaaatgtgagccaggttgcttcaaggacgaaataaacttgtttctatgaacaacacataaatattgaaatattaattaatcagacggaaattgagattaactaacgaggtcttcaaatatgcctagctgttacagcaccttggaaaatgagcatgcaacttgcgccttgaaaaaactaaccattcacatagccagtgacatccttcttaccagtcgaacatgtcagctttgccttaattattagtggttttttttctca

SEQ ID NO: 18928 - DNA, 1288 bp, Zea mays
  misc_feature (916)..(916): n is a, c, g, or t
atgcatctacgtgatgggtagattagagcagggtagagaatagcacatctagggtttgggaatttgccaccggtgtcgtggctccgccccgaatccgcctcacacctcgggaaagctacctcgcaactccattgctggcgaaaaggactcccctaggtttatctagatctctactacctattgcacctgtccgcatgtatggttgagatcgggatggtcggtttagggtgcgccggcgaggcatcgccgccgtagggaccctgttcaccacagctcgggtggcgggaagggaaagggagagatgaaatgggaaaattttgctattttatccctttcagtgtgctctttgttattatgtcactctatgtttatgacttatgcaaccatttgtgtttatgatttatggatctgatagtaaaatagagaaacctacaactgagagtgttaaaatagcaaatttctgaaataaagtgttgcagttgtcgctgaaaaaaaaaaaaaaggctgaattagagggcaggtcccccttcggcatattgaattcttgatctcagaacgcagggatcagatgagataacttaaataagtcgtaggatttagatctaagggccgagatctcatagctcctcacgatatagtctaggccatgtacttaaaatccaacgaccatgattcacttatacccattcgccaagcaaaacttacaaaaaaaagtccctgagaatattaggaatcaaccctccaactaaactatcacatattcattaggatctaaacctcaaaccttatggccctaattaacatagttgtgttaaattaccttaactaacacatatcagtcccaattcaccctactcttaggcgtcattgtttcctacaacatggtcgctttgcactattttacactcttgtatcntagctatatgtcattttagcttatatatataacatatagacaatagaatttgagtatataagaaaaccaaaacaatctataaaaaatgtaattgcatattatttttgttgctatattcttactctttttcgtcttatgaactgtaacaaaggaagtgaatgctatattcattctcctaaaagcaacgttaataatatagttcatagtgtcatgtcacataattaactaaaagagtagtcatgtaataaccctctcatgatataagttgtacatttaataccaacctactttcaactatctgctagcgcatgtataactctgagcctttggatcggttttcaattacaagagataactaaggaaccatatgat

SEQ ID NO: 18929 - DNA, 4824 bp, Zea mays
  misc_feature (955)..(955): n is a, c, g, or t
  misc_feature (1377)..(1377): n is a, c, g, or t
  misc_feature (1410)..(1410): n is a, c, g, or t
  misc_feature (1821)..(1821): n is a, c, g, or t
tattttttaaatattaaatatgttctaaccaattcggttattcactttcatccctatgtggaatgatctagcaatttgttaatttgttcaaatagtttagttagaacaatcctcttgctaatattgtagagcttctttaatatttttgtatgcttagatagagactcgctgctacttgttgttggactcttcctcttgtgtcgagctcttgtcttattgtagctaatagcatgtgatgcgtccacatttttttgacactggcctatgatcaccatctaagttaagacataattttttgctccaatcactcgagtcatcatcaatgtgtttgtgcaccacttgggttgatggtgacgagccacagcttgaactcgatttctccaggcttgttgcggaaactttctttggccgcttcaagcagcatagcattatcttcttcactcgcctaaagcgcgtacaagctgttgtagatggcattaaagagagtaatcttctcattgttcatcgataacttatccttcaattgcttgttggtacggtggcgagaagcttttgtggtgtagttgtatgtgttggctatttgccctagaatattggacccttcttattattgccatcaatagggtcaatcgagtgcagtagccacacataaaaaaaaactattatgaacctaaaagaatcttcttattgttcgtcggccgctaatccttccattgtttggaggtacggtggtgaggagattttatggtggagttgttcatgttggctattttcctccccctacaatattgatcacttcttaattttggtattaatagagtttagcgagtgtagtagccatatatatatacctaaaatatgaacttaaaatactatcagggatgatatgtggactttggaaaaacatacttattggcaatgagacggactagattttaagagactattcatggcngcttattaaaaaaattatgaaataagctgcgccaagcagagcatccggctgcatctctgctcgagctcacaatgcaactgcgcatgtggaatcgccgctttcctcatcagctcctcatcctctcctccgtgacttggtgggccaaaaccaaatattcaacatgatcatacggaccttcacgttcggtgcagcccacgtctctgcgatcaaacgggccgggcctgccgccaaacctcgtcggcttcagacggcttcagagggcgtgcccgacctggcggctggcgcttccgccggctactacggcaacacgtgctgaccaccgccggcgactacggcaacacggcaaaaagaaaattgttagtagtttaaacgccccacgttatgtctatttcattttgttttctacatttattatatattgnctatcttactttttcatttgcatgcatgtcctnggctttttttagctgttctgcggtcatagctactgtagctgttcggactactaaatctataatccataaagacaaaatactatagaagctacagtcgcatacaacagcctcttccatgtagaaaaaaagagaaaatttgttcaatcccatctaaatttatactaattccttcaatgtcatcaaaatttatagcttcccttcaatgccatcaaatttaaattttaatcccttaaataccatcgtcgttagttctatttaaagttgatctctccaatgccatcaaaatctatatcgatctcttcaatgccactagaaattagttcgatctatttgtgttttaaaaattccataatcaaaaaatacgaaccagctttttaaaattcgacgattgtaaaccccaaaaattactcngctatatcagttcggtctatttgattcctaatgtttttttcaaactaacaacaaacactaatgatgacaaagggagctaattctaaaaatcaatgtggtatattcgcgtttcaaaaattttggattctaaaaatgtggattgaagttctaaaagtatttaaatatttttaaaaaaattcagtacatatttttttaggacccagaaaactatgtggttattcgtttataccaatttgatctattcagtttttcatatattttttcaaatttattaggaagcagatagattaaactaatatatcgaagtaattttggagttttaaaaagtatggactaaagtttttaaaaatcgtggaattttaaaaatttggtccatattttttattctgggatttttaaaatctaaatagattgaaccaatttctagtggcattaaagggattgatatatattttaatggcattgaagggatttgctttaaatggaactaatggagttagcttcaaattacggtgatgatatttagagggttaaaatttatttaagagattaaaatttaaatttaatggtattaaagagaagctataaattctgatggtattgaagggattggtataaatttagatgggatttttttttaaaaaaaaagcgtgaaccggaacaataacggcaccaaagaaacacacgctacgtcacctcaaccaacgagacctgtttcacttgggaattgggatccactgcaatcaattcgaagaccaccggatggtcagctgcatgcacgaaatttctccggctggttgcatgtgtccaccacaacttactgcctgctgagttcagcatagtttatttgtttcagaaagagatgcaaggtccaacaaggcacctttcatagccatgcatcgaagctcttgattgctttgctacagggaaggacattttcaaagccaccggtggctccggacattttgcagtcaaagcattcagcaccgaagcaaagaaagaagggctgaagctcgcgcaggcatgtcgacgctcgccttcgctgtgcgccggcgcgaggcggagctcgtcggtcctgccgcgccgacgccccgcgacaccaagcgcctgtcggacctggacgaccaggccattctgcggcgccacgagcggctcatgttcttctaccgcggcaggtccgggtcacgggccaccaacgccgacccggcggccgccgtccgccgcgcgctcagcgaggcgctggtcccgtactacccgctcgcggggcggctgcgggaggtggaggaggggcggaagctcgccgtcgactgcaccggctagggggtgatgttcgtggaggccgacgccgacgtgcgcctggcggagctggaggcggccacgggcgggctgaggccgccgttcccgtgcgtggaccagctgctgttcgacgtggaaggcagcggcggcgtgctcggctgcccgctgctgctcgtccaggtgacgcggctcctgtgtggcggcttcgtcgtggcgctccgcctcaaccacaccatgtgcgacgcccacggcgtcgcccagttcgtgtccgcggtggccgagctcgcgcgcggcctcgctgcgccggccgttgcgcccgtgtggtcccgggaggtcctggaagcgcgcagcctaccggagccagccggcgtactccaaccccatcgccgcgaccatgacgtcgtgccagtagtaccgcagccaccgccgccaccgcccggagacggcgacatggtcgtgcggacattcaccttcggcccgcgcgacgtcgcggcgatcaagaagcgcctcccgccgcgcctccgggacacggccacgagctacgaggccctcacggcggccatctggcgtgcacgcacggcggcgctggagctcgcgcctggcgaggaggtgagcctcgtggtcgtcgccaactgcaggggcgtgcgtggcctggggatccccgacggctactacggcaacgcggtcgcgtacccggttgctcgggccaccgcgggggcgctggggctgggcaacgcggtggagctggtgcgggaggcgaaggcggcggttgactgccgagtacgtgcggtcggcggtggacctccttgcccggcgccgcgggtgcccgccagcgctggcgacgatggctaacgtcttcgccgtgtcggacaaccggcacgccgggttccatcgtgttgacttggggtggggcgtgcccgtgttcggcggcgtcgtgaccaccgtgtttggggcaagcttccttgttcccgttagcggcagcgacgggaaggaagccgtggccgtgccaatcgtgctgccacgtccagccatggatcgtttcgcgtcggagatagagatgacactgacactgacctgccacgccgcggtcggctcagcagcgccgccaccaccccgtgggagactttgaacttgccttgcctgctgcgttacacgaacgtaacgtctacgtagaacgtccgtgttatgcgttccatgtttacaatttgtccgtgactatgctgaaaatagtcatctttggatatatagtcataattatgttaatccacgcgtgatagtggaacttaaacaaaaaaaaaaaaaaaaatatataggttgggatgaatccgacattactcaaaggtcttacacgtatagaaacaacgatagataagatgccggtcttatatatacttccgggccctcctaaataaaatacaaacaatcagagttcaaacaagatcttaacgagataagaataataagccgagttaatctaatcgcgggggtctagaccgtccgccactttaggccttgttcggttattcccaatacacatggattggatgggattggaaaaaattcttaataagtttgacttatttgggattcaaaccaatccaatcccactcaatccacatggattgagagctaaccgaacaagcccttagggttcaactgattatacgtttcttctagtcgctggcaatatcacacattaattataaa

SEQ ID NO: 18930 - DNA, 770 bp, Zea mays
ggcgattgggacccccgtggccggccgggaggcgtcgtcgtggtgcgtgcctagcatgcatgcatgtgacgacctctcctcctcgctgtctctctgtatctgcaactgcaagcaaggaaattaattaaaagaagatcggcgccatggcggcaacgacgacggggatgcagatgatgcaggtgcagcaggcggcggcgttgctgctgtgcttggttgtgttggcggcgtctacgcgggtcgcgctgggcaactgccgcgacgactgcatggctgcatgcaacggctggaccatcgtctgccagctctcctgtgccagcgcatgctacggagaagtcgggatcacaaccttaggtacgtcggctgtattagcgaaagcagaagcgcctgcatcagcaccacaagcagcacaagagcgaggcgccgccgccggcgtgtccgcgctcagagggttcaagctatcatcaccgacgacccgtggccgtggatgaattaattaaggccccatgcatccatgcatcatgcatgcatgcctaagctacctcccatttctttgcttctacaatgcatgcatgcagatattaattaatcatcatcaatcagcatgtacaaacgagccctacgtactactgtagtacatacgtacgtacgtacgtactagcaatgcaattgagttattaagtctaaaaaaaaaaaaaaaaaaaaagcggccgccgcctccgcctccgccgcgggtactacgggcggcggtggcatcgccgacgccggggtac

SEQ ID NO: 18931 - DNA, 1206 bp, Zea mays
attataaagagccatggggcgggttggggtgggtttgttagctgattttctgtatagggtttgggttggggaaactgcttcataagctgcaggtcagggcgggttcagctcgattagcaggcttaatccagcacctaggggtggtaatggatcgcgatccaaatgcttcttcacaaaaggttagggtcctaaataaattttagttcaaaaatgaatagaaatagagcccgatcctagtccgatctgatccttaaatcttatactgtaaaatttagagcccattgtcacccctaccagcacctgggtttgattctctgtggaacagtggaagtgaatttcagggttggttaaaaacctcccttgctggcaacctgtgaaatagttgcagggcactgccctatgataatggtggcagttggcctgtgtgactgactggtgtggtcctacctgagggtagtcatggggcgctgaacctgggctgtgggcctgcggacaccaacactgtagggtctgcactgtcaggattcaggcggtttgtgtgtttaaagactgccgtttcttcttccaaacaaccccatggggacggtttttccctcactgtccgaattatagttcaagcacatgatttttattcacatcttttagagcactgcttctgttctccttgtatcacccttcatggagaatttccagcgataatacacttgtatgtctatcttaggttgtcttgttttggatttatgcattaaggattcattagggctatataaagtttgtctataggagacatgcatggcaagttatggcgtattcatggttcttaaagcggtaaggcgagttaaggcgttggaccaccgcccggacgcctaggcgaagcctaaggcgagcaaggtgacaccttatctatctaagaacaagcaagacaataacatggagaggtagagaaagaaaaaaaaaaaaaaaaaaaatgaagggaaggggtagcaggcccagcccaccatctagcccacatatcctccctgttgccctcctcccgctgatggagccgcccctgccctcgaagcagccatcgccaccccagatttggcgccactaacctcgattcgagcgtcgccaccacgattctggcagccgccgctccgattcaagccaccgcctagctgatttggtcgtcgacgccccgattcgggtcgccgccgcccgatt

SEQ ID NO: 18932 - DNA, 1579 bp, Zea mays
  misc_feature (136)..(136): n is a, c, g, or t
  misc_feature (529)..(529): n is a, c, g, or t
  misc_feature (1154)..(1154): n is a, c, g, or t
caccacagctcttaaacgagcggcagccaccaccagacacttctcccaagtccgaagagccaatcagaggcccaccgaaatggagctgaagaagtctcccgcgtcgtcgtcgtcgccgccgcctccgacgggcttntcggtcagacagcgcggccgccagcccgtacgtcacggcgccgtccagcccgcgcggacgcctggtcccctccgagggagcggcggcggccctattcctgacggcgccgccgtcgcctagtccgttcggcctcctgccgccggccaccccgacgcgcctcaccggcgccgacccgttcgacctcttccagcacttcaccagtgcgccagccagcccccggcgcgccgcggccatatacgcgcacgtcgccgaggggagcggcagcgacgaccaggagtttcagccgcgccgccggctgtacgccgccacaggcggatcgtccgtgccgttcgactgggaggagaggcctgggacgcccaagagggggctcggcgggggcgtgcccgccgcggnacgtggcggcatgggacacggaattcgagttcggcacgcgagtcggcaacgccgcgccggcggtgacgcttacggcggccgacgagctctttgagaagggcaagatcaggcctttgaagccgaggcccaagaagacggccgacgacgagcccaagattcgtccgttgaagccgccgccggggctgctcgacggcgggagcgtcacgccgtccccgcggtcgccggtcgtggccagaggcgcaggcgccatgtggtcgccgcggcggaggagcagggtcggctccggcgtcgatttcgacccgttcaccgctgcgctcctagaggcaaccaaggcgccatcgccgctcggcggcaaggacgacgagggcggtgttgctgttgccccccatggctcgccgcccacgagaccggccacgcgtcccgcgtcgaggagcgccgggtggagacggtggcggctcagcgatctcctcctgttccggagctcgtccgacggcggccgcgtcaacagctcgacgtgcccgtcaagagggcgagcgcagcagccggcggcggtgacgatcaaagccagcgccgcaaagcgcgaggacatgggcaagggctggaagcacggcgacggggacgcggncgcggcggcggcggcagacagcgtcgccgggtgcgcccggttgagcccgctgcagcggctggccaaagggctcggcctactcgtggcatagtcaccgcggcatggcggcgccggcgaccaaagggtgaagaatcatagcgttattttgccgtatttctttgcccggttattgttcatatatactacaagacgtgtcttctttttgcacagtgtgaaaacatgttcgagtgcaatttgcaaccaatagtgctcttggtgttggtttctcacgttgtggaccttgactacattatcgtcgtgtactatttgcacaagtagcaaacgtggatgtgaggttgtgtgcgtgcatcgaactcagtatattgaaactctgtattattttcgacacgagttattataacttatagcgaaaaaaaaaaaaaaaa

SEQ ID NO: 18933 - DNA, 333 bp, Zea mays
  misc_feature (34)..(34): n is a, c, g, or t
aaaaacgcaggaggccatggccgccgccgccgcngacgccggcgccggctgctaaggggctcggcccgcgagcgcctgctgccgcggacgatggtgaccgtacgggccgggccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtcttctccaataaaaaaaaaaaaaaaaag

SEQ ID NO: 18934 - DNA, 4592 bp, Zea mays
  misc_feature (3716)..(3716): n is a, c, g, or t
ctccttcatcgaagagaaaagttcagagatatactctatccccctgcgttagtggtatgtgagaatataacagtttggttgtctatcaatttgatcttcctttttatgcgttgtgttcttattactcccagaaataattagagggttagggacatatgtgctttgtggcagttatcagcttgttttaggttttggatgcttcctggtacatgccggtagagaacagggaatcatggaaagaatatcaggttttcagcatcagctatctcatcttcctttttgagataattgttggagctaaagtgttctggtatcctcaggtggcacacatccccagtgcgctattcttcgacttagatggcatagttgatcggacaactgatgtgagaattatttctagatatactttgcaccctcatttttttcattattttagctgaagtatagatacagttacaaaattatttgttttttggtcactaagcaagaactgacttctgccatgtaggcatgtcccttccggtatccttttgagcaatgtgtgctgcttcaaagtatttgttcttttctacaattttttttcatttctcattatttctgggttttgctcaatagctattctgtttgttctgatttctgaatgttttctctatgcatattgttttgtttgaactaattgcagctctttataaatgattaacaattcctttcagatcttatctagtaattttagatccttttacttttcttattgtctagtaacggtttgtttgtaatttcataaaaaatgttttggcaaccaacattgcggagagtagtatcactatagatgatgttgtctatgtgattgattgtggtaaggccaaggagacaagctatgatgccttgaataagctcgcatgccttcttccgtcatgaatatcaaaagcttctgctcatcaggtatgttactgctgacaatatgtaactaggctctttgcagacatgaaaagtccattaacagatgcagttctctctttattttattcacagaggagaggtcgtgcaggccgtgttcagccaggtttttgctatcggctctatccaaagatcattcacgatgcaatgccacagtttcagttacctgaaattcccaggactcctttgcaagagctatgccttaccatcaaaagcttatagcttggagcagtatcctcctttttagccaagtcactgcagccaccagatccactttctgttaagaatgctattgagcttcttaaaaccattggcgctaagccatcgattagcacctaggctactagttggctgacgtttctcgtttatctgtttgtttgttctgacagccagggacgagatggctgagggctcgcgctgctgggaagcagcaggtcagggaattcgagcttgttcggggaagggcgcacacggggaagaagagttggatcgtcagctttgatggcgtcaacaacctggacgaggtctgcctgctttgccttcccctgcagtcatttgcattttgccagttaatcttatccctcaactagtctaagtggtagtgtagtacgcagtcttgcttagtttctagaatgagcagttatttagtggacagtttgatttgaatcctttacttaatgtaaaattctttgttgtactgtttctgttcctctccgtctacatatgagatgtacagtcacagatggtaacagctggccgtctaaggccctatttggaagcacccaatttttaagaaactgctttatagaaattgaggtgcttccaaacatatcagtttagaactcagtttatagaaattagattcttagtttcttaaaaaccaagaagctggactctcttaggtaaaagataaaagcagtctcttaaaaactaggttgcttccaaacagggcctaattctatgactggcttgactgtaagagtaattccgctcaaactacccaactttactcttcgttttctgatgtaatccatttgcccttctcttttcaggctaggcaaatagttggttcagctatacttgtgaaagctcgagatagaccagaaattgaggatgatgaattctattcacttgaccttgttggaatgagagttattgtcaaggtacttacatctttgttgtatttttcaagatattgcagcagtgtcgcttcattggttggtttcagttacaaatttacgatgtgatgtaggcagttttaaaaggcatgtcccatgcacttttataattcttgttaaggagaattttcgtctatgctacttgtccagtcatggttttggtccatgccactgtaaatacttggttaagacataagaatcatttgcgttttaaaatagctccctccactccctaaaagtagacacagctgttatgaccttcgttcgataccttttcaaaactgttttgtccacccccagcaagtgtagtagtaaacaacacggccaaaaaatgcacacataataacctacttttttttggcgagaaacacactatacgacttatttcccatggaagtattgtcaattgtcatcaagtttagtaactgaaattagtccacaggatacaggcaagctcgtaggaacagttggtcagggtttcaatttcggaggtggagatcttctataggtgataatgggctcttctgagggtactgctgttgatccagattcagaaaatcaagattcaatctcatcacgtgagcatgtgtggattccatttgctgaagatattgtacctgatgttgatatggcaagcagagaaatgcggattacacctccgaaggggttacttgagctcaattctcgttctgacaagagatcgaagaaagaaaggcatgcgatggctaggtctgcatcatccttttctaccatccatgctcgcatctacagccatgatttgcatcttaaaagaaataaagaatgtgtcaggtccatagtactgaaatgttgatagcagcagatgtcctggctgaagattgtagatattatattgcatgtattataacaaatcaaattataccattaacttccgtgcttcaggtcctaacaaaaagcaatgtgatatttggtgtttgatggtttatactctgttatttatttttaataattcatgacccagatttgattgttgcaggagtggaaggacaggaaaaggtttcaacgtcgtgtaattgcaggaaagaaggtactctccgaaatggaccaagtccatgttctggaaggtttggtatcaggggacaaggtccaaaaggcatcacttgcagagcagattgggagcattgactttcaattgttccgacatgcagtacattgtgttagcaagcagattgagaggtaacaccctttattcaatatcccaccaaagacttcttaaaaagatagaacaataggtttattcactgtgcttttactatatacacatgttgacactacccaaatgccagatatagaaatcacactttgtttgcttttggtggaagagcaccgtttagtcattttttaaaagctctcatatttgctcttcaaacttgtcaatttcagctcttcaatgaatttgctcgctaactcttcactgtcaaggaaaaaagtgatcaaaataccatacaagactctcatcaaccttggggacaaagctgaacatgcattcagtactgaatttaaaaatggacttgacattcttttgaagtccaaagcagctantgtgcttgttagaaacggctctgactctgatactgagtttctgagtttgctcattcttttagtgaattaatgaaggtatgcattctttgtcattgttgttaattgtaattttaacatatagaattatagatgtagaatatattattgtgggtccttgctctctgtttattttcctataacaacaataacaaagtcttttagtcccaaacaaattaggtagactagggttgaaacccaactgaagccacaattcaaggtttagacacgttagttgtttttatgcagttatgcactcctattaaaggctaaatctttgggtatattctatcttttcaagtcccattttattgccttttcttatgtcaacttcagttttccccagcctctttccactactctcgtgtcttaggatcctactatgcactggtatctcaggaggtctcccttgaacatgttcaaaccatctcaactggtgttgacgtgttgtacaagtttttcttcgattggtgctatctctagtctatcacgtatatcatcgttccaaactcgatcctttcttgtatgaccataaatccacttaacatacatatttttgcaacatttatgtgctcaacatgtcatcaacatgctgcaacatacaacatagcagatctaatcgttgtcttgtaaaatttgtcttttatcttttgtgataccctttggtcacatagaacaccagatgcttgaagccacctcatccatcctgttttgattctatggttaacatctttgtcaatatgtactcatctccctatagcactaaccctaattaccgaaacatatccttcctgaatcctgggcactacttgaccttccaaaattaatatatccttcgtc

SEQ ID NO: 18935 - DNA, 2204 bp, Zea mays
  misc_feature (390)..(390): n is a, c, g, or t
cctcgaggccggccgggccgggctggatcctcctatccattccgtctctcgttcctctcgtcggctcgtcgctctccgagccgcgaaatggcgcctcctacctctgcatcggcgcggccgctatccctccccctcaccgtccctctctcctgtcaccgctcccacttgctccccgcgcccaacgctcgcctcctcccccggcgccgcgtcgcgctcgcgccgacccggcctggcgccacgctcctatccagcctcagtgacgcccgggaggaggaggaggatgaaagtggtttctacgaggaggatgagcaacaggaattcgaggatgaggatgaacaggggtacgacggggagaacgaggagctggtcgaggtgggatacgtgtcgggncggcaccggggtgcgcggcgacgtcctcgtcacgccacgcaccgactttccggagctccgcctcgccacgccggggacgaggtggctgagggctcgagctgctggcaagcagcaggtcagggaattcgagcttgttcggggaagggcgcacacggggaagaagagttggatcgtcagctttgatggcgtcaacaacctggacgaggctaggcaaatagttggttcagctgtacttgtgaaagctcgagatagaccagaaattgaggatgatgaattctattcacttgaccttgttggaatgagagttattgtcaaggatacaggcaagctcgtaggaacagttggtcaggttttcaatttcggaggtggagatcttctacaggtgataatgggctcttctgagggtactgctgttgatccagattcagaaaatcaagattcaatctcatcacgtgagcatgtgtggattccatttgctgaagatattgtacctgatgttgatatggcaagcagagaaatgcggattacacctccgaaggggttacttgagctcaattctcgttctgacaagagatcgaagaaagaaaggcgtgcgatggagtggaaggacaggaaaaggtttcaacgtcgtgtaattgcaggaaagaaggtactctccgaaatggaccaagtccatgttctggaaggtttggtatcaggggacaaggtccaaaaggcatcacttgcagagcagattgggagcattgactttcaattgttccgacatgcagtacattgtgttagcaagcagattgagagctcttcaatgaatttgctcgctaactcttcactgtcaaggaaaaaagtgatcaaaataccatacaagactctcatcaaccttggggacaaagctgaacatgcattcagtagtgaatttaaaaacggccttgacattcttttgaagtccaaagcagctattgtacttgttagaaacggctctgactctgatactgagtttctgagtttgctcaattcttttagtgaattaatgaaggttgtagaaaataaagtttctccccctttaattgtcattgccccagctggtcacgtggagtcagttcggaaatgcctggtagagaatgactattttggttttgacactcaaaaggtgtgggtgctggaagagctggagcttccagttgtcagtatatgctcggagggaaacagaaaaaaagttctgatgaagtctccctgggagataataaaaaagccaacaggttctggagcaatcttcagcttactgttatcaaacaaaattttggaaaccctcaatgaaatgggtgtacagtatacacagatctgcagctcatccaacagaccaatcatcgggcatcctttgctctttggggctgtcgcttcccgcggggctgatgttggcatccaggtctccaagaccggtgaaacattagacgatttcgacgtgatcctttccatcgaccagctgaacaagatgtgccgagatgtcacccagatcaggttctccgctcgccccgaacagaacgtgcacgtcgagcatgtcgacgggcagtgggtcgccgtccagccggaggtggcaaattcccatcgcctgcatgccgaggttacgagtgtcttagactcttgcgctcctgataagctgtgtgtcatggagattgttgagcaataaaagtttcttgcctgtgtactgtacataatcacaagtacttgatagatgcgtgaggtttttcttctgctattgttttgctatgaatttttaggggagcatctacgaagcgccataccagccacccactgcc

SEQ ID NO: 18936 - DNA, 1155 bp, Zea mays
cgacggctcgaccgcactgccagagcagcgtaaagccagggtagggtaacacaatgtcgagcgtcatgacggccgcgaaagaggacgatatggtcgtgcacgacttcgccccgctactccttgtatacaagagcgggcgcctggaacgcccactggccatgccggcggtctcgtccggccgcgacgtcgacacgggcgtcgtgtccaaggacgtggccctctcgcaggactccttatcggtgcgcctgtacctcccgcccgccgctaccacagcgcccgaaaggaggctcccagtggtcgtgtacttccacggcggtggcttcgtcgtcgggtcggccaggtccgccgtgtaccaccgctgcctgaacgacctcgccgccgcttgccccgctgtggccgtttccgtcgactaccgccttgcaccagagcacccggtgcccgccgcgtacgaggactccctggcggccctcaagtgggcgttggcgccgtcgtccgcgaccgactcgtggcttgcagtgcatggcgaccctgcgcgcgtgttcctcgccggcgacagcgcggggggcaacatctgccaccaccttgccatgcacccagacatccgggacgctggcctcaggggcgtcgtgctcatccacccctggttctggggcagggaccccatccctggggagccaccgctgaaccccgcctcaaagcagcagaagggcctatgggagttcgtgtgccccgaggcggtggacggcgcggacgaccccaggatgaacccgacagcgccgagcgccccagggttggacaacctggcgtgccagaaggtgatggtgtgcgtggccgagggggacatccttcgatggcgcgggaagctgtacgcagaggcggtggcgcgggcgaggggcaccgaaaaggacgtggagctattcgaatccgaaggggtcgggcatgtgttctacctgctggagcccgtgcaggagaaggccaaggagctattggacaagatcgcgacgtttgtcaggacggaatgaggagggatgcattggtggtggtggtccggtggacactgtcacactggacatcatgtatcgttaacgtactactactacatactccatccgttctttttatttatcgttgcttagtccaaaaaaaaaaaaaaaa

SEQ ID NO: 18937 - DNA, 1479 bp, Zea mays
gttcccgttctcctcctcgcaactctctcgtccatacgtcgtagccgccgcctgtctctcaccgccgacatcccgacagctctcagcccagatcgagcttcccccttcccaaatcgggttctgcttgggctcccgccaccgccgccctacaccaggtgccaaggccttcgccgacctcttcgccggcgaagagcgcccagcagagatgaatgtagcggtgccaccacatcttcgtctatatgactttgccaagagtgccatcatcaaaatttttgcctttccttatgctacggtctgtgacctgtattgcgacggtggaatggatacagacaagtggtgtgatgcccaggttggccactacataggcatcgatgcctctgcatcgggtgtcaactatgcccgtgagctatgggagaacaggaggaaacctttcactgctgaatttatcgagttggatccttctgatgatggttttgaagctcaagtacaggaaaagggcatccaatcagatatggtttgctgtatgcagcacttgcagttatgctttgagaatgaagaacgggcaaagaagcttctgaacaatgtatcgtcacttctcaaacctggaggctacttctttggcataactccagattcatctacaatatggacaaaatatcaaaagaatgttgaggcttcacataataagggtttgaagactgttccaaatagcattcgctcagagaactataccattacctttgaagtcgaggaagagaagtttcccttttttggaaagaagtatcaactcaaattcgcgagtgacgcggtgtttgagaatcagtgcctggtccactttcccacccttatgagattatcaagggaagctggacttgaatatgtggagatccagaatttaaccgagttttatgatgataacagaacacaattcgctccaatgcttggtggttacggtgcaagttttttggatgctcgagggaagcttgttgctcgttcctacgacattttaggcttgtattcagcatttgtgttccagaagcctgatccagatgcaataccaccgattgtaactcccgacttgcctgatcctgataaaggtcacgaagaggagtggctccagccacagcaggcgccagtggaagatgggagacgctcgcatgcggatgtgcttcccatagaccctgagaaaggcatcctgggtcctggacctgcagacatgaggctttagttgctggaaattcaaatgcagctgagcctgggtagtgattttttttcgtgtgttgtttttccaccataggcattctcccatagtcccatgtggccatgtctcctttatgagtccacgaaaataccgaacaacactacaaggctcatgaatcctgcacggacgcatgggctttcttgtaaaacaaatgctcgatacgtatggccttgtacggtctttgatgtgtataaaaaaaaaaaaaaaaaacaaaaaaa

SEQ ID NO: 18938 - DNA, 956 bp, Zea mays
ggttcatgagaaacaagtagaagaaattgttgttcctcggatcttctgcttgcatgatttcttgttttctattgattttatctgggtccaatttagtctgtttgtcatagctccactttaccggcagagctgttttttagcttcacgtacgggctatgttggcgacttggcggagtttaagctattttggcgaactatttgcaaaccagagtcgagttgagcatacgaagcaccgcatcaagcatgcatggtcgtatccttctggaacacgacggcatgagcccggtgggtctcggtggtgccgagccacgcgcggcggtccccatcgtccctgaacacgcccaggtcctggcacgacgtcgacgcgctggagcccccgcaccagaccagcttgtacccgcggctgtgcttctcgacgcggaacaccttctcccgtccgttcgggctcgaggacaggaccgggccggtgaggacgagccgacggcccgaccgcggcgcggcgccgtcgccgtcgccggagacgtgccactcggtggtctgcacgcacgtcgtcgcggcggcgaagtggacgccgacgtcggaggagacgcgcacggcgcggtcgctgccaccctggtcctgctgcagcggcgcgaagcgcacggggaagcccttgcggagcgggtccgtctcctgcgcgacgaagagcgggcacgggtgcaggcccttgggggccatggtgagcccgccgccgccgccgctcccgcggggcggtgccgggaggacgtagtagtccgcgtcggcgctcagctcgtggccgtccgtgtcgtagaccggcaacgctgccgcggcgccgcacgacgagagggagatggctagaacggagaggagcacaaggaggtgcgccgcgcgggggatgctcatgggcatggctgaaatgaaagtttttttttttttttttcccggccggcctcgag

SEQ ID NO: 18939 - DNA, 757 bp, Zea mays
aagcggaaaccagcgcagcgactcagcctgccgtcaaggagaaggaaagcggaagccgccgagagcacgccgcccgccccgcccacctaaagaaagagagcagaggaggcgagaccccaccccacccacctaccgcgaaggcttgaccgcggacggaaacaccatccatgtcgtcatcgtcgtcgtctatgggaggctccctggcgctcgccgccgccacggccgtcgcgttatccggctccctcgtcatcttctcgctctgccgcgcgcacctcgcccacggcgccgagccggagccggagccggagcacgccctgcgcccctgcctctcgtcttcggagaggcggacgcgcggcggggggaaggcgaaggcgaggagacgcaagggcgagaggcgggtgcggttcgcggccgacgtcgtcgacaatgagggcgcgacgcgcccggtcaggttctccccgcccgcgccgtcgtcgtcggcggccacgtgcggggacgcggcgcggtccgaagaccccatgatgcctgccaaccgggaggcgctctaccgcggcatgctccgcgaccgctccacgcaccgggtcacctgctcctactgagcctgacgctcaccgccggagagctcgtttgttcgttgcctctcttcgtttcgtttgttcgttcgccgttagcgttcggtcggtaggcaggctgttaacttcggaggttcatcctcttgctgacggaagattttgttaatggaaaaaaaaaaaaaaaa

SEQ ID NO: 18940 - DNA, 2218 bp, Zea mays
cgttaaatatgcacgtgactatgtttttatactagttaacgacaaaaataaataattaccttgtcaagagaccactaattgtacaaatgtgtttattttgatgtatgtataataatttgttacatctaacaatgtgtgtctaagtgataatatttaatattaataacaaagaacatatgtcttaattataatttaaatggagatggggatcctcgttggggatttatccccgcggagaacggggatgaaaaagaaatgtttcccgcaagcgttcatggggataccgtggataaattttttgtcgcggggaaggggagctattccccgatggggaattccccgttcccatccctaaacataccacataagggcgtctctaagtgactagctaaatgactcgacaaaccaaattttagctactcaacagcaaaataactttatttttaagtgaaacagcaaaataactttacaatagactagcctccaaattgtctgtcactagccaaatttggctaattatctgattagccaaactagatagatagtctgttggactgagatgctatatatgtatagtataatctttataaaaatgtaaatagatagttaaatagaaagctaaaaatgaatagtctcttacgcgtcgtttggtttgatgggctaaagattagtccctctattatagtcacatttaggaactaaattaccaaacggtgggactaaaacagggactaaaccgttttagtctctagtccctcaaggagtgactaaaagggactaaaccatataaatttcactttttgcccttctttatttcagttgtactaatggcgggagaatgttaaagggtattttagttctgatcttatgattcatttaatgtgttttgaatagttttagtccctataaccaaacatggtagaaactaaactttagtccctagactaaaggaaccaaacggcttcttagagatgctcgtaaatatgataacgtgacatacaatttaacacgaagagagtgaaactctgtatacactgttatttattaaacaaatgttaacgtgacaatcttaaaaatagtgcgatgaaactatcgatcgaaaatgaccataatcgtcgcggaagtgccgctccacctcggacatgcatatactaattgcttggctctaaattaacagctatctctaaattaatcacagtctataaatagttagccgctgattacactcgcaaccacacgcacccagcctccctctgggtataaaaccctccgtcccccccccgcccacccagccgcagaagcaaaccgagaggtgaaccagcagcctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgcctccgagtcgtcggcgtccgccgaagcccccgctggcgccgccggcgccggcgccggcaccggcaccgccgcggggccctccgccagcggcgccgcgcccgccctcgccgccgcgcccgccgcgctcctcttctccctcctcgcctactacctgcactaagcggacggacggacggacgcgcgcatggcattggcatgcatggactgttgaacatctatgcatgcatggacgacgtcacttgcaacgctgttcccatatagtactactggtctgctatgaatatctatgcatgcatggtaacgggttgtgttatttaattattattattacgtagacattactatttaaaattcatgtgttcgcgtcaagtcgttctgtaatcttgtgatggaatatatatgatatttccttttaaaatcattcgtttgaaatgcaatgtgtccagtcctcaaactgttactaccattatattgacggaatatatatgatttcctttttatgtggtttaacccgtaactacgtctccctcggtgcttgcattgcaattccattgcatatttcgtgtaatcgtctgaattccttcttggtcctcgccccatctctcttgggctggcccaataaaagctcgaagccggcctggaagcatatggcatgaccttttctcgttcgttcttcggaggcaaaagacg

SEQ ID NO: 18941 - DNA, 7230 bp, Zea mays
  misc_feature (843)..(843): n is a, c, g, or t
  misc_feature (2100)..(2100): n is a, c, g, or t
  misc_feature (3678)..(3678): n is a, c, g, or t
  misc_feature (5035)..(5035): n is a, c, g, or t
gcacaatagatgttggaccgcggaccgtcttgctaaaagaggacttcctatcccagtgcgtgtcctctttgtgaccaagaagaggaaacaatacaacatcttctcatctcttgcgtctttgcaagacagttctggtacttcttgttgagcaggtctggattgcctaatctttcaccggacaacgctttttgcagcctagatgactggtggagcagggctgtggagaagcttccccgtgatctccaatcaggtttcaattctatagttatccttggcgcttggagcctttggcgtcatcgcaacgactgtgtgttcaatgggcggtcgccgagccttgagaattctctcaccctcgctggcgatgagctcaggatgtggtgtagtgccggggcgaaagggttgaacctgctttcaactcttgcgttcatgcttgatccggggggatagtcttgtatcaggtccagagtggttaagtgtggtagtggtgttgcgttggttggtatgttgtgtcttgtgaggggtgtggtgcgtctgttggtatgttgtttgcggcgtgtgtgtgtgcgtgtgttgtaccttcttctatctatctattaatggaatgatacgcagatctcctgcgtgggcgagaaaaaaactcgcaacctggtgactcagtgagatagatctcaccactgcaccaggcttgccctgctcttcaggtgtaaattggaccaacttaaatagttggagggagtaaattgaaccaaatgttaatttagcggttatctgaacacagtcaaagcttggagagagtaatttgaacttttttctagttttaatgaggaattctataagtctgcntgcgctgttttatcttatgttttgtttcttctgctctacaggtcagcaaattatgtaacgttagttactgcacagctcattctcatggcaactcacatggtactttatgcttgtcttatattctttcaaaattaacttcatttgtctatactatcttaccttttttactaatgaaggctggattgggattacctgacattgactcttggaatatgattgagaaaatagccgagagaaacaacttgggttataaacagcttgtaagtcaaactgcaacttttgacattgagaattggttgctttaaacacttggtttcttacattttctctacacttcttcagatcaaacttagagcattgctcacacatctgcaacaactccggattggctattggggggttgctacagggaaaagccaaccattgcagtcatatggcatggcttcacctcatgcgatcgatgtgattgatgaaagccaacaacctgctgaagcatctgggttgggccgaagttgggtgcaaagtatgtttagcagagacagaagtttaagagccagctctttcaaccgagctagtaagttttcagctactaccatctctgcccttctgaggaccttgattcaattttgtttgaacacaatggcaggggctcttcctctcggttaagaaatataattgacctagtttatgagggaagagcaggactggtgcagtgagtcatcaggtcgcggtttcgaagtagcctctccatatttgcggggtgaggcaagtcggtttatttgttccctataccctacttatgtgggagcctttggcattagcctttataagggaaaccagtcctaagaaccttgcagtcacacaatttattaaaggaaaactggcccattaaacacccaaaagggacacgacagagcccaccacatgtcatcgttgccgagcttatcacagggcgataagcagctctgaagtctgactccaagacaaacatcagccagagaccctaacacgtcaccattcattcacaagccatgaccccatatgaaaagaacacatcgtcccatcgttgccaagctttgttgcaccccacaaacaaagcagttcatcttcgccactgtagatccactctattagaaccagagacccgccacaaggaagtagcaaaactagagagaacccagccttgtcgaaacccaacgatcgcagaagaacaaaaaaatgtcccacacggactagcatccaactaatgtggtgcangatcttctaggtgatgccttcaggaaggatacaacattgatcgttgtcgtcacatgcctaagaacctaggcggagtttccttgtaagaatcccgcaagatgaggagaggcaccttgacaacccttccaaggaagggaagcacacctaaagtgtcgctgttgtcagctttgggtaacaccggctgagcttttgcccaacgcgcttcaccacacacccacacaaaaggaccacacaactgctcatcagctgatcctgcaagcaccgcactactcataagagactaacacatgcaaccaaaccagcatctcccacgaagccatgtgaagttgctcgccatctgccaccacaaacagctcgtgagcatggaactgttgcagatggaaaatcatgccagagcaggtcactgtggccagctatgggcccatggctgccgtgcctcaatagcatgtgttgaatgcgacctctaagccactgtcttgtggctccatgccgcagccaccttgccgcccacatgctgctgtcgcctgtcagcctgaccgtgcagtcatccaaacgcagccggcctgcagcccgcacctccatttccgcaacccaccaacggtatctggcggccagctccaagtgtgaagtctgcagatccagctgaggggacaccatctgtacgcatcgggccggaatcctgttgccagacaccatcccgtgtaggcctagcctggagcccctcagtagggagagggaggaagggttccttgcccttcatggactgccaacgggcagtggtggcacgagggaattgttcggctgtggaggagacggcgccgtccgagccgccctggagagagggacccagggacctctgggtcgctgtccaaactatccctcactcccaaattggaccttaatacaataaagcttatattagtgggtacattactgcagactatatatttccacatttctaatatagccattgttgtatcatgtcaggtgatggaaatgctgttgctgccacgggcaaaaccgaaatctcagctgcacaaaagaaaactcaaactaacatgaggacccttagagggcatacaggtgctattactgctcttcattgcgtaacaagaaaggaggtctgggatcttgttggtgatcgtgaagatgctggttttttcatcagcggaagcacagattgcacggttagcttaaatcatatgctgttatacttactcttgttggttactttttacaatacttgctctagcatcacagctcactttgttattaggcatgccagcatgcttcacggccagtctccataagttaatcatattaccattagtccattcttcaattatgccaacattaaacaggtaaaccttgcgaagagaaggaagatgcgatacactaaaataggaattggtacctgtgtgtgttttgtgagaaagactaccatctctattctctgcacagtaaagaatacaatgttcttgataaaagatatcatttcatcctactctgttctttccttttgttatgttttaggagttggaatttgaaacatgaataatgaagccttcatgccctaantatgtcagggtagggcaggctagagataaaaagccaacgggaaggctacaaagcgggaattagtaaaagataaaatgtctcaactaggcatgttcaccgtgctggtttattgtcaattaccagaggaaatggttgttagaagttagaactaatccttgcgtttactgcttatccagctagcactaatagtgtatggcccttttaggtggctgctgccatataggtcggtttgctctatattcttagacagtgggtctagctgctgcctctgacagcaagtagtaagagcaaacagtagtctttgacagcaagtagtaagagcaagcagtagtctttgacagcaagcagtagtctattttgtttttactagcgcacaacagcaacagtatatgtatagtcggtcagtaagatacgatgcaggctgtcacctgtcggggaagtcaatttgatatcgttttgtactgacagctgccataagcatatggtcggtgtacaatctgacttatgtactgctatatatgtgtatccatatgcaatcaatagaattatggaagtttatttcagactgaactgtgtccagccacttcaactcactccgctcatcctatagctgcagtgctgcactactaacagtagtaacattatgagttgtggttctgaaaaatggttctttcagggtttgaactgagaactaacttgttaatacttagtttccatcaatttaaatcctatttgatattaaaattactgaaccggtcgtagtagttttttttttaaaaaaagagagtatccatgactgcttaaatttagttgcttactacatgacctgaatcatgctttggtattccctccgtccggttttgatcattagctaagctcttctgtgtttacttactccagccacaaccatcaaaatcatttaataagtgtgtgactgccacaagaaagaacaaacagatactagcacttgtggaagaatacgtagcggagatggttgacacataactcactgtataaatgaaatagcagatgtgaccaaacccaaggcaaaaacagattgtgctatgtacgcgatgatcgttgttgttgtttttttttggaaattatatactggacaggaggggcaagcctggtgctatgatgagagctgtctcactgagtcaccagatctcaggttcgaagcagcctctccacatccgcggggaaggcttgcctaaatttatctctttctagaccccactcataatgggagcctccggcactaggttttccctaattgtatgctggatggagggagtagtttgatagtttcatatgtatttgcagtcatattactaaaattattggttgatcctgngcaacgtttgattttgtaagtttagcatttttttctgtttttcttatgttaaaatactcatttcattttgaattacacacactagcatcacataagaatcaaggaacaaatgtgaaagagtaaactgcttccttgaatggcttaataacagctaatgcaccaactccaacatgcatgagttatgagtaaatacgtgtcaaccaattccataaatgcactaataaattaatagtaatacaaatttggttcataatgtacaatttgagatgcaaggccatgatgaaggccacctcgaaattgcagaatgtcatgtgtttaagaacaaatttccatgccagagcgacatttattttgtaagatatggagctcaacttgttggaggctcttagcattgcttcattaccttcatcttaatggtaccaaagcctgtgtttattgttgattgcactaagtaaaagttcatgtgcatttaatttatttgttggtattcatgcaatatgattgacaaccatcccctgatttgaattgagctatgctgaattattacatggtatctttatctgtctttgatttggacactgaacatttagtttgtttcgtacatctcacaggtaaaaatttgggatccaagtttgcgtggttctgaacttcgagcaacacttaaagggcatactaggtagtagccattatctaaattacatattaaatactgcattgtcacttcgatcgtattgcagtgtctgtttttttatgatacatctgtctgatacttctgggaatttactgaataggctgaagccatttaccctgtttctcttttattgttcttcagatagttgtagattatccattttgtttaccttgtcccctgattttatctatcaaagtatcaatttgttcaaatttgcagggcaattcgaacaatcagttcagatcgtggcaaaatagtttctggagctgatgatcagtctgtcatagtatgggataagcagacttttaagcttttggaagaactgaagggccacgaggcaccggtgaggctcttacatttagctgtagatttgtttctatgttaacattgtctccttagtaactccaaagcatgttttgttcaatatcggtataggttagttctgtccggatgctctcaggagaacgtgtccttattgcatcccatgatggtactgtgaagatgtgggatgtccggactgatacttgtgttgttaccgtgggtcgttgccaaagtgctgttctctgtatggaatatgatgattccactgggattctggcggctgctggaagagatatcacggcacatgtctgggatattcgctccagcaagcagatgttcaagcttcaagggcatacaaagtggataagatcaatgaggatgaccggagagaccataataacaggtagtgatgattggactgctagagtgtggtcccttaaccggggaacatgtgatgcagtgttagcatgccatgctggtcccgtactatgtgtggaatactcaccttcagataaaggaattatcactggttcagctgatgggctcatacgattttgggaaaatgaaggaggaataaaatgcgtcaagaatcttacacttcacacagcatccgttctgtccattagtgccagtgatcactggctagcgattggtgctgctgataattctatgtctcttttccatcggccacaagaaagattcggtggcttctcaaatgcaggatcaaaagttgcaggatggcagctttacagaactccccaaaaaactgctgcagtggtgagatgtatagcatctgacctggataggaaaagaatatgtagtggtggtcgcaacggactcctgcggctttgggatgcaactacaagcatctaggactgatagatgttcatgtgaaaaggcaattgaccatgatgttgcatgccattttccttttagctaggaatttatgtgctatttagaggatgcgaaaggagccggactttgttctactgtttctttctcatctaaaaaaccctgcccagttgagtatatgtttgacgtcgtgtaaaattttgtttatattttcgggttcagatagccttacgtggctacgattttgtaagaactatgagaaacttgggaagttctgtactactaccagtgcaaatgtttgttttagtacaacattattttttatgtgcat

SEQ ID NO: 18942 - DNA, 1771 bp, Zea mays
actgaacaatactgatatcagtatacatccaaatttaattgtatcccaaatcatagatgaagcttctatatgaaatctgtagaatcccgaaactgatcgtatatggtactgcataacttttaaaatggcttttggctgtgatgaaatattgtttacaattacagttaaggcgtacactgggaaacaatgtcaaaaaaaatccacttaatttacaaaaaaaacccaattaaatcaattcaaaatcattttattttgtaaaatctaataacattccgataccacgatatatccaatagaggtcgtgagggggagaaatgcaatcctatctaggatctcgattgtagcgacattggctttccaacctcctcaccgactacttgtgcgctactcttactagctttttatgatctgtatatgacacaacagaatttgtattgaagttttctaaaaatcagtttaatttcatagaaaatatacatggacacgaaaaagaaacctgtattccaaataggctctcatggtttccacctaatctaacgtcgcttctacaagtcacaagttatcggtagaacattcctttaaagatatatgatatgagtactctagaaatgttcttcaggcattcttaagctatctcgagcaactctcttattacaaaattctatttaaactccactatatgaagtactatctacactgcacaatattgttttacataattatatgtatgatctgctgcacacgtccaaacaccttgggccatcttctactcagtgtacgtaccgtacgagaaggccggcagcaccaacaaaagccaccaactgcagctctaccatccacatccaactctcaacgcattgccccacgactccacgagccatctacacaagctaactagctaagcaaaagaatcacccgcgccaccatgaagccgatgtcctccgtgttgttcgtcctgctcatcttgccgatgtgcagcaggtcgtcctccccgctgcaagacacatgcaggtccttcgccgccggccacccgtccatcggttacgagtactgcattagggtcttccaggccgacaaggacagcgccgaggccacggacacgcgtggcctcgccgccgtcgcggccaggatcgccgaggcgaaggtcaacgcgacggcggcgcgcatcgcggccatgggcgcgctcgagagggacgcgaggaggcgggaccgcctgtccgtgtgcgccgaggcatactcggacgccgtggaccagctcggccaggcagaagaggagctcgcccgcggcgcggagggcggggcggccggcatcgacgacgcggtcacgcagctcagcgcggcgctggacgcgcccgagacgtgcgaggacgcgttcggcgaggccgccgacacgtcgccgctggccggcgaggacgccgagttcaagaagctggcgaccgtcgctctcgccgtcgcggcgtcattggtgccgccaccgtcaacgccaaggccaagggttagtgattaaggcgccctgtactatatacaccgtgcttggtagtaagcaccggacactgccggcagatgtttttgcgttcttatatgtatttttgtttcccttgttcgatggttcggggttttgttgcgtgtagtgccgtgcatgcttcgcatgcatgtgcgtgatatggtattatggtgtagtgggcgagtagcacatctgcaatctgtgtcgcgccctttttgatctttgaacatggattgttacttgttaaaaacaaaaaaaaaaaaaaaa

SEQ ID NO: 18943 - DNA, 5126 bp, Zea mays
tgcttatttttcttttggataagcataagcaattcttcacaggttttgccgtcacttgacgtatccttttctgtaagcacgtcctcatcaagattgcaagagtatattgttcgcatggatgtcatgaacaagactccatcagagtcatttgtgcttcatcagttatcatgtgtcggtgataaatgggcagtttcagcattggcggcgtgcagttcaatcaactctgttgaaacagtatcagaaaatcaggctgtgtcgtacttcttcaaaattaaggttgaaggcacattcttcaatgaactgccagatacagaacacttcgatggtttccattgtcttattcaatgctcttgttttataagtcttgtgaattcaaggttgtgatatattttcccaatgcatgcttgtttgaaggattgtgaggcggattcttgtaaagaggcagaaagtgattcctgcacaagcgatatggctttgtgtccaggaagtagcactgatctgtttgacattgcacgatctccttttgttgattttcaccatcaagaaagatgcaggcaagtgaagatggcaaaggttagttcttatgttataatttattacactgatgttgcatacttgcatcatttgactattattttcttgctggttccatgagttaccgtctgatgaatcgatttctgggtagtttcttgacccaaatattcaaggtcaacttaacacaaacttgattggaaaactggcacatgcataaatttttttgttattttgatcaatgattaataaaattctgacctacacttgataactgttcaggggccatgcagccttcttgattttgttctaatctcaaaggcagttgataactcttccaagcctactccagacttcgaactactttctcatcacacatgtcattgcaggcaagtgatagaacatgtagttggttgcaatcttcgttggcctttgttgatgttgaataattgctgatcccatcttctgttttcatagtgctctaagccagaaccctatatggtggcttatggaagggcctcggacaattagtcatgatttctcaaagtcttattgtgaggctaacctccaattggtcattcacaattcagaagctcataagattttggtgagagtggtcacttttgatgtaattccagagaaaaccgtccatcctcatgactcaaccagtgctcagggtggatggtatgatgtatcactggaaagtgacgtaaaggccatctctagttccaagagtacacatcaagagaagcgatcttcgaagagcattccaccatatgtttggtgttcattgagttgtgctcaaatcgagctccaacctgacagttgtgctagagttcctctaaaagtgtgcatatttgcaccgggcacatacaatttttccaattatgagctgcaatggaaagtgcatctatctgagggaccacatgtgggtgaaaatgagaaccggttatctggcggtggtctaggctatcctttctatgtcactgtccttcaaggtgtctaagtaattatcaggattcaagaagtaccttcttgagcgtcaatatagaccagtgcaaaactcaggaactacacccaattgcaacgggctgatgataataggtgccagccagtccagtttgtgcaaagatctgccccggaagttccctgactgaatatacttggatacgctcatggttctgcttcggtaccgatatatttacacgtcattttgaaggatgagttctggtgagtacatgtatacaattgtcgctgggaacaaaaactaacggtaattgctggtggatttttggcagacagaatataccgatagaagttttgcttgtctaattgttgatggtggctagtaggagcatatactattcctgtacatcctgtttaacttgtcgctgctagacgatttcgcaaatgtagtatgtagtggtagatggatccgataaattttctgtaattttgacgaggtaatcaggcaatcgtctcgagattgttgttgtatgggcgacagtattttttcattgtttgtacaatccttttaaaaatcatcgtctggccttgagcctttatgccatatgggtatatgttgattccccttttcagttcctcgtatcgacgtccagctgtccacatcaggtgcaagtgtctgaggggtgctgttatttttgatattttcttttctttctgatcgtgatgtcgtcttttggtagatcgtaatcactacggaattgctatgatattttgtgtgatgacgttgtttttgggagatcataatcaatacggaattgctgtggtgacttcgaagagctagtgtatcatgtcgccccttttgcctctgatacgaacacatttgcacttctgtagggtgcagttgttttcggatatcataaccactatgtgactgctatgatactctgtgtgatgactctgaataacataccatgtgggttcttttgatactagccagatgcacgacgggctgacgagcacggcgccttctgctcgatccagtgcatgcgccggcccggccatttggccagtaccttcgccgagaactccttgatccttgtgtgacgctgacgcagcatgtcagcatgtggtgtagtacttgtacttctaacttctaagagatactcaagcgacagtacgacactatgctacagggtaccgtatcgcccttttctctcttgtctcggtgttacgagacagacaagtggatctgtagctgtgcagttgggttgatcgggtcagatcagccggtcagcatggatcggatagtgccgggtggttggtagttacggctcgttggatttccagcgaggcgacccggcgaaagacctggacccgcgcgccgaatcccaccacccatcgcgtccccaagaaccctcgctcgtacgtgtccgtgcccccctctgccctctccttcgtcccaccttcctcccgcgttgccatttcagagcaaggtggcgcgcgccgcctcctcatcacacggtctcctcgcccgccacggcgtcacatcacatggatgcctcggcacggccgactccttcaactccgcgtccgtcgtcttgttccatctcgcatgggtcgcgggggctccacgccccccttgtccaactacccctcccactatttcatttcatttcatccccccgatccaagaaaccggccaccgggccggagcgaacccttagaagcgaccttggcccgtgaggaagccaatcagccagagacagaacaatccatccaccatgaacagcctgttctcgagctcatggaagcgcgacggcggggacatcgagtccggcggcgtggagatgtctgcgccgccgggcgccgcggcgggcgcgagcctggacaggttcttcgaggacgtggagtccatcaaggacgagctccgcgacctggagcgcatccagcggtcgctccacgacgccaacgaggggggaaagtcgatgcacgacgcggcggccgtgcgcggcctccgcgcgcggatggacgcggacgtggccgcggcgatcaagaaggccaaggtggtgaagctgcgcctcgagtcgctggaccgcgccaacgccgccaaccggtccgtgcccgggtgcgggccgggctcctccaccgaccgcacccggacgtccgtcgtggccgggctgcgcaagaagctccgggactcgatggagtccttctcgtcgctgcggtcccgcgtcgcggccgagtaccgggacacggtggcgcggcggtacttcacggtcacgggggcgcagcccgacgaggcgaccctggacgcgctggcggagtccggggaaggagagcggttcctgcagcgcgccatcgcggagcagggccaggggcgcggggaggtgctgggcgtggtggcggagatccaggagcggcacggcgccgtggcggggctggagcgcagcctgctggagctgcagcaggtgttcaacgacatggccgtgctggtggccgcgcagggggagcagctggacgacatcgagggcaacgtcggccgcgccaggtccttcgtcgaccgcggacgcgagcagctgcaggtggcgcggaagcaccagaagagcacccgcaagtggaccttcatcgccatcatcatcctcctcgtcatcatcctcgtcatcgtcctccccatcgtgctcaagggcgtcaataagaactaggccgcctggcctgcgtaattcgttctagtttttcttttcgtggcctttgtatcatacatacggttcgttgatacggtcgtcttgattatatttttcttctattgcctcaaccttcgattacatggttttgtttataacacatgattcattttcttttgctgtcgatgtgccttggggaccgatgagcgagcttaggtcggaacttgcgggtcaaaacctgcttttgcggtggttattgactttactcgtacgcagcacgcacgcctgtgacctgacgcactcccggtcttcctcctagtcgggctcgggcatataccgggccagtcgccagggccggctggtgcgccagcgcctcgcatataccgggtcaacaatcttttgctattctcagagtgccgagccacttactctaaatctatcctctatatccattatttatagttttctttaaaaatatcaaaacatactttacttttattttttacacatacatatttatagtactctaaaatgtatatatattttagttttgctaaatctgttgttttaaatattaaaatagatagagtagaacagagagaaattctctatatagaggatcgagcagcgttctctatatttagagagatatgagaaaacggtttagataacactgctcgagatataatgaggagattcttctctaaaatttaaaatttagagtatatgacgattcagaggtctcaggagcccattggttccggcctccggttccgtgggctaaattctaaggacctttgaaacgaaacaacttattttatagaaaacataaaaaaaactcatcgaagtttaataccagttatgagttattaaatatagtttaattataaattgattatatatatatatatatatatatatatatatatatatatatatatatatata

SEQ ID NO: 18944 - DNA, 1621 bp, Zea mays
cggaattcccgggtcgacccacgcgtccgggttttgtcttacttgatgtatccttttctgtaagcacgtcctcatcaagattgcaagagtatattgttcgcatggatgtcatgaacaagactccatcagagtcatttgtgcttcatcagttatcatgtgttggtgataaatgggcagtttcagcattggcggcgtgcagttcaatcaactctgttgaaacagtatcagcgtggtcgcggccgtcgtacttcttcaaaattaaggattgtgaggcggattcttgtaaagaggcagaaagtgattcctgcacaagcgatatggctttgtgtccaggaagtagcactgatctgtttgacattgcacgatctccttttgttgattttcaccatcaagaaagatgcaggcaagtgaagatggcaaaggggccatgcagccttcttgattttgttctaatctcaaaggcagttgataactcttccaagcctactccagacttcgaactactttctcatcacacatgtcattgcagtgctctaagccagaaccctatatggtggcttatggaagggcctcggacaattagtcatgatttctcaaagtcttattgtgaggctaacctccaattggtcattcacaattcagaagctcataagattttggtgagagtggtcacttttgatgtaattccagagaaaaccgtccatcctcatgactcaaccagtgctcagggtggatggtatgatgtatcactggaaagtgacgtaaaggccatctctagttccaagagtacacatcaagagaagcgatcttcgaagagcattccaccatatgtttggtgttcattgagttgtgctcaaatcgagctccaacctgacagttgtgctagagttcctctaaaagtgtgcatatttgcaccgggcacatacaatttttccaattatgagctgcaatggaaagtgcatctatctgagggaccacatgtgggtgaaaatgagaaccggttatctggcggtggtctaggctatcctttctatgtcactgtccttcaaggtgtctaagtaattatcaggattcaagaagtaccttcttgagcgtcaatatagaccagtgcaaaactcaggaactacacccaattgcaacgggccgatgataataggtgccagccagtccagttggtgcaaagatctgccccggaagttccctgactgaatatacttggatacgctcatggttctgcttcggtaccgatatatttacacgtcattttgaaggatgagttctggtgagtacatgtatacaattgtcgctgggaacaaaaactaacggtaattgctggtggatttttggcagacagaatataccgatagaagttttgcttgtctaattgttgatggtggctagtaggagcatatactattcctgtacatcctgtttaacttgtcgctgctagacgatttcgcaaatgtagtatgtagtggtagatggatccgataaattttctgtaattttgacgaggtaatcaggcaatcgtctcgagattgttgttgtatgggcgacagtattttttcattgtttgtacaatccttttaaaaatcatcgtctggccttgagcctttatgcc

SEQ ID NO: 18945 - DNA, 819 bp, Zea mays
ccccacgcgtccgcggacgcgtggggatcgccgtgtcggcgctggcattggagtggaggtttgacgaatcaaggcgggtgctgctggatatgctggattgtggtaggaagccagatatgatcacctacaggacgctgctggaggagatgtgccgggctggacgcacggaggaggcatttgatgtgctggaggagctgaaagggaggaagcgagggacattggaccagaggatgtattcagaattgctcgatgggctgcactggatctcccagcctcgtcaaaacaacagccaacctgcgctccacaagggttctgatgattgaaaaatgttcaacgtattgtcttgtattattgtggcactgatggtcatccaaaatcaaatgcatggctggttttagttgagaagactggctggatctgcttgaagaagattcactatgaattgatgtaaatgagtcacccatctcacattagcgctacacaagcatgattgatgcacgacccaaggttcaaagaataccttatgggaggtatggcatcaaaattctcatggtatactgatttcattattactacaagttgcggtgggcactgtcgggacagcagctcactttcaatggcaacatttgaagtaattcctggcgcagccattcatgaaaattgctttaggtatcacatgtgacaaacggctgcatacaattgcagtggtgtacgtttagctcataaagtgcaaaactggaatgggtcttatatgtttcttggagttatgtttgtctagtttctgtgttggaatttaaaataaaaaatcttgtagcctgg

SEQ ID NO: 18946 - DNA, 918 bp, Zea mays
ctcggactatagataagccttccagatcatactgaaccaagctgtcacttcactgagtagaacacttgatcactcacagaaagttcagatcagaaaatgcaggttgccgctactgccgtcaggttctcggccgtgctgcctgtcaagggccggccggcggcgaagagtacggtggtggtccgtgtccctgcctcaaggaggagcgtccgtgcagctgctgttgtcgcggccgaggctgcggagatcgactacaactcgagcttctcggtgtttccgatggaggcctgcgacctgctcggcggcgatgcgtgcagcgcacagatgtacccagagaccaagctcgcctcggcggcggcggcggcgagcaggagggtggaggaggtggagagggactacctgtcgtacgacgagccaagaacggtgttcccgggcgaggcgtgcgacgacctcggcggcgagttctgcgaggcgccataccaggccggcgtctccagggagctggcgcacgcctgagcctgatgcaaattcccatccatatctgtctagaaccgagttggtctcggtagatgatgttagtcgggtagagatgttcacgccatgtaagtatgtgtgtagcagtctagcagatgaccaagcaaggccaagggtgtatgtaatgtatataggcatgtagtagaaaccaagatgaaatggtactggtgttattccttgttttaagaagatggaacgtagagctatggaagtactatgctacgatcgatctgttaaaagcacttgcaagccaatggatgaatagagggcgtactgcttaagctgaaaaaaaaaaaaaaaaaagcggcctgcacaaatggtatggcgaacttgacctgacaactgacattatcaagcaatctcatttaataatgcagatggtaacgt

SEQ ID NO: 18947 - DNA, 3093 bp, Zea mays
  misc_feature (331)..(331): n is a, c, g, or t
ggattgaaacccactcaatcccctctaatcaatatagattttaatgaaacctaacaagcccttaatgaagtttgaaaccatgcatgttaggattactctagaccagtgttttaaatagcgggaaaatgaatttatccccaaactttcaaaaaatgcaaatattgtgatatatcgcgatatagctagatatatcgggctaaacaacgtaacttttcgctgataaaaaggatatatcgggatatatcgaccgctatagctggctatttaaaatcttgctttagacctccgaagcagtaagccacaagggcattataatcatattcttccgaangtccaaaatttaaataatttgttgagcgggtccctcatagcccatatcttcttcccttcattcgaaagatgcaatcagagcatataatacgcacatgaaattgcatatatacagccccaaccgagaactgcagcgggcattaattcggttgacgttatcctactagcagtgaaattaattgaagattgaaacttgaaaatttccgagctgatcagcagctgacgcgagacattgtcaaaggcagcgagtcgaacgaaggaagagtcgacggggtaggctctaggataataaacaaaactaatttaagggtctgcttagatccctctacttttaaatgaagtcagattcttcaacaccgtggaattgtaacatcctactatcagttttctctgagaattcagaatttagaaactaaccaaaactgatgcaaaagcagtgcctaaatccatgcaggagcaaggtcaaaggcgcggaacatttcgtggtccgtgctcgtgcctcgcggtggccgccccgcgccgtccggcaaccatgtacgacccggtggaccttcgcttccgatcccgcgcgaccaacggtgatctcgctattaatttcgcagcgcgggcgcgggcgcggccgccatatttattttctcttccacttccacaccaaccagagctctggatcaaccaccacctgcgtcaaaccacgctccttgcattgctcacccttcgtaaacagtgctggtagaaaagaatccaccgaaccaagaccggcggcacccacttgtccgtgaacctcgcggctcgtctctcttcttctcctatcttcttcctctcctgtataaaagcttattcgccccccgtcccattctgctccagaacctttcccgttttgaccacagactctttctctctccactttctagccttgtagctagctagctagcttcatgcgtagataggtgcgcagcaggtaaacgacgcgcaaggtgtgctgcgtgctgcgcaggcaggatcaatagaatccatggagcgggcgcgggcgcgggcgccggctctggctctggcaccggtggaggttcccaagttcttcgtgtgcccgatctcgctggaggtcatgcgggacccggtcacgctgtcgtcggggatcacctacgaccgcgacagcatcgagcgctggctgttcaccgacgggcacggcgactgccccgtcaccaagctgccgctgggcgccgacgacctcgagcccacgcccaaccacacgctccggcggctcatccagtcctggtgcgccgcgcacgccgtcgagcggttccccaccccgcgcccaccggtcgacgccgaccgcgtcgccgcgatcgtgggctgcgccaagaagggtggccagcaggaagtgctggccgcgctcagggagctcgcggacatcatcggggagagcgaccgcaaccggcgctgcgtcgagggcgtgccagaagccgtggagttcctcgtgtccgtcgtcaagaaacacgccgcaggcacgtcgtcgtccaagcctctcggcggatgcagatcccaagaggagccgatgtgcggcgtgccggactcccctaaggcgtgctcgccggaggaggcggctctgagcatcttgcattctctcaagctctccgaggcgagcctgaagagagccttggagagcagcgacggtttcgtggacaccttagcgtccgtgctgcgctggccgccgaactaccgggcgcgcacgtacgcgatgcacctgctgaaggcggcgctgtcggcgatgcagccctcgcagctgagctcggcgagcacggatctggtcgagggcgtcgtgagggtggtggcagaccggacgttgtcgcccaaggcgatcaaggtggcgcttcacgtgctctgccggctttgcccgtggggccgcaaccgcgtcaaggcagtcgaggccggcgccgtggcggcggtggtggagctgctcctcaacgaggggtgcgggtgcggtggcagcaacggcaagcgggcggtggagctcgcggtggttgccatcgaccatctgtgcggctgcgcagaagggcggttggagctcgtggcccacccggcagggctggctgttgttgcgcgagccgcgacgcggctgtcccccaccgccaccgagagcgcggtgcgcgcgctgcacgcggtggccaggcactccgcgacccccgcggtgctgcaggagatgcttgccgtcggagtagtagcgaggctgctgtacctggtgcaggccggcgcatcgggcgagcgcccgagggagagggcgcgggagatgctcaagatgcacgccagagtttggaggggctcgccgtgcttggcgtcgcacatggcatcctacccttgttgatatcgcatgccagcgttccgcagccaaccaagaccgatcaccatttgcatttggtcactattctcgcgtttgatctagtcgtctgtttgttcgtcgtctcatacctaatcatacgtagagatacggcaaaaaaaaaaaaaaagaaaaaaaaaaaaaaaagtaaagatttttactcttaggtcgggactcgggaggtttgataagtaattaagttccctaaaatggggttcggataagatatgcgttagtgtaaataatgtatgtattacattttctatgcaaaaacaacattatttcaacctgctgatcaattttcttttcagaaccatgatcaactaatcattgcgtaatgatttgataaatactaatagcgtgcatcatgtttatagtactttagcttacgt

SEQ ID NO: 18948 - DNA, 877 bp, Zea mays
  misc_feature (859)..(859): n is a, c, g, or t
cctcgaggccggccgggaccgggccaccaataatcccggggcctccaggccgcccggcgaacggcccacggagcatcaccaccgcggcagctgagctcggccccaacattcagattcttcgaggcgcggcgacggcggtcggcgacatggaggccgcggtgcccagccgtgttgcgctctccgcggcgagccgcctcccaaatccccacgccgtgacaggagatagatctttcatttacaagggaagatgccaaagtcttgcaattcctatggctttgtcagcagctgcgccaggcaaaggtggtggtgtgcttgatcggccagttgagaaaactactcctggtcgccagtctgaatttgatgtgaagaaatcccggaaaatgtcgcctccataccgtgtcatcctgcacaatgacaactacaacaggcgcgagtacgttgtcaaggtcctgatgaaagtgatccctgggatgaccgtcgacaacgctgtgaacatcatgcaggaggcgcacgtgaatgggctgtcagtggtgattgtctgttcccagtccgaggctgaggagcactgcacgtcgctcaggggcaacggcctccggagctcgatcgagcccgcgagtggtggctgctgaggttcgagacttgggggtataccttgttttgccagcgtatagtttgtaaatacccagcgtatcaagctaaagctgaaacggattggttatatgcacttatcgatacaacgaagctgagtacccctctctcgggtaggtgtaaatcgtgcaagggtaccctgtagaagaagaacatagtattttcggttttgatttataaaatatttagttgcacaaaacaaaaatggttnagcggccttgcttctact

SEQ ID NO: 18949 - DNA, 904 bp, Zea mays
actcccctgggcgataggggctttccgatcgcgacccggggggccgcgggccacggagcatcaccaccgcggcagctaatctcggccccaagattcagaatcaccgaggcgcggcgaggcgacggcggttggcgacatgatggcctcggtgcccagccgtgttgcgctctccgcggcgagccgcctcccgaatctccacgccgtggcaggagatagatctttcatttacaagagaagatgtccaagtctttcaattcctatggctctgtcagcagctgcgccaggcaaaggtggcggtgtgcttgatcggccagtagagaaaattactcctggtcgtcagtccgaatttgatgtgaagaaatcccgcaaaatgacgcctccattccgcgtcatcctgcacaatgacaaccacaacaggcgtgagtatgttgtccaggtcctgatgaaagtgatccctgggatgaccgtcgacaacgcgttgaacatcatgcaggaggcgcatgtgaatgggttgtcagtggtgattgtctgttcccagtccgaggctgaggagcactgcacgtcactcaggggcaacggcctccgaagctcgatcgagcctgcgagtggtggctgctaaggttctagaaatgggtgtatcttgttttgccaagtatagtttgtaaatacccagcatatcaatctaagctgaaactgaaacgggttggttacatgcagttatcgatacaacgaagctaagtacctcttgggtaggtgtaaatcttgtaagggtaacctgtagaagaagaaacatagtatttttggttatgatttatgaaacatttagttacacttggtctaaaaaaaaaaaaaaaaagcgcccctcgtgctagcacttgcattttaaaaaaaaaaaaaaaaaaaa

SEQ ID NO: 18950 - DNA, 4967 bp, Zea mays
cctggaaggaaaaccacctaaggtcttgttcggttattcctatcccatatggattggaaaattttatgaatttttttgacttgtttgagatttaaacccactcaattccagcaaatccatgtggattgggagcaaaacggacaagccctaacagacacccaaacaagcgtgtatattcctattcacaatatccggttgcactataataaaatagctcacacttagggctgattcggtgacaagcgaattgaatcagatcaaaggattttctcccattggtcctgtacaatttccttgtcacaaatcaacccctaatgaaattattctagtcctcataattaatcaatggtactaaacactagcttaagttctggcttgtaatatatcatgatccaaaaataaaagagtgttgttatccgtatgctgcaggacagaaaggccttcatcaaccatgtgtagaacaacactctcgattagttgattagactttttttttaaaaaaggtggttatatccaccaccaggttaaaaatgatcgtgccccttatctaataacctattataatatatattctatatctaataacctactctctacaggtccgatttataagtcgttctggtcacgtaacagaagcatcagtcgttctagtatgttaaatcgttaacctgcacaaaatgtttgtggtacattctgttcatgctccatatttgctcctctacccaaactgcacaatcccgcgttgccaacctatcttgattcttcgtttcttctacaatcccttgtcaccctgtgctctccggtgtgcgcaacctagagctgctgaagaagcaatttaattccgtcagtgatcacacacaaaaaaagaggaagatcaacaatgatgcacaaccagcaaccagacgtacgctcaccgttgggtgaaatccgaggtggaagacggatagctcgacgggtgcgacggcgacggggagttggacggagaagtgtggtacgggcggggcggtatggccaggtcgtggacgctcctctccagcatctccagcaccctgctcatggacggcctgctggcgggcacggtctggatgcaccagagcccgatgagcgccatcttcctcgcgatctcctcgcctgccgctgcttctccggagcctcccgcgccgccaccgccaccgccccgaagcacgccgacgccgtcctcaagcagcaggtggtcgtacacccagagcgggaagaagagctcgccgccgctggacttgtcggcggcgcaggccttggcgttgctcctcccgccgaccatctccagcagcagcatcccgtagctgtacacgtcggacttggtggagatgaccccgaagccgcgggagaagacctccggcgcgatgaagccgatggtgccccgcgcgtccgccatcgacaggatgctctcctttgggttgcacagcttggccatcccgaagtcggcgatcttggggcggaagtcggcgtccaggagcacgttctggggcttgatgtcgaagtggatgatccgcgtgttgcacccctcgtgcaggtactcgagcccccgcgcgatgcccgccgcgatctcctgcagcgcctcccaccccagcgccgccgtgccggccgggtcggactcggagcggatgtacctgtccagcgagccgttgggcatgtactcgtacaccagcgcgcgcttggagccctcgaggcagaagcccaggagcgtgacgatgttcacgtgcgacgtccggccgatgctgaccacctcgttcaggaactcctcgccgttggggcgggcgtggtgcaggaccttgacggcgacctcgcgcgcgcgggtgccgccggcgccggcggccaggacgccgctgtacaccgccccgtagccgccttccccgagcttgcgctggaaggacttggttatcctcttcagctcggcgtacctgtagcgcttgggagcgagtgacccgtacttctgcagcagtttttccacgtcggcggtgtccccgctgctgcttctgtccagcaggaagctgaaactgcgtgttatttgtcgatggaacttgaggattaggacgagaagcgccgacagcaggccgaatgcgatcgacaaagacactgaaattgggtaccagatcgtatcagcggggtcgcaatgcagctcgtacgtaataataacagtaaaataatcatgatttgtacagtactagcatccttctacaaaaaaaaaaaaaaaacatcatgacgtgtatctgaagctgaacacatgcaagggcactatgcgtgtcagcgtgtgtgtagtatgcgtacctatcaggatcaccttccggtcggacttctttgcgcctgcaagtaaggaagagtcatttgatttcgatttcagtaaaaaaaaaaaaaacaacgtcgtcatcaatcaagaaacgactgataactgatggatatcttctccgacaaattgcctaataatccaagcctatcggtactcggtagatctgataagagatcaataattaataaactatacacagcggtgctcagcaagcgaatcaaacatgggatgaccagattagaggagcgaggactcttgtcactagcgtcattgatttcgtaaccaacgcatgcagcgggtgctacgactaatctggtctcaactcctaatctccaactaacactccaagactccaagccagtaacatgaatggaggcaaacacaagacgacgacagcttggtctgtataaaaagctggcatattcgtatgcatccgtgtcgcatgtatactcgtattattcaaactgtaagcgggtacagacgtacgactgatcatcgatggcggacttctaacctacccagagcaagaaacatcgcccctgcagcaccccacacggaagcgtaggcgaagaaagattaggtaagaggccatgcatgactgctgccgtgaattcctccaattcgcacgatgaacgcatgctcggattcaatgccggtttcggagacacgtatagtcagttcagtcttgttctgatcctctctggtttgattaattgaaaaagtcaaggataataaaaagttctctttttggttggatagattttagtcgacggcgttgagatcacgcatggccacttcttgtcagtgctatatattgtattcgtagtcatttctggtgagaactattgcgcgtcatgtgaattattacctcgttctggaaagctaaaaaagttcagttacttactaaacatcaaataggggccgagactttatttctttccagtttccaagtcactagcggctaataaatttgttagtttgcgagcatgaaagtgaataccgaaaagttcagaatgctacatgtataaacacgcaaaataataataataattcacggcatttcccatcttccatatgtgtatatatacacgcaaaaatctaccagccgaggttcgtttctactattattccagtttctaaaacgagtaaactgcaacaataaaaaaaaatcaaatacaactcataccgcatcttgccggatgtgaagacccgtcgtcgcagaggcaggcgaacgcatccgtgtcggagtcgtacccgcactggccgccgctggcattgcacgccgtgcagttcccaggcgacgcccgccactccagcaggtacccgcccctcagcagccgcgggtagtccccggcgctcgcgccgccgccgggggacaccagcaccggcacgaccgagtagtcgcaggccccggccaccgccctcgcgtcggtggtgttgtacctcgggtcgagccgcaccacggcctgcgcccccgggcacgtcacgttgacgaacccggccggcggcggcttgctgcagttgaagaggaagacgagctgcgcgttggcgccgctggccgtgaacggcgcgaggctgaggctggcggacacgtcgatgcgcggcacggggcagccgctggcgtcggtctgcacgttgtcgttggccaccaccacggtgcggtccgcgtaggacacgcggaggatcttgtaggcgccgcggaacgagcgcgccagcgacgcgcgcccgccgcggcagtccacctggaacgcgctcgggccgcacggcggcaacgacgaggaggaagcctgctggtccgggaccgggagccagaacgggtaggcgatggtcaggttgccgcaggtcctcggcgcgcagcttgtcgcggtggcagccgctgctgtcaccgcgtgaactgcgaggaacgttagggtggagagcagcagcagcagcacccggccatgcacggcggccatggcggcgatctggcaaaatgatggttggtggtggccgtggcggggatcggaggaaggtgtctatatattttagacaacaatagggtccgtttgacttgttagagcttcgagttgaaaatacatttcatatttcaattgaatggtctctttcttcgactttttttggtgcatcgtgtacgtgtgaacttgattcggcttcccgtcggtttatttggctggaagcttaggtgcgcatgccctgagtgcgacttggttcatagcgcacggctacccgctacgcgatgctaatgcttgcgttaggctccctccggctctccttgttcggccctggctcctgagtcgccgattagtcagccgctgacagcaaacaccaaaggagaaagaagatctaactccaagactcaacagaagtgcttagggttagagatgcgtcgattcggagagggggagacgacaaagagagagatgggagggcgaagggggttgagaacgaagaggaagacgaaacaggagagctgcagcctgcagatggcaagccgagagccctcgagaccgaagaggaagacgaacatgagttgtagatgcacaggcaccaaggtaaaataaaattatgttaaataaatatcttaaaaatattatgtatttccttttaaactgtatagtatcctttatctttggtagagagt

SEQ ID NO: 18951 - DNA, 1974 bp, Zea mays
cattgggtacctcgaggccggccgggaaggaattagaagcagccggacctcaagcgccccgccgcatagacttggtttgcttgacgttcactaggtgcaccaagaagccaaagccaatggcgactctacctctgctcctgcacctgctatgggaggcctctccgtgggcccgtgcaggcgcggcgacggccgccgtggtgctggtgtggctagcggcctggacgcttgagtgggcgtggtggacgccacggcggctagacagagccctacgggcccagggcctcaagggcaccaggtaccgcctcctcaccggcgacgtgagggagaacgcccggctcaaccgagaagcccgcacgaagccactgccgcttgggagtcacgacatcatcccacgcgtgctacccatgttccacaacgcggtgaaggagaatgggacaaattcattcacttggtttggcccgattccgagggtgataattccagacccggaattaatgagagaagttttgtctaacaagtttggccactttggcaaaccactgtttagccgtgttggcaagttactagccaatgggctcgctaatcatgaaggcgagaaatgggcaaaacacaggagaattctcaaccctgcattccaccatgagaaaataaagcggatgctgcctgtatttgctacctgttgtgccgatatgattaacagatgggaaaattcaatgtcttccaaggaaccttctgagatggacgtctggcctgagttccaaaatcttactggagatgttatctcaagaaccgcatttggtagcaactatcaggagggcaggaacatcttccagctacaaggagagcaggctgaacgccttatacaatcttttcaaacaatatttatcccaggctactggctcttgcccaccaaaaataacagaaggatgaaagaaattgatcgggagatccgtaaaattctgcatggaataatcaggaaaagagagagggcttttatagatagtgaaggaactaatgatgacttgttaggcttattggttgagtcaaacatgagggaatcaaatgggaatgcaaaactcggaatgactaccgaagatataatcgaggaatgcaagttattttactttgcaggtatggagacaacatcagtcctgcttacatggacgttaattctgctaagcatgcaccctgaatggcaagagcaggcaagagaagaagttttaaaccactttggaatgggtacaccagactttgataacttgaaccgcctgaagattgtaaccatgattttatatgaggtccttaggttgtacccaccagtagttttcctatccagaagaacctacaaggaaatggagctcggtggcatcaaatatccttcaggcgtgagccttctactgcccatcatcttcattcaccatgatcccaacatctggggaaaagacgcaagcgagttcaatccacagaggttcgaggatggcatttccaatgcgaccaagcatcaggccgccttctttccatttggatggggtcccaggatctgcataggccagaacttcgcgttgctggaagcaaagatggcactgagcaccatcctccaacgcttctcctttgagctctcaccatcctacactcatgcgccatacaccgtgataactttgcatcctcagcatggtgctcaaatcaggttgaagaagctttgaccatgatggtcatactgaatgccaaaacatgcactcctagtaacatattgtgattgttcatgtatgcaggtttaaatttagctttgatatgaataatgagaaccaagtgtgtatgaatggagtaggggtgtaatcggatcggatacgaacggatattgcttgtaccatatttgtttcatattttctgtttggattcagataacatcaagttgtgtcggataagatttgaatagatattgatatcttaaatatccgaaaaaaaaaaaaaaaa

SEQ ID NO: 18952 - DNA, 1484 bp, Zea mays
tacagatgtttgtaatcctatttttgcgaattaaatgttttggatgttattattaggaagaacactgttttgtctccggcccgtcgcagccccactgccgtgcgccgccaccctgccggcgcacccggccccgccagcgcgttcgaggccgacgcgcgccgccacctgccgcgtcacgctccggccattcctgccccctcaccattctgccgcctccaccgcagcagccgcggcgatgcgacccgcatcctcctcctcccgcttctcggccacaacatctccgtctcgctgccgacctgaacaacgaggcacactccattgttggccatgcttgatctcctcatcctgctgcagtgctgccgtggaagggaggccagtgcgggaacaacccagactgcgagcgccttcgcgccgagctccgccggatgccgcccccaaacggccgagccgtgctgctctttcgcaatcccgtgtggctgctctgcacttctggatgcatttttgttgacatggtttgcgtttcattcaaatttagaatgcttcttaatttcttttcgttgcattgaaaatatccagcggtttattggtgtttgggctaataaatagataaactgttcacaaaaaaaaaaaaaaaagatgactaaggtatgagggtactgcataataatactttctactctctgtggagctttactgttttgttgggcttggattggtctttcgaattaccttttcaaattgacattttgccaaatttttgcccgtaaaaatatcttttagaccttgggccatgaatataaatataaggccttattcgtttgtctaggaatggaacatgaatcgttccagctaatgaaaacttatataaattagaaaagcaaaccggctaaaatttgttttagcctccgttccggaaaaaaaaaacgaacggcccctaagtgtgtaaacatatggtattagtatatttgtcatatatctaccatttttttgttattgataaacagaagttttttgaagactgttcgtcaatagtgaaagaacaggtagaatagaatagaggtggtatatcctgtttcctaataaaatcacgcccaatatttcattgtcatcacagcccttgcgttagaggaatttgttcttctatgttgatctcccaagggcatattgcgcattccaaccaaaacctgcatttgctggatttgaagctacgtagcaagccaaactggtttttaaggtgctctagtttcatctttttggagttgaaactctcccaaacaggtcctaacttgcctagcttgcaatccactctaggagatctttcaaaaagaaaaaaaaatccattagaggaacatcatacaatgcaatttgcagaaaaaatatagattcgttagacagttcttcattccttggaagccacaactggatgagaaaaacaagtaactataaaaatgattctacatatcgcaatctcaaccagtgttggc

SEQ ID NO: 18953 - DNA, 989 bp, Zea mays
gacaagtgctcatgcaaatgttttaggagggtcaaaattaaaacgtaggagtaggtaggacagctttattccgttccaacttccaaggtccgagggctccagaaaccggcaaggggatcgaagcggagagcaagggagcggtcgagcgggtgacatcatcgtcatccagggtttctcaatcggcagcgatggcgaccagggcggcggcgaggttcctgcagcgcaggtttctgtcttccggcggcaaggtcctcagcgaggaggagaaggccgccgagaacgtgtacatcaagaaagtggaacaagagaagctggagaagctcgcacgcaagggccccagctcaggagagcaaccctcgtcaaccacaggctctgcagcaagtgatgtgaaggccgatgctgggccaacggagtcagcatctgcaagtgtgtcgacggacaagaacaagaactatgctgttctggcaggcgcagttgctgccctgggtggcttgggttggtatctattgttaaagcctaagaagtcggaggaggttgtggactgaagagggaggttgtgaatgcggatggtcggccttatatctcaccatggttttactttctgcgcatagacctgcaacttctgaaaataattgttgaaatttactctgcactacttgttcttaggcctgttgcatcacagaaccttgaagtatgcactcgagttgttcagtagttctctccctcgcttggcaggttgcaatgttgagtgatgcttgtagtgctgcctacatcgttgctggataggtttttggatagtttggtttagaaggtgaggcactaaaccaggcctcaatctacttcaattcctttctcccaaacaatctttctgattcaattccaaacgtacgctctacttcccaatatagattattacatgtgttccgtattgttgtgggattcataattttattccatggtttacacagaactgtccaaagtgttctgtc

SEQ ID NO: 18954 - DNA, 1299 bp, Zea mays
cattgggtacctcgaggccggccgggaagaatacaatccagcttccggcaaggggatcgaagcggagagcaagggagcggccgagcgggtgacatcatcgtcttccagggtttctcaatcggcagcgatggcgaccagggcggcggcgaggttcctgcagcgcaggtttctgtcttccggcggcaaggtcctcagcgaggaggaagaaggccgccgagaacgtgtacatcaagaaagtggaacaagagaagctggagaagctcgcacgcaagggccccagctcaggagagcaaccctcgtcaaccacaggctctgcagcaagtgatgtgaaggccgatgctgggctaacggagtcagcatctgcaagtgtgtcgacggacaagaacaggaactatgctgttctggcaggcgcagttgctgccctgggtggcttgggttggtatctattgtcaaagcctaagaagtcggaggaggttgtggactgaagagggaggttgtgaatgcgatctgcggatggtcggccttatatctcaccatggttttactttctgcgcatagacctgcaacttctggagatagttgttgaaatttactctgcactacttgttcttaggcctgttgcatcacagaaccttgaagtatgcactcgagttgttcaatagttctctccctcgcttggcaggttgcaatgttgagtgatgcttgtagtgctgcctacatcgttgctggataggtttttggatggtttggtttagaaggggaggcactaaaccaggcctcaatctacttcaattcctttctcccaaacaatctttctgattcaattccaaacgtacgctctactttcctatatagattattacatgtgttacgtatgttgtgggattcacaattttattccatggtgtacacagaactgtccaaagtgcatgcgttggtttgcatatattaacattattgcttcacacttactccaagtgccagcctgccaggctaccaggtatcttgctattatttgctctgctcttaatacagagctggggtgttatgggtgtgccacaaagatgatgaattccaagattcatcaaatgaagctcctgaatgaggaccccctgagatgatctttattcggaaaatgcaaggcaacttaatggcctacccaatgtgcacaggctaacatgatgaatattgcagagtgatactgtatttgtttagtcaccttattacttgatcacattgtattatctttatacattgttaccatgactgagcttataaaaacttttctatttaaatgta

SEQ ID NO: 18955 - DNA, 1031 bp, Zea mays
cctcataggcgcgccgcgcgcgcggaagagttaatggaggccgtttccgtaagtgcgctgtttatataggacatcaagtaattaaccaattagttaatctcaactgctcgattatattgctggttaattatccttgtacgcggttgtatcggaggtcgttacgttctaacaaggatatccaaccttaattatatatacatacatgatcatgatatccaacctatagctctcgacgacctacaatctaatctaatagtcaaccagcatgacgcagattttctgcctgacgactcttttcatctggctcggggaagttcttctcatcatcgccttcgtcgccgccgtctgcttctactatctacggtgccggaaccggaaccgggtggaggccgctgccgcggccgcggccgccgctgccgctttcgaccggcggcaacaggcggcggcaccccgcgcgcagccagcggccgcggtgcagatggcgcccatggccttggtcctgcggctggaccgcgtctgcgtcacgtacacacgccggaacggcggcggcaccgacgatcgtcgtcagcagccgtcggtggcggaggcggagcaggactgcgcgatctgcctgagcccgttccagtacggcgaccggtgcagcgtcatgcacgtctgccgccacgagttccaccggagctgcattgcgaagtggctggcgtgccacaaccacaacacgtgcccgctctgtagggctcagctgcgttgggatgatgttgctattaacatgccgtagatcacgaacagggatgtgttattcgtcgatctcgtgctgttgctattaacatgccgtagatcacgaatagggatgctgtttttttttggtctccaactgcttcgattctgtataataattctctactaattaatgattcgacgatgaccctgcttcacctatgaaccgtgtatgtttattctctcctctgtaggctagtttggaataaaaaaaacagaggtattaagagcttgtttgggtaaaaaaaaaaaaaaaa

SEQ ID NO: 18956 - DNA, 2768 bp, Zea mays
ggcttcgctaaatagtcgaagctcggactcgaaagttaaatccacatgccagcaggcccaaacaaaacaaagtcaagttcaaacgtgggttgccggtgaacctgccagaagtgggcccacacgtcagcagccaatggggcgaacgacacctaaccctggcagccaaccaaaaccccgtccaaatcaaagagaccccacccgcgtgctcgtctcccgccatatttgacctcctccaaccaccaatctctgaccgaccgcagcttcttcatcactgaccgatcgccttccttccacacccataccacgcccttaaacaaggaacggggctgctgcctgaggctaccgcgccgtttctctttcttgacccgatcgcctgcttcctaccaccggtgacgctagcggcaggcccatttaacctctcgatcgagcacctgtgcctgcacggcagatatatatacatatataggcgagaccagtcctgccaggaaccatccatatatacatgctccggtgagctttgctcgacgacagtcatcatgcatggcgcgcggcgagtgaagtgaatcggagcagtttgggtgccggtgagttcttcgtgtcaccctgctctgtttctttctagtcagacaggcgagcttaaaacctgatcaactaactcatcgtcctcccttgcagatttactcaacctgttcttgacggaaccaagccaagatctcgatcgacctggtccactccagtccagaccagaaatggaggtacagatggcagcacaaggccctaaatcgatgggacgacgacgcagcagcacgccgtgtgactctcagcacggcggcggtgccgacaccaagcccgtccccggctacctcaggccgtcggccggctcctgccaccacgtctgcaagtacggcggcacgcacaccttcgaggaccacaacaggccccagcctaggccgcctcggaagcagcagcagccggcggcggagagccacagccacaacagggtgctcgtcaaggtgcggtcggtgttccggaggccttccaaggcggccgccgacaagtccagtggggtcgagagcgtggagtggaaggacattgtggcctatgatacggttccacttccaccccatggatcgtcctccccgaagcatgatggaacctcagctcagttcaccggcggctccaagaagaaggatgtaatgaaggggaagaggtcgcatggcaaggccaagacccatgaacaagtggaagggcagaaacctagggcggctgctttgctcgtggaaaacatgggtaccaattatcaggaaatgcttcaagggtaccaaattctgcccccttctctgctgcagagtcgcgcaagccttttgcgcgacctcgagaaggagatgatggttcaccacgacgctgccgatgccggggaaggaagagcaacgccaacgtactctccggacccagaacagtgcgctgctgccgctgaatcaagcaggcccatccctgcgcaccggagggtgcagagcatgagcatcagcagcaggtccgcgcggcacccgttcgcgcgacaagcgagcaggaactcgggcgccttcaagctgcggtccacgagcaccagagcgcccgcagtgcttccaccgcccgacgaggagaagcccgcgaggctgaggtccaggaggggcggcgagaatccttcggtgaccaccgaaagaggcatccatctcaggatccgaagcctccggaagcgaggcgtcggtgcttccgccgccggcactgctggtttcgtcgtgccggcggtggcgctcaggcaccagaagacgctggagaagaacaagagccagaggctgtacaataacctcatcgaggagacggcgaccaggctcgtcaagacgaggaagagcagggtgaaggccctggtcggggccttcgagaccgtcatctccaagatcgcaaagtaggaatcagcaagcgtattttggttgctctctcagtgagtgactgcttcctgtcaaaactgtttgcaccgtttatctatcaaaatggcccatcctatttcgtctacagcgactcgataagactggatccaatccaaccagtcacgatactgatccgtgacgtcctgttcggccagagcgggcataccgatcggtgggcctgattgctatcgaccgagctgaactagtggataccgacccaaatgctgaaggtaccaattatatgttgtaagcaaagcttcatcgtcgataaaaatggcgcccaatgagaacttcgaagaattggagatacacaaagtttcgacgaagaacagacatgtgaacacgtctgccctcaaatatagagaattgctatgtattggggaggggtaaaatgtaattttgtctgaaagtatattggtacttgaccatataaataggtgaatagtgtgaccgtcatgtgatcggacattcgctaaaattgtgcttgctacattcacgtctatagataacactagtgacacccatatcatatatccaaagtttatgtttgtttgtatggaacatctgttttgtgaattatagattgattttaaaatgttatatctttggtcttacatgaaaaaataattatattcaaaaacaaaactttacatctatatgttgtcaaagaatagcaaagagccctcaccataccttctgttgggtcatgtcttgccgaagatcctcaaaaatggctttgcttcggagggagcaaatgtattttaagcagacaacaaagaatgtgccggggaccataattag

SEQ ID NO: 18957 - DNA, 2330 bp, Zea mays
tcttctggtgatgcgtgctccaatggttattttcctcagactataaaagcttctactgccaatttagtgatccttcatacgtgaagaagttgaaacttgagatgttgactgctatagcaaatgaaagcaacacatatgagattgtcaccgaactgtgtgaatacgctgggaatgttgatgtaccgattgcaagggagtctatccgcgcagttggaaaaatagcactgcagcagtatgatgttaatgctattgtggacaggcttctacaatttcttgaaatggataaggattatgtgactgctgaaactctagtcttggtaaaagatcttctcagaaaatatcctcaatggagccatgattgtatagctgttgttggaaatatcagcagcaaaaacatccaggagcccaaaggaaaagcagctctcatatggatgttgggagaatattcacaagacatgcatgatgctccatacatccttgaaaatcttgttgaaaactggcctgaagagatcgactcggcaccgacggttcgcttgcatctcctgacagcagtgatgaaatgtttctttaaaagacctccagagacacaaaaggcattaggagctacattagcagctggtctatctgacacccatcaggatgttcatgacagagcacttttctactacaggcttttgcaatacaatcctaatgtagcagaacggggagtaaacccctcccaaaacaagctgtctctgtatttgcagatacacagagcagtgaaaccaaagatcggatatttgatgagttcaacagtctatcagttgtatatcagaagccatcttacatgtttacagatagggagcatcgtgggccatttgaatactcagaggatcttacaagcttgactgttggggcagaggatccagaaaatgtaatttctgcccaaagatatcaagaaaacgataatgatcttttgctaagtacttcagataaagaggacaatggtacaagagccagcaatggttcttctacctctgcatacaatgctccttctgatttgattagcccttcattgataagctcccaaacaccagctgaaacttcactagtaaatactggtgggccgacacattcctcacaatcaaacttcagtctcgatgaccttcttggccttggcgttactgaagctcctgctccaacaccaccagcactgacccttaactcgaagcctgtgctagatcctggtacgttccagaggaaatggggccagctagcattggcgctgtctcaggtacgccacatagccttttcacatcttggtcgattttcttacagtttttgcaaagtagaccactacatgagatcttttgttacggttgtctaatgtatttgtttctgatggagtatgaaactagaagcccgttccaattcatggcctaatgagtaatgaatctaaaccctgagtgccatggttgtctagggcgtcgatccacctttaaatgtctcccaatgtgtctgatatcaactgccctatgttctgatctatgttctttctattatgatctgaactgttttatactgtgtttcgttgacaggaatgctctttgagtccacaaggagcagcttcattgatgaatccccaatcactcatccgtcatatgcaaagcaattacatccaatgtattgcttcaggtggtcagcctccgaactacaagttctttttctatgctcagaaagatggggctactgctttcttccttgttgaatgtattgtcaacacagcatcagcgaaggcacagctcagaattaaggctgatgatgggactgctgctgaggcattctcgactttgtttcagtcagccttgtccaaatttgggctttcttgatcctgagtattttgtctgagcgattcactggtccacaatttttttccggcgttcacagttttgcccccactctgccgcggtgccgcctaagcttgtccagtacttgatcaaattgttggagaatcagcgtagaaggtgcgattagagggcaatatattattatcactaaattcagcaagagagcaatggagttttgcggagtaaaatcttatttgtattaattgggtgaactgtgcatttgtacatgactacatgtcacctagataaatagctaggttatttaggattgtgctagtgtgatgccttgacttcttctgaagggccttctttttcttgaaggatgtagaaacaacacacaactccccctttcatgtatgctgtacttacctttatttcttgcacaggtgaccaataaagatgtttcttccatgttgatctaaaaaaaaaaaaaaaaaagcggcc

SEQ ID NO: 18958 - DNA, 3138 bp, Zea mays
gcacgagaccattacctagaacatcctaatcgaaaactgttcacagaccacagtcccaattcccaaactcagatccaagcaaagcaaacatcacggctcgtcgcagtcgtcttcctccccacgcgaggccagatccaacctgcctcggccgaccaccgccatggctcccacggtcccttcggcggcgaagtctgcctctccttcccaaccttccgggaagagcgaggtggcagatctgaagcagcagttgcggcagctggcggggagccgcgctcccgatgcggacgaccagcgccgtgatgtcttcaagagggtgatctcctgcatgacggccggcatcgacgtgtcggccgcgttcggggagatggtgctctgctccgccacctccgacgtcgtaaccaagaagatgtgctatctctatgtaggctcccacgctcgcgcgcacccggacctagcactcctgaccatcaacttcctccagcgggactgccgtgatcaggaccccaccattcgcggcctcgcgctccgcagcctctgctccctccgtgtccccaaccttgtcgagtatctcgttacgccactcacgaccgggctgaaggatcctagcgcctacgtccggatgatcgctgctgttggtgctgccaagttgtatcacatatctgccacagcttgcattgatgctgaccttccggcttcgctcaaggcgctcatgctctccgatccagacgcacaggtagttgccaattgcctacatgcattgcaggagatctggaccctagaagctgctaactcagaggcagcagcaagagagattgagacattgtatagcaagccagtggtattttacctgttaaacaagatcaaagagttcagtgaatgggcacagtgtattgttcttgagttggcatcaaagttccttccatctgataataacgaaatatttgacataatgaatctgctggaggatagacttcagcatgcaaatggagctgttgttttggcaacgattaaagtttttctccatttgacaatgtctatgactgatgtccatcaacaggtttatgaacgtattaaagcacccttgcttactctggtgggtgctggcagtcctgaacagtcatactctgtgctatgccatctacatcttctggtgatgcgtgctccaatgttattttcctcggactataaaagcttctactgccaatttagtgatccttcatatgtgaagaagttgaaacttgagatgttgactgctatagcaaatgaaagcaacacatatgagattgtcactgaactatgtgaatatgctggaaatgttgatgtaccaattgcaagagagtctatccgggcagttggaaaaatagcactgcagcagtatgatgttaatgccattgtggacaggcttctacaatttcttgaaatggataaggattatgtgactgctgaaactctagtcttggtgaaagatcttctcagaaaatatcctcaatggagtcatgattgtatagcagttgtgggaaatatcagcagcaaaaacattcaggagccaaaaggaaaagcagctctcatatggatgttgggagaatattcacaggacatgcatgatgctccatacatccttgaaagtcttgttgaaaactgggatgaagagcactctcctgaggttcgcttgcatctcctgacagcagtgatgaaatgtttctttaaaagacccccagagacacagaaggcactaggggatacattagcagctggtctatctgacacccatcaggatgttcatgacagagcacttttttactataggcttttgcaatacagtcctaatgtagcagaacgtgtagtaaaccctcccaagcaagctgtctctgtatttgcagatacacagagcagtgaaatcaaagatcggatattcgatgagttcaacagtctatcagttgtatatcagaagccatcgtacatgtttacagataaggagcatcgcggaccatttgagtactcagaggatcttacaggcttgactgaggatccagaaaatgtaatttctgcccaaagatatcaagaaaatgataatgatcttttgctaagtacttcagataaagaggacaatggtacaagagccagcaatggttcttccacctctacatacaatgctccttccgatttgattagtccttcattgataagctcgcaaacaccagctgaaacttcactagtaaatactggtgggacatattcctcacaatcaaacttcagtctcgatgaccttcttggccttagcgttactgaagctcctgctttaccacaaccaacactggcccttaactcaaagcctgtgctagatcctggtacgttccagaggaaatggggccagctagcattggcactgtctcaggaatgttctttgagtccacaaggggcagtagctttgatgaatccccaatcactcatccgtcatatgcaaagcaatcacatccaatgtattgcttcaggcggtcagcctccgaactacaagttctttttctatgctcagaaagatggggctactgctttcttccttgttgaatgtattgtcaacacagcatcagcgaaggcacagctcaaaatcaaggctgatgatgggactgctgctgaggcattctcgagtttgtttcagtcagccttgtccaaatttgggctttcttgatcctgagtaatttgtctgagcgattcaccggtccacagttttttatgggtttcacagtttgccccaactccactgtcttggcttgtccagtacttgtgatcatattattggagaatcagagtagaaggtgcaaaagggtactggagttttgcggagctaaaaatcctatttgtactatttgggtgaactgtgcatttgtacatgactacatgtcacccagataaatagctgggttatttaggactgtactgtttgatgttctgggttatttaggattgtgatagtttgatgccttgatctcttctgaagggtttcgtttccttgaaggatgtagaaacaacacgcaacaacccctttcatgtatgctatttaccatttcttgcacagatgatcaataagatgtttcgtcttccattttgaaaaaaaaaaaaaaaaaaaagggggggcccggt

SEQ ID NO: 18959 - DNA, 3231 bp, Zea mays
  misc_feature (15)..(15): n is a, c, g, or t
  misc_feature (702)..(702): n is a, c, g, or t
  misc_feature (704)..(704): n is a, c, g, or t
  misc_feature (706)..(709): n is a, c, g, or t
  misc_feature (711)..(711): n is a, c, g, or t
  misc_feature (714)..(721): n is a, c, g, or t
  misc_feature (724)..(725): n is a, c, g, or t
  misc_feature (727)..(728): n is a, c, g, or t
  misc_feature (3214)..(3214): n is a, c, g, or t
taaagcaccagctgngagagataaagcaaaccagagtaaatacagttctaatggtaataaatagtggttgtagtagagcttattacatcggtaaaaggcgtagaagtgtagaggaatcgagccgcgtgagggggagttaacatagttcagtagagaatcggccagagtaaaaaagatttttattatagaatgtaatggtcgaatgataagtggttcattttagaataagcaagtagagttagccacgaaaaatagggccatgaagtgatgaggaaagaagagagggtgaacaaacatggggagagaatgtaatcacgactaagtgcaccggaagaagagataggttgtaataaggggtaaaggtgataggggagaagaaaaagatacgagtcatgtgtagataaagtctatattacgagagggtgtgagcagttgaaaaaaagaagatgggtgtctaagattatacgatagtgaaaagggccgaggttgagctcaaagcaagtgtgaagaaagatgcgagagagccattagggtaaccagagatggacaattatgaattggaggctccaacaacgaagagggaggagagaagaaagacaatgtacaccaggaatctaacatgaccaaaaaaaaaacaaagttgaaaataaaccaccattaaagggaacaaaagttgaacttccgccccggtgggggcggatnangnnnngnggnnnnnnnnggnntnnagcccccccccccccccccccagaagagcctgctgtagcggcgcaaacgcaggaggaacaacaactgcggccgtttgagcttgaggttgagaagggcgctgccttcactctgggcctcctagctgtaaagcctgaacatcaacaatttatagttgatgctggtgcactacctcccctagtgaaacttttgaaaaggcagagaagtactacaaattcaaggatggttaatagcgttatcaagagagcagctgatgcaattaccaaccttgcacatgagaatagcaacatcaaaactagagtcagaatggaaggtggaatcccaccacttgttgaattgcttgaatctcaggatcttaaggtgcagagggcagctgcaggggccttgcggactttagcctttaaaaatgatgaaaataaaactcagattgttcaatgcaatgctttgccaactttgatcttaatgctgcgatctgaagatgccgcaattcactatgaagcagttggtgtcattggaaatttggttcattcatcacctaacatcaagaaggaggtccttaatgcaggggcactgcaacctgtgattggattattaagctcatgttgtacagaaagccaaagagaggctgctttgttgctagggcaatttgcttcagccgactcagattgcaaggtccatattatgcaaaggggtgcagtccgtccactaattgaaatgctacagtcggctgatgtccaactccgggagatgtctgcttttgcactcggcaggcttgcccaggacacacataaccaagcaggtattgcttatattgcccccctcccgcccttgtttaaactccttgactcaaaaaatggatctctgcaacataatgctgcatttgccctttatggagttgcagataatgaggactatgtatctgacttcattaaagtaggaggtgtccaaaagttgcaagatggggaatttattgtgcaggcaacaaaggactgtgtggcaaaaacattgaaaaggttagaggagaagataaatggacgagtgttgaaacacttgctttatttgatgcgagtaggagagcaatctgtgcaaaggcgtgttgctctggctctcgcacacctttgtgctcctgaagatcaaagggcaatttttattgataataatggtctcgacttgcttcttgatcttctgatttccatgagcccaaaacatcaacaagatggctcagcagcattatacaaattggccaacaaagctgcagcactttctcccatggatgctgcccctccatctccaacacctcaggtttatcttggtgagcaatacgtgaatagttcaacactttcagatgttactttcttggtagaaggaaagcgcttttatgcacacagaattgctttgcttgcttcttcggatgcatttcgtgcaatgtttgatggcgggtatagggaaaaggatgcaagagacattgaaattccaaatatcagatgggaggtctttgaactcatgatgagatttatctatacagggtcagtgcagattaacagtgaaatttcacaggatcttcttagagctgctgatcagtatctcttagaaggactcaaacgcttatgtgaatatactattgcgaaggatgtgaatctagataatgtatctgacatgtatgacttgtccgaagcctttcatgccgtgtcactgagacatacatgcatcttgtacattctggaacattttaacaagatctgcaccagagccggttctgcacagctgatccagcgtgttattccagagatccgcaattttctaaccaaggcactgagttcatcaagaagtccaagtccaagcgacaggaactcgcagacttgatgagtcccaattcattggcaccgacgccgtcatctgaccaaagttgctggagatcctgtacagtaaaatttctggcgctgagcgttcaatggtatctattttgggtacatggtggcgcggtccttgaaattaacatcagcaatgtaacaaaattttctaagatctagttgaggataaggataaggagaacatgtctcgtactcatgcatcgaccagcttacactgggataggctatagttggatggtcctggccgtaattcgtcggtctcagctttgattgagtttagtgttgttttcactttccagttcacagttcagtgtatgcccgcatctgtttatttaaagtattaagcgtgaacaagttagacattaggacatgtacaatgatgtttaatgtagatgctcttgaggtgtttaatgtagatgctcttgaggtgtctaaagggtttgcaaaaaaaattatggagccgtctctctccatgaagagatgcctcctctgactcgtaacctaagtagcaatagatgtctcatttcttattgaaaaaaaaaaaaaaaagttttttcattcggtgctgcataagtgtatttacttttatatttattaatagactatatttataaacnaaaaaaaaaaaaaaaaa

SEQ ID NO: 18960 - DNA, 1179 bp, Zea mays
ccacgcgtccggtgagcaattcgtgttatagttcaacactttcagacgttactttcttggtagaaggttggtactatttcacgaccctgatttcatcagtataattcttttcaatcgtgtaccagataatcttaatcccttctacaggaaagcgattttatgcacacagaattgctttgcttgcttcttctgatgcatcgcgcgcgttgtctgatcccgggctcagggaaaagggtgcaagggacattgggagtcctaatatcagatgggacgtctttgaactcatgatgagatttatctatacagggtcagttcaggttaccagtgaaattgcacaggatcttcttagagctggtgatcagtatctcttagaaggcctcaaacgcctatgtgaatatactattgcgaaggatgtgaatctagataacgtatctgacatgtatgacttgtccgaagcctttcatgccgtgtctctgagacatacgtgcatcttgtacattctggaacattttaacaagatctgcaccagagccggttctgcacagctgatccagcgtgttattccagagctccgcaatttcctaaccaaggcactgagttcatcaagaagcccaagtacaaccgacgacaggaacttgcagacttgattttgagtcccaattcattgacactgacaccgtcatctgaccaaagttgctggacatcctgtacagtgaagtttctggcgctgcgcatttgatggcatctgttgtggtacatggtggccggctcctcaaaattaacatcagcagcttaacaaacttttgtaagatttagtggaggatatgggtaaagagaacccgcgtcttagtcatgcctcgaccagcttacactgggataggctgtagttgtgaatggtcttggccgtaattcgtcggtctctgctttgtttctgagttgtgtttgtttcaagttcacagttcagtgtatgcctgcatatgtttaaagtatgaagcttgagcaagttagaaattagcccctgtagtgataaagctgtctgtgtagatccaccgattggagttaccgaaacaactatgtaacatcatagatgacattagatgcatgataattgctggtaaagcttggtcaaaaaaaaaaaaaaatattaaaaaaaaaaaaaaaattaaaaaaaaattaaaa

SEQ ID NO: 18961 - DNA, 4229 bp, Zea mays
  misc_feature (1528)..(1528): n is a, c, g, or t
  misc_feature (1542)..(1542): n is a, c, g, or t
aaacaagcgcgcaaacccagccagcagcagccagcaaccccacgcacggacaaacgcatgccacacgcgccgcgtaccgatcggtcgccggatcggcaaaagcgatccaatccagcccaagcccaaggggaccggccggggcagcgacagcggccgccccggacggcgccaaacgcgcgccatcccgcggccgggacgacgagcgaagcttcggtcgccctccgtgcctgtgcatgcacctctccccgccccggtccggccgcaaagccgctggacgcacgacacggatcgttctcgaccgcgcgcgcggtagtatagtacaatacgacgtggtggcgctcgggccaacggcgagatcgatcgccgtggagaaaggcgcctgctgactgcgctgcgctgggttgcatcaacgcgtgtttgggtagctgttttacagctgcggatgatggcaactaatgctacacgccggttcggtcaggagcaaggaaggaacggtacataactacatacgtcaggtcaggtgaatttacaaaacagatatatggagggcgacgcgttcacgtttacggaacagtgatgagttgattagtcgccggagatacgtagggtagtagggtgtatccagctggtcgccctgattgcatggtcgattcctgcgcatgtgcagggacataaatgtttcttttgccaattgtacctttaactataattttacctcttgttttttcaattttatagttttaccgttgtttggatattttattattcacatcaatccacatgtattgatatagattgaagtgtaaatttacgcttcaatctatcataatacatacggattaaagtaaatactagaatattcaaacaagtcctgacatattttcttacaacagcggtactgtctatctcagataggtcctgtaattgttttacaattttttgtcgagtacagctcttcctgtttttccggtacgctttctgctctcatctatagtcatactattagtacctagtacctacgatgagtattatattctctctcactaattttagcagtatggagcaatgttgctacgactacgacgcagtcacgagcagtaccaaacaggccctaagtaggccacaccgtacctgtttaagggcccgtagttacgattatgggccttgagcccgttattatgactacgggccttcgtttccgcgctgccaattcaccgggacagaagaacacggcgcgaacttcaacaaatagcaagcacagatgcaactttacaagaaagggatccccgctccagtattaatgaccactgtactttcactttgcagtacactcgaaaatgaacgagcaaccttcctagccagggtactttcacttcaaatgtgcaatgtataggatctgtttggtgttatttataaaccgtttatggttaaaataaactgaaactagatggggaaaaaaaggataatgactaagaaagtaaacaacaattgtcaaagttatttcttatgtgtgatgatgaccccaccncaagtgtatgctgncctaatgcttaaagttattttttttaatgcatggtgtgtctatcatagcaattgggtgatgcggcatagcattatctataatcgtgataatgtaggtattgtttaagtggccagagagaatccaaaatctgtaccccgatgaacaataaatagcttgatagttgtcacttctaactgtacttactagtaagaacaaacaaactaaaccatttttagattctcaccacattaggatcctcatccttgtgttcaaattatcatgagctgctaaatattagtgtaactagtttctaattaaacgatatccattattactcctaattaatattaagaaatgcgatgtagccaaccaaggccacgtttggtttgatcggctaaagattactcactccattttaatgagttgtgttatgaatacttttaagggatgtttggttattttagtcaccttttaaattttagtgactaactctagttcttaaaaaaatatattttagtatctcgtttggtatgttagaaactaaaagtgtcactaaagtttaggatacaccaaccaaacaccctctaaattagatagagactaaacttaggcctccaacaaactttagtcgtgaactatgagaatgtttgaatgtatcataattaatagttacctgctaaaattagttgcatatatctaaacaatctatctaatagttcaattattagttatttttagcaaattaattaatagttagctagatatttgttagctagctaatttcactagaatttttagccaacggactattaactctagtgtatttaaacatttctaagagagctgatttggtgaacaagtatcacgataggaatcacaaaatagcaattaaatttcttttcatgatctctctcgatcacgggtcactaaaccaccataaaaaataccaaacactccttaaacttcaaccaatcaccccctcgttgacctagtaaactccggtatctcgcctgtctgatggccgccacaaccgccgccgacgcattcccctccaccgtctcctcagactcggactccgacgatctacttctcccgaacctcctcccctccaccaccgccgcacccgcaccctcctccccatcgcgcgagcagctccaccacttccaaatcccctccctcccgtcccccatcaccgtccgcgcgctcccgtcacggggcctctcgtttcagctctggccctcggcctccaccctcctgcgagtcctccctgccaccccgtgcctcctcccgcgcccgcccgcgccggggagcccactcagcgtcctcgagcttggctccggcaccggcgccgcggggctcgccctggccgcggcgctcccggcgcgcgccgtcctctccgacctccccgacgcgctccccaacctccgccacaacgtcgaactcaacgagcacctcctcgcctccgccggcggcgcggcgtccgtcgtgccgctccgatggggcgacgcctccgcgatggcggacgtggccgtggcgcagacggcgtccccgttcgaccttgtcgtggcggcggacgtggtgtactacgaggagttggtggaccccttgatagagacgctgcggttctttgtgaaggggaaggtggcgttcgtgatggcgcacatgaggcggtggaagcgcacggacaagaagttcttcggcagggcgagaaagctgttcgacgttgaggtggttcacgaggatccaccgctcgagggctggcgccacgggccggtggtttaccggttcaccgccaagaagcagcacggcaagaagtgaagaaactaccttaaggtaaaggctgattgcttgcctatctgcatgtgttcatgttgcagcgctgctgctgctactgtttgtcctcgtttgttgagtgctagattccaatgttggaaacagaaagcagttccttggaacaatgtgcaactctggaccaaaactgggttgaatttgcaggcatattgatttacattgtatcggtgaggttttgctctggtttactatatactatctagtttgatgagttcaatgtaagtgtcatattacatttttcgaattgaggaatctttattcttctcaaaaaaaaaaaaaaaatcatgttgagtttcaactctaacctagccaaacttgtagggtaaaaggcttttttgttgctgaaggatcttgttcttatgtatgatacattttcctaaaaaatcttatatatggtaaaatatatgatgtgaaatactaggtagttgccacatgtactttgcaagtaataatgtagtattatatccacatgattgtttggatggtgtaatttcatggtttgatatttcaaactgcttctaggtccttgtgcactacaaaacaaatgtttgtttcaccattaacttaagtagcataaattaaccggtagtttcaaactttccaacaccacttctatgccattatgtgataataataaatgtttgcttcaatatgaccttaagtaacagaacatatttatccattgttaaactgcgatcggaggttgtcaacatgcgaatgctttgtctgtatagcatgttaacctcgctctgcttggagggcttctcttgcactattttctaaaacttttctctaggtgaagctctaatgaattgagtctttctcatatgaaatgaaaggttcccttcatgtgtac

SEQ ID NO: 18962 - DNA, 6500 bp, Zea mays
  misc_feature (2159)..(2159): n is a, c, g, or t
  misc_feature (3943)..(3943): n is a, c, g, or t
  misc_feature (4027)..(4027): n is a, c, g, or t
gtgattggaatattactaaaaaatatcaaggggtcaaaaaagtaacaacctaaagtttagtatttggcatatatactaccacataattatgattgtatagtatatagccaggggcggagggcccagtgtggctcgctattgctccagcaataccttagcccaacccaacaacggaccagcagtaaaacaaatcccaaccctagccggctattccctgttcactccgaaggaggcgcaagccacaaccgttgacgcctaccaatccacacgaccacaaccaccccccagcctccaaggtccgagctccgttagtcgtgcgctggcggcccgaccacaatattcatgccgacgcacctcctcccatcggtccagaccgtccgcctgcactgagatccttcccaacggccgacagccaagctcctccccgacagctgcgtcgtgctgagcttgtcctagaacgttgctcctcccacttcctaggacgctgcactgatctccttccctacagccgcatgtcggcgctcgcgccgagctcctccccagcagcgctgagctcccccatgctcctccccagcaaccgagtgtccgcgccctgtatcatcgtatcaagctttcccccgtccctagcaatcgcaggtccatgtcgagctcctccccgaccccggcatctcctccccgaccatcgcctgtgagtgactttgttggcgttgagctcatcctcagtcatcatggcgagctcctcccataccattgtgtgggtgcatgtgggctgtgccgaattaagcaaacaatttacatttaaatacatcagctggataatctgaatacatgtggcctctgtacagcattgagcattccgcctgcttcatgattctgcagctccgatgccgagcaaacaaaacaagcagtagagatggagagaacctagacaaatgcggttgtctgtcttctagaaatggactcttatttcatttgtttaatagtcttgtatgtatgaattgatttaaattatgttgtgaatttttttcgttgttgcgttagcaacaccttaattttgacgcgtcctccgccactgtatatagcggatgcaactgtgaacacaaatggattcacagtgaaactagttattgtgagtagcaattctagccaatgttagtgataccatcatgaatatgatgtctaatttaatcagcaggattgaatatgtattattctgatgatttcttaagcgtgcagcaaattgcatggattaataatcgttagtcgttactaatggccttgtgcctttgttcgacaatccaaactttggcctttctgattattttcaccatggatgacggactggctattgtgtcattatgtctcttgcttcaaaccatttaaagtaagcatagaggcacgcacctctagtccaatacttccaaaccactcgatcaagctctccactgattcacggatcatgagaacaacaatagtcgccatcgccatcttggtgatcaagattcagtttttggtgaaatcacgagtctattttttctcttcctttgcccttattttcaatattgaagggtgttggcgtcgatctggacgccaaacactgaaacgaaccacgtgctctctacggagccgcggacgatccgcggccctgggcgcagtgcacgcttccggacagtccgcgtcatctatataaagaggggacatctggacccgttacaaatcggtttctgagcctaattgattctacgcacgcgcgtaccgtccgcctacaggctcaacagtccggctgcccattttgggactgaacaaaggggtttcaaaacaaaaaaatctaatactgatctaatatcaaataggaagccagttgaatattgaattgattcacagttggtgctgcaattgatcagagacccagagaattcaaacctgttcagctgctcttcttccgttgttcgctgttcggtgccccagcctccttggtgggacggtttctcggcaccgcactgccacggtgccaccgccgccgacctcagtggctacgagcgcgacgacgcccctggctgccccggccccggaccgcccagccactggccactgcccgcccgcaggtgcgcgacgcggcagccgtccaagccaagccaagccgaacggagagctgcctncctgcctgtcctccaccgcctcgaacgagcctcagcagccagcaaacttccacggagctcgcctcgatagcgacggcgagacgagagtataactgtttaatgggccggatcgacactttgggctgactctaaatacgtagagaagacgggacatgtttgagtttgagagccattcactaatttcagcttccgtttttcagcttcaacaaattattgaaatgggtttgagaagtatttgacatgtacataaactcaagcttctataatacaattaatctgtataagtttttttattacacttcatgattagtggctctcaagaaccgaagcgctatggtgttaattttcatgtagcttcatgaaaagtataaaaacggtgtttgtccctcgaagagcttcgtgaatttcgtgaaagttgtctctaattttaagtttaagatttttaaagttaaaggtcgtgaagctagacctgtttagatagaagaagttagaataaacctaattttttttaagtgaagcctttccaaacagtccctagatacgtagagaaaactcccgtcggtttcgtgatgaggacaaaaaataattttatcaactttgcactcaagaaagcaacgctgaaattctgtaaaagaagaaaacgctgaaaccatcttcttgcacaggaagacaaatcagcagacagcagcactctttcgtgcagcggaggaaagaatcgaggcccttcttgaccgtccgatgaaagatccaacagcccacgatccccgccgcccgcttcacatagccacgccgcctcccctgtccccgggattggccttccgcctccacctgtacacgcctccgccacccgacaaactactcaataaccctagctaaacccccacgccgccgcggcgacctcctccgccggcgggatggacagcctcaggggagtcaagttgccgggcgtgccgaagggcgggagtgcgctcgtgaaggtggcgctgctcggcggcgcggggctctacgccgtcctcaacagcttctacaacgtcgagggcggacaccgcgccatcgtcttcaaccgcctcgaggggatcaaggacaaggtgaggccacctcggtcgcgaccgcgcagtggcggcccgatgtgtgtgagtgtggtttcgagttttttgactgggtgggttcccgattcgcatttcgttctctggcgcaggtgtaccccgaaggaactcacctgatgatcccgtggatcgaaaggccgatcatctacgacgtccgcgcccgacccaacctcgtcgagagcacgtccggaagccgcgacctccagatggtaagtttccttatcgagtctccattccctatccactcattttgcagcgaatgtactgcccgatgtgcgtgcatgactaggcacttactctggggaccaaaaggattgacttctgatggcaatagctgagatgatgttgactgccgcttgtagtgatcttttatggttctgaactgattgctgtgattctgtccctactccctgctactccctagatgtatgcatagatttaatggctaatttggtgctatcacttaacccttgttctgctgtaactcatggcagaacaatgcaatgccttgtagtggtcttttatggttctgatgaactgattgctgtgatgctgtcccttgatgtgtgcacagatttaatggctcatttggcagtgttactttgaatctttgttctggtgcaactcatatgagctcttatgggctgcctgccatgaatgaactcgttttttgctcancacggcagtgttaacgcacccttttgtagttgccatggatctagtaatgatgtagcccattggctgccagtaattgaattgttnatttctgcttgcatattgatgtgcattaatctgttctgacttctgagggtgtctttgattttaaagtgcaattgtgaatccagtacaacgcgctgtttctgttctttactttaccatttcaaagcacataataggttgtggaagtttcttgaagtttacaagtaagtccggcctaggttcatcatattcattgtcattgtagtttataatggtttgctcatgtttgattgtattttgagagatactgttcatgtgggtctgtcttcatatgtatgcactcgatttttttgtgtgtgcatttccacttctgcgagtacattagcaccatcgtccttttatgtatttgattttttagttggtaacttgggcaggtgagaattggtcttcgtgtccttactcgacccatgccagaccagctacctaaaatctacaggaacctgggggagaacttcaatgagagagttctgccttcaatcattcatgaaacactcaaagctgtggttgctcaatacaatgccagccagctgatcacccagagagaggtaccgttcatgcgtctagacacgatgttccccatataacaactgtcttgctaggattggatgagattaggatatgttaacagttcattcatgcattcgattccgatgcaggctgtgagcagggagattaggaagattctgactgagagggccaacaacttcaatattgctctggatgatgtgtccatcacaagcctcagctttggaaaagagtttactcatgccattgaagccaagcaggttgctgcacaagaagctgagcgtgccaagttcattgttgagaaggctgagcaggacaagcgcagtgcagttatcagggcacaggttagtagccaccctttcttgtgtaagagtgttcttttgtctggctggaaacaagtaaaacttacaaggaaaaaaaagaaatgccatgaccttaatcgtgatgttgaacacatgcctgtagtttcagattctcattctgaaagtgtattggtagtgttcttggtgtctctgtgtgtagttcagtagttgtgtatatactattgcatcattccccttttaccctgatgactctgaatcaccgtctgtctgtgacttgcatttgaacagggtgaggctaagagcgctgagttgattggccaagccattgccaacaaccccgccttcctggctctgagacagattgaagctgccagggagatctcccacaccatggcggcctccagcaacaaggtgttccttgattccagggaccttttgcttggtcttcagcagctgaacgtgggggccaagcaaaagaagtgaagcggtcgtccccaggccatcgtggatgagagtagtttcaggcgatggttttatctgttacagaatgcgcgtgcgcgggaatgaacaaagtggcaccatgttgcagtctgtatgttctgacaaatttgtctatcgatctttgattctctgctcttgtaagtcgtgactgatgaatctgttcttgcaattgccttcctggaggcttgctctgatgcgtgtaacagccattccattgctcgtagtcgcagacgtaattcagcgtgtgagttcaatcaggacccgtgtgactggttgtggcatggtggtagcctggcccgacttgtctagtatgtggagccagatttcatatatccaggctaggctcatgctcatatttatgtttggttgtttgcgttcaggtcggataaagatatgtgtttggctgtatgcatcaataccaagatcaaataaagtaaataaataaatcttcacaattaaataataaatatggtatagttttgttcgtgaaaatgttagaaatatgataaaaaatctaacgcaatggctttgttggagtccgtacacgggacaagaatttatggggtcacagagaccacatgagagccatggcttgctggtctgctaagcccgtcgagaacagatcacatcgttgcgacgagtgagatctagcttgtcggtcggattagcgttacgatgacaacgggataaaggacgaaggcgtaggaaagaggcagagtagatacaaggacttgactgagagaatccgacatggagacttgacagggttgttttaggctttgttccaaacctctataactgattgttaactgtttttagctaggtcgaggcagctacaactaatacttatttaaggagtatagctaacaactagttgatctattctaaacctcttaactaattttattcggtaggtatagttttagaggtgtaaaacaagactttgtactataaaaaacttcgattttttttgcacttaatactaattaatcactaggtataaaaaggtataccaaattgaggggtcatagtcccctttgcatccctgatatggaaccaacccaacatacggaatgtgtcgatgaatcttgggctctctaacttcagagcgatttgctatacaaagg

SEQ ID NO: 18963 - DNA, 1289 bp, Zea mays
cattgggtacctcgaggccggccgggcgcaattggccttccgcctccacctgtacacgcctccgccacccgacaaactactcaataaccctagctaaacccccacgccgccgcggcgacctcctccgccggcgggatggacagcctcaggggagtcaagttgccgggcgtgccgaagggcgggagtgcgctcgtgaaggtggcgctgctcggcggcgcggggctctacgccgtcctcaacagcttctacaacgtcgagggcggacaccgcgccatcgtcttcaaccgcctcgaggggatcaaggacaaggtgtaccccgaaggaactcacctgatgatcccgtggatcgaaaggccgatcatctacgacgtccgcgcccgacccaacctcgtcgagagcacctccggaagccgcgacctccagatggtgagaattggtcttcgtgtccttactcgacccatgccagatcagctacctaaaatctacaggaacttgggggagaacttcaatgagagagttctgccttcaatcattcatgaaacactcaaagctgtggttgctcaatacaatgccagccagctgatcacccagagagaggctgtgagcagggagattaggaagattctgactgagagggccaacaacttcaatattgctctggatgatgtgtccatcacaagcctcagctttggaaaagagtttactcatgccattgaagccaagcaggttgctgcacaagaagctgagcgtgccaagttcattgttgagaaggctgagcaggacaagcgcagtgcagttatcagggcacagggtgaggctaagagcgctgagttgattggccaagccattgccaacaaccccgccttcctggctctgagacagattgaagctgccagggagatctcccacaccatggcggcctccagcaacaaggtgttccttgattccagggaccttttgcttggtcttcagcagctgaacgtggggggcaagcaaaagaagtgaagcggtcgtccccaggccatcgcggatgagagtagtttcaggcgatggttttatctgttacagaatgcgcatgcgcgggaatgaacaaagtggcaccatgttgcagtctgtatgtactgacaagtttgtctatcgatctttgattctctgctcttgtaagtcgtgactgatgaatctgttcttgcaattgccttcctggaggcttgctctgatgcgtgtaacagccattccattgctcgtagtcgcagacgtaattcagcgtgtgagtcaaaaaaaaaaaaaaa

SEQ ID NO: 18964 - DNA, 1498 bp, Zea mays
  misc_feature (1482)..(1482): n is a, c, g, or t
gcacgagaccattacctagaacatcctaatcgaaaagtgatgaggacaaaaaataattttatcaactttgcactcaagaaagcaacgctgaaattctgtaaaagaagaaaacgctgaaaccatcttcttgcacaggaagacaaatcagcagcactctttcgtgcagcggaggaaagaatcgaggcccttcttgaccgtccgatgaaagatccaacgcccacgatccccgccgcccgcttcacataaatcctcaggggagtcaagttgccgggcgtgccgaagggcgggagtgcgctcgtgaaggtggcgctgctcggcggcgcggggctctacgccgtcctcaacagcttctacaacgtcgagggcggacaccgcgccatcgtcttcaaccgcctcgaggggatcaaggacaaggtgtaccccgaaggaactcacctgatgatcccgtggatcgaaaggccgatcatctacgacgtccgcgcccgacccaacctcgtcgagagcacctccgggaagccgcgacctccagatggtgagaattggtcttcgtgtccttactcgacccatgccagatcagctacctaaaatctacaggaacttgggggagaacttcaatgagagagttctgccttcaatcattcatgaaacactcaaagctgtggttgctcaatacaatgccagccagctgatcacccagagagaggctgtgagcagggagattaggaagattctgactgagagggccaacaacttcaatattgctctggatgatgtgtccatcacaagcctcagctttggaaaagagtttactcatgccattgaagccaagcaggttgctgcacaagaagctgagcgtgccaagttcattgttgagaaggctgagcaggacaagcgcagtgcagttatcagggcacagggtgaggctaagagcgctgagttgattggccaagccattgccaacaaccccgccttcctggctctgagacagattgaagctgccagggagatctcccacaccatggcggcctccagcaacaaggtgttccttgattccagggaccttttgcttggtcttcagcagctgaacgtggggggcaagcaaaagaagtgaagcggtcgtccccaggccatcgcggatgagagtagtttcaggcgatggttttatctgttacagaatgcgcatgcgcgggaatgaacaaagtggcaccatgttgcagtctgtatgtactgacaagtttgtctatcgatctttgattctctgctcttgtaagtcgtgactgatgaatctgttgttgcaattgccttcctggaggcttgctctgatgcgtgtaacagccattccattgctcgtagtcgcagacgtaattcagcgtgtgagttcaatcaggacccgtgtgactggttgtggcatggtggtagcctggcccgacttgtctagtatgtggagccagatttcatatatccaggctaggctcatgctcnaaaaaaaaaaaaaaaa

SEQ ID NO: 18965 - DNA, 3556 bp, Zea mays
acaataatgtacatcaatagagtgaatcaaattcaaatttttattggcttctctagcatttagcgatttttctaagtaaataaaatcatttttttttttattcctgacgctaaacctaaagttatagggaacccactaaccatctctatctctactcttttaaagcaccagttttaatggtcgtcctatactcctatgtcacacaccaagcaaacatctgttaccatctcctcgcttctcgtctatccgtaaaccgttcactcacatatatgtctgttctcttcaccatttctcatttaccagttggtcgttatcccacagatggcctatgagaattcatccaatcccaacacgacaggaagacgcacgtagcgtagcgtttccacgtagtaacaccccgttaactaacagagaatgagagagctgtaaaaaaagtcagactttttttaattcatacatttctcagtcttttagctaaaacaaagtgtaatatttattcttatcagtttaatatatctattatgtatattatatattcactttgatattaaatttattttttgtggctattttttgtgggaggttccactacactgtcgtgacgagagattgttgtttttgtgtgtgtccacagtccacacagaccgacgatctcttcctgttggcggcctatataaagatggccatggaagaatgccataaggccattaagaattctctcggtctctaccaaaaaaacagcgacctctaacgcttagctagctctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacgtaatatttgttgatcgatcgagctcctcccgctcccgcccactcgaccatccacacccacacacatgcatatggtcattatgcattgtatatattcggtgacttgttttaactaattatctctcggccagggctgtgacggctccgttcttctggacgacaagccgttcttcatcggcgagaagacggctgtgcccaacgccaactcaatcaggggcttcgaggtcattgacgccatcaagaccgagctggagcgggagtgcccagatacagtttcctgtgccgacctccttgccatcgctgcccgtgactccgtcgttgtggtatgtattacatacataggcatcatcgtctcatcgacacttataataagcttcttctcaatcacatagatcttcttttgaagtcgtgcaaataaaaagattgttctactgagtaatgcatgatcatggtttgtttgcatcatcatcatcattaaattatccggcggcccgttcagtctggcgggccgagctgggagattgaggtcggccggaaggacagccgcaccgccagcctgcagggcgccaacaccaacctcccagcaccgacgtctggcgtcgacaccctcgtgcagaagttcaggaacgtgggcctctctaccaaggacatggtcgcactctccggtaatacctacctccctccgccgacgccgcgcgcccacaccctcgtgcggaagttcaggaacgtgggcctctctaccaaggacatggtcgcactctccggcgcgcacaccatcgggaaagcgcggtgcacttcgttcagtgcgcgccttgccggcgccggcggcgtctcggaaggcggcgcgggcgccttcaaggacctcaccttcttgcagtcgctgcagcagctgtgcacggggtcggctgggtccgcgctggcacacctggacctcgccaccccggcgaccttcgacaaccagtactacatcaacctgctctctggcgacggtctgctgccgtcagaccaggcactggcgtcgtcggctgccgtgcctggggtagaggcggacgtcgccagcctcgtcgccacctacgccttcgacgcctccgtattcttccaggacttcgcggagtccatgctgcggatggggaggcttgcaccgggcgtcggcaccagcggcgaggtccgccggaactgccgggtggtgaacagctccgaataaagtcatgcatgctcacgctcaactatctggtcgtccgtgcggcttgcattgctgatttgttatcagctaagtcaagccagtaagtttgtttgggttaaaaaataatcggctttggcatgggaattatgataatggccatcgtttaaatagctactagtaggtgtcttgatgtactaatgtactatctacgctacgtactctgctgttcccaaataaatatttttaagacattaaatctatctaaaaaattattagtcaacaaaaactaatatgcacaaaaaaactacatagatttcgacggtttaagccatcggatataagctcctcaccgttgaaaataaaccgacttctaatgttttggacgtttatctctgacagcaaatgtccgttggtcttaacgatcgaaagagaaatataatagacaatttagccttttctacatgttttggtcatcagtagcggaggcatagcccagcaaacaagggcacgtgcccgggcttcgactgtatgcagtccactaaacatctacattagttaattaggcccaatagtgcagtgaaagctagatcatccatcattccatatttccatccgcacagcgccgccgctcgccagggtcctgctgcacggctgcaccctgcgtccctgcaaggctgcagactgcgtcagcgcctgccaggctgccaccagctgcctgcgcccaggcggccaatgaccagcggctaagcggccaacgcccagggcctaggcggccagcgcctagcgcggcagcttccaggcataggcactgctcgacgccgccagcgcccagcgcctagtccccacgccggacgccgccagcccgcccacgcctgactacttgataagtataatttatccatctctaggatgcgtggacaaggatacgatggagcttcaaatatgaggggtcaatttaatgggctacagaaaaatattttagttgaaaatccacatgctttttatgtccattgttttgcccatcggttgcagttaatcattgtttctgtttctagctgttgctcggctattcatgatttctttgagtatgtctgttgggggtctgcttcgtctccgaaggtcctgtgagaagaaacaccttcggaagatcaaaacagaagcggtgccgaagctaccaatcagggagcttcgtagcgtaccttcacatgcaccgacttaaagataaaaagaccaattggcccatgataatttgtgttatgatga

SEQ ID NO: 18966 - DNA, 645 bp, Zea mays
atataaatactcgatctattatatatgaatagatcttgtatgagcatgtatagatgtgtctttgagatattggaggaacacaaaggagagaattgcttcagttatatcgtgatcaacatgccgcgttagaatatatactattataatgtgttatctaaaatatgaggacgcccattcagttggcacattgacgttgtgtgcatgcaccacaattgcaacattgacgatggagctcaataccaccacacgtgatgtcatggacgaagttgtcgtccaagcacatgatgattattctttcctcgctcatcgatcggtttttgtatattgtgtttttcttggtggttccctcattgcttggaagattaagaagcagttagcagtttccctgtttgagtacaaaggttcagttgtgtgctattcctcttgctacggtagaggtgacttgggtatggtggttgcttgttgattttggtgtttctgtgtctatattgacacccctttgtctagcagtattggttctattagtacttcttgtgatccaataatcattattggttctattagtattggtcgtgatccggtaaagcatgagcttactaaacatattaaacatattggtgtttatgctcaaaaaaaaaaaaaaaa

SEQ ID NO: 18967 - DNA, 2879 bp, Zea mays
tctctctaatcaagaattattgtctatctagttaccatgtccacagagggaagaggagtggcctagggcttctagttgtgtgggagaagtgaaggagtttagtagcaagtaatgtgggacatggagaggtatttatgggccacaagtcaaaactatccatttggattgattactgaaacctagcctattggggatttcaaaccaactagtcgttgggctaagccagcctggcgagtccctaaaccagcctagatagcatgccaatctagcctagctagcttatgagctgaggttgggtctacaagtgggtctgacattctctctctctctcgtctttcactctcaagttttctctcatggggtaacttgagcactatttgctcgtctcaaattcaatgaaacatcttgatagtgtagcatatctattctcaaggaataaattaatcttcatttgagctttgaattatccatgtttactgcatcgatcatgcataattggtggtccatcatttctctttttttagcatgtgacttaaataggtcacatgaagtcagtttcatcattgatttgatctttcacattgatgtagcttttcatagttcgatttgtttaccttgactaaatacaagtgaatttcttcatcaccttagctaggttcgtcggtcaccaaaccatcgcttgtacttcatccttgccatcaagacacttgcttgttatcttcaccctcttaaaccatcaaatcatatcaatgctcctgaccaccatttgactatcttttcatttgcattgctttcttgtgcctgaactatattgttttcaataataacccttacattctttaacaactacctttgatatttattctcccaatcttcctcatttgagaccaatcaatatgttaaccatcttgtctcgttcatctgataacacgcatgcttgcaaactcttgctttcgagtaatcaatattggattcggttgatatttatatgatcacggctcaaaatatgaattcgatggttaattataaatttgggactaagcacctagaaatctcgtgaatattgtgagtcccttaattatgttgccatttaattagctaaaactcctttaggatctactacgttccgaaagcaacctacgtaatttgctggggactatttctatcatctcttgattgaaatcgggatagactggatgatatgcacagcaacaggagcggatcctactccgtggagatcatgcgcaagttctccgatcatgtttattgcgccgacaactatggggatgtttattgggataattttttaggaggttgcatgtttattgcgagatatattcataattttattgcattcgattctttttcacagatatgcgcgcgccgtaggcacattttcactagagaaagaccgagttatttaaataccagtgttaatagttttgccggcagcagtgcctgcaagtgcaactcagacttttggtttaccaccgcgaccacccaacgccccaaccaaaccaacccacacgctaaaagcctaaaaccctcctctccgcgcgcctcctcggctcctcgccatggacggggacgacgccggcggccagctccccgcagcccctgcttctccgcgcaccgaggaggcgatcgccgcggcccatgatgacgcccgcttcccacccaccccctccgacggcgaggactacgatgacctctacggtgacgtcaacgtcggcttcaactccctgctgccgctctccccctctccggctccgacatcgcctcccaaaaccccatccccgggcccctccttccagttgccaccccagtggccgcaccgtcccccgcctccggaacccctgcccgcgcctgcgccccagcgcgagcccgagccgcaaccgagacaagataccccgcgacaccagccgccgcagcctaccccgtccgtgccgagacaccacatgacgccgcgcggtggcggcgcctcctactcgtcgtcgcccaggtgcacgtcgctgtacatcagcgagctccactggtggacgacggacgcggaagtggaggccgctctcgcgctcgcgccggacggtgccgccgccgcgttatacggcctccacttctacaccgaaaagatcaccggcatgtcgcgcggcatctgccgcgccgatttcctccatccagccgcggccgccgcggccgccaccgcgctccatggtcacgccttccacgggcgcaagtgcgtcgcctctctcgccccctctccctccctcaacctcctgggcgacgacctcgactcctacgccgaagccgcctggtcccggaaccctactggaggcctcggcaacggtggtcatggtgcgagcgatgccacggcgggtcgaggcaatgtggccctcgccttggctgatcggctgcctctggcgcgacctcagctgtccgtggttccccggccgacacctaggagcgttccgttcgctggtattggtgggtacggtgggttccagtcaatgagacagtacagtgcggggatgggcattgctatgatgccgtcggcagtggcacaccgcgtgaacccaccgttcttggcgttgcaaggttcaggattttggtatgatcaggggatatctgggagcttttggggagcacagcaggaacggaatttcggaggttgtcaaatgccatggcagcagctaatggccccaaggcagcagcagcaccaacaggcgcagcagcagtttgggaattggaactacgggatgcaggggcgtggcttaagacatgaaagactaagtaatacgaggagcattggcaatgtgaggtatctggatagaaggcaggctaactgtgatgggggtgatcggtacaaagagaatgattgtgag

SEQ ID NO: 18968 - DNA, 1059 bp, Zea mays
agggtctaagctcggaattgttgcaaggttgtgctagttggctgaataccacacggaaatggaggaagttttgggtctgtcattttcaattccaaactttggccctaaatactgacatccaaacggggtgttagccaactttagacgctgtccggcacccaaggagtcaaggtccaaagagacaaaacctcgttttttcttgacccatgcttggctaaaaaaagaaaccaagaaacgccatgtctgatccccccggcgagacggaccataaccatcgcgatggaaagcaccggcgatcgcacctccaccacctgaatgtgcaggtccctcccgtcgccagcaacattggctgcttcgccggctgcttccgcccgtccccgacatcatcgtcttcccccgccgcgcacggcaccaactgccacggacacggacacggacacggacaccggcacgcggaccggccggcgtccccgtctctgatccggtcgccgtcggcgtggatcaaagcgaagggccagagcctcgggtctggcaggcacgcgcgccgccggtcccaggacttccagtacgacgcccttagctacgcgcgtaacttcgacgagggcgggagcgggacggacggcgtgggtgaggaggaggctacgagcgacgcgctcaagcaccggtgcttcacgtctaggctccccacgtcgccaccgcccgaatcgccttcggggatggccaccagcggcaacggcaaggcagcggaaacaggccgtcatgagttggagtgaaaccattgcattggagctttcgcttttgtcatcggctcttttttttttcgtgttggattggaaggagttcatcgtggtcggctgctggtgctggccatagcgcgtcccgtagagctgagatccgctaatcagcgtttgcttttgtttcgtttatctgcgttgctgcaatgtaactgtactttgaaacatgttcttcgagtggacactttgttgtaatgttacgtactttggccgccaacaatacacgaaatacatggaagacaaataggcaaaaaaaaaaaaaaaa

SEQ ID NO: 18969 - DNA, 764 bp, Zea mays
ataaccatcgcgatggaaagcaccggcgatcgcacctccaccacctgaatgtgcaggtccctcccgtcgccagcaacattggctgcttcgccggctgcttccgcccgtccccgacatcatcgtcttcccccgccgcgcacggcaccaactgccacggacacggacaccggcacgcagaccggccggcgtccccgtctctgatccggtcgccgtcggcgtggatcaaagcgaagggccagagcctcgggtctggcaggcacgcgcgccgccggtcccaggacttccagtacgacgcccttagctacgcgcgtaacttcgacgagggcgggagcgggacggacggcgtgggtgaggaggaggctacgagcgacgcgctcaagcaccggtgcttcacgtctaggctccccacgtcgccaccgcccgaatcgccttcggggatggccaccagcggcaacggcaaggcagcggaaacaggccgtcatgagttggagtgaaaccattgcattggagctttcgcttttgtcatcgcctcttttttttttcgtgttggattggaaggagttcatcgtggtcggctgctggtgctggccatagcgcgtcccgtagagctgagatccgctaatcagcgtttgcttttgtttcgtttatctgcgttgctgcaatgtaactgtactttgaaacatgttcttcgagtggacactttgttgtaatgttacgtactttggccgccaacaatacacgaaatacatggaagacaaataggc

SEQ ID NO: 18970 - DNA, 2413 bp, Zea mays
  misc_feature (605)..(605): n is a, c, g, or t
caccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctcgaaatcgccaaccgtatgcagaacatggtgtgtgtggaaaccatgatgcacctgacatgtacaaacatgccagtagagaagattgaccatgccttggaaaccatcaaatccaatgggattcaaaatgttttggccctcagaggggatcctccacatgggcaagacaaatttgtgcaagttgaaggcggatttgcttgtgctcttgatttggtgcagcatattagagccaagtacggtgattattttggcataactgtagctggttatccagaggcacaccctgatgcgatacaaggcgagggaggtgctacattggaagcatatagcaatgatcttgcgtacttgaagagaaaggttgatgctggtgctgaccttattgttacacaacttccctccgattcccccggctttctcaagtttngtgaatgactgccgccaaattggtattacttgtcccattgttcctggcataatgccaataaataactacaaaggtttcctgcgcatgactgggttctgcaaaactaagataccttctgagatcactgctgcactagatcctatcaaagacaatgaggaggctgttagacaatatggaatccaccttggaactgagatgtgcaagaaaattcttgctactggcattaagactttgcacctttacacactaaacatggacaagtctgctataggaattttgatgaatcttggattaattgaggagtccaaggtttcaaggccattaccttggaggccagcgactaatgttttccgtgttaaagaggatgttcgacctatattctgggccaacagaccaaagagctatcttaaaaggacattaggttgggatcagtatccccatggacggtggggtgattctcggaacccatcatatggagcacttactgaccaccagttcacaagaccacgaggccgtggtaagaagctccaagaggaatgggctgttccactgaaatctgtggaggacattagtgagcgcttcacaaacttctgtcaagggaaactcacaagcagcccatggtcagaattggacggtcttcaaccagagacaaagattatcgatgaccagttggtgaatattaaccagaagggtttccttacaattaacagccaacctgctgtaaatggagagaaatccgactcgcctactgttggttggggtggtcctggaggctacgtttatcagaaggcctacctcgaattcttctgcgcaaaggagaagttggaccaactaattgagaagatcaaagcattcccttctctcacttacattgctgtgaacaaggatggagaaacattctccaatatttcaccgaacgccgtgaatgctgtcacgtggggtgttttccctggcaaggagattatccagcctacggttgtggatcatgcaagttttatggtttggaaggacgaagcatttgaaatctggactcgggggtggggttgcatgttccctgagggtgattcatcgagggagctactagagaaggttcagaagacctactacctggtcagcctcgttgacaacgactacgtccagggggacctgtttgctgccttcaagatctgattatgctctcatggtcggtattgttgtatggttggacccaacaatattcttgcatccccgactacaggtctgatcgccatgaaagcttctgttcatttgagctcgggggagtccgctagtcttatttttcttgatttctcttggctttctggaaccatacgaatcaataaggaatgagccgtgttcactttccagttcctccatgtgcaagtggcgcaacggccaggttctagatgtaaaattcgtcctctaatacagaggttggtattgtatgttagtgtaggatgcgctgctcgcattgcactgtattgtgcttctgtttggtggaaataaagattggtcgaaatctgagggccaatttggaaaaaaaaaccccggacctgattggaggggctaaatttcattttttgttcaattttgaataagaagaagaatctagcccctccggtttctcattcccaatctgtcctgaatgttcacaagcccccatttgaatttagccgggtaacccctttaattaggaggtctattgaggcgtttttatgggtatgtggaaagcttaggagactcgagacgactctatataaaggcaggcctcctttgggtcaaagaataattttctgaatcacttgtttttg

SEQ ID NO: 18971 - DNA, 2541 bp, Zea mays
ttgggggcccccgcggccccccggctccttctcagtataaactcatccgcaccacctcccccgggcccgcccgccgctcctgcctcgcctcaccaccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctccttctgcgacatcacctggggcgccgggggatccaccgctgaccttaccctcgaaatcgccaaccgtatgcagaacatggtgtgtgtggaaaccatgatgcacctgacatgtacaaacatgccagtagagaagattgaccatgccttggaaaccatcaaatccaatgggattcaaaatgttttggccctcagaggggatcctccacatgggcaagacaaatttgtgcaagttgaaggcggatttgcttgtgctcttgatttggtgcagcatattagagccaagtacggtgattattttggcataactgtagctggttatccagaggcacaccctgatgcgatacaaggcgagggaggtgctacattggaagcatatagcaatgatcttgcgtacttgaagagaaaggttgatgctggtgctgaccttattgttacacaacttttctatgataccgacatctttctcaagtttgtgaatgactgccgccaaattggtattacttgtcccattgttcctggcataatgccaataaataactacaaaggtttcctgcgcatgactgggttctgcaaaactaagataccttctgagatcactgctgcactagatcctatcaaagacaatgaggaggctgttagacaatatggaatccaccttggaactgagatgtgcaagaaaattcttgctactggcattaagactttgcacctttacacactaaacatggacaagtctgctataggaattttgatgaatcttggattaattgaggagtccaaggtttcaaggccattaccttggaggccagcgactaatgttttccgtgttaaagaggatgttcgacctatattctgggccaacagaccaaagagctatcttaaaaggacattaggttgggatcagtatccccatggacggtggggtgattctcggaacccatcatatggagcacttactgaccaccagttcacaagaccacgaggccgtggtaagaagctccaagaggaatgggctgttccactgaaatctgtggaggacattagtgagcgcttcacaaacttctgtcaagggaaactcacaagcagcccatggtcagaattggacggtcttcaaccagagacaaagattatcgatgaccagttggtgaatattaaccagaagggtttccttacaattaacagccaacctgctgtaaatggagagaaatccgactcgcctactgttggttggggtggtcctggaggctacgtttatcagaaggcctacctcgaattcttctgcgcaaaggagaagttggaccaactaattgagaagatcaaagcattcccttctctcacttacattgctgtgaacaaggatggagaaacattctccaatatttcaccgaacgccgtgaatgctgtcacgtggggtgttttccctggcaaggagattatccagcctacggttgtggatcatgcaagttttatggtttggaaggacgaagcatttgaaatctggactcgggggtggggttgcatgttccctgagggtgattcatcgagggagctactagagaaggttcagaagacctactacctggtcagcctcgttgacaacgactacgtccagggggacctgtttgctgccttcaagatctgattatgctctcatggtctgtattgttgtatggttggacccaacaatattcttgcatccccgactacaggtctgatcgccatgaaagcttctgttcatttgagctcgggggagtccgctagtcttatttttcttgatttctcttggctttctggaaccatacgaatcaataagaaatgagctgtgttcactttccagttcctccgtgcaagtggcgcaacggccaggttctagatgtaaaattcgtcctctaatacagaggttggtattgtatgttagtgtaggatgcgctgctcgcattgcactgttattgtgcttctgtttggtggaaataaagattggtcgaaatctgagggccagattgaaagccaaaaaaaaaaaaaaaaaaaaaaaaaaaaatattattctttgattaattttaaataagaaggagaatctagcccctccggtttctcgctcccaatctagtcctgaatgttcacaagcccccatttgaatttagccgggtaaccccattaattaggaggtctattgaggcgtttttatgggtatgtgaaaagattaggagactctagacgactctatataaaggcagccctcctttgggtcaaagaataattttctg

SEQ ID NO: 18972 - DNA, 1498 bp, Zea mays
  misc_feature (54)..(54): n is a, c, g, or t
  misc_feature (62)..(62): n is a, c, g, or t
caaactctgtgtgattgtataggtgctgggtgaaggtagtcttcccaaatgccnccctaggnccaaatataggaagaacggaccaagggttttgccactatctttggctatgataatatcctctatagttttctgaaagatggcgtccctcccaaacaacttgtcttgtgtgattgagagcttgtcggggaccttttagtggaggagctactgtcttgagggttactagtgtctgacactatcttgagcaagtcagagacaggagtagagttggattgcagctcctctatgaggagcttgattttgttggacatagccactcgattgaatgacaactttccaacatggccaccgtcaccagacatggcatcggtagcagcagcatcgtgtctcggggtcggggacagcagccagagaagcatgagagccagttaccagcagtgtggcgagcagcatggcgggcatggtgagcttgggctgcgaggccaccgcccaactccggtgcggcgtctcgagtcccgtcgtgtttgtcctggatcatgaagtagtgaagctcgtccacagcatcctcagcctcgtcggccttcttgccgagagtctcgagctgctccagcaggttggggttcccggcgacgacgtcgtccctccccttggccacgtccagcagcgctctagcgtaccgcatcttctctttgatcatgttaaggttggtgccgagctcggcgctggacacgtaggatttcatccagtcgtcggggagattattgagaacatggccaaggagagacttggccgttcccagagccacctccatcttctgctccggccgagatggaagtcgaaagaacagtgtgcgtgtgctgctggctggatgtcccggcccggcgcgccgcgccgacgtatgcttatatggcgttctggtaattgataattgattggtcctgatgcgattcgtgcttatctataattctatccggatccggctcgtcatctaatcccctcgctaggcatctggcccctgggcgttcggcttcctcgtggtcctcatctaatggtgctgtcacattcaaagaagaaagtgctgggaaaaccacgtacgagaatttccgatacagatcagacagcaggcctaacatctatagccaaggatgtctgaataccgcccgacatgtctcccccgcactcccgtgcggcgttccgccgccgctcgctcgccttgggccgccgacctccctcagccgccacccgccagccatcccgccccgcagtaccgcccaccgctccagctccagctccagctccggctccagctccagctccagctccagccccatcccccggcgccacccccgctgcagtcaccccgtcttcacaatcgccccaagatctggtttggaatctggggaggggaacacccatagttccccctcagggctagtttggatacttgggattagaggtttgaagggattcccggccggcctcgaggtacccaatg

SEQ ID NO: 18973 - DNA, 3126 bp, Zea mays
acctccccgtcccaccacgcacaaaggcgacgcgagcagcgtttgcttccctttccctgctgtgctcggcctcgccgcttcctctgccctggctcaacgattcctccgcttttcctttttcaaaatcgccctttcctcgtgcgcgtgtcgactccttcctgctcgccgccgggtctgggctgggtgacgctgcctcggatgaggccgcgctgaccggagccgtagccggaccacccgcccacccatggcgcgcccgcagcgcgtgtatgaggcttggaaagggaacaataaattcttctttggtgggaggctcatattcggacctgacgccaagtcactgatcctgtctgtttcgctcattgtggccccggtattggtcttctgcggattcgttgctcggcatcttcgccaccacttcccggcttacaatgctggatatgcgattcctgcggtagctgtagtgtttatgatttatgtgctagtcctgctcttgattacatcagcgcaggatcctgggatcgttccccgcgcagcccacccgccggaggatgagttttcttatggcaacgctttgtctgggggcacgcctgggaggctacaattcccccgtgtaaaggaagtactggttaatgggatgcctgtgaaagtgaagtattgtgacacctgcatgatttatcggcctcctcgatgctcacactgttcgatatgcaacaattgtgtagagcgctttgaccatcattgcccctgggttggacaatgcattgggcagcgcaattaccggtactttttcatgtttgtttcttcctcgactcttctctgcatttatgtatttgcaatgtcagccttgtacatcaagtttatcatggatgaggattatccaacagtatggaaggctttcaaacactctcccgcttctttggggcttctgatatattgtttcattgctctctggtttgttggtggactcactggatttcatatgtacctcattagcaccaaccagaccacgtacgagaatttccgatacagatcagacagcaggcctaacatctatagccaaggatgtctgaataactttctacaagtcttctgcagcaagacaaagccttctaaacacaagttccgggcctacgcgcaagaggaagtgcggcctccaacggttagcttcggcagggaggtcgatgaggaaccggtcggcgggcctcggccgaaagttgaggacgatcttgaaattggtaccgatcttctgaagatctctcagcggcgcaactacgaggacgtcgatgcagaaacgggaggccgtcgcagtcgcagcagcgaggtggaaggcacggccagtgccagacctgctgtggcgtgctcggagtcccagatccctgcggtcgggggtactgacgtgagggtgcggcactcgagctgggaccggcgaagcgggaactgggacatgtcgtcggctgtgcttacgaggagcgcgtcagatgtgattggacgtagcagcgtgtttgccgcggacgctgcacgtccatctctagaagagactcgctagcgaactgtgtctgtgcatccaggaaacatgtgcgagcggttcggatagcgaggccatttgactcgtggtggtggtgacacacacccaggtgttttggctttggctgccttgattgggttttgttaccgacccttgtcagttgtcatgtatggacagttatttttagtcaaagaatctgcccccattgttggcgccatgttcgtgtgcctgtaaattgcaaatgcaggatcctcatccaacttcaattcttattgggctgtttctttagaacgcccaatgtgcaaaagcatctggcctagcccttttcaggaatggcaacgggtcggggggtcgggtaaagcaaaaaattgctcgcgatcgcacatgtgaagtctatctaaactcaccagtgatagcacccgtggcaattctaaagcatccaaacccgggacccaaagtttttactcggtgtacaattttaaatattattttagctatctctactatataaagcaccagtttctacggttccaaggaagacgtgtagtttgcgcaactgcacgtatgatctactggacgctaaacgatgtccatttctttactcaatttccgcatgcgtagccacattcatgatctgctcgagatagccttattttcgtacctcaaaataaggtgggtagccattttttgcagcttattctaactatgtttattcccacaatctctatttgtactaaaaggtcaaagcatactccggcttcgtttggtctgaagtgactaaactagtcacttttaattcctaaagaagtaaatagggctactaaaacctcgaactaaagttcagtcctctaattactaaaagggtgactaaaaagaactaatgttatgtttggtttgttgtcaaacttgacacactttttctaatttttttttgtctaagattagttctataattcggacgacgactaactttaaataaagtttagcacaattagccacgaaccaaaatagcagtaacatcaattaatacgcgtgagcaggcaccatggcgtttgttcagctggtgtgaacacaccgaaccagcacctgcatacatttatttaaggtagtatagtcattatgcacagtgattattaattaatgctgttttgctagatttaggcaacgagtcctctggttgtgcgggtttctctggaaagcgttttcctagagaagctggatcgcagttaggtctcgtaaaccgcgtgatcttgagtgaacgccagaacaatcatttgaagcagttcagagcatccgcccgtccgcgcaatgtggttgcaagcacgtacgaagaactgtttgtttgcttctagaattggctcttgtttctagcttagtggtgttctgctggtcttgtggattctgactactgcgaagggactggagcttgaagcctgctgcgctgatgttggcaaacctgtcgataatgcctccgactcggcgatcacgccagcaaaaggatccttggcccttgcaatgaatggttggttggttgttttcattggattcatgtgcagctggaaagcttgcgcttttaatcattctggcaagcaaagctgcag

SEQ ID NO: 18974 - DNA, 2732 bp, Zea mays
  misc_feature (2025)..(2025): n is a, c, g, or t
ggccactggaggtatggatggcaatggactctaaattttacaatataatatttaaggatcagatcaaattaagatcgggtcctatttgtatttatttttaaactaaaatttatttatagccctactagttttgtaaagaaatattttgatcgtggtctattaccatccctagctgggggtgggagctcgagtgcatgtatcgctgctactggaatctctaataacactctctcaaaagctccagtgcactaatgtgaggacttctgttcttcactattgtttttttttgtagacaaattcttgaagttttatataaaccacttggaagtactagctaatcaggacgaatatatcaatactattgatgtattaatactctcgtatatagagttggtcacagtttataaatcctgactgctacatccataagcatcattatccgtctatttatacgccacatgagggcttgttcggttagctctcaatccatgtggattgagtgggattggatgggtttgaatcccaaacaagtcaaacttcttctcaattttttccaatctcatccaatccatgtgttttgggaataaccgaacaagccctgactgggcagctccctagctcaactcacaccacatccacaccagccagcaggcaggcagccacagcccacagagcacaaattaataaacctgctggtagtagccaatcctcgaaaaagtgtacgtgcaggcagctctgcatgtgccgcacacgctagcttagctaaccagcagcagcgcatcggtcgtgtcgtctcgtctccgtgtttcttccaccatgatgagctcgctgaagctgacggaggtcgtctccaagaggtggggcggcggcggcagcagcagcaaggtgacttccccgagcgcggcggcgtgcccgcgaggccacttcgcggcctacacgcgggagggccgccgcttctttgtccccatcgcctacctcgccagcgacaccttccgggagctgctcagcatggccgaggaggagttcggcgagcccggcgcccgccccatcgtgctgccctgctccgccagccatctggagcagatcctcgacgccttccgcagcggcggcggcgccaagaagaagaagaaggagaaggagagcgccggcaggatcagcaagatctggtagcagcctagcaggtactacgaagaatgcagttgcattactgcactctgctgctagctagctgttgccgtcgctagcaggctgcctgccgcctgatcgatccatgagcttgggtgcatgcatgactgtgagattattattaatatatagtagcttcgatccattgctgactgttcactggcgctcaactagtgctgctgctgatcagcctagctagctaggcggtgttgtgatctattcgttaattaaatgatgtttttttttgctgttctcctggggtggcctacatgccaatgcatgtgtgtgttttcaggagaccagctgtggcgtggcagtcagtacaatggccgacctgccatgatgtaacatctctctgtacaatgtaccttttcgtttgttggattttctcctgccaaaaaaaaaaaaaaaagagtcatgccatgcatgagttaattgttcgatggtcgtgcattgtaacatcaatgtgtagtagttcaggtgcagagatgtatctagaattctaggtgaattcatattctgcttaaagagtgttgataattcttttgtcataggatgttttcaagggcctgtttggcagcactctgatttctctaaaaataacttcagctttggctcctccgcaagagtctgtgtcttttaaatatactatttggcaaaacgactcctcatgtatttttttatttaatgtaaaggcaaatattcatagtgccccttatagccatttgtatgaacacgtcatgtgtgtacataccaataatgcataaataatttatgaccatgacaaattataagaactgatgaccaaatagcttcgttgaggcaccgggccacggcggnaggcgctaatcgaggaggcaacaatgggcatggatcgacgacgtcgggcacagagcgacggaggctggcgcgaggccatggcagtggcgctgggcggggagacaacgtcgagcatgggtcgacgatgttggatgtgagacgcgggagagggatagaactaggagccagggagagagacgctcaaagccagcttttttttgctccaacttctccccaaaagtggctcccacttataagggttctttgttaggagcggttttttgcaccgtttgggagggctcctaaaggagccagagccagtttgagaaccctcccaaacaggctcttagtgagattttctcttatccactttatatctcggttaggcgtgccgcttaatttaatgaaaaaatggcatcgttgtatggatcagaggttaacttcgtagtacaaactttgaaaggcacttttcattcagagaacatattagaagtacataaacaaagttagatccattattattcatacggtcgtacccatgcttccataccatgccttgttcttgtacacgtcctgtactgtaatacctcactgtaccatgaatatagcatgctacattgatatattccatatatagtacaaacataccacggaatcgggaatgttgcctatgcatatacgtgtcactgtctcaattactccctcgatgctaaaatataatttgtttt

SEQ ID NO: 18975 - DNA, 1993 bp, Zea mays
tgggtacctcgaggccggccggggtcgtgtcatccactccgccgcacaggcgctcagctccgcaacgccgccggaaatggtcgccgccaccgccaccgccaccgccatggccaccgctgcatcgccgctactcaacgggacccgaatacctgcgcggctccgccatcgaggactcagcgtgcgctgcgctgctgtggcgggcggcgcggccgaggcaccggcttccaccggcgcgcggctgtccgcggactgcgtcgtggtgggcggaggcatcagtggcctctgcaccgcgcaggcgctggccacgcggcacggcgtcggggacgtgcttgtcacggaggcccgcgcccgccccggcggcaacattaccaccgtcgagcgccccgaggaagggtacctctgggaggagggtcccaacagcttccagccctccgaccccgttctcaccatggccgtggacagcggactgaaggatgacttggtttttggggacccaaacgcgccgcgtttcgtgctgtgggaggggaagctgaggcccgtgccatccaagcccgccgacctcccgttcttcgatctcatgagcatcccagggaagctcagggccggtctaggcgcgcttggcatccgcccgcctcctccaggccgcgaagagtcagtggaggagttcgtgcgccgcaacctcggtgctgaggtcttcgagcgcctcattgagcctttctgctcaggtgtctatgctggtgatccttctaagctcagcatgaaggctgcatttgggaaggtttggcggttggaagaaactggaggtagtattattggtggaaccatcaagacaattcaggagaggagcaagaatccaaaaccaccgagggatgcccgccttccgaagccaaaagggcagacagttgcatctttcaggaagggtcttgccatgcttccaaatgccattacatccagcttgggtagtaaagtcaaactatcatggaaactcacgagcattacaaaatcagatgacaagggatatgttttggagtatgaaacgccagaaggggttgtttcggtgcaggctaaaagtgttatcatgactattccatcatatgttgctagcaacattttgcgtccactttcaagcgatgctgcagatgctctatcaagattctattatccaccggttgctgctgtaactgtttcgtatccaaaggaagcaattagaaaagaatgcttaattgatggggagctccagggctttggccagttgcatccacgtagtcaaggagttgagacattaggaacaatatacagttcctcactctttccaaatcgtgctcctgacggtagggtgttacttctaaactacataggaggtgctacaaacacaggaattgtttccaagactgaaagtgagctggtcgaagcagttgaccgtgacctccgaaaaatgcttataaattctacagcagtggaccctttagtccttggtgttcgagtttggccacaagccatacctcagttcctggtaggacatcttgatcttctggaagccgcaaaagctgccctggaccgaggtggctacgatgggctgttcctaggagggaactatgttgcaggagttgccctgggcagatgcgttgagggcgcgtatgaaagtgcctcgcaaatatctgacttcttgaccaagtatgcctacaagtgatgaaagaagtggagcgctacttgttaatcgtttatgttgcatagatgaggtgcctccggggaaaaaaagcttgaatagtattttttattcttattttgtaaattgcatttctgttcttttttctatcagtaattagttatattttagttctgtaggagattgttctgttcactgcccttcaaaagaaattttatttttcattcttttatgagagctgtgctacttagattgccttggatgattattttgcttctgcgtttttctggaagtacaaacaaattcaaataaaaaaaaaaaaaaaaa

SEQ ID NO: 18976 - DNA, 1397 bp, Zea mays
ctggtgtgctaggctggagtacctctccatacccattctggtaactcggcccgatgctcaccggactatagtctggtgctcccagtactgctgatctttgacaaattttggtatatcttcgtcaagttgatttggttgtacatgagggggtcatatgacttagacaaacatatctagtgactagtcaactagtctaagtcatggattttagttgttttgaattctttatctcatattctgtttttggctcaacttggcttcaaaagtgtgaaacttcaaaactgagctttccaacctctctagatatatcaaataggctcctaggtgttttataatacctcaaaatcttattttgggtacttactaagataatacagagatcttgaaacaaaatatcttttaacaagaatcttcctacctttgaagttgcatcccctaaagtgaatatgttttctaataaatattaaaccaaaaagattctaagttatcgtgtgtggaattttataattagaaatattccctaaaatatctaaactaaataaatatgttcctttatgtaaacaataaaatttagtgtgaatcatttccttatccttcatagttatgaacattttttaaggtaataaataattaaatctctcccctctgggcggtcgggcgccgccgcgcccccccggccccgcctcccctccgctcgcgcccgccctcgttcccctcacccagcctttcgcacaaacaacccatccgctccatctgcgagcaagctctagcgatctagcagcatgcaggccctatgacgctcgccatcctcatccgggagcgtggccatgcctccgcccgcctcttcccccaccccaggtgccccttccacacaccccccgcaccgctgtcctgcccctctcccctcgcacacccactcccttctaccatctccatgcttggcgccctcaccacctccccgaccgcctctgagctcatcgccttcccccatagcccgaacgagatatttgcgtccgacccgcccatcgacgtggacgccatcatggagaacgagctacggaagaaggacggcggtgcggatgtggaacatctcagatctgtcactctatctccggcgacctgggtcgggcgaggcacttcttttatgtgatgcctgagtggaacttggtatcctggaacaaaatgttgggcgcgtatgcctgtggcaggatgctcaccgaggcgcgggacctgttcgacgcaatgcttgccaggaacagcgccaccttccgataattattagctcgcctcccctcccattttctcagtacaatctactccatgttgttgctgtatgattcagacaaaattcttctatcaagtccccccaatgacaacaaaaggaaaaaagaaccctg

SEQ ID NO: 18977 - DNA, 866 bp, Zea mays
ggccgcttttcttgtttctgctttactgtaccatatatatttgtggaacataacaatatacatgataggaaacggaatagcatgtatacttggttgggaaagcataaggttctctaaacgttcctttgaccagttttggacttcagaaactacacatcccaagaatatggagcacgctcaaccactaaatagtctcctcttatgtccttagcaacccgtatgtcatcatccaaatagacagtgtcaaaccatccttttccaaacggcggaaaaggaacctcccagttgttccctctcagagcagcgcgtgtgaacctgaaattgactcgctggggcggctgcacctcgatgtcgccattgacgacgaacgcgcctgagggaggaaacgtgatgacgttgttaagggcgccgccggcgacatcgatgacctggagcacgtcgccggcggcagtgcggaagaatggggcgttgcgcacaatgaagagctgctcctgctcggtggtccagaggaggcgccaggttccggagagcttggcggcgtcggatacggtgtctgcgccgggggatacggcggcgagcgcgtcgatgcaggagacgatgtcagcgaggcgggaaggggcggactgcgtctcgaggccgcggccctggtcggcgatgaggcggaggaggtcagccttcgccgccggtggcctggtgggaaaaaatctgcggaggaaggccgcggcggatgggggtctgggcgcgaagcggtggcgagcgtggaggatcggtggtgccaaggttttgttcgggacgaagaggagtggcgccatcggtggtgtgccaaggaagattcccggaggccccggccggccgcctcgagcgcc

SEQ ID NO: 18978 - DNA, 750 bp, Zea mays
atgggaccgggactgcccttttgacgcggagcggaacccacaccacaccacggcggctgcacgcgcgcgccaccaccaggcaccagccaccagatcccggcgtcataaaattccccgcgcggccgtgcctcccaccagccacctctgctcactcagcttccttccttccttcctacacaccaccaaccgaaggccgcgcgcgccatccagccatgggcaactgcctgaacacggccgccaagcggggtcaccgcggcatgcttctgccggaagaggaggagagcctatcggagatgagaaggataagccagctgctgcgggaggaggaggaggaggagatggtggccgtagctccggcggagggcctcaaggtgaaggtcgtgctgacgcgcggcgagctcgagtggctcgtggcgcagctcaagggcggcgagcggcgcctcgaggacgcgatccaccacatgcaggccgccgaccacgccaagggagtcggcgacggcggctggcggccgcgcctcgagagcatcctcgagtgcccggagacccagagctgagctgctgaggccggccacgctcgttctctccttaaatactagtataattcagatcttgtccgcgcgtggtgcatgtagtaggttcttgctctctcgtcgctcgctcgctcttcgaatggatatggatccatggatcggatcatcggagtcatggagggagaggcttttgctccgctgtataaaaaaaaaaaaaaaa

SEQ ID NO: 18979 - DNA, 1560 bp, Zea mays
  misc_feature (1552)..(1553): n is a, c, g, or t
  misc_feature (1555)..(1555): n is a, c, g, or t
  misc_feature (1557)..(1559): n is a, c, g, or t
ctcatcctgccgcactgccccgttgtgtctgggactctgcgagtgcgcatccttcgtccttccccttcccagccgccctcttccccccctctcccggtcgcctctaacgtcgctggtgactcacgaagacctccatcgacggcggtgaaactggggccgacttctggagggtttgacttgttggatacagcgccggctcttccaatcgccgggtgctctctgccactctgtcttgcggagcccccaccgcggaaaccggttggtgcgcgtggccatggcggtggcgaaggtcaaatcggtcgccctctccgtcagtcacaagtgccggaacatcttggccgccggttgggaagcccacctcaacactgtcaaggctgacaacaagggaagcaagaatgagatttacacgtcgagggtgcactacatgatccataagggcacgccctacttgattgtccccgagaacgacatgcacaacattaacattataatcgatgagcgggggtctcttgcagtattcagtccgatccgtggccgagttgcgagcttattgaagccatcgaagacacctcctcgtgttgctatgactggtgatgttctgcggctgaaagactcaaaggttccaattattgccgatagcctgaagcaaactattctgaaggaacatgaagctgctagtaaagctagttatggagtgtcagcaatactgtcttcggcaggtgctacctgcaggtcccggagtgagggcctccttagtctgctcagtgaggagagctcttacaacatcttaaaatttgacataggttcctgtgtctacatagacttcaatgggagcagccataatattgaattggacagctttgaagcaccaaaagcagatctgctaatgccattctctgcgaagcttgtggatggtatcaaccaaaatgactctaggaggagggcactggtgatgttctgttttgcgtattttaatgtgatagcaagaagcgctgtcatgctctccattgaccaccatggttttgatgtcctcgccaaagtgcctcaaggagacatccttactaatccacaataccactggaaggagttcaggttcacattcaaggaacctgccaaagatgctgaggacttctgccgcatgctggttgggttagaggaagagggtttgcagaccgtgaagagctgcagcggttacggttgacaacccacttgcaaggttcacattcaaggaaccagccaaggatgctgagggactctgccgcatgctggttcgattagagggattttgcagcgcgtgaagagctatagcggtctaggtgacagctcacttgccacaaaaccagtgagaaactatatatccgttattttggaactttgaaatatggttttagattgctatgttttattcgaagatctatggcttctcgaatttagtagagtagatgatgtttgaacatggagccgcaaactatcaatatctgtttgaatggtatttatataaataataaaactggtaacggtgaaaacctaaatttataaaaaaaaaaaaaannanannna

SEQ ID NO: 18980 - DNA, 1143 bp, Zea mays
  misc_feature (794)..(794): n is a, c, g, or t
cttgggtcttaatagttgtagagatatatatagcttgcgtaccccgcggcccgccggcagcccattcacagaaggcgtcttcccagcagcgccttcatcagccaccgccgtcgcgtcttcttcagctacaccttccgcaccgcggctgaaaatgcgccgctgccccagatcgtcgtcgtgggctccgccgacatctacgtcgaggtccaccgatccccgctcatcggcgagacggccgcgcgggcggcaagggcgccaacctggccgcctgcggtgcgccctacctacctcgtggcgcgcgtcggggatgacgccaatggccgactactcgaggacgccctagccgacgccggcggcgttgcaccgaccgcgtcgcgcgcgcggccgatgcgccatcgggacacgccatagtcatgctcatgccccacgaccacaactccgtcatcatcgtgggcggggcgaacatggagagctgggcggcggggattggctcggaggacctggattgatccgaaaggaaggcgtgctgatgcagagggagatacccgattgagtcaatccgcaggctgcccaggcgcttgcttttttatcaatctcagcttggtttgggcacacatttttctttttttttatgttactgtttgattattttgatctcaattagactgaatagggcaatgtagctttgagcgccatgccacagtttttaggtgtttcctgccacaactatgatgcaccacacttccctagcatcatgtcttacacgtagaagactcattttcatgctaaacttncgattttgctgaccatacattctgtggcaaccgcagcttgccaaaggttaggcatgtcaaactacggcaacaaccaaacatgagagatatatgtttgagaatgaagcaacaatttactgaatgttttgaatatttgatgtttgagtatttactttttgaaattttgggagatatgttggctggctaggttcttctagcacactggtgctgtttagtcagttgaagcaataaatttggtaataacatctaaattcgtagggcaacaacagcaagagaaagtttctcttttatatcttagaaccgtatttagtacaggacttagtatgaactatactttcgattatttgca

SEQ ID NO: 18981 - DNA, 1958 bp, Zea mays
  misc_feature (295)..(295): n is a, c, g, or t
  misc_feature (308)..(308): n is a, c, g, or t
  misc_feature (1923)..(1923): n is a, c, g, or t
ctgctctgatcctctcttcttcttcctccccaagttggttgctctgttccagtttcattcttccttcccaagctggttgctctgttcacagtgctataagtagatgggcacctgcatcgcacacgtccactccaactccaactctcctcaagcccgcagtacgtggccaagcagacagcaaagccaaaccttccgcgcaacgccaagagcaaccaccacttagcgatggagagcagcagcgccagcaacgaggaggtgacggctgtcccggcctcgtggaacttcgagccgaacnagaccctgctggncctgatggcgctctcggtgcgcggcgtgctggccaggatcaaggccgagatggttgccggcggcggcggcgggaggccggtgatcccgatgggccacggcgacccgtcggcgttcccgtgcttccggacggcgccggaagccgtggacgccgtcgccggcgctctccagtccggcgagtacaactcctactccacttgcgtcggccttgagcccgcacggaggtgacttgttatttctagactgcatgatgctgaactaacatgatgcgtaaactggtgtcggcatttttttttgaaagggagaggcaaaagacttgccactccaatatattagaaggagtaggactaacaggaaattacaagaaaccaagacgacttacaagactagaagcgaactcctgaacaaatttactaagcggacctactaagcgtacctactagccagccagggccatggaaacaaccaactaactctttgaccactagcgcgacctgctccgttgatttaagctgactgtgaaagattctattgttcctctctaaccaaatgctccaccaaaaataaatgataaggccatcaaaggatcttctcgaaggcttgttgcacctacttctcaaatttctccaccagtcgtacaatgaatcagagccatagatccccttaaaggacgaaagattcgcccaagccaagattctgtcccacacctccctgctgaaggggcagtccttgcagagatgaaccgtcgtttcaaaggtcgaattacagagacaacaagaaggattgtgaggtcatccccttttctgaaggttctctgctgtcaacactctgttgtgtaaaagagtccaagcgaagaagcgacacttgggttcagtttttgctttccaaatggaacagattttcattgtgcagaagtttgttgagaactgaatgttatatgcgctgcttgcactgtactggccatcagtcgtccatctccaagagatggaatcctccaagttattaagttcgtgcatgctactgatagcctgccatagggttacaaaatcttttatttcgtcttctcgtatgcatggcagacatagctgaatccagctattggctctaagagcatgaaaaactgagatgttcttcttccttgctttcttgaacagaattggcgctatattcttaggcgcctgaccatggatccaactagatttccaaaaacttgctgttctcccattaccaacgttgaccaccgtggatgcattgaaaagttcttcatctattttgtcgcatggcgattgcaaaccaatccacgccttatccctgttcttccaacgcatccacagccatctgattcttaaagcccttgcgaagcgttctaggttcagaatgcccagtccccccttgttctttggctgacatgttgtagaccagttgatcaaacagtgacccccactgcaagcttcagggttgtttcctttccaaagaaagcctcttcttagcttatcaattttctttagcagccatttttgaactggaaaaaccgtaagatgataaatcggttgggctgttaatactgatttaaccaatgtttctctgcctgctttagagagtagtctgcctttccanccgaacagtctgttgtggccggcctcgaggtaccc

SEQ ID NO: 18982 - DNA, 4393 bp, Zea mays
  misc_feature (11)..(11): n is a, c, g, or t
ggtaccctccnggttcggccggggcaagcgttagtgcgactgtccccactgcaagttcggctggaaacccccctactcgcgccgctcgctcggtcatccatggcgacctcctccactccgccacctgctgcttcccacgcctccctctccccccgtctctaggttcgttcgttccacgtcgccggccacccctgtccacagccgcgacaaactcttcctcagacccacgccacgtacgatgcctctctccccttccctttcccctccgcccaacgccaccgccgccgccgccgccctgcccctcctcctgctgctcgtctgcgccagcagcattgccgcgcagccgctggcgtcgtcgcaggccaaggcgctcctccgggtgcgccgcctgctgttctacccgccggcgctcgagccgctgcgcggggcgccggacccctgcgcgctgccgcccgcgccggccctcgccgtcgcctgcgagggcggccaggtcacggcgctctccgtcctgggcgaccgcgacccggacgcggcctggcgcgccgcgctgccggccagcttctcctccgaggcgctgttcaccacgctcaccaggctcccggcgctcgcgcgcctctcgctcgtcggcctcggcgcctggggcccgctcccgggcgccaagctccgccggctccaggcgctgcagcagctcaacctcagctccaactacttctacggcgccgtccccgatggcctcgcccggctctactcgctgcagagcctcgtgctgtcctggaactggctcaacggcaccgtgccgtccctgtccgggctccagttcctggaggagctcgacctgtcgcacaaccggctcggcccggcgttcccggacgtggggaggtcggtcgcgcggctggtcctggacgacaacaacttcaccgggggtatcccggcgggggtgagctcgctgggcctgctccagtacttcgacgtgtccgggaaccagctgcagggttggatcccctcctccgtcttcgcgctcccggcgctgcggtacatcaacctctcccgcaaccggctggcgggccagcttcccgccaccacggcttgcgcggaggcgctggcgttcgtggacgtctcggcgaacctgctcactggggcgcgccccgtgcaggccggcccacgcctccgcgcgcacggtcctcgtcgcgggtaactgcttcgccgacgccaagcagcagcgggccagctcgtactgcaaccccggcgcgctggccgccgtgctgccgccgccgcagggcaacggaggaggagggcaggggacggggaagggccgcgagatcgggatggttcttgcgattgccggcagcgtcgttggtgccgcattgctgattgcgctggccatggtggtggtcctgaggagggcgaggaggcagcgtccggaggcgaccatcctgccgaagtcgcccgcggcgacaccgaccaacaaggcggatggatggaaggctccggctaaggcaacccagaagattattactactgctgataagagacatgcatcacaagctgcaagggtgaatacactggaagtaccagcctaccgagtgtgtacactggaggagctccaagaagcaaccgacaatttcagttcctccaacctaatcaagactagtcctcttgcacaggattataatggtcagcttcaagatggttcacgagtactggttagatgtttgaggctgaagccgaagtactcctcccagagccttgtccaatacatggagattatttctaaacttcggcaccgtcatttggtcagcatcattggtcattgcattgtcagtgatgaggagaatcctaatatcgcgagctcggtctacctcgtttctgaatgcgtgacaaatggatctttaagaagtcaccttactgagtggaggaagcgtgaaatgctcaaatggccccaacgggtttgcgctgccattggcattgcgagaggggttcagtttctgcataatctgactgctcctgggatcgtacagaacaatctcaacatagaacatatcctgctggacaagaccctcacgtctaagatcagcaacttcagtcttccaatgatatcaactagcaagaacggcaagattctctcagagaccccatttgctgtccatgaagacaatgatattggcagtgctcagaacgcggcacaaggtgacaaggaagacatctaccagattggcctaattctcctggaggtgatcacaggcaaaccaacagagtcccaaagccaactggagtccctgaaagctcagctaagtgaggcgctgactgaagacccagacaggctgaaagacatggcagacccggcgatacacggtacttttgcagtggactcactgagcacagtcgccgagatagccctcaagtgcacggctggcgacccaagcgaccgaccttccatcgacgacgtgctctggaacctgcagtactccatgcaggtgcaggatgggtgggcgagcagcgagagcttaggcttgagcgtcaaatctcaggcttagataaaggcgcagtgattcggttcctatgcaaatgatgattatgaagctctatgcgccatcactctgcctctagttttctggggttttttttttgggaggaagagaggtcgttggtatagtctctactgtatatatgtggaccttacctttttcagaactgttgtttatggtacctgtaaaactcaggttctattaagcgtttgtccactcaacagatatgtgctgccatttatggagcagcacacaagcagtagttaaattgggacttacagcctaaattctttgaaacaaaccccttactttttgagctaaggttagcaaaaaccctttactccctcagttcacatgatttagatcgtttcagacttgtcctaagtcaattaatattagcattgatcagatattttataagattttacaaaataaaagaaaacttactagattcatcgtgagttgaactactataatatatattttttagtttaaaataattttatcttataaatattgttcgtcaaaatttcaatagtttgatttaggacaagtctaaaacgactaagtcacgtgaacggaaagagtacttgtatagtttgatcatcatgcatgatgcatctcaggtaaggaatatcattgcagcctaattttattaaaaaaaaacaatcggagacaaaagcattctaaggttcaagctacggttcggcaactggaaaaccaagagtaacctggaacaaatgaactacgagacaaggaggttcggctacaaattattagcatatatcctaggcatgtccggagtccaagccggcacatgaactaaaaaatcttatttgccatgcgagcgcatcaatcgctcaggcgtttacggttggtgcggcggcggcggcaccgggttcggctgagcttccggctttaacgacggcggcggccggcggcggcagcaggaggaggatcggctgccgagtctccggctttggcgacagcagcggcggcggcaggatcgacggagcctccggccttggttcgctgtagaacagccatggcttcgcggactttggcccggagagcctccggagaccgcagcagctgtaggatctcggccttgtccatctccagcagcatcccggtaactttgccagaaagatcgaaactcgagctgttagaccagcgcgtacaacttgttgccgagaatctgcacacgacgaaaagagcaaagggaggcccatgttaccatagatttcatcaatggtgtacttctatttagtggcactacaaaaaaaatcctattctgctgtaaattagctcatggtccacaaggctaactcgatgctacggcagtagttgtcctgatgtttacgtacctgatgttggtctgccggtccagcggatgctacggcagtagttgtcctgcttacagcgtgttgctgccacgccgtggcacccgcacctgggaaggcctgaggcggcattgtagggtaaggcccaggtctggcattcggcatgtggttggcatttgcgtggatcatctgaggaaggacatgaaagcgctattagcagaagaacgtcatggaatgccgccagccagacgtgattggtaatacaataaaaagactgatgaataaatactatcatgatttttctttttcttaagaaaaatcatgtcttcttgagaaaaaagaagttattagcagaagaacgtcatggacataccgcctgctgctgccgatatggagcaggaccaggataccttggtcgctgcatgttgtgtggcggcatcataacgggagagataggccccattcccggaacgaagtgttgcggaaacccaaatactgcgccctgaggaggcgcgatcgggccag

SEQ ID NO: 18983 - DNA, 1600 bp, Zea mays
agacttatttcgagagaggagtacgttttaagccggtgctccatgtgtcccgtcccgtgtcccgtcccgtctacgttttaagctgcgagcgagatctgctttcacagcgtggctgaccagcagatccgtcgttgccggaacccacgctcgccggctgcgaatgcatctgtagcctgctcttcgtccacacggacaattggacgagctagactctgcgtcgccggcgatggggtgctccttctcagggctgaacgcactgtacgacaccgtcggcggtcggggtggtgacgtctgggttaacgactaccacttccgcgtgctccgcaggctcggcgatgccggccctgcgggctcgtcggtcttcctcgtcaaggaggtcgtcgccgccgcaaccgcctccgacggcacggctgggtcagagcccggcgcctcagggatcgccgggaagaaaggcatcgacccatcacacatctcagctgacgggacatatgctctcaagaaagttcttgttcagagtgatcagcacttagagcttgttcagcaagagatccgagtgtcctctcaattcagccatccaaatttacttcctcttcttgaacatgccatcgttgctgtcaagggtgttcaggatggatcccagaactatgaggcctacttattattcccagttcatttagaaggaacattacatgatataactaaaaccatgcttgaaaagaaggaattcttcccaacaattactgttctccagatatttcgccagctttgttctggattaaagcacatgcacagttttgatccaccatatgcgcacaatggggttaaaccagataatgtcctcataacacagaggaagcagtctcatctagcaattttgatggattttgagagtgctggtccagcaagaaagactattagatcacaagctgaagctttgcagttacaggaatgggcttcagagcactgttcttctcattaccgtgcccccgaactatgggagtgtccaagtcatgctgacattgatgagaggacagatatatggtctttgggatgcactttgtatgctatgatgtatggaaagtctccatttgattatgagcttgatgagtcttctggtgaaagcttgcacagtgttattaaaaatgtacagattaaatggcctgaagaagcgggatctacataccctgattccctccgccagtttataacttggatgctgcagccacatcccgcagttcgtcctcatattgatgatatcataattcatgttgataaacttgtcatgaagtactctaattaaccgctacaccaagccgcttctccaccagaaaaaagaatcattattatgtaagtctacacgattcattagcaaaatgtgatatgtatgttccttgatagctattactgtattaaacgagaaaaggacattctgctgtagtcttcaaccattcgtggactcgccattgttcatgagtatgttatctatagatgttttttttgtatgcccgacagtgttaccgggttaataaatgatacagtacctcttttatagttataatggtgccctcaaagaaaaaaaaaaaataactctctctcctcg

SEQ ID NO: 18984 - DNA, 1905 bp, Zea mays
  misc_feature (14)..(14): n is a, c, g, or t
ggtaccactccggncctgaggcgcccaggcccaggaagagagagaaggttctccaagtcaatcgcaatcacgaagagtcatcacgccatacgacacggaggacaccgagccggaggcgaagccggtgcgcagcgcgagagtagcggcgagtcggcgaccatcaagcaactgcatggccgcgttacccgccagcgcccccgcccccgcccccgccccctccgaggcggcggagctcgtgccgacgctctcctcgctggagccggtctacggcgcgggcgcgcagctcgacgaggcgcgcctccgcttcgcccgcctcggggaccgcttccacgccgtctacggcgcccgccccgcgctcttcgcccgctccccagggagggtcaatctgatcggggagcacatcgactacgagggctactcggtgttgccgatggccatccgccaggacatgatcgtcgccatccgaagggccaacggcgcccaggtgagggtcgccaacgtcgacgacaagtaccccctctgcgtctaccccgccgacccagacaaggaaattgacgtaaaaaatcacaaatgggggcactatttcatgtgtggatacaagggagtttatgaatactgtagatcaaaagggatagatctgggcaaacctgttgcgcttgacgtcgttgttgatggcacagttcctcaaggctctggactgtcaagctcagcagcgtttgtctgttcagcaacaattgctatcatgggaatccttgacaaaaactttccaaagaaagaagttgctcaattcacttgtctgtctgagcgccacattggaacgcaatctggcggcatggatcaggctatatctatcatggcgaaacctggattcgctgagttgatagattttaatccaatccatgcaactgacgtccaactaccttcaggtggtacatttgtgatcgcccattgtttggccgagtccaagaaagcagagacagctgcaacaaattataataaccgcgttgtggagtgtcgcttagcagcgattgttcttgccatcaaacttgggatggataggaaaaaagctatctcctccgttacaaccctctccgatgttgaggggctatgtgtttcttttgctgggagagaaggttcatctgatcctgcagtagctgtgaagaaacttctgcatgaggacccatatacagctggagaaatagagaaaattacaggagaaggcctgacatctgtcttccagggctctcagacgtcattggatgttataaaagcggcaaagcactacaagctatttcagcgtgcgacccatgtctactctgaagcaaggagggtttatgctttcagggatactgtctcttcaaaactcagtgaggaaggcaagcttaagaaacttggtgatcttatgaacgagagccattacagctgcagcgtgctatacgaatgcagttgccctgagctggaggagcttgtgaaggtctgcagagacaacggagcactgggagcacgtctgacaggagctgggtggggtggctgcgcggttgctctggtcaaggagcccatcgtccctcagttcattctgaaactaaaggaaatgtactacaaatcaaggattgacaggggagtaatcaagcagggcgatgtgggcctgtacgtgttcgcatccaagccgtcgagcggcgcggccatactgaggttgtaggcaggcaggaaggcagaggcagccgctattcttttcacgagtgtggtggccctgtaaaacatggaataaagttgccatgaacaccgaacccttgtagtagcgttgaattatctcagacgacacacgcattaaattgatatctatctataggagtaacacacgagcgaaccatgctgttttaaaaccacagcaacgcagcgcccgct

SEQ ID NO: 18985 - DNA, 1662 bp, Zea mays
  misc_feature (1151)..(1151): n is a, c, g, or t
  misc_feature (1364)..(1365): n is a, c, g, or t
ttgatgaatttctcctgttacctcccaaaccctagatggatgtacattgccttgtatgtggatgattttctcctgttcccttatgctcaagcgacattgttacccttttatttgttccttctgttgtacaaattattcaccttccaagatatttatatacccaaccaaaggagagtagaacaaaaacgactcacctttttaacaacaggtacactaatgaagaatagggctttagtctaaataaattagtatcgaccaattttaattgtgatgtcctcatagaattcattagtaccggttgctatattcaacttgtacaactagaaagtaattagtattaaagacccctcttcaatattgggccatccaacaggtatcaaagattaattattggatatcttacatccagcagctagaagcattaaaaaattatagatttagaaatcaagataatattaaataactgaaattaaataaatgatcttatagctacaagaaaatggtccactgtgtaattgtatatattggaggacacattaaactaaaattgtattgattgagtgtgagggttacaaatatataggcatatgcctagggtactaccccaaccctaataggaaacataggctaggttctaggcccatacagtgatagccacacacaaacacacacatagtgataggaggctaaaaccctacccttagtcaaaactctagccatgacagatgttgagactggaccgaaactccaagaacatagagaatggaagttccttgatgaagatatcgacatactgtgatgtcatcaagacatggaggacatggatgtctatgttggctacacgctcgcagacgaagtggagatcaatctaaaaatgtttcatgcgctggtgttgtactgggttgacagagaggtagacgacactaatgttatcatagtaaacgagtgtgctcttggttagagagttatggagctcctagaggaacttccatagccaacacaccttagccatgacattggccatgatgtggtactcggcttcgttgcttgaggcaggagccatgggctgacacttggaggaccatgagatgaggttgtcctcaaggaataaacacacctcgccctaggggcgtgtccctggacactacgcncaatgagcatatcaaaactattgaagttgttaatgagaagatccaagattaaactattaaagttgagcatatcaaaattcatcatatgctaatgggtccactcacaaaagaccttccacctaatgtggttagacaacacgtagacaatataggattaaagtaaagcatatgattctggacgaaaggggctatagaatgatcatagagaaaatnnttctatcttgaggcagagatgcatattatagtcaatgagttcagtggcacataactggtatcctaatgcatttgtcttgatgtgtcaatttgtcgaagagtggaatatagaaattaagaataagaaagtagagaacaaagggaaaaaatgttaggtatgttttatggcttgatcaaggaaaccaagtctcgacccgattctaagtgaacttctctctaatcggggcctacctttcttggttgaggcaatcggtcgtagcctcataggcgctatattagctatggctagaacccgcaa

SEQ ID NO: 18986 - DNA, 2396 bp, Zea mays
  misc_feature (25)..(25): n is a, c, g, or t
  misc_feature (27)..(27): n is a, c, g, or t
  misc_feature (32)..(32): n is a, c, g, or t
ggtacccttgtggtccggccggggntnagggnacgttatccccagctgcccagcaccacgatcgggtccccttgccctccgtccagctcgccgtctctcgcagagggaagcagggcgcagcagtcaccagtgaccagtcatggctcgctgcgttgccggcagctgccctcccgtcaccttcgcgtgttgcccccgccggactggacgaagtgctgttgttcagtgtggcactgcatcgagcacaccagcaatatctggaaccggaccttcatcatctggatcctcggggcttgttcaagattgtactgcccctctggtctgtgcactgcaattaactgccagacaagatgtttcctgctttcacttcccaggacacaacagaggaaaagctgctccatcttccttgtcgaaactcattggctcaggggcatttctgcatgacttgcccgagctacccgagctggatgatctcttctccccaaaaggtgtgattctagatgcccagaggcgagcagctcaactgtttgggtcatctaaaacttggttccttgtcaacggaacgacctgtggaatccaggcctcagtgatggctacctgttctcccggcgactacctcattgtgccacggaactgccacatttcagtgatctctgcgctggtcttgtctggtgtggtgcctaaatacataataccagaatataattctgggtgggacattgctggtggtatcaccccgctgcagctggatgaagcagtaaaagagctggaggaggatggaaagagggtaggcgctgttcttgttacttcacccacctaccatggtgtatgcagcaatgtgcaaggtattgtcagtgtttgtcatccacgaggcattccggttatagttgatgaagcgcatggtgcacatttcaggttccatgacagtttgccaagcactgcaattgagcaaggtgctgacctagctgtgcaatccacacacaaggtcctgtgctcccgggcgcagtcttcaatgcttcacatgtctggagatcttgtcgatgtagataaagtaagccagtgccttcagctcctccagagctcgagcccgagttaccttctactgtcatctttagatgccgcgagagatcagctgagccagaacacaaatatatttgatgagccattagctatagcatcggaaacaaaagacctgctggcgagaatccctgggatatctgttctagacttaccatgctttgcttctgatttccctgccattgatccgttgcgcatcacactcagtgcctcagatctgcaattatcgggatacgaagccgatgacattttatatgaaggccatcaaatcgtatctgagcttgttggcacaagggccgtgacatttgcagtcaacttaggaaccagagtgcaggacgctgagaagcttgtgcagtctgcaaagcatctatcagaaaaacatttctttgcaaatagcctgaaacccgtgaaggagaatcgtgtgcatggcccattagagaatatctctgtgcatctgagtccaagagaggccttctttacagagaagaggagagtgaaaatcgaggacagccttggtgaaatctgtggtgagctaatatgcccgtatccacctggtatcccagttctgattccaggcgaggtagtaacccatgattcactgtcctacttgatgagcgttagacaccaaggcatcacgatcagtggagcggctgatgctgagctaaattccattctggtgtgcgacttatgatgattgccctattgtttgtcacaagactgtgttgtcgcagagataccgtgggtgggagagatcaagtatggtttatgccaagtcaagagcacaatgtattgtccgcttgatggatgtaaaccaacggctggcggtttgtagccaccggccacttggccaaataatttagtctgtgttgtgttgtgtctcggtctcgtgagccgaaagagttgccaagctgcgacatatgatgccaaagcatgaataagggtctatagcatgtgatctcctgtgttgttgtttgaagtatgagttgctagggagggagggctacctttctatctgaagtgccgtgcaatgtaatggtttcctctttgcttctcttctgaactgggaggtccggtctgaactggcagtaaagctgaagcatcatatgcaggtctgcacacctccacggttgtgctacctccggctgcatgttttgcagggcttctgaaacaagtactatctaccttctcttctaagtttatccatcaactcatgaattcacgaacattccacaactcgtacacacacacacaaaaaaggaaacataggaatggaccgcatcattgtaatcacaattttttttcttcaaaaaaaaaaaaaaaaa

SEQ ID NO: 18987 - DNA, 2369 bp, Zea mays
tgagttttgtgttctacccaggtacaaacatgtgtttttcgttcatgtagcagctgcaaaaatcatgcataccatggtatatagtccctcaattccaaattaaaaaatcatgcgtaccattatatatatctaacttttgctatgcaattagatatacttatgtttgtgctttccatctctaagatgcatttcaaaggctcattcctgcatcatcatcaaattgatactacattacacctgtctctgcttcatctacaaccacttgacctatagcaacaaggatgatgatgaggtttgtagaaatggcgacgtcgccgagatatgatcctcaagaacatcaacctacaacacgcgtgatatggtgtcggccggtagctatgacgttcccgaaaacatttttcagttcgattaagcttttaaattaaagcgcctctgaaccaccacgatcttcaatcttgctatgctcaaacaatttgcaatattgcattccaacatcagaatgatatggctcagttatctgaaccatcgaatgtcagtgggctatgaagatacatgaacgttactgtagaagaatgattgggacgttcttgtgaagaaaatatcgcaaagattccgatcatcttcggatactgatgtctctctataaattggccagaatttcaccaacaatttttgcatctcataattgagagagaaacagggagaacgttcagagacatggcatggaaggtgggcattgggtgactgcgagcactcgggatgacaacgtgcgagatccacagatggagttgctggacgacggctcggctatgacaccatcgctatcgaatgtcgtacaccttgccaccctagcacgacgccattgcaggtctcacgcatgcatgaagggcaagggattgagcatgggatccacaggaggctatagaaattaccctggctctgccaaatgttcaataaaaaatttcacaaagaaatagagtactagattgatgctcactatgggcgttagtttatcctttagtttcacgtctttctaataaggttttgccaaatgtttttacttagtgcttatgtgtacttaatattgtcatgggcgtatttatagtgccctcccccaaatagatatatgtatcaatttcaatagaaaggttgcccaactctccacaccttggaatggctggctatgtgggtatttatagtgccctccccaaaatagagccattggagaaagcagacttttctgcattgcacctgaccggtttggtgcttccatgtcaggtagctgttagcttctaacagattctctgtgctaccatcgtcaatgtccggcgtgccacccgcatgggtacggtgcacaggagtccgagtgtccaaaattcatcatctctaacaaactggtctggtgcacacccgcccggtctggtgcgccagctgctcacttttccgataaaagctctctagcaaagtggtccggtgcaccagtctagggcaccaccaagagaatttcaacctatctttgatttcttcaatcctttttgtttggtcttcattcttgacttgtgtcttgaactttgcttgatacttgaaggtcttctataagtctttaagagtcttctttgaggtgttgcattctgagagcctcggtctaatccactttgcatcccatgaactacaaaacataaacacttaaatacattagtccacaggttatcttgaacatcaaacaccaaaatcacttagtcaaatggccagggtccattttccttacaagtagtaaatccaacctttctgccacttcgctttcatggttgttatcttcatccgcattcgtccactcaaagtaagatgcctcgagatcggatcatactaagaagtccaatggatcattacctcagagatgaaaggcgaaggagaagaggaaagatagaggggaggaaggtggatcgaaaaaataaagggtaaagtataaatcggaggaagagggtgagttgctcccaatggtggaagaaaggtcatccgccattggtgctagaaggattttggctcttggcccttgactattctacaaagggagtgtactggtatactagtaaagttgataaggtaaataagcggagaagtgtgcaaaagagttattcactaggggtgagtgtgtttaaattgatagtatgagacttctaggtgaagattcttgtcatggtaatgaaataattagggaataagagttattaccaccaaatctaaaccgaattaggacaacatgaggatcggttgttgggctaaatggacatccgcttaaagctagttttctagtgcattaactagccttatcggctatgtaccttagatagaagtaattttttttggtt

SEQ ID NO: 18988 - DNA, 1656 bp, Zea mays
  misc_feature (1611)..(1611): n is a, c, g, or t
  misc_feature (1648)..(1649): n is a, c, g, or t
gcacgagaccattacctagaacatcctaatcgaaaaaggcatgtttagaatatacttgtctcttattcgatagagcggagacgatgattttacagtaactatagcaggccgacgcgtcactcaaggctggtaaatggcagcgcaacaagtatgttggtgtatctcttgtgggaaaaactctcgctattctcggatttggaaaggtcggatctgaagttgctcgtcgtgctaaaggcttaggaatgcatgtgattgcacatgatccatatgcttctgctgaccgggctcgtgcaatcggggttgaactagttagcatggaggaggccatgacaactgctgactttatctcgttacacatgcctcttacgcctgcaacggacaagatgctcaatgatgaggccttcgctaagatgaagaagggtgttcgcattataaatgttgcacgtggtggcgtaattgatgaagaagctctagtcagggcacttgattcaggggtagtagcacaggctgctcttgatgttttcactaaagaacccccagcagctgacaacaagttggtactgcacgggaatgttactgtcacacctcaccttggtgccagcacagtggaggcacaggaaggggtggctattgagatagctgaagctgtcattggagctctgaaaggggagcttgcagcttctgcagtgaacgcgccgatggttcctgctgaggtgctgtcagagcttgcaccttttgttgtgctcgcagaaaagcttgggcgcttggctgtgcaactagttgctggtggtggtggtatcaagtctgtgaaagtgacctatgcatctgcgcgggcccctgatgatcttgacacgagacttctccgtgcaatgatcaccaagggattgattgaaccaatctccagcgtttttgtcaatctggtaaatgccgacttcaccgcaaagcagaggggagttcgcatcacggaggagaggatcctgctggacggctcacctgaaacacctatcgattacattcaagttcagattgccaatgtcgagtccaaatttcccagtgcgatatctgagactggagaaatcactgtggagggcagagtgaaggatggtgttcctcatctaacaaaggttggagcattccaggtggatgtgagcttggaaggaagcctcatcctttgcaggcaggttgatcaaccaggtatgattgggtcagtcggaagcgtcttgggtgaggagaatgttaatgtcagtttcatgagtgtcggaagaattgctcctcgcaagcatgctgtcatggcaattggtgttgatgaggaaccaagcaagggcacactgacgaagatcggggagattccagcgatcgaagagtttgttttcctcaagctctaggcgcgaatgtatgtttgaagttgcaagcatggtgtgcaattttgatgtagctagcaatctagaggacggatggttctccttgaaataagcctttaggagtatttttgtagtggcgctcttgaatatggtctggtatcgatgactacttttgaacggggtgtttattaataaaaacttatataccaatgcttggctcattggttgattccaaaaaaaaaaaaaaaanaaaaaaaaaaaaaaaaaaaaaaaaaaaaaaaaaaaannaagggtt

SEQ ID NO: 18989 - DNA, 2303 bp, Zea mays
gaaacacagcagacaggagcaacattcacggccgggggcccctcgaccccggccccctcgaggcctcgacccgacccgacccgcctccaactccaagccaagccgccatggcggctccgcccgcgaccaccgccacgactcaccaccgcgcgctcctcccgcccacgcgcacccacgccgccgctacgcactccgcgctccgcctcccgctccgcgcgcatccccacgcccacgcccagcgcgcgcgcctcaccgccgccgctgccccggcccccgcggcgtcgacggcctccctcgagtcctccgccgcggggaagcctacggtgctcgtggccgagaagctcggcgccgcggggcttgcgctgctgcgggaattcgccaacgtcgactgctcctacggcctctcccccgaggacctccgtgccaagatctcgctctgcgacgcgctcatcgtcaggtccgggaccaaggtcggccgcgacgtcttcgaggcgtccgggggcaggctccgcgtcgtcggccgcgccggcgtcggcatcgacaacgtcgaccttgccgccgccaccgagcacggatgcctcgtcgtcaacgcgcccactgccaacaccgtcgccgccgccgagcatggcatcgcgctgctcaccgccatggccaggaacatcgcgcaggcggacgcgtcactcaaggctggtaaatggcagcgcaacaagtatgttggtgtatctcttgtgggcaaaactctcgcgattcttgggttcgggaaggttggttcagaagttgctcgtcgcgctaaaggtttaggaatgcatgtgattgcacatgatccatacgcttctgctgatcgggcccgtgcaattggagttgagctagttagtatggaggaggccatgacaactgctgacttcatctcattgcacatgcctcttacccctgcaacaaacaagatgctcaacgatgaggcctttgctaagatgaagtatggtgttcgcattataaatgttgcacgcggtggtgtgattgatgaagatgctctagtcagggctcttgattcaggaatagtagcacaggctgctcttgatgtgttcactaaagaacctccagctcctgataacaagttggtgctgcacgagaatgttactgtcacacctcaccttggtgccagcacagtggaggcacaggaaggagtggctattgagatagctgaagctgtcattggagctctgaaaggggaacttgcagcttctgcagtcaacgctccaatggttcctgctgaggtgctgtcagagcttgcaccttttgttgtgcttgcagaaaagcttgggcatttagctgtgcaactagttgctggtggtggtggcatcaagtctgtgaaagtgacctatgcatctgcacgggcccctgatgatcttgacacgagacttctccgtgcaatgatcaccaagggattgattgagccaatctccagcgtttttgtcaatcttgttaatgctgacttcaccgcaaagcagaggggagttcgcatcactgaggagaggatcatcttggacggctcacctgagacgcctatcgactacattcaagttcagattgccaatgtcaagtccaaatttcctagtgcgatatctgagactggagagatcacagtggaggggagagtgaaggatggcgttcctcatctaacaaaggttggagcattccaggtggatgtgagcttggaaggaagcctgatcctttgcaggcaggttgatcagccaggtatgattgggtcggtaggaagtgtcttgggtgaggagaacattaatgtcagtttcatgagtgtcggaaggattgctcctcgcaagcatgctgtcatggcaatcggtgttgatgaggaaccaagcaaggtcacactgagaaagattggggagattccagcaatcgaagagtttgttttcctcaagctttaggcaactaagcgcaaatgtatgtttcaagttgcaagcatgctgtgcaattttgatgtagcttagcaatatagaggacggatggttctccttaaataagcttttaggattatttttgtagtggcgctcttgaatttggtgcaatattgatgccatcttttgaacggggtgttattctcagctactgtttcccaggttataaaaaataatatgtactccacgttccaatttataattcgtttgactttttttatctaatttataattcgtttgatttttttatctgaagcttgaccacctcgttttattcaaaaaaatatctaattattaatattttttattatgatattgttttgcata

SEQ ID NO: 18990 - DNA, 1372 bp, Zea mays
tggagtattttgaagggtctataaaagtctaagtaggaaaaatatataagacacgggcaaagagcctgtcttctcacaactttctatacagttgtctgtattgatgatccagggtctgagaattgcttaatggttgtacatatgccctaatgtatatcgtgggacaagcacaagccatataggttggcaggcagctggcatctgcatgcatgagttgaataatgtgcgcacgcttgtcatcgtggtatctttccgccttctgctttctgtgagccgacgtacgacggcgaagccctagattggaagtatggaagtagccagctagcaataggacgggacgaggacgacctcaaatgtccaggagggtacgttccatacttcccatacggttggaaacctgcatgcgtttcgttgggtgccgccgccagcatgcagggacaatgacgacgacgtacggacggactgagcagagacacatttgcaaacctgctggctgaccttgaccttgatgctccctccgcatatggtgtgctgagagatcgcctataaatacaaggtatgcccgccggccgggtcgccaagcacaaacgactaacacacggtttggaacacatcacggtttcagtgccatggcacccaacaagtccgttggtcaccctgcgctccgattcctagccgctatggcactcgtgttaacggtatcagtctgtggccagtcgtcgtctccagctccgacgcctgctccagccccggcgcctgcaacgactcctgctttagccccaataatgccagcgccgactcctgctccgacgcctgcaacgactcctcctgcttcagccccaacggcgccagcaccgacaccagcgccaacaccatcactgacaccagcgccgactcctgccccggcgccatccgaaaaccggtgtccccctggcttccctaacctaatcaccttaattcaagccattaagaccacctatcctaataagtgcaatattattattgtccccgttccattctcgccggtgaacccagggtcgggcattcttccatttccaccctacaaatgcctgtgctactgatttcccattattaggattccatggcccggcatccccacctacaaatgtgttcctgtaggcactcccggcccttaacagtatgagcatatatatatttgggtgcacggaaactatgcagaaatgtgcgcatgcatacttaagtatgaataagtgcatgtgagcgaggtctgtaatctggaggttgattagttccatacatgggcgcagtgtgtgcatggtaagggacaattaattgacctacggttgtgtgtaatgcgcgacatgctgttgttgtcttccatataccactt

SEQ ID NO: 18991 - DNA, 3293 bp, Zea mays
  misc_feature (3183)..(3183): n is a, c, g, or t
tttcaaaagggcgtgacaggagctttgctcacaggtgactcagtatatgacgatcatgatgcgctttaggtcatatatttgaagttcatcactgacctcatcaaggaacatgtttctagtgaccttggtgttagggtgttcttatggggtcgtaggtcatgctaccatcactgtcgatcgaggcattgtaggaatcgttcagtcaagtcattgaccgcccttcactcaatcagtcattgaccgcccatcactcaaccaggtcacgagtacctgacttatgcatgggacaatacttcctttactaggtgcgataaggcactatatggcaatggttgtcttcatgggggtaggctcgatgtcactctgaagtcacaaccctaggcgtgataccatactttttttgtgcaatagatagagcaactcgtaggtcatggatcttagagttccaagggcccttaaggggggtctaggcgatcaagaggactcaaggagaatgagagcgtcttggagtgtcctaggggccttgagtgccctctgtttcacttgttctaacaaatggttgtggctgggatagtcttacatgtctacggaggcccgagaccagatcctctgatatgttaggcttgtatcttagctagagtcgaggttagtcgcggatcagacaattccttctatcgaggttctttgaaaggcatcctatcaactcattagggtatgatctactcccgttgttaataaacgtattttataacacaacactcacatcatgaattgtatttaaactcaaccagaacttcagcatctcctcaccagtatgaatcatcacatattcatcaacgatgttttcagagtccatgcctctaaataaatttattataaaaaatattctataactaatctaataatacttattttatattaaaaaattagtacttatataactttagtcaaagtcaactgttgaggaagccaacattatactttttatggatggttgaagtatacagttttctataaactttgtcaaattatgtatggtaacttaacttagaaaataacaagaaataatggagagatatcacatttggaaacggcgtagtattccacttggaacacttttattttaagatgcaaaaaaaaatggctggtggagctaaaatattttttatttgagccgagacattctttttttgtgaactacttcatctgcgcagcggcagacttcgcgtgcgtattaatgtttatactgtgttgaactttagatacataaaccgataaacgcatgcaaattaaaagttgttcttgctgccacgcctatcggttgagttgcatgactttcaggccaacccactgcaagcaaaatggaattggagattttctacgagagcgagtggtcaagtattcatgactagccggctgcctcgtcttcttctcgaatggaatggctcccacttgctgcaaacggcccgccggagacgcttcgttaccccactaatccctggaaaggagtttacatggacagtgggagcctcgagaccctcgcccagggcgtcccactccatccgagaaggacgatcaggcttcaggcatggcgtcccctggccggaaggatggtccgccggtcgcgcgatccttcagcttcaggttggccgcaggtggagagctcggattggccgccgccgtggcgcccgcggtccctatcgctaggccggtcaggtttgtgaccctaacagtgcaggacgcccagcggcgcgacgtcacgcgtactatgcgcgtgacagacacgctgcagggcctgatggaccactactacgacatggtgggctcggccggcacacgccgcgcagggcgcttcgtgttcgacggcaagcggctgaaagggaagcagacgccggaggagctcgggatgaagaaccgggacaagatcgactttttcgttgatctgagcgtgacggacgacggcggcgacgtggaggagccggccgtgtacttgacggtgaaggtggtggtgctggacatgaaagggcgtacgatggagcgcactttgcagagtacccacaagctgcaggtcgttatggatgcctactacgacagcgtgccggacgtctcacgcggcgtgggcaagttcctatacgacggcgggcagttgcagggctggcagacgctcgcacagctgaagatggatgacaaggacgagatcgagatcgacttcctcgctgacatgatgggtggcggcgggccgccgggccggtgggctgctactgctgctgaacagccgccggtgcctgcgtacctcgatctgcggactgctccatcattgatggcagctaataatttttattaaactttcgagtgatcgtaacatcgattgagaaccagacgtactgtttgtttcctccttggtttgatatttggttctacaataatcaatgcaataacagttttaacaaaaaaaaaaaaaaaagtacatcaatattttagacaatcaaatactttaataaggcatggtttgctaccggcaaagaaagaaaaatattgtctagctaaattttttcaaagaattcctcatgtttttacttggcaaaggtggcttgcaactaagcacaatatttttttatgcgtgctgcataaagatggtgaatcgtagcgacttaagtaggtgtactcatggttaacaccaaataaatctatcctgcttcttctaaggaggaaaaaaaaccataccgtgctttcagaaacacgtttgcgtgatgaagacgcgtgtctttgtgcggtcttgtttttattttgagccaagttacgaacgcgtttgcctccgttttcttttccagccaaaaacgacccatcactgcccaaaacccaccaccaccaccttccagccaaatgccactgccctacgtactagaataataattaattacctgtgcatagctaacaatatatgtatttacaatatctattctttatgtaacataaatatatatatgagctatagtagttagaagcctaaacaattttttatcatgatattgtgatcaagaaatcaaatatggcacaaaggatatatcaactataagatatagttaaacgggctgcaaacattacatagataggatcagcaaatactatagtttccaaccattttgaaaccaactaactttatgttcattgacatcaaagaancaaggtttataagtatgacatacacgatatttgtagatggatacctaccacaaaatacatatacacaacaaatggagacctaccaaatgttgaaaccttatgcgaagggc

SEQ ID NO: 18992 - DNA, 642 bp, Zea mays
agttcttgtatgagcatgtccagatgtgtctttgagatgttggagtaacacaaagcagagaaccgcttcagttatatcgtgatcaacatgtcgcgttagaatatcttctagatttggatgtttgatgtgttttctaaatacaaggatgatcatctggttggcggggcgacgtcgagcacctacgccatgactgcaacattctagtgaacaacgtcatggacatgagacacattgtggcgaaggtgcgctctcgaggacaacaggtctcaagaccctcacgcatgaggtgatgggcatgctgatcgacaagaccaaacaaatgacgctcatttggtgggccagacctctattgtccctagtaggtctagtacaccatcgtcgattatgtgtcctacgcgattggtcggctgctgctcactagggagcacacgaaatacatagatatcgtcgttgcaacaatctcgttctatattatcttcgtgtgactttcatatctactgtgatgcgaatcgaattagtgatttctcagatgttggtctatcggatttttattggtggtttccttgttgcttgtaagattaagaagtagctaacagtgttccattcgagtataaaaaaaaaaaaaaagggcgtagatcgcga

SEQ ID NO: 18993 - DNA, 1188 bp, Zea mays
ccggccgggaaaatggttggtttggctcccgaggccattgggtatatgctatagcgggcgtagtactagggatgttcattgtcaacgagtccattacggttggtgctgagacgggcgagcgcctacggagtttgatcctgaaatacatcagggagaagagtttgataggtcacaagtatgattgggagcactggagggtgaataccagggctaagcagtcagtgcttttgtcagtgatgataattttgatgtctttcttttggattttgagcattgtgctgactgtagtaaagatgcatagtcttgctgatggtgctgtcctatggatgggctgctcggtagcacctccaggtgtttggttacgctggtacctggcaaggctcaatggccagggaattggcaaacagagatccttgaaatggctgcccactgggactctggtagccaatgttcttgctgcaggcataatggcagttcttgctgtaacatccaaagcggtagatacaaagcgatcaacaactattcttagtggaatacagctcggcttccttggttgcctaagcacagtgtctacttttgctgctgaagtgtatacaatgagaagaagcgggcagattgccagggcctttgtttatgccgcatccaccttcctgctttcttttctgctaggaactctagtgtattctgtgccagtttgggaaaagcattataaatgacctattgcaacttccagattcaacattttaccagatggcttaaatgtgcaatgggaaagagagcatcaacttcctgaacaaagtacaagatacagagccaagacctcaaaggttcacagatgcaaaagagagcatcaacacaaacgtttgcagaatggacccacagaaccatctatatacctggctgggaaaaacagagtaaactttgcttagtagaatatgtagtggcgtggaataatttttgtcttggagaatggagtacatgtatgtatctgtgaactagatgtatcattaatgcatgagatatgcatagatgaatttaattagtgtgggattagctccactttattctcatgctgtctcatgtaaatgcaggacatctagaaatgtttttcttgttactaagacatattggcttaattagtttttgaataaaacatttccttttgacaaaaaaaaaaaaaaagcggcc

SEQ ID NO: 18994 - DNA, 2183 bp, Zea mays
ctatagaaaatatgattatatccttccatcgtctttatacgtccaaccatacacacgaaaaaacagtatcatcccacttgacaattatttttaattcttttccttttctataatgtagataaattatgtaattacacctatacggtaccgagtagtcttttgattgttaataaagttcacacctttttacggacctcaaaatcttaggcatgacgagttaattttaatgtttttctttcggctaattccaccatttaacatttttcgcttatttttaatgcatacggactacggtttggcgaatcattacaggtacggtcagtctttttttccctgaagacaggcagcactaaaacatttctctgcctaactacttccctgtacgtggacgaggaccaaggagacagagagaaagcctggccgcgccgcccaccgtcgcctcgtcagtcgcctcctccatcctccctccccatcgacttcccaaatcccagccaggtaattcttggagctcgtctttccggttgtctcctctttcctgtgcatcctgctgctccgaaaatctctcagatctcctcgtcctctggcccattctcttcatctccatgcatggatgaacaagagacggagggagacagatgcaaacatcgagactgggtaggtgtggcgtcgtgctgatcttcctcccaccttacttgaccatggaacctttagagctaaaaggcaccaggcactgattatattaggttacttgttaattaacaattagcatcgcgattagactagaccagttggttactaacaatcaaacaattggtatcgagatgtcaaaggcagtcacctttagtgggatcgatactgttcttttagtctattcaattcagtagcagtctaatcagaagacgccacttgtttccctcgcttcaacggcgctgtcacgggttcagacgtgtttctatttttcttcttttccagccttacttttgattaaactaattatttgtttctggtcttcgttacgtgtactttctcgctcctacaatttttttcgcgtgtgccatatgtgttcccggaaaagtttcctgtccctttcgggtactccggatggttcccattttttttctttcataaaagttctattttgaagcttggagaacagtgatgtacatgtactgtgagctatttgatttgactgaaggaaaaaaaatgttgctgcagtctcctcgatcttcagagctgtgatgtgatttgtccagatacctacaaaaacgtaccaaatcctatctttttgtcctacccattgtttggttcccgtgcttccagaatttatatggactgtggattttaatggaagaaaagaaaggaaaaatatgaatcataaactactgactcatgtcataacattgactttttgtgtagggttgttatctgtctttgtagcagaagaaacagtcctaaaaaagaatggagagctcctcagataggagcaacgtttctcaggggaaccacctgggttatgcgagaagcacatccatggattccactggtcctcagttagctggtaggtctagctcaatgttgagtaggagaagtagcagacagggctcaaggggatccatcagcctctcaagggagatgggggactccatactgagctcaatgaggcattctcttcagtcggcggatcaattgctaggagacatcgatagctcagttctggctcaactcatcgaaagtggtcgagttctatcacccgaaggcgatgttgatgaggatacagtaagaatctctgaacatcataaggttggccctgttccagatgatgcaataaagcaaaccagtgacaattttgcatcagcacctatatcttcagcggagacaaaagacactatttctaacgtcctagcagattcatctactaaggtaaagatagtagtggagttgagtagctgcttgtcattctcatacgtgtggttgctccgttgatatattgttgaaaggttattttttatgttatatgtgctggcatgaccatgctttcatctgcctgtaggttgaaccatataagctttctctgaggctagactatgctgcttacatgatccatttagctgtctttggctttttccggggtaactctccaaaattctcacataaagggttctttctatgttctttgagatagc

SEQ ID NO: 18995 - DNA, 4829 bp, Zea mays
  misc_feature (4780)..(4780): n is a, c, g, or t
cgtcataaatttgtgttcttgattgatttgtcttgatattgtgcacaaaaaatagagctagcctagtttgtgcacacaaataaagctaatatcatgtgcataaaataatcattatacgatattacatgtcactcaaatgtgccgagatgaaatccatgtctggttagcgaaatctacacagttattttaacttgatctttttaagaatatagcctgtggagttatttatgtttacttagcgaagttaaaagtggaacaaaaagataaagcatagcaatcctagctaaatccttaggttgcatttggtttgaggacacgatagagttggacagttctaaccttagaggttgtttggtttccatatctcaaactttagtgactaatatttagtcacttttaatccctaagttatcaaatagtatgaaaatcatagagactaaagtttagtttctaaaatttatgagagcgaccaaaggaaccaaacacccacttattctcgtagacgggattgttccaatctcatgttttgttgataacgatctctactctcttaaagcacgagttttgactgatgtcatacgaaatgcgcgaagagtgttagaagaaacatttccaagtgatcttcatatcgtggttttctcggtagctttatgatgtattatagtcacaattgatacacaattcgttatggttgttgtcaacggatactccattttttgtacaacatcgggcccacgaaattcttagggacagccctagcccttaacactgctccattagcatcgaagctcatcgtgttggagcttgtcgtgcttgtgctacttgctcatgccgaagcttcgctcacaccccgtcggggtcgcttgattgtagggactagattttaacccgtgtcatcatatctaatgtttgaatgcttattactagtattaaatataatttaattataaaattaattacataattaaagactaaacagcgagacggatttatgaaacctaattaatccatgattatcaattgtgaattgtagcatcacatgaagtaattagatttaataggttcgttgtatcatttatttctcttctgtgcaattagttttataattaaattgtatttaatacttctaattaacattaaagattcgatatgatagagactttggattaaatagagagtctgtggagctcgcatgtgcctcgcactcccctcttgttctcaggccacaagttatgccctgttggttacttgtttttaattgctacgaaccaaaaaaggcaacataatattagacattaaggacctccgtcctccgaaacattatcttctcttgaagataatagttctcggatgaaggtgatgaaaaatatgtcttcatcttccaatgaaccatttagaaggggtttattgtttataagcacaatatcataatgtgatataatattaaatctcctattttatttgtatgttcaaacaagatgatagtctgaattacacaatgacaaaagattacatttataccttcaattccgtgtaaaagataaatgcaagaataaccttcaattaatacgtgaacagtacgcggtactgttcatttatttatagtcatggaacgtaaccgaagcaaaagtacaattgtaaccctaatatctatacatttgtcaaatgagccaaatcagcttgctgaggtcctttggcaaacaagtagacccccaacacccccctccccctaatgcttcccgtctgacctttaaccaaacaaaagaaagaggtggaattgtcctaaaccagacggcaccattgtttcagtctagtgtgacctgatcggtatttagccgccacgttttcttatattttaccccgacgagcgatcgtgtatgctgcatgctggaagcatgaaaccgagaagatctgagatctgaaatctcatgctaattgtcggctgacctgacaggtaaggactgcttgtgcaggcaatgagtagagtaggttctcaagattccccagcttgattgaaggcctgaactgtccatactccacagaaattaagaaatgcacgcgcaagtgtaaccttgggattcagggtgcgttgcagatttgcacggttactttatatctactacactacacaagagaatttggaacgagccatcatcgcccggccacttctggtggtcgcgtgaggggtgggcccagtacaatgaactgacgtccccatggagcctaccggcacggccgccgcatcaccaaccttgtccagttgcctgcccccctttgcccttttccctcgtcctcgtgtgatctaccactcttcagtcctctcgcgtgactctctctcagtctcactcacgctgtcacgcggctcacgccccacccccaccacaccgctctcttcttcaccaccgcgaaagcaagagagagagagacagagagagcaggcagcggcaatggctggcgctggggacgagtactactacggcgggccggggcaggggcaggggccgcgcggcgccccacacggcctgctgctggcggtggtggttggcctcgtggtggcgggcccgctgtttctgggcgacggcggcgaggcgctgacggaggccgtggcggagctgctgagcccggtcgggctgcttctcctccccgtgtgcctgctgttcctcatccgcctcctctcctccgaccgcggcgccgcggcgctcgccgacgtcttcgccttcggcgggtcccccgacgccgtccaccgcgtcggagggtccccctcggcgtcgcgctcatgctcctcctcatcctcgcgctgctctactaccgctcctcgctcttcggcggcggcggcgacgacgacgagtaggagaccggcggcgcgatctccggccgtggcgtggcgttgtttttgtgtaatgcgaggggcgtgggtgcaaaagtgcgtgtgtaaatcgagtggatcggagtaaattaatctaatttactcctttgctaatgcttcgtctgtttgtaaatcgatggctcctgaagcttctgtgctgcgtcgggccgggcgggcgggccatgtgcttctactctgcatctcgtcggtggcctctgtctgtttcgctcctccctgcctcttgccccagagccagaaccagaagcactacgctgtagctttgcgagtggactgggtcggtctgtctactgatccagaacacccatgcgtgcccgcgaatttcttgttttacctctaacgacggtgccaatgcagcctgttccggggcgggagcgcagcctcgagcgatggctgcgtcggccggcgagagctggctagcacgttcggtgggtgttctggatcggtacagaggtgagtgattgatccacgtcactgccgcgcgtactagaaaaaaatcataaatttcattctcagtctatttataaatactcttacttagttgaagcttattttagacattatttcacctcgtacaatttttaaaaaaattacgtaactttattttaagtattatgtaatacatagttttaaattcaataaaaagttcatgttgtgtaatttttatgtgttgaaataaaacagtatcaatagttaattgtgaaaaaaaatcgacgtgtttgagactgtagtctgctatagtatatacactggaacaacatatacgagcgtgaagtcaagagtttacgtggcagagacaaaagaggatggtgtactagcaccagcctaaacaacacaggcaagtaccccgtcgtacaaaggtgcagcaggatcaataaaggtttagggcttgttcggttagctctcaatccatgtggattgctctcaatccatgtggattgagtgagattgaatgagtttaaatcacaaacaagtcaaacttcttcattttttccaatctcatccaaatccatgtgtattgagaataaccgaacaagatcttacggggatatgacgatccttgtcctcgtttacgtttacgggggacattttttcctattcacgttccctacgggatatgacgatcattgtcctcatttaaattataactaggacatacaacatttattatttatataaaatattttcactcatacatagtgttagatataagattttgttatgtgtatatcaagataaacatatttgtacaatagttgatctcttgatacggtaattattaatttttatcattaactagtacataaaaacatcctcacatatagttttaatgggttagcacgggaaacggaaatagagaatgctgccctatcacatccctatttatccgccgttggggaaagattttttcccttacatctttgtgaaaaaaaccttacttatcttcatcctccaacgaagaaatttcccacggaagagtcagtgatcaggggcgttgtcacctccagccgtatggttgtcctgtccgtgcctccgctggctcgcgcctacggagtaaagtatactagtactgtcctccaatgtgtatttgtttaattgagcatttatgctgcatactttctgaccacatgggacggctgacggcgcattctgttatgttctttaatcccatgccttgtacgttttacctgcataaaaactggtttaatgccctcctacaattatgtccattacgactaaattcctcacctacaaattgttacgcttgtactcatcggtcgccaaggatgctcctgacaatgattcttgttcggattctgcttccaactgtagtcctacagctggagccaaaatccaaaggtttcctaattatgcagtatagtattacctctatanttgaaatatttatggtccgcttaatttatttttaaactaaaacccgaca

SEQ ID NO: 18996 - DNA, 1581 bp, Zea mays
ggaatggttgacgtgtttcttttgatccgcgtgacaaacctatcggctctcaccgcgtacatgttatgatttcctgtaacgctcaaggcaactgcgggtacgaccgtacgagactgggaaatggacatgagacacgcttatccgttattatcaaatccatggcgtacaataacgccgtggtaggagcgaagcttccaagtggcaaccgaattcacaacgcgcgtgaatttaccatcctccttggctccgtccgttcccttccatataaatcgccacgactaccacgtcgatcgatcgtgtcaccaccacccaaaaacaaactgtttttgcgtcgccgatcgagtccgccgcagagtaatgtcgcacaaggtggcgacaatgccgatgacgaccatcgaggtgacggtcctgtccggggaggacgtgcgacgagtgccctcgggccggcccctgtgccgcggcgcctacgccgtggttccacaccgcgtcgtcctccgcgcccacccgcgtcgaccaggaccccgactgccacggctacccgcactggggcgatgcggtgcgcgtggcgctcccggcgggcgcgcgctggctggacgtcgaggtctgccgcgcgcgcgccgggggccagtcggagcccgttggccgcggcgcgcgttccccgtcgaggacttcaccgtcgggcccccaggccacctgcattgcctcagctaccggctgttccactccgccggcggcatgcagcgccggaacggcattgtcaaacatcaccgtcaagaggctcgatggtggcgcgccgccggtggaagggaaggcgatgttcaggtcggccgcgaaggccgtggacgccgccggcgcgagcgggagtggctcatgctgcgccgccgccgtggagcaggggaagcccgcggcgcctgctggcgccgtgatgggttaccccgttgggtgctaggcgattcggcatgctagttaggatccacgttcttatatgacctgagaatatatctgatcagtactcgctagtactcagggtcgtttggattttgttcatgcatggagtgcttcaaaaagtctaataaagaaataacagattaacagcccttgtcaaataatctgctgcatttagcattgtttattttctgctgttcttcatgctttgttagttcttctcactcgaatctcaagttgtctcaaggaaatcgcccttgggcattgttctgtatgaaaaaaaaaatcatgtatagtgaagcttgaggagcatgacgtcccatcatattgatgttcaaatccttctatctgacgtgagccatcctgtaaacttgtcggtatgtatccttatctactctcactgatttcttgtatcctggataatctacattacaaacatatgtatattgtaactgcatgtagaattttcttagaccgagtttcttgtgttcagtataataaaaaaaactcgatcggaaattatattaagaagacaccgaaacgtgatcttgcccacgtgctggacgtaaactaagagcggataagacgcagcgaaagaatatttttaaccaagctagaaaaaatcgttctcaagag

SEQ ID NO: 18997 - DNA, 2328 bp, Zea mays
acacgatcgatcgggccaggcccgcattctatgggatccgtctctccactctcttctctaccgaacacaatctcatccgtcttcctcttccccatcagccgccctaccgagtcttcgcacgcacgacgcttcgtcaggatcgattcgcgagacctctcctgtccggatcgaggttcatggtttacatatgcgcgtttgtttactgatgcataccacgaccacctgatccggatgtcaggacagatctcctgctttaatcgagtccagttcatgtatgaactctcccttttcctggcacgttgctagatgtaaaagggtgttccgggatttaagagaaccacccacgcatccatgtctgaccagcaaaggcactacggcagctacgagctcctcccggctcacccagatttgcggtgcctggtctgcacgcggccgttcactcttgacgccgaggtcaccgacagcttggaagctttagccatatgcagggagtgcaagacgacggtgcttagtgacagcaacagggacgacactccccgagccaaccgacagagaagatggcgaaggcagcaaagctccatcaggggggtctcggtgttctcgcagctgatcaacctagctagacaacagggtcatgaggcggacactgattctccgacggttccccgccgccacacatcctatagttctacgccgagccggtcccagagggggcacacttccgacgacgagagcgatggtctgagctacgccgattccgtgtttggtgagatcgagtcgaacatcagttttggtgatgagggtggggaatctgacacttctcttgatcgccacaccatggttgggagggaaattggcatacagcttgacaatgagagctacatgaacacagatacagatattgatcctatgaatgctggagtataccagtgggactcagacgatcctgaagacgatgaagatgaggagtcagaggagtctggtttggatgaaggagatgacaccatgcaggagcgccggcagcagtggcatgatatcgtcccgagtggattgaatgagcaggaatctgaaggtgctgcatggacttggagaacagttggaagccaagacataaacaggactgatctgagagtcgacatggaaggacgggaaatcaggagactttttattgggaaccccggagattatgttgatgcaagacagtttgaaatgcttctcgagcaattcgctgatgaggataacaattccagaagaggagctccacctgcagcggcatcttccatcgaaaatctttcgtctgtggtcatctccaaaggctatgagataaacggtggtgtaacctgtccagtctgcaaagatgacatgcctatcaccactgtagcaaaacagctaccatgcatgcatctctatcattcatcttgcatcttgccatggcttaattctaggaacacatgcccagtttgtcgttacgagcttcctacagatgactcggaatatgagaggtccaagcatgccgcggtcaatgaaggaggtatccatggggtggagcgtacccatccgcaggaagttgttgaagaaacttatgaacctgaggttgatggaggttccaatacaggcggtgatacaatgaatgagactaatacacatgaacagcatactgcacagcagccaaatggagcacatgggcgtcatagatggctgtttattgcagcagctccagttgtaagtcttgtcagtttagctctagttttgtgcttcaccaatcctgctggcaatgttaggaggcaattgtgccgtaggtcccagactaccactacggcacatgtagacacaagaagaagttggtggtctatgttctaagtaaccagtgtttacttgctgatgctgaatttctgtgtgatggcgtgtgcttgttgccacttgccagtgttgtgtcaattatgtatgaaaaggttctagataaatttgaagtgcaaactgtgtgtgccaaccaaggtgttcttgtaaccaagttcagacagttcagcaaaacaaatactgatgattgctgctgttcattgatattttatatgtttggttgctcaggttgtaacttcaagcatgtaactaacactctgccttaaagtttacccatgcattcatcagtaagtgcctaaaatatctcttgtgcatgatgcacattgtagtttgactggtaatttgcaggtcctatgaaacttctgctttaaattaaatatgtttaactctccactccaagtcatccatgccttaaacaatctattgctgatctgatatttgtcttatgttcaaaaatatctgttcaaacca

SEQ ID NO: 18998 - DNA, 3248 bp, Zea mays
  misc_feature (1256)..(1256): n is a, c, g, or t
gcgcctgttattcatttgccactgaaattagtatgtatttatgattatgcttatctgattagggtgtgtgattagtattattgtttagttcgattctattaatgtattagtggcatatgcggttcattattttgtggcatattgtatttgtggcattagttttataatatgtggtacatttacattattggtacattattgtgagtttgtggtagactgtaatgaatttgtaaggtattttggtggattgtgatgtattttgtgaggaattgtggtgaattgtgttattttgtgttgaatgcgtgtaattctgcaatttcggttgttgttataatattgtgattatattgttgttgattttacatgtcattctttttttctctgaaataacttattttcggcatccatgtctaggccgacgaaaataagcttgtatagttttcggcggctacagtcaggccgacgaaaatcccaaatttcttttggcagtccgagtgaaacaaccgaaaataagttattttcgacgacctggctatggccgccgaaaataaaaactaatttcggctattttttggtagacggaagccgccaaaataggtcatataccgtataaaattagctatttttggcggcatatggcctattttctgcggcttctggccaccgaaaatgattgtgtcctgtagtgtcctcgaagacgaactcgattcgctcatctccgtctcatacccggagaactacaacaacatatgatggagcagtacaagaagctgacagttgccacaccaattttctttcttgtgatgagtattgagcatcatcatatgattcatataattggcatgcaactagaacacattatatgtagatattgatgtctatgataaattatatattgttcatctctatgtaatcgttatgcactaacattttaataacgagagcatataacgataaataacgcttttacatcttaatatatcttatcattacatgatcactttgtagcaagacatgggtatacacctattaatcagttaacagtagagagtgcctgccagcatcagctgtgtgtaatatactctccactagcaacaactagagaggtgacggacgatatgatttttagtcgttcatgacgggtggtaaaaccactagcaacaaccggtttattgttgtctgcgtttgtcatgtcacggcccaccatcaacataaatactgtacacaatatatgtatgtaaccgaatgattagccncactgtccatgcaaattgaagatcccttaaaccaatgatttgatgcattgttctagtggttgtggacttgatataatcaaactactgttgctgctattaataaatatgctatatttaaatcaatattatgaaaacgcattacatatcatcgccgactctagacaattggttggtgatatggtaaaccaccgaagatgagctcctcccgcatgtatcatgccgacagtaacatcataactagaaatcatatgctgtcagatagctcgatcaataagcaccagcataggccatgcagtatttagtcgcccgcatgcagctgaggccatgctccggctcgcgggaagcagccatgcaagtcctcctgcagttgctcccgttggttctctcggcggcggcggccatcctgatcgcctggcgtgcaacgccgccggccgtcaaagcacgcctggccgccctccagtccggcatagcacgtgcgcgtaagccaataatgttggtcaccgacttcgccacagcgcaccacctgctcgtgcggggcagcagcgccggctccttctccaaccgcccgccgtccatggcacccagcgccgtcctctcgggccgccgctaccacaacatcaactcggtgccctacagccagctctggcgcgcgctccgctccaacctcacctcgggagtgctccacccgacgcgcctgcgccactacgctgccgcgcggcgccgcgcgctacaccgcctcgccgcggacctcagggagcagcagctcgccgacgacggcgtggaggcgctcgcggcggaaagcatccgtagcgcggtgttcggcctcgtctccaccatgtgcttcggcgacggcggcgtcgacgcggccgtggttcgcgccatggccgacgtccagaccgagctggtcctgtccctgtccgcggtgcgcaccttcgcgttcgtgccgttcctcgcggtgtccaagctagtctaccgcgggcggtggaacaagctcgccgcgatacggcggaagcaggaggagctgtacctcccgctcatcgatggctgccgccgcaggcgtggccgtgacgacgacgactccgacgggacgccgccgagttacgtgcgcacgctcctcgacctccgagtcccggtagaactcgacggcgaccacgatagcagtggaggcgagcagacgcagcagcggaggctcgaggacggtgaactcgtgggactatgctcggagttccttggttctggcaccgagtccgtgtcagcggcgctgcagtggatcatggcgaacctgatcaaacggccagacatgcaggacgccgtcaggagggagatcgacgctgctgtggatgccgatgccgaggaggtcggggaggaggtccttgggaagctggatctcctcaacgctgtcatcttggaggcgctcaggctacatcccaccatcaagtttggatttagggaggtaaattcctcgctagcttggtgcggagctaaattcagccacagtgtcaaaatctcatctcatgtatgtactttaattattaacaggtgatgcaagaagaccaagtggttcatgatggccaccgtattcctgtcggcaccaagatggtcttccccctggaggctctagcgagggacaagacggcgtgggacgagcctgacgagttcatgccggaacgtttccatggatgctgcgcgggtggagaaagtaccaagaagctactgtccgtggcggcggagatgaagatgctgccgttcggaggcgggaggaggatgtgccctgcgataggcgtctcgttgctccacatcggctatttcatggcgaaccttgtgagggagttcgagtggcgggaagcggagggcggcgagcacgccggcgtccaactccaccccgacgccaccgtcgagatgttcaacttcatggagcgtccactgcgtgctcgcctcgtaccattacgtcgaccgggaggcaagaagttccgttacgtccattaattatcg

SEQ ID NO: 18999 - DNA, 954 bp, Zea mays
ccaagcaggccccaaacctgagcgagcagttttcaggcaggaatgaccccggtctcacatgtcagtgagtcacaacagccagatggaaaggcccacgtcatctagtcattggttgtgaaatccccgttctacccctcccgtctctgatctcgataggcgggccggcgctccgccgccgcgccgggaaaaaacagaggaggaaaaaaacacccaaaaaaccaccttcttttcctgcgttcccctgctcgatccccgacgagaattcgctcccgaacccatcgatctgctctccgcagtccgccgatccgtggatcgatccgtgcgcgggctcggtccgccccgggttccgatctggtcgccgcctcgcctgaggagatgaacggcgccgggggcagccaccaccagcagcagcagaggctccggcagcagcagcagcaggcgctcctgatgcagcaggcgctgcagcagcagcagcagcagcagcagtaccagtccggcgtcctcgccgccgcggcggcggcggccatgacccaggtcgtctccccggatcctcgcctctcgatctgctggtctgcgtgcgcattgggcagcagtaatgcgcgccgatctgcttgggagattttttttctttgctttgagtatttttcctaggctgcctcgctggtttactgcacacttttttggtggtgggctagcggcagcactagttagagcttgatagatagggtttcttgtagctatttttttggtggaattggagcgagcgctgttgctgcacaaaactttctgctgattgcgtgctgttgtttgtgatctgctcgcgtacaaggtgcttgtgctactgcctctatcgttgttggattgttgccacttggaagaaagtttgttaataaaggaaggcgtttggatgtgattgctcggaagacagttactactaattggttgtcatggata

SEQ ID NO: 19000 - DNA, 689 bp, Zea mays
actcttctctccacgaaagtacgaaaccaactagaccagtccagccgcaggccgcagcacgcagccaggcagccagccatggccgtggcttgcgcgtcgcttgcggttgcgggcaggtgggagatcgggggcctgttcacggaggcggagctggcggtggcggaccagctcgtgcaactcagcggcagcggcggaggggacgaggaggcggcgtcgtcggagtcgccgcggtcggtgaacacgtgcgcgggtgccgcggcgtgggaggagcgagaggaggcggccgccggtcccgcgctgggggcgatggagctggacaggagggcgaggaagaggtaccgcctcctgtccgacgtctacgccgccacgaggccggtggccggcgccggcaccggcgcggacaacgccaggaagaggaagcggggtcacgagccgaccgaggcggagccgcggaggcggggacgacgatcaggtaggtacgacgacggagatcagtgcttctagacttgtagaatctagatggaatattacggaggtaggagatgggagggaagcgcttttgtgtaattatcgaagagtagcagggtctgttctgcaatgtcagtcctttagcttttcaaagttctcctagtagtagtagaagagaaggggcacagcagccagcaaacaacaaaggcaagctagtttgt

SEQ ID NO: 19001 - DNA, 916 bp, Zea mays
gggtacctcgccgccggcccggccgggccagtcccagctgcctaggtctgccgcctgtcttgaccccacccactggccacttcccctcctgtccgttcccaaatcccgtcccctccacccgcactccattggcgccgctcccctcccctcgccgccgccggagatctgatccgatccgatccgatccgtttgtgcttgtgctgcagcaggagtgagaagtaaaaaaatatggctgccctgccactggccaccgccgaagtatgcgacgctaaccctcacctgatcatgaacggcgagctccgcgcgctccagccaatcttccagatctacggacggcgccaggtcttcgccggccccatcgtcacgctcaaggtctacgaggacaacgtcctggtccgcgagttcctcgaggagaaaggccacggtagggtcctcgtggtcgacggcggcggcagcatgcgctgcgccatccttggcggcaaccccgtccagcaggcgcagaacaacgggtgggctggtatcctggtcaacggctgcatcagggacgtggatgagatcaacggctgcgacatcggtgtccgggctctcagctcgcaccctatgaaggccaacaagaaggggatgggcgagaagcacgtccccgtcaacatcgctggaaccaggatttgcgacggcgagtggctctacgccgatcccgatggcattcttgtctccaggacggaactcaccgtgtagacagacacctggttgtatgtgtgtgtgtataaggaatcgggcgctcttgctgttaagcccgagcttgcaataatggattcttgctggatcacacatttatacttagaataatcgaatgcttgcttccttggttaaaaaaaaaaaaaaaaaaggccttttttttgttccttgtcaattttct

SEQ ID NO: 19002 - DNA, 2253 bp, Zea mays
cattgggtacctcgaggccggccgggctcttttctccaccccaatcccccccgaggcccggccgggccttcccactcggccactcctcatcagccatccccaaaaggccaaaacccgcgcacaccggcgacggccggagaacctcccgccggccgccgccatgccgccgcctctacaggcccaccgcctactcatctcccaccgccgcctacccactccagctcgccgccggttcaccgccgcctcttccgtccaatccgctcccgccacaaccttggccccgggccccgccacatcctccatcctctccatccgcgagtcgctcctctcaggcgagaggaccgcggcggacatcacctccgagtacctctcccgcctccgccgtaccgagccgaccttgcgcagcttcatccacgtcgcggacgccgccgccgagcgggaggcggaggaactcgaccggaggattgcctccggggagaaggatgcggtgggtccgctcgctggagtgctggtgggagtgaaggacaatctttgcacagccaacatgccctccacgggcgggtcgcggatactggacgggtaccggccggcgtacgacgccactgccgtgcggcggctgcgggaggccggcgctattgtgttggggaagacgaacctcgacgaattcggaatggggagcaccaccgagggctccgcgtttcaggtgacaacgaacccgtgggatgattcacgtgtgcctgggggatcctctggtggttctgctgctgcagtatctgctaggcaatgcgtagtgtcactaggtagtgacacaggtggaagtgtgagacaaccagcgtcgttttgcggtgtagtgggattgaagccaacttatggccgggtttctcgttttggtctcatggcctacgcttcatcgctggatgttgtgggatgctttggttcgtcggtttttgacactgcaaccatcttatctgttgttgctggccatgacaagatggacgcaaccagcagttcacaggttgttccagagtacgcatcggagttggtctccctagatttactagaatcgaaaccattaaatggtgtgagaattgggattatacaagaaactcttggagaaggtgttgccagtggagtcgtatcatcaatcaagggtgctgcttcacacctggagcagttgggatctgtggtggaagaggtttcactgccttcattttctcttggcttaccagcatattacatactagcctcatctgaagcttcttctaatctatcacgctatgatggtatcaggtatggaggacaggtctcggcggatgacttgaatgagctttatggagagtcccgggctaatggttttggtcatgaggtcaaaatgagaattttgatgggaacctatgctctttctgctgggtactatgatgcatactacaaacgagcacaacaggtcaggacactggttaagcaaagcttcaaagatgctttggaaagatacgacattctaatctcaccagctgcgccatcagcagcctacaagataggtgaaaagataaatgacccgttagccatgtatgcaggagatatcatgacggtgaatgttaatttggccgggcttcctgcattggttgtgccttgtggatttgttgaaggtggagctgcagggctcccagtgggactccagatgatgggatctccattctgtgaggggaatttgctgagagtaggccacatctttgagcagactctccagaatctcagctttgttccaccgttgttggcagagggccagttgtaacagataatccactcgctgctcaacaagcaattacctgagttacgggttttggggtggctttctgtcattcgcatgcggaggaaattggtagcacgcatgacgcatttagaaaatagaatgttttgctcgtggggtcgctgataattgtgagagagcaacgacacccatgtgatgtacaccagcaaccagcacattgcataccacacagcattttacatgccttcagaatgattgatgattttgtatcaatgctggttttctcaaaactcaaattttgcatagaaagcggccgtgtccctggcagaggtgagtattccagcacctataagcagttgtggccttgtggggatccgatgagaaacagaacagaaagcagagaaacaaaacagaaaggacccatttggacgtagatattggatgttagaattgaatggatccaatacaaaatctgcatagtattg

SEQ ID NO: 19003 - DNA, 878 bp, Zea mays
  misc_feature (537)..(537): n is a, c, g, or t
  misc_feature (547)..(547): n is a, c, g, or t
  misc_feature (695)..(695): n is a, c, g, or t
  misc_feature (853)..(854): n is a, c, g, or t
aaccaaaccaacgcacacaaaagcctccccactccccgagaccccccctcctccttcgttttgcaccctccccaaatctgcactactcccctctccctcgtccttcctccgccccgccccgcccatgaggatcaggaggcggcctccgggccagcctctgccctactcctcctcggtaacaaatgattcggccgcggatctcggggacggccgctcctcctcctcctcgtcggcgctcatcaggcgcccggcattgtcgccgcaggacggtgcggtggagcgcagcacgggtctggtgggtgcgcaacagcagcagcaacaggggcatgcagatggccacagcagcctagagaacggactccatcgccacgtgccggagccggtgacgatgccctgcaggccggagagcgtctctgcagcggcaacggcgtcggcgcagcagtggcaatggctacggacgacgacagcaacagcgggcgcgaaggccacgaagcagcggcatcggcagacagagacaaataagcaggacaccggcgncggcgtgaanagggcggcgcggggcccaggcgtgctgatggaggggtcgcggtgcagccggaagaacggccgcgggtggcgctgcagccagccgacgctggtgggctacgcactctgccagtaccacctcggcaagggccgcaccaagagcgggagcnccgtggacgggggcgggcgcgggcgcggccccggccagctcggccgcaccgagcacgcgaacaaaacctccgccgccgcggacgtgccgccggcccagagcgtgcagcactgctaggggacgcgagattcttggacatatcgatcgtaattcttttgnngcgtttccaaaaaaaaaaaaaaaa

SEQ ID NO: 19004 - DNA, 1669 bp, Zea mays
agaacaaccgggaccgggcaattcgtccagcagcatggacgcgcctccgccctcacagccggacgatgctgctccggcgccctcctcgaccttggcttctgctccctctccggcgccaacatccaacccacccacttccgccgccgccgccgcacccgccccggactccgccatcgccaaccctaacccgaacctaggtaccgtcgcaaaccctgctcaaaccctagaggctcctggccccagctccgccgccgcgcggccgccgccgccgcgaatgagaacgccttacacgcacctggccgcgcccatcacgatgtcgtcctcctcctctgctgccacagccgcggcctcctcggcatccgttccggccgcatcctcctcggctcctcctataccacgcggaggggttgtcctgggggtgcccgcgccgcgttcctcacagacgcccgctggttacactgggttcgttccgccgcctccgcttgctcaccagtttggatcgatgcatcgaggccccgaccagcccccaccttcatcttcacagagacccccatctcagtctttaatgaggccgatgactgtgagttctccttcgctggcttcacaacaaactccacaaagttcgtcttcaacatttaggccccaacagaggccacaagtttcacaaccaagaccacaacaatctcaacttgttactccacctcaacagaacacaattttaacacagcagcagcagcagcagaaacaacaacagagtgcctcacatcaaaatcaacaaattgctgcccctaaaaatcagccacagctttctcagcatccaactgctcgtactccaatatcaatgacaccaaagcctgatttgcctgctatacaaaatgttgctgttttacaatctgtggatacagctgcaactgatgcaaatgctagtgaaactggtactcgattactcaccaagagaagtatacatgaattagttgcacagattgatcctaatgaaaagctggatcctgaagttgaagatgttcttattgacatcgcagaagattttgttgagtctgtcacaacttttgcttgttctttagcaaagcataggaagtcaagcacattagaagcaaaagatgtactcctacatgcagaaagaagctggaatatcaccttgccaggcttcagtggtgatgaaatcaaactgtacaagaaacagcacataaatgatattcacagggagaggcttgctctgataaagaagtccatggcgactgacacgagaaactctgctgcccaagctgcagctaaccagaaaaatcagactccgaaaccacctgccccagcttccccgtgaaacatgtccacaggccctgcaaacacagtatcagtgtaccacgcatcacatctgtggtgttcggacagttgtcggttgtatgttggtagtgttgcaatgagtacatgtatagattattctgtcgttactcgttactaggatctggttagaatgttgtttagttaatccaatgcatggtttctattattgtatatcacttctgttctaaactataaatcatttagggctagtctaggagccacaaaacctgagtggattgaagggattaaaatcccctcatttaattttaaataagaagggaaaatatcatatacaaaaaaaaaaaaaaaa

SEQ ID NO: 19005 - DNA, 4275 bp, Zea mays
tagcttatgtatcccgaaccaaagtgtatgtattttcgtcctcccatttttattcgaacagatgagttgtcttttttttacacgtaaaaattgtcagcaaatactgtttaccgtactttccatgagttaggatttgtggccttttcatgaccctgtgggtgagattttcggttattaaataaatattttgggggaggctttccccaggagtccttaagacagcgttttgaaccacttaacagaaaaaggtagctgagatgagaatacccatttgtaaaaaatttcaggctatgcatcagttagattagaaagttgtaatctgaagtacatgtccctgagtacctcagagaaaaaaggcagggagaagtacatagcatctccaactaactgagacattatatgaatctataaaccatggatctcatggatctaaacattgaagaggtttgtactttgtagccaaatttttacttacgaatggcatatacagtcgcagaagtccttgtgcttcacaggcaaataattcgtatgtcacccattcctttgtcagcgtgtttgtcagagatattctgcaattgtttgtctatattgtacttgtaacaaactcgggtattatttgacattactcaaggaagccgaaaagcatggaatgtgtcttgaagaagtgaatggaacgagaacaaccatctcaaatcttggaggagtcatatttgacattaccctgaaatgacactctgacctttgactcgcctttgtcaaaatgcttgggtggttatttgtcaaaatgcgggtaattcgaagttccgcattatggtgagctggagatgtggcagttgtattgtatctctgtagaggaggaagcactcactacctcgctgtcacagtaagaacactacccagtgatggtttttgattgatatgccgatttggtgtggccttctactgtttgaccactccatccttttagctaatataagatataacaatcgtcaattcactagcagtgatgttacaactttctcagactatctatcggtgagatgaccagactctggaagttgtggcaaagagttgccgaaagcagcggcatcatgtatgagttgcagatgctcgtctgaattctgaaaaaggctctggattaccatgagctcgtgcttgatgcagtaccatgttacatgtaaaacacgaatcgaacagaaaccatcagcaacccaccaattttccgccttgttctctagcctgttcttggttctttgctacatcgatctgtaagcttgccgagacagcttgtcaagacctccctgacgcaaccttgtcacttgggcgtcgggacacagttttatcggctttcctggacgcagcctgaaaccagatggccatgttctgtatggatcagagctgtcagtgatgcagtgccttgcctgcagtttgaacaggcctgaacaacgtcgaaatttatggagcgatgatgcaaggtctatatcccggaactgccgggtgttgttgacacataactctagtgttcatgatcatcgggaataacattccactaggttggtattactagatctcataataaaatacgaaaatcaagtataaacccgttccatcattttttatttttgctgtattgctgtcagtagttcgggagtcatgttagagaccgtgtaatgtttcagtggacgtagggcgtcaataataatacgagtagctagctcatagcaaaatttattcagcaagaataagagacacacacagataaaactatgcaatgtaattttgggtttagtttgttctagtgtgaccgacagtgcctcttactatgaggttcactgaacatagaattgtgcttttcaggatcatacaagaaaaggcatcatggctgattagtttcttttggcctctccttttttccagcgcatccgatgctgggagggtgaggtcagagaaaggaggatgccaagaaagagggatgcatccatccaagcaactgaaaggaggagggcaaaagtgtgcacaaaaagaagagcaaaatttactggagggtactgagcctaaaaagcaaaagtgaaatggaaaaaaaaagaggaaggaagcaaccgtgaggtctctcatcttcaccacacaccagttgggtgccatggcaagcaaacagccttctgcagctgcagcatcgttttccattccattgccctgcattgcatagggtttcaggttccttccattgtttactcgctttccatgtctggctgcagagattcccttgcgaaaagcccaaaacatgttgcatataaacacatagagagaggttgattggttggccaatgattgggtgcatacatgagagaagaattccatgccattacattatgcaaggcacatgcctgcctccataagaccatagcaaacatgcatgttgtttagggtgcagcacagttcttgcctgatgataacaaagccattatccatgcaatacattgttacgttgcacgcagagttgtctcgcccaatggccacacagcctcctcttaccttgggataacatatacaggcacagagaatccctgcctgtacgtacacgcagtagccagctactagtagaagtatgcaccaaactctgatgcccaaataccaactgattgatctgatctgatcaacgacacaggcgagatcatttggttgcttgtcaatttatgagatgtatttataacaggtgactggatgaggtgccggtgacaccatccctgctgttctaccagctccagcccagcccaggccaccacaacgaatactttttttgcaggtgaggttggcatgaacaaaatccaactggccccggccggcatggcgacaggacggctaccggccggctcgccggcgccggcggcccgccggttggtcaaaaaggttaataggctcggtctttgctcctgtatcagtgccctctggatggaaaagttggggggcatagccatagacaaataattcggaaaagatgattggaggaactggaaattttgtatgattcggatgtaagctgttgttggaggtggtagtggcatgacatggacgccacagtgatgataaacttgtgaccccacactgccgatctgtggggctcaaacaatatacaagtacctgaaaattgttttttttctttgccgtttgttgtggcagaaactgcactaattgctgtgcttaagcttaacagtgcaactaacaaagccactgaatacaaaaaaaaaaaaaaaaacatggcggcagccggcatgaggttactttcctagttctgggcagtttggtagtcaccagtgagtgcagtgctcaactcaaccatcggcagtggccagcttgccaataaaatataacaggtcaatgggttgagttgttgtagcatgcatgtttaggactggctggaggaacttaaaaagcttcttcaattcgtcacttgaatgggtccccactccccagtgcaagttcatatgagctgtcccgccctatgtatgcgtagttgcgtacatgtccaacagaatggacagctaccatgcttcctctgtgtctgtgatgaagtaccctagttgtacagctacaacaccgaaaagaaagattttctttttagtagagaaaagctacaggtagattgctaggtcgtctgaactgggattttaatgcatggtcatgcatgcagcatgcttctctctcttggttaatctacacatgggttagcccattggttggtagtaaagattgttattagctgtttaacgcgttttttggtagtaaggtagtgtagagacattgactctcaaactgtatcgcacatagtatgtggcagtgaagaccaaatatcaaattatatgtcatcagctactgctagtcactggactccatcagttagttgcaagttgcaaccagttttgcatatcagtggaagttcattcactacttgcaggccttcaaaagagagaaatttgctaaactgtagtgccacagtttttaattactcactcagttctaaaataatagtcgttttagagaattagtgggttcatgcaattttcgatgcatgtgcctaaattcatcatcattcatttgaatatagacatggaaaccaaaagctaaaacgactactattttagaacggatggaatatatattacagccagtactttcacattggagatgacatttacaattaaaaatacattgaatagcttctggtctactgaaagggagtgggtagctttctactctagaatgtcatctgctttgtgc

SEQ ID NO: 19006 - DNA, 1587 bp, Zea mays
caagttttttatgtttgaggatgcaaccaaccaaaccatataccagaagaaacaggggtcatctacacgcgtagaaaaggcaaatagcctcaccgtttttgccgtagagcctcgcatgctgctccacctgcgctcggaaccaaaaacgaatcagcacaaccccacccccaccacattaccagtacgcaaactgaaattcacaagaaaaacgcttcagttcagtacctgcgaatcagagagtcctttggtttgatccacgccgaacgcctcgagcacctgcgagaagcggggaggccagatccgtgagtggcggcggcggcggcggggtggagggttcaaacgaacgcacgacggggttgaagtcggaaggcgctcattacctcggcgacggacttggcgtaggcgtcctccatgggcgaccgccgccgccgctgcctctagggacgccgggcggggggagtgaaggctgtgctagagaggaagggagcgcgcgagccggagaagggagaagaggtgcggctagaactacaaagcgatcgagtctgcgacgtttggcagcggtgtttgcaacggtcacgcccgtacaggagcccggagctccggagcccggaacgggacggcacgcgtggcgtcggtcgcggtcgcgtctgtactcgccaacctttttggtgcggagcggacgcaggaggtgcggcgcgatcgcgggttcagtgcagccagtgagaagcaagcgacccgtccgagagtccaacagcgcgctggctgctgaccttgctttcactgggaaaagctaagtttagcaggggacgaactgaaatatactagtagacaaattgtgtagaattttactttaccagtacagtaatagttgtgttgcgacgacgacagacaatcatttctgataatttatttagacgaagaatttgatcaggataacacaaatggagaaacttacaactaaccaacctagatatcatcgctgtcactgtgtgttaccacaaaaaaatccattctgatagcaccagatactatttgcaaactctgaaatcattcgttgtgaccaactaatcaataggctaacaaatggggaaacttacaactaaccaactttgaaaccattagagcaactttatcaccacgcattaacgaaaacatttattatgtgggcaaaatggaaaaatagggatcacgcatagttctggcacaagaaatccaaacatcatagggatgctagataaacacttgttactgtagataaaatggtcgaaaacgaacggaaacaaaaaaacaagggttgaaatacgggatcagaattgttggttatttaaaaataatcgaaaataataaactgtagtcgaaaagacaaatattttatcattttataaatacataataaagtgacatgttgcctgatttttaaggtattaaaatacacatacaactcttttttatcatttgcgtatttagagtaattgtagtttttgtttttctcttatttattcacttgaatgcaataaaatttataacttgcataaattatatgctagatgtatcttgtcggagtgcaaaactctggtcgagtggtgg

SEQ ID NO: 19007 - DNA, 1384 bp, Zea mays
ggcacgtgtcgcaagaagcctcctctttcggaaagcaggacacgtgctccttgtcgtcgccggacgtgtcaagtcgccaggcgtataaagtgttcagccgacctcccgtgccatgcctcttgttttgtactcaatcgtcgtcgtgtacgccaaagataggaagagcagagcgcaaggatgccggctagcctggtgacgtcgtcgctcctcccgccgtgccgcgcggccgcgacgtcggcgcgcgcgttgcgttcgttcgcccgccggccgccgccttcgtccgccggtctcgtccgcgtgcgctgccacgctgccactccgccgccgccggaggtcccgggccagacgacgccgcccgaggtgcctggcacggaccgccagccgctcgaggtgccggggacgaaccgcccgccggacgaggtgccgagcatcgacacgccgccagagttcaacgcgccgccgggcgtcgacgtgccgatgccggggcagccagcgcccggaccggagctcccgggtccggcgatgccgtcgccgccggcgccggaggtccctgtcgtgccgcccaaccccgacgtaccgccgccacagctcccggaggtggacccgcccagtccgccgcccgaggtcgtcccgccggagccgccaggcaccgcgacggcgccgcctccctttgtgtagctccgtggctccgccgccgtcgatggcgcgggccggtggcaggtggacagggcgggcggcatgcgaatgaaccacgtaggagtgtacaaagtagttagaaggcatgttgttcacgggtcacggctgggcaagtttgctattggttcaaaaatggacctatcaaagtcgaggacgaccggtgccgtagcttagctagcttggcgtgatccgtgatcgtgagctcgtggcaatggcgctcgctgagcgcccacggtggtgtttggtttgctcgactaaacttgagttcgtctcactattattataaaactaactgcgccactaccacccattgtttggtcggagcgccgggactcgcaaggtcgcaactcgaattcaccctgttcttccctctactgactcgcgttttgattcgtggtcgtgtctgccgtgggcctgtgccggcttccgccaatccgaattgggcattttgtagctgtgctgctcgtaacgggcctccatcgcttaaaattcgctttgttttttaacctaaattttgattaaaatttacatttagactttttggatgacttagggggtgtttggtttgtagggactaatccctacatttattccattttagttccaaaattaccaaatatagaaactaaaactttattttagtttctatatttagcaatttatagactaaaaatgaataaaatgaagg

SEQ ID NO: 19008 - DNA, 1415 bp, Zea mays
  misc_feature (2)..(2): n is a, c, g, or t
tncgccactctcgagagggccacacacaaaaaccccaatgcgagcgcccctggcttgtcggcgtcgcctccttcagccaaaaccctagcttgcatacgcgcccgaacaaagcttcgtctgcgaggggcgtcctcctgccgccagaagctttcaggagcatcagcgatggtgtggttccaatgcgaggactgtggcgagaacctcaagaagcccaaacttgccggccacttccgctcctgctccgcgtacaagctgtcatgcatcgattgcggcgagttattcagccaggacaccgtgcaggggcacacgcagtgcatctccgaggccgagaagtacggtcctaagggacagaccaaaccatccaatggtgcacagggtaaggcagataagccaaagccaaatgcagatgtcgatatcaatgttgggctgtcgacacggcctccttggttctgtagcctatgcaagaccactaccacaagcaagcaaactctcttactacatgctgatgggaagaagcatagggcaaaggcgaaagccttccatgtgtctcagaaacaaaaagatggtgcagaacaaactccagatgtgaaggaagctggagttgtacccacaaaagaatctgctcaagtaaatggtggcgtgagtggtgatcatgaaagaaatgaagataaagatgctgggaaaaggaaacgaatggatgacatgaccatagagccaggtaacacaaaaagacagttgacacagtctggagatgagaagtcagaaaacaaagcgaagagtaaggccgatgaactagcaagtggtactgactgcaaaagtgttcaaaagcaaaagatcaaatggaagaagattattactaaaacattgaaggcgaacgcagatggagttatgaagctaaagaagctacaaaagatagtctccaaggagcttcaggaatgtggtgtctccaaagacaaggaggagctccgtgctaccttgatggataaaatagcttcaagttccagattttctgttgatggcaagaatgttagactggtggccaagaatgaagaagaatcttagaaagaggttgtcagtcattttttggcattgttgctggtttcattctttggtgtcaactttcagatggcttatagccaagtgttggttaaattgagtccatgaaccatcaattatatccatgacctgtagacggtatgggaatttagcatctgaattttctcgacaaccgttcaaaagtgaaatgtttactctttatgctgtcaagcaatggcaatgatggttgataaaaaaaaaaaaaaaacagggggcggccgccaccgcggtcgagtaccggtcattggatttgagtaagggagaagatgttatgtagtgctctgaaccatcgattttgatggtgtgataattctgggtgc

SEQ ID NO: 19009 - DNA, 2074 bp, Zea mays
gatggagtgaagtctttttcggaacttctctcttcattcacgcgacatgacttgtttgctcgttcaagccatccatagaccgtagcccgtgttgggttggggccagaaggggcttgtagttctgttcttgtgcttgtggttaccaccgaccgagctcatcttctgatcgtttcccagttccccaaaccgaacaggatgaattggtacattgcagctggcactactacactcgagtaaggggaggagatggctggacagagcaaaaggggcacgcagtcgcagctggacaacggcgagcaggtccacaacggcaagaaggcgagggcgcaggccatgcccgacggcgtggtcaagcgggagcagcaagagacaggcgaggcagcggatgagggacaagagcaggaggaaggggaggttagccaaggcggcggcgcgggggccatggaggaggcgcagatcagtttgaggttcgggctcaccttgttccactgccgatcttgcctcctccccctcaagcctccaacgttcaaggtaccccgttgctctgctctcatcgtcgtcgacatgtcatcgacatcaatgccgatgaaaactaagacctagtttgtccaatcccttacattacagctcaatccaccctcgatacatgtggattggacacaatactaaagtatcacactctaatccaggagtataaggcctagtttgggaaccccgattatccaaggatttccatttttctatgagaaaataaactattttttcatgtgaaaataaaaatcacttggaaaatcgaggtttccaaactaggcctaaagatatttttttttcttcctcaagagaagcacggacctttcgttttgttgatgacaaaataaaacaagatgcctctgttccggccgtgtttctgttctgcagtgcgaacacgggcacgtgatatgcggcgtctgccgcaatagccacgcgcaggtgtgccgcggcgccgtctactcgccgtgcgtggaggtggacgccttcgtgcgcgacgccaagcagccgtgcccgtacgaggagttcgggtgcaagagcgccgtggtgtacttcgaggcggcggagcaccagcgcgcgtgcccctgggcgccctgctcgtgcccggccccgggctgcggcttcttcagctcgccggcgaggctggccggccacttcacgggcgcccacgcctggcccgtcacggaggtaagctacgggaagccgttcagggtcgcgctgccgccgccgcagggctggcacgtccttgtgggcgcggaggaccggtgcgtgttcctgtgtccgcgtgcgcgctcggcgtgggcgcggccgccgcggtgtcgctcgtgtgcgtgcgggccaacggcgacgcggcggacggggcgccccagttcaggtgcaggctctgggcggaggccgccaacagcaaggagagcgtggtggtgatgatgtccatggtgaagagcagccgcttgtgcggcggtgctggcgcgttctcggccgccgaccagggcatgttcttcgtgatgccaccggagatcatggacgacgcgttgggcgagacgcccgccgtcatggttcgcatcgacagagcaggcgctgctgccagaagctctagctctaggagagtagctgagtaggaggcattgcatgtaattaggcgctgctgccatgagtgctttgaacacgagaatgcaatgcaagtgcaagggatctgggccatgacatgatgcaccactggtacactaatacctatggtacgtaacttgtgactgtttgttgggggaaaaaaaaaaaaaaaatgttttgtgaatgtgaaccatggtgctagcatatgcaggttcagcgttcaagaaattcattagcgctatgcagtatagatggccccagacggacggcacggcccgatccgccgagtccgatttggggtctgacacaacaggcacgagcacgcctgtccatttacttaatcgtggcaggctgagccgcctgacgtgactgggactaggcccaagcacaacatggccagttcctacacgtgtcgtgccggcccaattactcgacagca

SEQ ID NO: 19010 - DNA, 1405 bp, Zea mays
gatggagtgaagtctttttcggaacttctctcttcattcacgcgacatgacttgtttgctcgttcaagccatccatagaccgtagcccgtgttgggttggggccagaaggggcttgtagttctgttcttgtgcttgtggttaccaccgaccgagctcatcttctgatcgtttcccagttccccaaaccgaacaggatgaattggtacattgcagctggcactactacactcgagtaaggggaggagatggctggacagagcaaaaggggcacgcagtcgcagctggacaacggcgagcaggtccacaacggcaagaaggcgagggcgcaggccatgcccgacggcgtggtcaagcgggagcagcaagagacaggcgaggcagcggatgagggacaagagcaggaggaaggggaggttagccaaggcggcggcgcgggggccatggaggaggcgcagatcagtttgaggttcgggctcaccttgttccactgccgatcttgcctcctccccctcaagcctccaacgttcaagtgcgagcacgggcacgtgatatgcggcgtctgccgcaacagccacgcgcaggtgtgcagcggcgccgtctactcgccgtgcgtggaggtggacgccttcgtgcgcgacgccaagcagccgtgcccgtacgaggagttcgggtgcaagagcgccgtggtgtacttcgaggcggcggagcaccagcgcgcgtgcccctgggcgccctgctcgtgcccggccccgggctgcggcttcttcagctcgccggcgaggctggccggccacttcacgggcgcccacgcctggcccgtcacggaggtaagctacgggaagccgttcagggtcgcgctgccgccgccgcagggctggcacgtccttgtgggcgcggaggaccggtgcgtgttcctgtgtccgcgtgcgcgctcggcgtgggcgcggccgccgcggtgtcgctcgtgtgcgtgcgggccaacggcgacgcggcggacggggcgccccagttcaggtgcaggctctgggcggaggccgccaacagcaagtagagcgtggtggtgatgatgtccatggtgaagagcagccgcttgtgcggcggtgctggcgcgttctcggccgccgaccagggcatgttcttcgtgatgccaccggagatcatggacgacgcgttgggcgagacgcccgccgtcatggttcgcatcgacagagcaggcgctgctgccagaagctctagctctaggagagtagctgagtaggaggcattgcatgtaattaggcgctgctgccatgagtgctttgaacacgagaatgcaatgcaagtgcaagggatctgggccatgacatgatgcaccactggtacactaatacctatggtacgtaacttgtgactgtttgttggggg

SEQ ID NO: 19011 - DNA, 2655 bp, Zea mays
atatttaatttgttctataaaatttgttttgaatttcggggcaaaaaattgaatttcagcctttttataatttcatcccgtccgaaatgagctcggtaagtttaaccaattatgtgccaagtcatgggctggtccggctcgtcctaaattcaaacgggccggcccagcccaaaatttaacggaccaaccctttttaggcttgggtcggatcgggcgatccgaatatacacatataactatagttactcgtttctgggtactcgacaaacatgcactctaaatctttcaactaataaattagccaaattaataatctttttagtttgcatgctagatatttagattcatataaaaatataaaagtactttaaggtggaatttttttattgataatataataggaaaaatatgaatgttcaaagttttgctttaaggacgataccaaaaaattatacgttgtaattaatggtctagacagagtaagacagatatatggacatgtatatccaagagagcgattcctccgttgtattatataatctaggtagattataatttcaaacaaactctataattctttaatcacgatctagcctagttgggcacggattcgcgcattggccgggcaaaaaattaaccagcaaatcggagcaggcccatgtgaccagaccataatcaaccatccgccacgcacttcatgcgctgcagctgctagggcaaccagcttgtctgtttccaataagctagccgccggctaaacgaggacagacacgccgtgcttgctaaatatatgtcacttccgaagcagctgcccacacaacgaagtcacatgccactgtgctccactactactgggcgcgcggtcatgggatcactggcgacggcggaggggcagcggccgcacgccgtgtgcatgccgtacccggcgcagggacacgtgacgcccatgctcaagctcgccaagctcctccacgcgcggggcttccagatcaccttcgtcaacaccgagttcaaccaccgccgcctgctccactcgcgcgggcccgacgcgctcgaccgcgtgcccgggttccgcttcgacgccattcccgacggcctcccgccgtccgacgccgacgccacgcaggacatccccgcgctctgctactccaccatgaccacctgcctcccgcacctcctcgcgctcctcgccagggtcgacgccgacgccgggtccccgccggtcacctgcctcgtcgtggacgccgtcatgtcgttcggcttcgacgccgccagagagatcggcgtgcccgtcgccgcgctctggaccgccagcgcctgcgggttcatgggctaccggaactacagaaacctcatcgactggggcctcgtgccattcaagagcgccgcggacctccaggacaacgtcggcggcggccacctcgccaccgtggtcaccggcgcgcgcggcatgtgcgacggcgtgcagctgcgcgacttccccaacttcatccgcaccacggaccgcgcggacttcatgttcaacttcctcatgcgcgagtccgagcggctgtcgctccccgacggcgtcatcgtcaacaccttcgaggacctcgagggcgccacgctggacgccatgcgcgctatcctcccgacggtgtaccccgtcggcccgctcctcctccgcgagcgcctggagatccccgctagcagcccgctcgcgggcctcggctccaacctctggaaggaggaggaaggcctcctggagtggctcgctggccgcgcgccgcgatccgtggtgtacgtgaactacggcagcatcacggtgatgaccaactcgcagctgctcgagttcgcgtggggcctggccaacagcgggtacccgttcgtgtggaacatccggccggacctggtgaagggcgactccgccgtgctgccgccggagttcgcgtccgccgtcgagggccgcgcgttgctgacgacgtggtgcccgcaggaggcggcgatccagcatgaggcggtcggggtgttcctgactcactccggctggaactccaccctggagagcctctgcgcgggggtgcccatgctgagctggcccttcttcgcggagcagcagaccaactgccggtacaagcggacggagtggggagtcgggatggagatcggcggcgaggtgcggcgcgacgaggtgacggtcgttctaaaggaggccatggacggggagaaggggagggagatgcgccggcgcgcagaggagtggaaggagaaggccgtgaaggtgacgctgccgggtgggcctgcggagactaacctcgagagggtcatccacgaggtgctgctctcccagaaaaagggatagactgccaacgcgtgatcgtcgtggactcgtggggagtatcatgttcgcgagcatcatgccttgcccctcgctttgctgtgttttcttatttacgtgtgttagctttgaataattaattatctcaactttcagctctcaaatgacaaacctcaaaccccagctctccgctgaaaggttgtactaatatttttatcataacattttttttactagtttcagtgagtggtggtttcaaaattttgcaacattgaactatagccaggctccgtcactacgcagagtaaggggaatttactatgttcggctgcctgcag

SEQ ID NO: 19012 - DNA, 1336 bp, Zea mays
  misc_feature (726)..(726): n is a, c, g, or t
gttgtttaaagcttaccgccgacgccctcctggggggcctatcggacgatgagttcgacctcatctttctaccgggtgggatgcctggttcttccactttttggagaatgcaaagttttggagaaaatggtcaaaaaacatgtagagaagggcaagctttatgctgcaatttgcgctgcaccagcaatgactctaggaacttggggcttgcatcaatggcttaaaggcaacatgatatccttcgttcattgaaaaaccttccttcagaggtacatgcttgtggaatcaagaagtgcagattgatgggaagtgtatgaccagtcgtgtgaccgggaacagccatgggagtagttctgttattttaggcttgagcaactatatcggaaaggcaaaaagctaaagtaagttgtctgggcacaatgggttatgtcgctcctacagcatgggtgtgggtaattctctatagaaagaggtcgaattggagggtggtgggggagatgttgcgtaggaacaaccacaatattactaagtacacgcatcgcttaatggcgacagtaggtagaatggaagtcaactatgtataatctgacattattgccgtaggggcgataagacaaatgttagttggtctagcctacctttggaaagcacaagcctagaagaatatgttgccatgccaggaaagtgtgaacgatgaattgcatgatgtgactgttaggatgatgnctcttaaggagcaatatgatctcattctgatacctggaggactgggtggtgcacaagcatatgcaaaatctgataaactaatggatctgatcaagaagcaagctgaggcaaatagattgtatggagctatatgtgcctcccctgcgattgctcttgaaccacatggcctactaaagggaaagaaagctacatcctatcctgctatgtggaacaaacttgcagaccaaagcgaatgcaacaacagagttattgttgatggtaacctaatcaccagccaaggtcctgggacttctatggaattctcgcttgccatagtggagaaactctttggacgggagagagcccttgagctggccaaatccatggtttttatttgagttgaaatggtacgtgtacgtattacgtattaggtttctggagtatgtacttgtgtaaatcgaggcatgctatgttctttttcttgtggaatgtacttcaaattcccttttaaatagaaataagacgaacacttgtaatgtgttccatatgcagtaaaaggtttgaggcaaacattaagcgaagacaaaaatgaacctcacgttctatgaaatctttttgctcgtttgaagct

SEQ ID NO: 19013 - DNA, 1635 bp, Zea mays
  misc_feature (1634)..(1634): n is a, c, g, or t
cccacgccgccgcccgcccggccgccctcgcgtccggaaaaccactcgttgcttctggaacaccaccgcgaaagcaaaggaataacgagccgaggaaatggccacgcggtcactcacctccgcacttccgctctccagaaccccgcgcgtcccctcgcatcgtccctctctccgccgactccaaaccctaacccgcgcgcttacctcctcgtcccctcaggccatggcgtcgtcccctacccccaagaaggtgctggtcccgatcgcgaatgggacggagccgatggaggcggtcatcaccatcgacgtgctccggcgcgcgggggccgatgtcgccgtcgcttccgtcgagccgggggcgacgtccgtagctgcctcatggggcatcaagcttaccgccgacgcgctcctcgccgacctcgcggacgatgagttcgatctcatctctctaccgggagggatgcctggttcttcgacttttggagagtgcaaagttttggagaaaatggtcaaaaaacatgtagagaagggcaagctttatgctgcaatttgcgctgcaccagcaatgactctaggaacttggggtttgctcaatggcttaaaggcaacatgttatccttcgttcattgataaacttccttcagaggtacatgctgtggaatcaagagtgcagattgatgggaagtgtatgaccagtcgtggaccgggaacagccatggagtattctgttattttggttgagcaactatatggaaaggaaaaagctaaagaagttgctgggccaatggttatgcgtcctcagcatggtgtggaattctctatgaaagaggtgaattcaactagttggaatgttggtgaaacaccaaatattctagtaccaatcgctaatgggacagaggagatggaagcaactatgataattgacattttgcgtagggcgaaagcaaatgttgtggttgcctccttggaagacaagctagagattgttgcatccaggaaggtgaagatgattgctgatgtgctgttggatgatgctcttaaggagcaatatgatctcattctgttacctggaggtctgggtggtgcagaagcatatgcaaaatctgataaactaatggatctgatcaagaagcaagctgaggcaaatagattgtatggagctatatgtgcctcccctgcgattgctcttgaaccacatggcctactaaagggaaagaaagttacatcctatcctgctatgtggaacaaacttgcagaccaaagcgaatgcaacaacagagttattgttgatggtaacctaatcaccagccaaggtcctgggacttctatggaattctcgcttgccatagtggagaaactctttggacgggagagagcccttgagctggccaaatccatggtttttatttgagttgaaatggtacgtgtacgtattaggtttctggagtatgtacttgtgtaaatcgaggcatgctatgttctttttcttgtggaatgtacttcaaatccccttttaaatagaaataagacgaacgcttgtaatgtgtttcatatgcagtaaaaggtttgaggcaaacattaagcgaaaaaaaaaaaaaaagaaaagaacaaaaaaaacggagtttgctcgtttna

SEQ ID NO: 19014 - DNA, 3307 bp, Zea mays
agctctgtgcgactgtgccgcgtgtggccttggttctacactgcctcatggtcatggaaatgtcgatatggccatgtcgtgctgtgtcctcgactccttggacgcgatggtggtgcgcgattgccccgtcgcacacttcagaatttcagatgacggatcgtcggctccccaatcattctctgtcgttgacatggccaggcagctctcgctgccaccgcattgatgcgttggacgctgccggctaccgggtcccggctgcaggacaacgggacgcggcacgtcacatcacatcgcccttgtgctacggccacgccgcgtcggcgtcggcgcccccgtcgattgatcacacacggacacggccccacgcacacggaagccgcgcccgcgcgagtcgccttgccgctgccgcacgctaggtgggcaggtcgcacgcctatctggtgggcgtgacgcgccgcatgccgccgtgcgcggccagtcgaacgacgtgacgaccaggcgaccagcgttcaccgtctccagaagccaaattccatttcggcccccgaaacaaaaacattattaccaagaagcggacacaggcgaaccattggagtccacggcggcgcgcgccgcccgtgaccacccgacgcatcgcagccgtccagcagccgaaatgggggacggaagggaacggaagcccaccgcgaaattttacgggtcgcacgtcccgcgccgcgcggcgtgtcggtcaaggtgcccccacgcgccgcggttggcgccgccgccgctgccgcccaccgccgcccgcgtgcgcccaccgccacctgttgccgcctaaggggaacgcctccgttataacccaacgcttcaccatccatgccgtcctccaccaccgcttcaccatcccctccaggcccaccaccaccatggcctctccttccccttcttcccccgcccgcgcctccggccgccgcgtgccgccgccgtgctggacgaccgacgagaccctcgcgctcgcgcgggcctacaccgcgcgccgcctcgccgtcggccgggagcacctgacctccaccgactgggccgccgtagccgcggccgccccgtccaagaccgccaggcagtgccgccacaagatcgagaagctccgccgacgcctccggtccaaccgccgacgcccatgcccgctcctcgacgccatggatctcctcgacggcccttccccgcccttcttttccaagtcccagtcccgatccacgtccctgtcctcgtcgccgccgccaccggcggcggtttccacgccgtctcccccttcccctcccgcatctccgcccaggaagaggcggcgggacgatgcctgggacgaggacggtgtgagcgacgtggtgggtgctctgagggccatcggggagggtttcctgcgggcggaggagaggaggatggaggccgcacgggagacgcagaggatgcggatggagatggcgctccggcacctcgatgcacagaggaggctcatggacgcgcttgtcggccgcatcatcgacgccttggactgaagtggtggcacaaagatgtttcctctcaaggtttcttgcctgtcctcgttgcatgctgccttgcgaggagtttaggagtttcttagtgctgtttatatgtagtagttgtgatggatctgtgatgtagttgaaccggacaagctttagtgttttttcagtcttgcatttgctcgaaaggagagtttcttaaaaaaaaaaaaaaaactgttgcacgtctgtcgcctacttgtctccttactttcatgtatcacgcttttaatttgtttgatttttatgttctgatgaaagtgacatgtatactactgataacctagggatgttagaagattagcattgagttctcataacaattatgtttttgggctctggacttgtaattccttgaagagagagaacacaattgtcactgctacattacagacttatacatcattaaaaaatgtctctgctaccttggctcctgcagcacttggacaataagaaccggagatgtgttattttaatgtcagggactgtatttttttagtcctttgctagtgcctcaacctgtcaactgtggtccgtgaggctaatagtattatttacatttttcatgtgagatcctgaatgaaatttcaatactgagctcaacctatatgttttgagacagtcatgccaaggttatattttcagttatgtacctggcagaatacatctgtttacttcttgattttttttttgctgtatgaagatgaaaagtctacaatctgcatattaattgtactattgaagaaactcaatattctatgcattgcatctctatgaatagttgcatgtcctgaagtgggatatctcgatgactggatggccatattggtactcaacatccgcacattaacattccttgtgtccatggttgctgcatccaatatacattttgatgaacaatcaaatatcctcaagatggggtcaacagatttcttttcagaagtgagacaaaagtttgcacacacctcttgtatgtagaacacatgttttcttcaaatatgccactcaaaatttacaaaattagatagctagtttatttggatgccactgaactagctatctaattttgcaaaatttgagtggcatattttttattgtcctacaaacctattggaaaaactgaagttggattcttctacatgctcttctttatataatgaggttattcgtgaaagacaagttctacttgaaaaattgcacggtataaaaaatggatacaactcttagccacatgaattatttatgttgattacaggtccttcgttagatatgtggcagtgctgataggctgtaatcccaacctttatcttatcttttattgaccacctttttaaagaaaataacttctacggataatatagtgccttctttattacttttgtatgcttccttttgcatctaacatttctatttgtaagaataaacataccttgtcattgtgtttctcctttggatccttctcatctccacacaaagtttctgcgtgcacatgtgttatgtgtacatgaatttgtttgctactgaccggtggtaacttttcttttgttctcatttttcaggagattcaacttagattatgactataattcttcacatactactcatgtttgatatatgtaatttgttcatcttcattgtttttgcggggggaaagccacatttttgtggcttcggcttctaagtgaaaacagcttcatcttcattgtttttttgcttgtgttttggcttcaccaagcacataaggg

SEQ ID NO: 19015 - DNA, 702 bp, Zea mays
gaggctcggccgggaattcgagttcaatccaccgcatcatcaccccacgcaggtagggttttccttcctttcggcctcgccgcgtcgatctccgtcaatccacccgcccgccccctacccaaaccctagggcttccaaggtccaagcttgccgttgatggggcgcaagaagaacgtcgccatcgacgacgacgagtacttctttccgcaggacgacgcggccgacccagccccgcccccgcccgcccccgccgccgccgacaaagagaagtccaagaagggcggcaagaagggaaagaaggggggcaaggctgccgcgcccgacgacgacgactacgagccccctcccccgccgccgccggccgccgacgaggacgatgacggcgagcccatcaacctcgtcttcaccggcaagaaaaagaagaagaagggcgccactcccgccgctcccttcagcgccttcagcgccctcggcgaggagggcgaggaccaggatgaggaggaccccgccccgtctgccgcagccgagccggaggccatcaacgatccggcggaggacgacgatgacgtcgtcgatttcgatttcagcaaggccaagaagaaaaagaagaaggacaagggacctcgctcggcacctgccaaagacgaggatgtcgagcctgctccgccacccccacctgtggctgatgaggaggatgaggag

SEQ ID NO: 19016 - DNA, 1007 bp, Zea mays
cccacgcgcaactccattactccgcgcgcacctcgaggccggccgggactctgtctcttcctcagtcccggcatcagcgctcaaaccctaacacgccacgcgatcccgatgcgcaggggtctgggcagcgaggcatcgttgcgccggcggcgcgggccggcgcggctttgggtggcagtggcggcgctggtggtcggcaccgtgtgcctcttctcctcctcttcggtcggcctgttgggcgcctcttacagggtccaggatgttgatgtaaataagttgtggagaactgcagattcaaatggttggagagcatcttctgcaccacgcacctactggcctcccccaccaactgaatctgagagcaatggctacttgcgcgtccggtgcaatggtggcttgaaccaacaacgtagtgcaatatgtaatgctgttgttgctgcacggatcatgaatgctacactggtgctgccagaattagacacaaattcattctggcatgatgaaagtggctttgtaggtatttatgatgttccccacttcatcaagacactgaaatatgacgtccgaattgttatgagcattcctgaaatcactacaaatggaaagaccaagaagctcaaaggccagcagcttcggccaccaagagatgcaccggtatcttggtatgcaactgatgctttggagacgatgaagaagtatggagctatatatttaagtccattttcacaccgtttggcagaagatattgataatccagagctccagagattgagatgcagagtgaattaccatgcactacgattcaagccaaatatcatgaaaacaagcagtgagatagtgaacaagctccgctcagaaggccatttcatgtcaattcatcttcgatttgagttggatatgcttgcatttgcagggtgctttgacatattcaaacctcaagagcaaaaaattctgtggaagtacagggaagaacattttgcagaaaaggaacttatccccatgaaaat

SEQ ID NO: 19017 - DNA, 955 bp, Zea mays
gagttggtaagtataagatctctatgtgcttccgctccgggagccccccgtcgacccacgcctccggagtcacttccatcttattcagtggtgggttcatcttctgcatttggtatttcaagccaaaggttatcaaatggacatttgaaactaccttcttattttggggcaattgcggtgttagtctgcttcgtgtctgctggtttctctcttgcatttgctttcgctatcattccacggcaggttatgccatggacaggtttgctactgatgcttgagtggacctttgtggcattcttcttattgtttgggagttatctccgttttgtctaccggtggggaagtatcagtgcaaaccatgtgggatttagcaattctgactcatcggagaatcatatgggtccaggccatcagcgaaatatgtctgactgcgacatggatgcaacattttactggatagggatggcatctatagctactattactgtactgttaccgactatcttgggcataactgcattgttcacaaagctaggattaatggtcgctggtggtattgtgctggcatcttttatgacatacgcagcggagcatcttgcaatctcagtcttcaacaagggtcaaaaatacaggaatgcgtcaagaactcgaagcttttgtttttaacgtttaagtaaaaaatccttgttgcattgtaggtagttttgtacacaaaaagaatgatgattcatttttaacacgtggcttcctgcccatggcccctttttttgtagcgctgatgtcacgccaacttgtggtaaataggtttccgacattgtttctgtagcacagttggcatgaagattacagacatgttttgggatcgtgacccgcttttactcgcttatattgatgtttatggtgagattgtcgtaaaaaaaaaaaaaaaaaaaaaaaaagaaaaaaaaaaaaaaaa

SEQ ID NO: 19018 - DNA, 2399 bp, Zea mays
  misc_feature (840)..(840): n is a, c, g, or t
  misc_feature (1780)..(1780): n is a, c, g, or t
ctagggctaactttacttttggcccaggccccaactccccaagcccaattgcacataccccttcaattcactttctttctctcgtcaccatcataatggtgcggtctggagctgcttctccgcctccagtggtccagccacctggatgcaggactacactggggacaaggcctttggaaagaagggagatgggtgttactggctgccaggcatctggggcagcttcacagcccagttgtaagggctgtgtacctctgcttgattttaatatttgactaaactgaccaggatatcttggcctattctatttttaattctggttcttttacatctttgtatgatctccttactgaaacataccgattatattatgcaatatcggtttaatggttccttggcgctcctgcagttatcaaatggacatttgaaactaccttcttattttggggcaattgcggtgttagtctgcttcgtgtctgctggtttctctcttgcatttgctttcgctatcattccacggcaggttatgccatggacaggtttgctactgatgcttgagtggacctttgtggcattcttcttattgtttgggagttatctccgtgttgtctaccggtggggaagtatcagtgcaaaccatgtgggatttagcaattctgactcatcggagaatcatatgggtccaggtatgttgaactatgtaacctctcagagttttaccatcctagtattaaacaacttggtcttttgcaggccatcagcgaaatatgtctgactgcgacatggatgcaacattttactggatagggatggcatctatagctactattactgtactgntaccgactatcttgggcataactgcattgttcacaaagtaaggcacctgactgcccccctttgtataaacttttgtcataggtatatgaagaatgtagggaagattgaactgcagtagtttcttgaatattatatagatcccgtgttcagcatttcctgtattatgatgcaagagaagggatctggaacttaaatacttaatattggggattgaggcgaactgagggtgttggtatgtagggtttggtcgatggatgacagctaaggctttacttttgtacttaacacatcatataattaattaggggtcttatataatatgcttaggacaaactagtttcagaagatgagtttgcttcttccatccttatgatggctttgtagtgtggaatgccaaattctggatataacttcaattctagcttatgaatacaactcgagtctagcaactaatgcacataaattcgtctgaagggttaaattatgcttgctagtaaatgtcgagacatttgattttttttcatgccggtaagtgatgagtccaatatgttctttcctttggcaggctaggattaatggtcgctggtggtattgtgctggcatcttttatgacatacgcagcggagcatcttgcaatctcagtcttcaacaagggtcaaaaatacaggaatgcgtcaagaactcgaagcttttgtttttaacgtttaagtacaaattccttgttgtattgtaggtagttttgtacacaaaaagaatgatgattcatttttaacacgtggcttcctgcccatggcccctttttttgtagcgctgatgtcacgccaacttgtggtaaataggtttccgacattgtttctgtagcacagttgacatgaagattacagacacgttgtgggtgcgtgacccgcttttactcgcttatattgatgtttatggtganattgtagtatatcagaaaaaagttacattactgcaataatcgataagtgcaggtaccatcgcaaacctgaaagttaactgcaaccatttttttttatcatgtactccctccatcccataaaataagttatatttttttttggcaaagtctttatattgagactttgaccattaatttctttttaaagtatgacatcaataaataaaaaattaagattatattaaagcattttttaatacaattcaagtatataacgtgcatacataaactatatagctgaattgttggtcaaaattttaaaacgatatttttttccaaaaatatgcacttcttattttatgggatagagtgagtatgtcactagcttttccgtagtaaccttaccaatttagcataaaataccatacaacagaaacatcatagcttctttacaaaacagagacaattctagctcgctctcaaatcaatccatctcgaatttaacaaatacaatacaaatatacaagtactcatcatactattattagacttagggtccgtttgtttccttgtatgatcacataatctagcttattttatatataatctagtttatataatcttatttggtggataaata

SEQ ID NO: 19019 - DNA, 2199 bp, Zea mays
ttgggtacctcgcggccggtcgggcgcggcccgccgggccggacgactcgtaaaaaaatagcgtcttttatcatatccgttgctcgcaaaacgcccccacacgccgccggcgaatcggcgactccccttgcgacgggaggaagcagccacgccgccgtctcggcgcctccccgacgactgcctctccggtctcgaacgcgatctggcccatggtggctctggcgccgttggttcgtgagatctagggttgtcgagcgccgcggagtgggagcggatggggcgccggaagatgtccgcagcggcgccgccgtcccggagctggtccaacgttggcgggagcgtaatccccgaactacgggcaaaacacaaaacggacttggaaaatttgacgctgacaaaacatccaatcagaacattacattttttcctgttagccatgttacaatacttgaaaagattagcaacatatatcctgagaaagagtggtttgttctttctcttaattgttttggtggtagcttccggaatcttgctctctatttcagatggcctgcataagaagcatgtgcaggagttccttaattatgctaaattcgtgttgtggtggatttcattaggtgtggcttcatcaattggactaggttctgggttgcatacatttgtgctgtatctaggtcctcatattgctctgttcactattaaagctgttcagtgtggccgaattgatttgaaaatggctccatatgataccatacagcttaaggttgggccatcatggctcgacaagaaatgttctgaatttggtccgcctgtgtatccagcatcagctcattctgttaggatccccgtctttgatttactacctcagatacagctggaagcagttctttggggcattgggactgcacttggcgagcttcccccttattttatatcacgagcagctcgcttatcaggaagcaagtcaaaagctgttaaggagcttgatgccgctacttccaaagaagatgggacagtagcatccactcttgatcgctccaagcgttggcttctttctcactctcaacatctcaacttcttctctatcttgatacttgcttcggttccgaacccactctttgatctcgctggaattatgtgtggccaatttggtgtacctttctgggagttcttttttgcaactttgattgggaaggccatcatcaagactcatattcagacgctgtttatcgtgtccttatgcaacaaccagctcctgtatcttatggaaaaggagctaatctggatattcggtcacattcctgggttttctgctaccctaccatctgtgattgccaaactccatgctgccaaggacaagtatctatcaccaccgacaccagtctcggcgtcctcacagatggaggagaaaagttggaatctctcttttacattggtttggaactctatagtgtggcttgtgcttctgaacttctccgttaagataatcacgtcgacggcacaggattatctcaaaaagcagcaggatatggagatggaacgcgtttctgattctccgcccccggaacaaaactaactagcggcgcaagtttatttcagctgctagctgcacagattctcctctgcatttttagcaactggttaagcgtctgcagacgattccaagttccaacgattatcaattagtattagtagctattcatctacacagtcaacgaaaacatgggcctggcaactggccgggtgatggctgtgacctcctatcatatcattgagcctgtagtgggcagttcctggaggagaattctactgttcttttttgtttttccggacatctacacggatagacagtagggattgtttgtgtgaagcacggttggcttatgccgagatttagcactggtagatgtttctatttgttttggaaatgctatagaaacatgtgagcattcaacaatgatacgctctgttaagtttgttgtgtattttggtttgcaactggtgcccgaaagagcaaacagtggctccatcaatttcctttggcaagtaaaaccccctatagaagacattgcttgtcctaaaaaaagtccgctgaagcatgtagggataatgtgtatttcaagtgtttgtatttatgctgttataagtgtatagtaattataaacgatgtctttaggcacaaaataattctactggggc

SEQ ID NO: 19020 - DNA, 1978 bp, Zea mays
cattgggtacctcggggcccgccaggccggccggtcaggagagcaaaacgggagagagaatgaattgaaacgaaggcccgcgacgcgaggagcgagggaactaccaccggtctcggcgcctccgcgacgatagcctctccgacctcgagcgcggtccggttcctccctgcgtcagcacgcgagcccttggagcttcgagtcagatcccggcgggcgcccatggtggctctggtgccgttgagccgcgcgatgtagggttttcgcgcgccgcatagtaggagcgatggggcgccggaagatgtccgcggcggcaccgccgtctcggagctggtccaacgttggcggaagcgtcatcccggaacttcgagctaaacacaaaacagacttggagaatttgacgctgaccaaacagccactcagaacattgcattttttcctattagccatgttacaatacttgaaaagattagcaacatatatcctgagtaagggtggtttcttctttctcctaattgttttattggtagcttctggaatcttgctcgtcgtttcggatggtctgcataagaagcatgtgcaggaattccttaattatgctaaatttgtgtcgtggtgggtttcattaggtgtggcttcatcaattggactaggttctggtttgcatacatttgtgctgtatctgggtcctcatattgctctgttcactattaaggctgttcaatgtggtcgaattgatctaaaaattgctccatatgataccatacagctaaaggttgggccatcatggcttgacaagaaatgttcagaatttggaccgcctgtgtatccagcatcagctcattcagttaggatcccagtcttcgacctactacctcagatacagctggaggcagttctttggggaattgggactgcgcttggtgagctccctccttattttatatcacgagcagctcgcttatcaggaagcgagtcaaaagctgttcaggagcttgatgcagctacttccaaagaagatgggccagtagcatcatcccttaatcgaaccaagcgttggcttctctctcactcccaacatctcaacttcttctctatcttgattcttgcttcggttccaaatccactctttgaccttgctggtattatgtgtgggcaatttggtgtgcctttctgggagttcttgtttgctactttgattgggaaagccatcatcaagactcatattcagacactatttatcgtgtccctgtgcaacaatcagctcttgtatcttattgaaaaggagttaatctggatatttggtcacgttcctgggttttctgccacccttccgtctgtgattgccagactccatgctgccaaggacaagtatctatcaccaccagccccagtctcaccgtcatcacaaatgggggagaaacagtggaatttctcttttacatctgtctggaactctatagtgtggcttgtgcttttgaacttcttcattaagatagtcacgtcaacagcacaggattatctcaaaaagcagcaggatacggagatggaacttatttcggattccccgatccaggaccattctaaaactaactagtggcgcagctagtggtgtttatacacagctgctagcagcaaagattctcctctgtagcttaagcccctgcagatgatttcaagttccaacaattagtattagtagttattcatctgcgcagtggacaaaaacatggacacatggtcttggttaacttgtcagttgacgaccttttgtcattgagcctgtacctgtactggcagctcctggtggagtcattctgtttatttttcggacatctacacggataaacagtaggaattgtttatggagcacggttggctttgtgagatgtatcattcatacctgttcctatgtattctgggaacttgaaatgcaatagaaacctgggaggatttaacaaggacaaaaaaaaaaaaaaaa

SEQ ID NO: 19021 - DNA, 892 bp, Zea mays
gcaccagctagtccccccccccccccccaagtccaacttctctccttaagaaactctccttaagaattaagaaagagaccagaaacgaaaacctcatcaatcaaagctcaaaatcgccttcaatggatgctaagatcggacaattctttgactccgtcggaactttcattcagcggcagcgataagatcccatggtgcgacggagatgtcatcgctggatgtgaaagagaggttcgagaggccacagattctggcactgaagatcttaagaaagagtgcttgatgcgattgtcatgggcccttgttcattcccgtcaaacggaagatgttcaacgtggaatagccatgcttgaagcatctcttgaaagcagtgcccctccattggaggaccgagagaagctctatcttcttgctgttgggtattacagaagtgggaattactcaaggagcaggcagctcgtggaccgctgtatcgagatgcaagctgattggagacaagctttggtcctaaagaagaccatcgaagacaaaatcacaaaggatggtgttatagggatagggatcacggctacagcctttggagctgtgggtctcatagccggtggtatcgtagcagcgatgtctcgcaagaaatgaaaaccacaaccatgacttcttctctgtgtatacaatggcagtttactttttttcacatttttttcttcttctttgagtgtgttctccactgcttacttcacaatctatgatatagaaaagtcgaagcaaatagcttcgaattaacattttgcttcgaattaacattgtgccatgtcattaattagcatttatacataccatttttactcaaaaaaaaaaaaaaaaaaaactcgagggggggcccggtacccaatcg

SEQ ID NO: 19022 - DNA, 1436 bp, Zea mays
ccttttcgctttcccacgcttatatatactcctgccatgcaaccgccccatgcaccaccaacgcacctaccagctcaaccacctctgacctctttcggcatcatctctctctcctcagcttgcattgtcaacgacgacaaagcgagcgcagactcgcacaccactctctagctagctctcagcctgcgccctgtggtcggcggcagcatgaatttctcgtcgtatttcttctcctcgtcatcctcggacaagaagtcgtcgtccaagcgccagcagcagcaggcggcgcagccccagacggacgccaacacgacgcggtacctgggtgtgcggcgccgaccgtggggccggtacgcggcggagatccgggacccggccactaaggagcggcactggctgggaaccttcgacacggccgaggaggccgccgtggcctacgaccgcgccgcgcgctccctccgcggcgcccgcgcgcgcaccaacttcgcctacccggacctcccgccgggctcctccgtcacgccctacctctccccggacctcacctcgggcgacaacgccacgcagctcctccagccattctatgccgccgacccagccgccgcgtctctaccaccggcgctcccggccgcaaacggcgcggcgggctacggcggcgccgccggcgactacgcctcctacggctatagtgccgaggacatgtccgctctcatggacgacctcaccatacccgacgacctgaccgctgactacggcgcagaagacgccggcggctccgtggacatgtcctccatgtacggcggcggcggcagcagcgccaatgccagctccgccagcagcggcgggggcgggtggtgcgacgcgtcggagttcagcgcgtacggcgcgtcggccgcctcgcacggggtctacttcgaggaagggtacgtgcacagcccgctcttctcgccgatgccggccgtcgacgacgcctgcgccgacggcttccagctcggcggctcctcgtcttcatactactactgagtactgatcctgatcgtccgtcccgctcggtgctgccttcccggatcgatcgtcgaccgcctctgcgcccgccggtggtggactgtggcgtggtgagttgctgggtgcggctagcagtttaattaattacagtcgtgtgataatactatatattaataatatactcctatgtactgtcactgtattttgtcactttttgggcctccatctccattctctgggtgatcgatgggcctttcgtattgggctgtgtaacatgttctttttttatgctcctttctcatttgtttttttttggcgattgtatcagtcggcatgcactcgtgtgttgctggcgcttcagttcagtgtaatatcttttattacctgctattatatgtacatttgttttctagtgaaaaaaaaaaaaaaaa

SEQ ID NO: 19023 - DNA, 592 bp, Zea mays
ggcactctccaaaccctgcccggaacgcactctcctatatccgccgccatcgtctcgggctctcatctctaatcttcgggttcgcgtcgcagtgtcttccgcccgggctaccaccatgccgaagcagatccacgagatcaaggacttcctgctgactgcgcggcggaaggacgcacggtcggtgcggatcaagcgggccaaggacgccgtcaagttcaaggtgcgctgctccaggtacctctacaccctctgcgtccacgacgccgacaaggccaacaagctcaagcagtcgctcccgccaggtctgactgtccaggagatttaaggtatcaagccacaaactgtgctttttttgcggtgtcagggacgtttgctccagtgttactttagtttgtaggtgggctccattgctgtgtttgaatgaattatgaagtttgagtttgggatgcgaatgatgtgtcgaacctatgagcctgtgttgtaatggttaccccagaccgcaaaggatggcaatctatcataagttaaactgatttccgtgaaaaaaaaaaaaaaaaaaaagccgacaccgcaaccctcgaggggggggccc

SEQ ID NO: 19024 - DNA, 673 bp, Zea mays
gaacgcactctcctatatccgccgccatcgtctcgggctctcatctctaatcttcgggttcgcgtcgcagtgtcttccgcccgggctaccaccatgccgaagcagatccacgagatcaaggacttcctgctgactgcgcggcggaaggacgcacggtcggtgcggatcaagcgggccaaggacgccgtcaagttcaaggtgcgctgctccaggtacctctacaccctctgcgtccacgacgccgacaaggccaacaagctcaagcagtcgctcccgccaggtctgactgtccaggagatttaaggtatcaagccacaaactgtgctttttttgcggtgtcagggacgtttgctccagtgttactttagtttgtaggtgggctcatgaagtttgagtttgggatgcgaatgatgtgtcgaacctatgagcctgtgttgtaatggttaccccagaccgcaaaggatggcaatctatcataagttaaactgatttccgtgattttcgcttcccccccttttgtctgattcctttgttgtttttcgcctgagcctttttctgccacagcaattgcgaactttgacgtggcaatggtggaatgagttatgttgtatcatctttcttgcctgctcgtatttgtaatattgaacagatagcagctgaaaattttgtaggc

SEQ ID NO: 19025 - DNA, 1594 bp, Zea mays
ttttttttttttttttgaacaaaatgttcctttactttgaatcagcattaacggtaaacatagaaaccaacaaccagagaaatgaaaacaaagaaaagttaacaagataacagcaaaagaaacagaataacagacgcaaatctaaggggttgaagttctgtctatttgacctttgggttgtaacatgaacaaaaatataccacctgcaactgaaacattcagagattcaaaagtaccttccattggaatgtttacaagctcacatgcctggagggtctctgcagagagaccattgccctcacttcctaacactaagcacagagactcattcaacagtgaatcagctagttcgttggacagcgagtaggtttctttggatgcatcactgctactttctggatgccctgccatcatcttcatacgatactttgtcaccaatgcatgcaggtcatgccacgtaccagagacaataggaagctgcaaagaggctccacgagctgctcgaatagccttttcattgaaaggatcacaacaagccggaagaaggaatactccatcccatttgaatgcacaagctgatcttatcagtgttccaaggttgccaggatcctgaatcccatcaaggactagaatcctctttggataactgaacaaaccatcaagagcatccccatcctgatggctcccgagatcgcggaaaaggttaggcatgtgcatgacagcaaccgcctcggtggaatcaaccgactgcatcccggacaccttcttcatcaccgcggcgctgacatacaatatatcaccagagaactcgcgcagcgcctctggggcctctacgccgtccaggagaagcaagtaatcgatggcttcgagctcaaaactacacacctccaggataggcgcgaggccgacgaggaggaggcggcggcaggagcgtcggtacgcggcggagagccggagcttgacgcagtgcttcaccagcgggttcgccacgctcgtcacctgcttgcgcttttgcccgcccagggaggaagccgccggcttcgccgtggcagtggccgtagtaacgccggcacgggaagaggacagaccgcgaaggcgaagggggcgctccagatcagccgggaaattggccgccgccgagagcggcgcgggagacggcggggcgcgcaccagtagcatcggggtggcgactggcgagtgctgcgtttgataacttcggctcgtgggcttggcgcccatcttatctgctccgaacagattgcactcaacggcctgcgtgggctcttgaaattattccatccccaaatcaatttcatgattcgtcaaaagcatttgccattcttcgaatgttatttggctacagcggtctggagagttatttttattgctctaaatatagataaatctaataatattaatcatattatagagacatggtaaagtagcaaagaaattgctcataagaaacaaattataattggggtagctgccatagttctggttaatttggttatgccgcaattatattgaatttaatgaaaaacatatacctttagttatgcatgttattctcaaggggacttactggcttaaa

SEQ ID NO: 19026 - DNA, 1044 bp, Zea mays
accaacgggaagttcggccgatcatgaaaacacacacggatgaacccgcgggattggtagccccctgtcaacatctcgatttcgaatttcacccagctccgcacgcgcctcaacccttcctctcgggcggcggcgccggcaaggcggcagccaaccggagcgggagctgcgatgaagaagatcttcggcgccaagaaggacaaggggccgcccccctccatccaggacgccaccgagcgaataaacaagcggggtgagacggtggacgagaagatcaagaagctggacgaggagctagccaggtacaaggagcagatccgcaagacccgccccggcccgtcccaggaagccatcaaggcacgcgccatccgactcctcaagcacaagcgcatgtacgaggagcaacgcaacatgttgtacaaccaaacctacaatctcgaccaagttggctttgctgccgatggcctcaaggatgctcagcagactatgaatgcaatgaaggcagcaaacaaggagctcaagggaatgatgaaaactgtcaaaattgatgaaattgataatatgcaagatgaaatgacagatctgatggacgtgagcaatgagatacaagaaactcttggtagaagctacaacatccctgatgacgttgacgaggaagaactgatgggcgagctagatgctttggagtctgatatggaatttgactcagctgcagtcccctcatatcttcaaccagattctgactttgatgctgacctcaacttacctgctgcaccaagtcgccctgcaatggtcccagcaggcgggctgcaggaggatgagctaggattgccagcggtgcctcgggcatcacttcgcagttagaaataatcttgtgtttcgattttaagttggtgtgaaaactctgtagtttgtgtctgagtctgaacaatctaatgcttttcgtcatggtaatgcttcagtttattgcacttcctgttgctgctgacgtttcaggttccttttttttgtcattctggaatttttcatctgtcacctgtcact

SEQ ID NO: 19027 - DNA, 4189 bp, Zea mays
  misc_feature (202)..(202): n is a, c, g, or t
  misc_feature (4168)..(4168): n is a, c, g, or t
ttttattcggcacgaggtctcatggtgtttgtcagtcataagatggcagcaacaccggtttttgtttcattcttcgtagaaaatgggtgcagcaaaatcattgatgtgggaagaaagtgaagtctaacggcacttataagatcattttttttctttcaggagtttgaatggtttgcacttggaggtattctttttgttttcntggtgtcttgcaggtatgatgccagcaagaggcattttagttcgtggtatctataatgcatctatcattgatcgcttattgcctgtgcagtgcactgttgtagtaatattgagctgaccagcattggttgttggataggttgcttgagaccattatttgtgctttgagatctgcatatgtatgccagctcttgttttcccgttgacccattttgctatcattatcgaagagggctatttctcttagactgttagttgcattctctaactgctaatccattttctaaatcacatcaaaatgattattaaaattactcctatgtactttatatgtcggttatgttcatggttggattgtccgtttaccattatttaattgttttctgcaatttgtgtgatcccatatttaagctcaagcctttcaacattctcattcaataaatcctctgtcagatgacaacagctatcgcccttggagatgtgagaagagaagtgagaatactgagttctctggcaggccacagtaacctagtgcagttctacgatgcttttgaggatgaagataatgtgtatatagttatggagtaagttggcaccctttttttagtatcgagtgttttttatgttctgtactcacatattattgtgttcattggctgaagttctcgttcctgtatatgttgaggctttgggggttgaaactctggagacacgttccgtagatgttgatcctcttgatggattgtttggttatagtctagtcattttggcccattgtcaccgttcaggccaataatattgtgcacacatgcaattctggttacttgatcatcttgagcctactcacctgtttccttatgtttcagattatgtaaaggaggtgaactgctggacaggatattggctaggtacctatagagccaacattaaaataatttccaacttatctaaggatttaatctgctaaggttgtgatttgatttttttccaggggtggaaagtactctgaagaggatgcaaaggttgttatggtacaaattttgggtgtcgtatcattttgccatcttcaaggtgttgttcatcgtgatctgaagccggaggtagggtctgggaaactttggcaaattgtacactggtgctgaacatagactgccactggataccatgactattatgttgttttcccgtatatttgctattatttccatggtgctaatattgccgagtcagcgccttttttcctcatgtatggtgatttgtgcatcccttttccagaatttccttttctcttcaaaggacgaaaactctcccttgaaggtcatagattttggcctgtctgactttgtgaagccaggttagtctcatttagttacatgaggattcatgtgtactgtttatccttgccagattaaacagccacagtgtcataacgccaccattatgttctgcagacgaaagactaaatgatattgttggaagtgcatactacgttgctccagaggtgctccaccgatcttacggcactgaggcagatatgtggagcatcggagtaatcgcctacatcttgctatgcgggagccgacctttctgggcgcgcacggagtcaggaatcttccgggctgtcttgaaggcggaaccgagtttcgatgaggccccatggcccactctcacagctgaagctaaagatttcgtaaaaaggcttcttaacaaggattaccgcaagaggatgacagccgcgcaagctctgagtaagtgcaagattagctccgcgttgttgcacgccgctaccctgctgtgaaggtgcttaacggttcgctcaaataaacgatgactgcaggccatccgtggatccgtaatgctcaacaagtgaaagttcctttggatatgatcatctataagctaatgagagcttacatcagctcgtcttcgctgcggaagtccgctttgagggtatgcatgtaaccaaaccttagaaagagtgcgcctaggaactaggattcactttttggtctgtagatgaatgttccctctgcataccttgagttgatggtattacacagctaatcctttctatggattctgcaggccctagccaagacgctgacgacgaaccaactcttttatgtaagggagcagtttgaactgctgggcccaaacaagaacggctatatctcattgcaaaatctgaaatcggtcagtaattagttttacgtttctcgcgcttcactgtctgtgtatatatatatatatatatttctctttcacctatgcaattgctcaaaggtaaatggaacgtgcaggctttagtgaagaactccactgacgcgatgaaggactctagggttgttgactttgttaacacggtaagtcccccggagacccagactaccttctgttctaagtagtgttggtacatgagatgtctcaaacaaaccgcttactggcgtttcgtcgcggcactaggtgtgcactcttcagtacaggaagctggacttcgaagagttcgccgcttccgccatcagcgtttaccagatggaagccttggagacgtgggagcagcacgcgcggcgtgcgtacgagctgttcgacaaggaaggaaaccggcccatcgtgatcgaagagcttgcatcggtacgactccgatccatccatctgttgagacaaacaactgggttcactggacatcgcgtcgctcacgttgataagctttggtttggcaggaactcgggcttggcccgtcggtgcctctccacgttgtcctccaggactggatccggcacgccgacgggaagctgagcttcctggggttcataaagctcttgcacggggtgtcgtcgcgctcgatccccaaggcctagccacgcgccatccattactcatccctgcgcatccatatccatcaagaaccaaggagatgatgaccgatgtggctaagccagtctctggctggtgcgtgcgtgcgtgcgtgcgtgccgtgtgtattgtgttgtgttcgagggtggctggagggtggtggacggcctgaaaccgttgcatgatgaggagagatgcttggtagtcctgttaggtaaaagaggcagtaagaaggctggtgccggtgccttgtaccacttgtaccccatcccttgccacgtggattgatggtggcgtcgtcgtcgtcgttgtactgaagtaaggtgttgtgtagacgagtgtacagatgatggaggataggagaaaatgagtacgatggaagggccgaaagatttgcggctgctgtgctgtttgtcaatcgccaatgggcaatggctgcttgcagtgcagctgtggcctgtgtcgagctctctcctctttgcctgcgccgtcagagaacaggaacgtcgcagcgcgtcactgcaggcctccctgttcatggcggcgggcgacgacgacgcaggcgctgtacgtgagcttgctgctggtgtgtaggttgccgtgcatgcagcggtgtcgccacacggcgctggtcctggacgtacgtacggcggagcaggtccggtcgagcccggccgccggggtgcggggccattgacagctagagcggcaggaggaggaccacacggccggggacccaaattaaaacctctttcccgtgagtcagtcagacagactaccaaatgcgaaaataaaataaaaaactcagattatacgtatatagctagaatatggtttaaagctatagtaccacaagacaaagttaataagtaactaaacatgctcttctttagtcattatgtctgagctgacgcgaataaatcgaacttattgcaaaacggctcgcaaagatcgatctcaaccagactgattggataattttgagcgtatggatggatgtaggttaataatatcaaaatgaattattttatatctactaatgcgattcccacaattaaatatcatctcaaataaagtcaacgcatacggttaatctaagatgagatggtgcggntaaccaatcaggtggctgcgt

SEQ ID NO: 19028 - DNA, 2640 bp, Zea mays
  misc_feature (505)..(505): n is a, c, g, or t
gtttgttcacttcgggaaccaaggaataagttcttgcgctgtgcgcgatagagagcctgatccatccttccccatatcctattcctgtggcatttcgctgcgcttgcgccctgtgcgtggccactgcaggggaaggattttggcctggtttctctcttcttggggttccaagttttcgggcgagatcttcgcctcaaggcggttccttgcttttctggtattggcgcggctcttgttgctcccctacaagtccaaggaaagaatttggaggccgtggggggtcccttgcgaccggttctggtcgatttctcgggcagctccagctgaattcaagatgccgctgtgacccaccgctgcctggtttcttggaggaaggaaattttgcttcaattgggcgtcgttgagctagacccctcctccagctcttgatccggtccatggggctctgccatggcaagccgacgcaaatcccggaggccgaggctgaggaggatccccacgaccnttcccggcgcaagcggacgcgaacggggacggggcgacctcgccgtcggcggcggcgcccgcggcgaagccaggcacgccgaaacagcccaagttcccgttctacctgccgagcccgctcccgccgtccagctacaagggctcgccggcaaactcgagcgtctcgtccaccccggcgcgcggcgggctcaagcgcccgttcccgccgccgtcgcctgccaagcacatccgcgctctcctcgcgcggcggcacggctcggtcaagcccaacgaggtgtccattcccgagggcggcgagccggagctcggcctggacaagagcttcggcttctccaagcacttcttcgctaagtacgacctcggcgaggagatcggccgcggccacttcggctacacgtgctccgccaaggccaagaagggcgagcacaagggccaggacgtcgccgtcaaagtcatccccaaggccaagatgacaacagctatcgccattgaagatgtgagaagagaagtgagaatactgagttctctgacaggtcacagtaacctagtgcagttctacgatgcttttgaggatgaagataacgtgtatatagttatggaattatgtaaaggaggtgaactgctggacaggatattggctaggggtggaaagtactctgaagaggatgcaaaggttgttatggtacaaattttgggtgtcgtatcattttgccatcttcaaggtgttgttcatcgtgatctgaagccggagaatttccttttctcttcaaaggacgaaaactctcccttgaaggtcatagattttggcctgtctgactttgtgaagccagacgaaagactaaatgatattgttggaagtgcatactacgttgctccagaggtgctccaccgatcttacggcaccgaggcagatatgtggagcatcggagtaatcgcctacatcttgctatgcgggagccgacctttctgggcgcgcacggagtcaggaatcttccgggctgtcttgaaggcggaaccgagtttcgatgaggccccatggcccactctcacagctgaagctaaagatttcgtaaaaaggcttcttaacaaggattaccgcaagaggatgacggccgcgcaagctctgagccatccgtggatccgtaatgctcaacaagtgaaagttcccttggatatgatcatctataagctaatgagagcttacatcagctcgtcttcgctgcggaagtccgctttgagggccctagccaagacgctgacgacgaaccaactcttttatgtaagggagcagtttgaactgctgggcccaaacaagaacggctatatctcattgcaaaatctgaaatcggctttagtgaagaactccactgacgcgatgaaggactctagggttgttgactttgttaacacggtgtgcactcttcagtacaggaagctggacttcgaagagttcgccgcttccgccatcagcgtttaccagatggaagccttggagacgtgggagcagcacgcgcggcgtgcgtacgagctgttcgacaaggaaggaaaccggcccatcgtgatcgaagagcttgcatcggaactcgggcttggcccgtcggtgcctctccacgttgtcctccaggactggatccggcacgccgacgggaagctgagcttcctggggttcataaagctcttgcacggggtgtcgtcgcgctcgatccccaaggcctagccatgcgccatccattactcatccctgcgcatccatatccatcaagaaccaaggagatgatgaccggtggctaagccagtctctggctggtgcgtgcgtgcgtgcgtgccgtgtgtattgtgttctgttcgagagtggctggagggtggtggacggcctgaaactgttgcatgatgaggagagatgcttggtagtcctgtgaggtaaagaggcagttagaaggctggtgcctgtgccttgtaccacttgtaccccatcccttgccacggggattgatggctgtcgtcgtcgttgtactgaagtaaggtgctgtgtagacgagtgtacagatgatggaggataggagaaaatgagtactacgatggaagggccgtaagatttgcggctgctgtgctgttaaaaaaaaaaaaaaaaaaaaa

SEQ ID NO: 19029 - DNA, 8680 bp, Zea mays
  misc_feature (5928)..(5928): n is a, c, g, or t
  misc_feature (6724)..(6724): n is a, c, g, or t
  misc_feature (6755)..(6755): n is a, c, g, or t
aaagggttccaggttcgagttctatgtgttgcatcatgtttttcttttttgtgtccttcttcagctatacctcattattattttgtcctccgccactgactgaaaatacatactatacataggtgttcatgtttttcttttttttgtccttcttcagctatacctcattattattttgtcctccgccactgactgaaaatacatactatacataggtgtgacaaaattgagaggaattacagatacatgcaagcaaaatgatagcagccgcagatgcaagtctcctgccgcgctattcaaacaaaaatgttatgaaagctgaagggatgggaagcaccattgcagggtttccaaaaggtttcataatactccctctgtaactaaataaatcaacttttagagctgtcttaagtcaaactttctttatatttaaccattcataaatatttataacaccaagcaagcacactataacttctctcttacgactctgttcaaagtgtggtaagaagtgatcaattttaagctagctcttttgctcctatactatatacgtggaactaaactttccaccgtatccggcccaagccttccagccacgggcctccgcttcgctcgccaacttggtcgtcttcttcagaatttggatcacaaactcaacagtagcctgctacgtgagggtcgatgacgggcgagcggtcggacggtcaagggagaggaagctcggtgacgggaggctcagcgatgggaggagccacgcctggagctcgagccctccaacgtgcatctcctcctcggcgtgctccgttagcgcgcgcgatcagtctctggaaagggctctgcaggcaacttgggggagggaaggaggagagggcggtggccaggatgggggccgcccctgggagtgatggaggagcttcccagggacggcggggtggaagccggtggtgaccgggtttggttaggagttcgcaggaaggagaggaagtgaacgcctctgataccatgtaagattgtgaactgcttgatttattgcatagcagataaggtacatatatatagacttagaactctaacgctaatggaccagcaacccaaaagtggtgctggcccacacacacagagagagcacacacagtctaatactgagcaatactataccttggaccgtgccaaattgatatcttatgatcagctggaccaaggatcaatgcagagtgtaaaacaagaacaaaagtcatgaatttttgtgtacgtagcttctagcgcactactgctacatatgtatatgtatgtctgtagtactgatatagttgttctcttcatttcctaacaactgaattgtccacgaaatatgcctctttcagtttccagtcggcaattccgaggtggatgtccagaaataaagtgcattgtggcaaattgatggagcaatttggttgagcagttagtgggtgatgaaagcaatgttggtagttatatatacttatctggttgcttgttttgtttacagcaagagaggggccctatttgcttggctcatttgggattcggtgaatgtggtgccacagtgccccatgccagcaatggcaacaagcacctagctcctcacttgtttcagttatccatgtaactccattgatttctagtgcctgatcggatgtgcagctagtaattatacagtacttgcacatgctatcgagcaaaacaaaattcgggaaactgtcaggtagcagcatgaaagtttgaatgccatgggctgacggtgctggttggatggaccgaaacctgaaattaagcaggtggcaaccctagtcccaacatgcatataatactgactccaacctcttttttttatgcgagtgtgcagtgcagcagagaggacaatgggattggacaattccattgaacctgcctgttccttctttttgtttggaggtgaagctgaagcactggcactgctatacaatcaaatgagtggagagaatgtactagtagcacactgtttcataggacgattagaagtccttaatctgacagtgtctgagttaaaagctgattattgcatctgttatagatttcaaaataaattattccactgtataaaactgataagctagtaaaaaaaactgaatttcttatcgtgcacatcactgtgatggcccatgcatgaagacgatagctgcacgcaaagcaaacaaacaccacaggagttatcgaaaacgtggctcagtggttgttaatccgtctgacgtctggagaagtttatacaaatcttccaaatttttacctgcctcgttagcaaaatctgaggaaccgctagtctctagtgtctagtaaaaagatggcagcttcctcagtcaaagactctgacgattacagtgacaggagaaggcggccaggtcagatctaaagaagaagaagaaaagagcgaatcggagatcccaaacccatgtctcccaacttgcctcgcggaggcggaggcgggggcgatggatggatggatggaagcaccaaaaggaaaggaaaggtggtggcgtactggcttattgagcaagcagcattgatgcctccattactcacccctgttcagttctttagggcttgaacagcatggagatttcttcttatgaatccctccatttctcagtgcaccaaaccagcccttagtaggttggaggagccgaggaggagctcacaaagacagcctgttctcgtggccttttcggggatggaggtttgaggggtgacagactggtgagactacagtgacagtgagatcagacagcaccacagattctcaccctgtacatttctgtaacaaacaagcaatgacacaagagaacattactaggattcagaaccatcatttacaagttttggcattcttgctgaaattttgtagtggtaaataattttccctgcctctgcttgtgtctgaccatgtttcatggcaacgttcggagggactgcagcagttttgagggaattcaggtaaacagatacacatggcatagttatggtatgttttgttaggtttgcagtaaagtgatgacctgatcagaccaaatagatggcaacaaagccaagaacaaaagaggtgcatgtcaccatggacaggggctgtggctgtgctgtgatgtgcgcctgtgccaccccaaccccaccaccccacgccgcctcaccgaagcacaagcacagcgcaatacacagactcgcagggctcctagaaaagagaaagtagacgaccaaaagaaactggagaaaaagagaggagctcaaaagcaaggcgaggcctcctccgcccctttttctcccctcccaattcacacaggattcttcactcgcccgcccagttgtttcttttagtgccgcccccattccgctctgatccgagcctttcgctcaaagcctccagcttttgcaattgtttggtcacttcgggaatcaaggaataagttctcgcgctgtgcgcgatagagagcctgatccatctttccccatcctcttcccgtggcatttcggtgtgcttgcgctctgtgcgtggccactgcaaggggaggatttttggcctggtttctgtcttcttggggttctaaaatttcgggcgagatcttagcctcaaggaggttccttgcttttctggtattggcgactcttgttgctccctacaagtccaagaaaagaatttggaggccatggtgggggtcccttgcgaccggttctggtcgattattcgtgctgttgaattcaatatgccgctgtgacccacctctgcctggtttcttggaggaaatttgcttcagttgggcgtcgttgagctagagctctcctccagctcttgattcggtccatggggctttgccatggcaagccgacgcaaatcccggaggccgaggcggaggaggatccccatgtagcctccggagcgggtgacagcggggacgggccgacctcgccgtcggcggcggcgcccacggcgaagccgggcacgccgaagcagcccaagttcccgttctacctgccgagcccgctcccgccgtccagctacaagggctcgccggcgaactcgagcgtcgcgtccacgccggcgcgcggcgggttcaagcgccctttcccaccgccatcgcccgccaagcacatccgcgctctcctcgcgcggcggcacggctcggtcaagcccaacgaggcgtccatccccgagggcggcgagccggagctcggcctggacaagagcttcggcttctccaagcacttcttcgcaaagtacgacctcggcgaggaggtcggccgcggtcacttcggctacacgtgctccgccaaggccaagaagggcgagcacaggggccaggacgtagccgtcaaggtcatccccaaggccaaggttcgacacacgcacgcactcatcttcatggttcataccataccattgcccattgtcatgtactcatgtcccgttctcgagctgtttgtatcatttggtcattggagttcgtctctgcacttcacattctttggctgtccccgtccagttgcattttgcacgtttgaccaattctttgtcagatttctgcgtggttggatttcagcatgtctacactacaccaatacaccatgctgctatgctcagttttgtcgtcatcatccagactttttaattcctctgcagtcctctatgtgttgaccaagactcagcatttggaatcttcattttttttcacctccttgcttgtggttttggatcctagttcggttccgtcacactgctgcttcaaccagtagaattaggaacttcataaaagctggatatgtgtgtcatcacaaattggtagaatgttactaatcaagctgggttaaaggacgcttaacaaattaatggaaaggagaaactttacgaacccttcggtttctaatatctcccggggtgctcgtgatagctggtggcagggtgacctcgtcgcgcctgtatgacaatcatgtggtacctccatcacaggggaggagcctcctgccctcctccatctggatgtggactgcctcctgcattgattgtcttcatgtcatgctcatggcgccatcagctgcctcctgccctcctccatctggatgtggactgcctcctgccattttccctcctgccgtgactaaccaccaccttccaatcttctctcatgttgcatccacaggtagtaagcacatgaccccccttggatagatctgtaggtcaaaagggagcaaagctattgaatcatagctcgatgcttttaattccccttgaagagttcactcattatgcacctccctgcaattatacgaggggtcattcaattaagaccctgtagaggctcagtatccccggccaggccgttgcttttatgagcaaagctgccagtcctccttgcatatgtaatgctgtaatgccccacgcccccacctacagctatttacattccatgttctcgtgttgtttgtcagtcatagcctcataggatggcagcaacactggtttttgtttcattctttgtagaaaatgaatgcaacaaaatcacgcttggattgtctgtttaccattaattaattgttttctgcatcttgtgtaatcccatatttaagctcaagcatttcaacattctcactcaataaatcctctgtcagatgacaacagctatcgccattgaagatgtgagaagagaagtgagaatattgagttctctgacaggccacagtaatttagtgcagttctacgatgctttcgaggatgaagataacgtgtatatagttatggagtaaagtttgcacccttctttttattactgaatgctttttatcttctgtacccgtttggtattatattcatttgctgaagctctcgttcttgtacatattggtatgtttagactttagagacatgttctgtagatgtagatnctcttgatggattgtttggtcatagtccagtcattttggcccattgtcatcgttcaggctaataatatggtgcacacatgcgattctggttactcaatcatcttgagcctactcagctgttttcttatgtttcagattatgtaaaggaggtgaactgctggacaggatattggctaggtacctatagagacaacattaaaataattttcaacagccctaaggatttattctgctaggggtgtgctgcgggtctgctttcatggctagaggtggaaagtactctgaagaggatgcgaaggtcggtatggtacaaattttgagtgttgtatcattttgccatcttcaaggtgttgttcaccgtgatctgaaaccagaggtaggttgctaggagactttggcaaactgttgcatatttgtatcactgacctggaattttatttatgttacactggcgctgagcatagactagcattggataccatgactattactccctccacttccggtttggtcaggcattagcgggatttagaaaaaagtcctatttatacaacatacaatgttactgaagagtccaactggagcctaagcattgtttgcatgctgtagttaaagcacagttcagattcctttgcttgatgcatgagatccatccggtggtagttggtttgccatgcaggtatccatgcaaaatacagaactctaaccattttttctcgagacgaggcatacgattgcagcgcccattaggggagttactcctagcgcattggtatttgtttttctacgtctttcncctaagacaatggactggagggagtatgtcntttgtcctgtatatttgttattgattccatagtactaatattgtttagtcagtgcagttctttttttttctctcatgtatggtgagttatgtatttgtgcattccttttgcagaatttccttttctcttcaaaggatgaaaactctcccttgaaggtcatagattttggcttgtctgactttgtgaagccaggttagtcttatttagttacacgaggattcaagtgtgctgtttacccttgccagattaaatagctgcggtgggtcataacaccattatatgttatgcagatgaaagactaaacgacattgttggaagcgcatactatgttgctccagaggtcctccacagatcttatgccaccgaggcagatatgtggagcattggagtaattgcctacatcttgctctgtgggagtaggcctttctgggcgcgcacggagtcgggaatcttccgagctgtcttgaaggcggaaccgagttttgatgaggccccatggcccactctcacggctgaagctaaagattttgtaaaaaggcttcttaacaaggattaccgcaagagaatgacggctgcacaagctctcagtaagtgcaagattagcttcgcactgcactgtcgcacgctgctatcctgctgcgaagatgcctaacgcctttctcgaataaatgacaactgcaggtcatccatggatccgtaattctcaacaagtgaaggttcctttggatatgataatctataagctaatgagagcgtacatcagctcgtcttcgctgcggaagtctgctttgagggtatgcacataatcgaactttggaaagagtatatatgcctaggaactagggttcctttttctggtctgtagtagatgaatgttccctttgcataccttgagctgatggtatatgtacggcttagtaaactgtatattgctaattatttctatgaatttcgcaggccctagccaagacgctgacgacggaccaactcttttatgtgagggagcagtttgaattgctgggcccgaacaagaatggttacatctcattgcaaaatctgaaatcggttagtaactagtgtaaccttttgcagttcactacatatattctctctctctctctctctctctctcaccgtgcaattgctgaaaggtaaatggaacgtgcaggctctagcgaagaactccacggatgcaatgaaggactccagggttgtcgattttgttaacaccgtaagccgccactggactaccttctagtatttgctctactgttggtaatgagataatcccaaaccactcacgggggggggggggtgcctgtcacgatgctctaggtgtgcgctcttcagtacaggaaactggatttcgaagagttcgccgcttccgccatcagcgtctaccagatggaagccctggagacctgggagcagcacgcgaggcgcgcgtacgagctgttcgacaaggaaggaaaccggcccattgtgatcgaggaacttgcgtcggtatgagtacgaccccatctgttcaggcaactggtggccatgcatggcatggtattagctgctcgctgaacatcgctcatgtccgtgtcttgtggtttgccaggagctcggacttggcccgtcagtgcctctccacgttgtcctccaagactgggtcagacacgccgacgggaagctgagcttcctggggttcatcaagctcttgcacggggtctcgtcgcgctcgatcccaaaggcctagcattgtacaccatccatccatcgtcgttgttgttgtagttgtactgaagtaaagctgttgtgtagacgagtgtacagatgaggatagggaaaagaaatgaacatgatggaagactggaagggccgtaagatttgcggctgctgtttgtcaatgccaaattgccattgcctgcaggcatgca

SEQ ID NO: 19030 - DNA, 1466 bp, Zea mays
gcacaagggccaggacgtagccgtcaaggtcatccccaaggccaagatgacaacagctatcgccattgaagatgtgagaagagaagtgagaatattgagttctctgacaggccacagtaatttagtgcagttctacgatgctttcgaggatgaagataacgtgtatatagttatggaattatgtaaaggaggtgaactgctggacaggatattggctagaggtggaaagtactctgaagaggatgcgaaggtcgttatggtacaaattttgagtgttgtatcattttgccatcttcaaggtgttgttcaccgtgatctgaaaccagagaatttccttttctcttcaaaggatgaaaactcttccttgaaggtcatagattttggcttgtctgactttgtgaagccagatgaaagactaaacgacattgttggaagcgcatactatgttgctccagaggtcctccacagatcttatgcccccgaggcagatatgtggagcattggagtaattgcctacatcttgctctgtgggagtaggcctttctgggcgcgcacggagtcgggaatcttccgagctgtcttgaaggcggaaccgagttttgatgaggccccatggcccactctcacggctgaagctaaagattttgtaaaaaggcttcttaacaaggattaccgcaagagaatgacggctgcacaagctctcagtcatccatggatccgtaattctcaacaagtgaaggttcctttggatatgataatctataagctaatgagagcgtacatcagctcgtcttcgctgcggaagtctgctttgagggccctagccaagacgctgacgacggaccaactcttttatgtgagggagcagtttgaattgctgggcccgaacaagaatggttacatctcattgcaaaatctgaaatcggctctagcgaagaactccacggatgcaatgaaggactccagggttgtcgattttgttaacaccgtgtgcgctcttcagtacaggaaactggatttcgaagagttcgccgcttccgccatcagcgtctaccagatggaagccctggagacctgggagcagcacgcgaggcgcgcgtacgagctgttcgacaaggaaggaaaccggcccattgtgatcgaggaacttgcgtcggagctcggacttggcccgtcagtgcctctccacgttgtcctccaagactgggtcagacacgccgacgggaagctgagcttcctggggttcatcaagctcttgcacggggtctcgtcgcgctcgatcccaaaggcctagcattgtacaccatccatccatcgtcgttgttgttgtagttgtactgaagtaaagctgttgtgtagacgagtgtacagatgaggatagggaaaagaaatgaacatgatggaagactggaagggccgtaagatttgcggctgctgtttgtcaatgccaaattgccattgcctgc

SEQ ID NO: 19031 - DNA, 3008 bp, Zea mays
cattgggtacctcgaggccggccggggactccgtcatttctatcagacgcaagcagcagtgacgccgcgctacccgaccaaaatccgccgccggtgcccagaactcgacgggaaaaccggggctttggtcgccggacgccggctgcctcgagatgctcgtgtgggcggccaccgcgtcaccacccagcactccatccgccgtgccatttgctcctccccaccgcgccgccgctccccgccctccaccgcctctctgccgctcgctcccggggctgctgtgcgcgggcctgatccctccgccgcgcgccgccgcttctgacggcgacgtcttctgggaggagccagacgacggctccgggagcgactacgaggacgacggcccggagcaaaggagggccttgcgtttcccatcttcctcgccgtcctacaggctcgaggcgtcggcgcagcaagaacaggacctccggagagagatcgagcttctcctaacgcctgaagaaaaggctactttggaccagcatgagacccctgacgtcactagaatatcatcacccaagtggcacccacttcatagctacgcgttggcactgcagatacccctcatggacaagcttctgaacagcggtgttgacatcaacttagttgatagagatggcttcacctctcttcacaaggctgtcatagggaaaaaagaggctgtcattagccatctcctaagaaaaggggcaaatccccatgttagagatagggatggagccacaccattacattatgctgttcaagctggtgccctgcaaaccgtgaagttactgattaagtacaaggttgatgtcaatgttgccgataatgatggatggacaccactccatttagccatacagagtaggaatagagatatagctaaggtcttgcttgtcaatggtgcggataagacaagaagaaccaaggatgggaggactgcgctggatctaagtctatgctttggaagggatttcaagtcatatgatcttgcaaagcttgtcaagcttattccagcaaacagaggtgcgtgatttcgctctgccatgaatctgagggaaagaaagtccaaaagttagccaatgcagcagcctcatacgacccatgcatagcttatgaagaagggtccaggagccgcgtgccgccgtgccagtcatcattcattttttttttcttgaccgccaactcaaacgatctgacagattgctctacaattgtgccgttagatttcagtgtccatggtctgtagcctgttcgacgtgactcgaaaaatgatgatgtacatgcaacagtcctccagctgttgtgttcagttgttttgttcaatatgggccagggccaccaaaacaagatctgaattgtaactgttattaaccttcagcatatgtgtacacattatcgttttggcaaaaaaaaaaaaaaaacgtagtttgtaaacctgtattaggattcgaagacactactaagtttctgtaaatctgcaactaaggccttgtttagaagcattcagttttaaaaaaactgctttataaaatttgaggtggtaccaaacagctaaaactaaaagataaaaactggtttctcaaaaactgaattgcaaacagggcataagccggttcctattttgtgtcaaccggatctaaagcaattttctattggtgtatttagggttcagactgagctgcatacacagtgagggaaatgatcctggcatctatggctctatgcgattaggaacactctatacaatggaatattgctccggtagccgcaacacactcgccttggcaaactcttttaaagctgaacaaaataactgggtctgcagaaccttgcaaagcaacattgcaatatttagtaccaagtacacctactgctaaattttttttaaaaaaatgtataaaactgacaaacacacgtaacacgatctagcttataatctctaagcgacttattcttcttgtaaggagatccgcctgaagatggcatagaaagtctgtcctccatttcttgccaccttctggctttcttcagtggcagtagacagtagtttgaaaacagggtcagccttaatctcttcctcaggaacggtttcgaataacgggtgtttctctagacacgaccgcatccactctccgagctcctcgacatcagtgatggtatatatgattcctcccacttccatcacgtaagcatactcgtctaacagctgcatgctgataaccctcctcctgtggttcttctccttgaagtggggatcggggaacaggaagaacatcttggtgagctgagcctttctgaagtaatttggaatgtatttcatcgagttcgtgcggacaacggatatgttatcatactgtcctgggtttgccgctcttagagctaaaatcctctccttcacatactccgttacctgtaccatcacaaatgacaagcaaaatgagtaacagatatttcccagtggatcctaaactaggctatttgaaatttctgaacaaaacaactttctaaaaccacatcgttttctaagtagaaatctacagcagactaaattttaaccacacatttactgcaaagctgaagcaaataataattatgtaagaaagaaagttggtgtcacagaatactaaattcgtatcacaaaccaaactggaacatgttgcagatgattggcatataaactcacaatgttacatgataagcatgtggtcaaatttgatttatttctaagattttaacatttttatattcaaaagcatgtcaaacgcattgtttatcttcataatactaccagtaactttaagcttggaacagtctacaaggcgtccaaataaatcaagggagaaataaaaggcaaaataataggattaccttgtccctgagctccatgccaatcatgagcgtatctgggaagagaggcgagagccctacaagcaaaccgccaaatccgcaccccacatcggcgaaacggatctgttgtggcgctgcag

SEQ ID NO: 19032 - DNA, 1555 bp, Zea mays
ggggaccgggccccccctcgagttttttttgtttttttttttgggtctgcagaaccttgcaaagcaacattgcaatatttagtaccaagtacacctactgctaaattttttttaaaaaatgtataaaactgacaaacacacgtaacacgatctagctaataatctcttaagcgacttattcttcttgtaaggagatccgcctgaagatggcatagaaagtctgtcctccatttcttgccaccttctggctttcttcagtggcagtagacagtagtttgaaaacagggtcagccttaatctcttcctcaggaacggtttcgaataacgggtgcttctctagacacgaccgcatccactctccgagctcctcgacatcagtgatggtatatatgattcctcccacttccatcacgtaagcatactcgtctaacagctgcatgctgataaccctcctcctgtggttcttctccttgaagtggggatcggggaacaggaagaacatcttggtgagctgagcctttctgaagtaatttggaatgtatttcatcgagttcgtgcggacaacggatatgttatcatactgtcctgggtttgcccctcttagagctaaaatcctctccttcacatactccgttaccttgtccctgagctccatgccaatcatgagcgtatctgggaagagaggcgagagccctacaagcaacccgccaaatccgcaccccacatcggcgaagcggatctgttgtggcgctgcagcctcctcaccgtcgctgcccttgtcagcagggaagtaccgcgggtagtgctgtgagagatcgacctcttcaggcgatattgggactgggaagtgcgagtcgctgagcgggttgctgtgtgccctggcgcgatagaagcgcttccggggaagcttcccaccaccacttgcatcgtttgtcctcgtcatcagcctaacaaacaatggtggatcatgaaacgaagttaagagggggctaagcaattaaaggatagaaatccaaatatatgtaatagcggaagcggacacagctattaatatcacattaaatgttaaaggaacatcctgaacagctttttttgagtagaaaataccaaacaaatattgataatcaacagatcatacatgtcttcacagttagacaccactttggtcactatataagattttgtattaaaacaatagacatttttctagtggcaagtcttttcttttcagatacagctcaggcaaaagacatggctcaagaaccttatcgaattgctgtatgttaacaaaccatttcagtaaaagatgcatataccattggtaaatttctggttggtaaacccatggataccatcaaagaatgtgtggccactcaactttgcagggattgccaacaagattttctagcagcactatcttctgtgctacatagccctgataatggggtcaaacccatggctcaccccaactcatcgcttgcaaacatcttttgccaacgcacccacctaaaaatataatcaacgaagggggggggggggggactagtgagctctc

SEQ ID NO: 19033 - DNA, 1316 bp, Zea mays
  misc_feature (1225)..(1226): n is a, c, g, or t
  misc_feature (1262)..(1263): n is a, c, g, or t
  misc_feature (1265)..(1266): n is a, c, g, or t
  misc_feature (1268)..(1268): n is a, c, g, or t
  misc_feature (1273)..(1273): n is a, c, g, or t
  misc_feature (1293)..(1293): n is a, c, g, or t
  misc_feature (1314)..(1314): n is a, c, g, or t
gatcctggcatctttggctctttgcgtttaggaacactctatacaatggaatattgctttggtaaactcaacacaatcgtcttggcaaactcttttaaagctgaacaaaataactgggtctgcagaaccttgcaaagcaacattgcaatatttagtaccaagtacacctactgctattttttttaaaaaaatgtataaaacttacaaacacacttaacacgatctagcttataatctctaagcgacttattcttcttgtaaggagatccgcctgaagatggcatagaaagtctgtcctccatttcttgccaccttctggctttcttcagtggcagtagacagtaatttgaaaacagggtcagccttaatctcttcctcaggaacggtttcgaataacgggtgtttctctagacacgaccgcatccactctccgagctcctcgacatcagtgatggtatatatgattcctcccacttccatcacgtaagcatactcgtctaacagctgcatgctgataaccctcctcctgtggttcttctccttgaagtggggatcggggaacaggaagaacatcttggtgagctgagcctttctgaagtaatttggaatgtatttcatcgagttcgtgcggacaacggatatgttatcatactgtcctgggtttgccgctcttagagctaaaatcctctccttcacatactccgttaccttgtccctgagctccatgccaatcatgagcgtatctgggaagagaggcgagagccctacaagcaaaccgccaaatccacaccccacatcggcgaaacggatctgttgtggcgctgcagcctcctcaccgtcgctgcccttgtcagcagggaagtaccgcgggtagtgctgtgagagatcgacctcttcaggcgatattgggaccgggaagtgcgagtcgctgagcgggttgctgtgtgccctggcgcgatagaagcgcttccggggaagcttcccaccaccacttgcatcgtttgtcctcgtcatcagcccaaacaattagaaatgcaatcgaattattcttgaaacgggcacgaactgactttgctgtgaattttcggggtgtcgctcttctcggccttctcagcaatgacctggtggatgctcgtcgccggggaaggtcccgaagacagagacctgggcaactggtgtagggtgccggcggccgcccagtcgtagagcgcacgcccccgcctcnngagaagctgcccgagttttcgattaggatgttctanntnntntgggngcgaaacctcagcccgcctntgggaaaaggaaagaccccgnag

SEQ ID NO: 19034 - DNA, 4441 bp, Zea mays
ctggtgagggcaaagtagctgtatattacctcgccaggatttcggacccttctgatttacctcatgctactgtgtctaccaatgaggactatggtgaaaaacatatttcacctgcaactatatctaaaaggagttgactccaagtgttgcaggctcagtatataagagtactctcacagaacatggtgctgagccatctagtgcgcaaacaggtagcaaccagcaggaatcaataaatgtgaaaaacagtagctcagcttcaaaagaacaggaaacaactgacaattcattgtttatctcttccaataagaagcccttagacactcaagcaagtgaatgtgactggtccacctgcagccttgcgtagcttagcgttaacaggaaacacaaaacctacaatattttccagcttttctactgaaggcatgaatccaacaggaggcaatgcacctaatgaattagcttcttccttgcaaccaagcagcagaagttttggaaacaaccaaactggtaaagaaggcctggattcagttcaatcagtgggaatatttggtggatctcaaaactccaataaagatggtgatgtctatggtttcgagtcttcattattcacctctagtggatctgtccctgccaagatcggagaaaggaatgaggttggttttggagttccttcgctgcacaccagctacaccgctgatagaaaagttttgggtgcttcagttgccttaagctctgtaccttcatcatctatatctccggctaaaccttccccaattggatcttcaagtggatttcggacagcaaactctgaagcacctcaatcattgcgtggatcacctccggcacagcaatctatgggcaaatcacataacagcaggacacaagcaccggcagaatattctagaaactccaagaagggcacagggattcgattcctgaacaagacttgtctaaaaaattttacacgtgataaatgagaatgacgaaggagttagatgccctactagcatatatagaaaaggatggtggttttagagatgcctgcataaccatccagcagcgtcctctttctatgtttgaggatggcttacaaaactttttgcagctgttgcaggtcttcaagggcaaagtagaggagcaatgttcaaaaattgaagatctgaggaacaacatgtttcaagtttctgctaggcaaacttacatgaaaggaattgttagccagtcttcagataatcagtactgggatatatggaaccgtcagaaattgagtccagaatttgaagtaaagagacaaaatattctcagagctaaccaggatttgacaaatcagctggttgagctggagaggcacttcaataatctggagatgaacagatccagtgaaacaggaagagtggcttctactcgaagagctgtttattctaacaagacaagttcgagtcagacacaattatccagtgtatatagtgcactgaactcgcagttggcagctgctgagcagctatctgaatgcctttcaaagcagatatctgtgttaaatattggttctcctagtaggaagcaggggatggtgaccaaaaagttgtttgagtcaattggtttagcccacacaactgatgcaaccaaattttcaggcagcactcctaagccagttaagcggtttccatcagtgaatgagcattcaaagggaatattagggtcttccaagggtggtgagcctgagactgctcgaaggaggagggaatcactggatatgagcctggctagtttggaacctcagaaaacaactgttaaaagaataacacagcaacaacgcctcaagatcagcagtgatctaccattcaggtcaaacaagaaaatatttgattctcaaatggcagcaatatcacaggaaaagtcaagcgatagctccaattcatctatagtagaatcatatgtaagcagactgcgttctctgagtgaagatgtaaacgataaactgtcaggaccccaacagaaccctttgttcaaatgggtaaaggaatcaactgggtcatctcaaacctcagagcaaaagcatttcgagttacccagggcaaatgaaaagtactgcacagtcttcaaaactgacaccatcttcaccaccatcattcagttacacacgtatgggtgcacaagatagtatcaacccatccagcgttccatccttcggaacaaaacatactgtgtctaagccaaatactctaaccttcaaaaccactataagccctaaaagtaatgccaacacagagccaaatatattaccttctataacagctccaaaaacttctctaagtccactgtctgtaaaaactgctggggagtctggagatttgcctacattaactatgaagaacagacaggatggtcagtcaatgccatctttggggaacataaaaggaccgggtgcttctctgcagaacaagggtggcatatttagagatctcgacaaatcgtcttttaattctgaacattccaagcctgctgcattacatgagaagactgaccagctaagtggggttggcgatgctgtgcagaacactgtgaaagatatctccaaaatggcacctcaaccttctgcattcttgccagctcctgttactcagaccaattcatactccttaaggccgactgtttcttcttcagccacatcaggtgcgaaaacttcggatgttttatctagttcaatgcagaaagtttctccaatagtacctgggggtactgtgtctagctcagtccctactcctgctaaggattcatcaactggattgagtcaaaatgcttccaaacctgaaacgctaatatcaaaggtaactagtaccatagtttctgcaagttcgacttctgtcatatcagtcactgaaagcaaaccttcagtgcctccaacaactggcgccagcttgccttctactcatgtctctgctcctcaaacagcaccaacaacatcggaatcagttttcacttccacaggaaaaaatgtaggaccaaacactgacaccatctcaaccgatgaagatgacatggaagaggaggcaccttctgcaagtgccgaactgaacttgggagcccttggtggattcggccttgggtcccagccttcttcaagtcctcaaaagtctaatccttttggtgcctcctttggtacatctggcaataaaagttcaggcacaccatttactttgacaaccagtccaggacagcttttccggccagcgtcgctaagcattccttcagctcagccagcccaaccatctcaatcaactagttctagttctttttctaattcgttctcaagtgggcttactggatttggacagcctgcacaaattggatctggccagcagtcagcttttgggaagcctgcacagattggagctggccagcatgcaggatttgggcagactgcccaaattcaatctggttttggccagcctgcccaaattcaatctggttttggccagtcagcacaaatcggaactgggcaacagtcaggatttgggaagcctgcacaaattggggctgtccagtcaggatttgggcagcctgcacagtttgctgctcaacagacacttggatcagtgctgggttcttttggacaacctccccagttaggaggcataggttctggaggatttggtggattttcaagtgcttctacatctgctggttttagttctttatcttcaggtaatgctggatttgctggtgctgcatctggtgggggcttttcagctcctacttgcttctgcagttgctgctcttgcttccaaaagtggtggttttgttggtgcagcttcatctggtggtggttttggaggtgcctcccagggaggtggctttgccagtggtggtggtggattcggatcctttggtggtaatcaaggagctgggttctcggcatttggagcaagtggggctggaagaccggcagctgatttcttgacgcagatgagaaagtaggctccaggcaaatccccagacaggtttacgcattagctatagcatacacatgaggcgagttacttttatgttccactcttaagcgttgtttcggcacaggagctgtagcataaacatgaccgcagtataccctggactggatgagccctcgcttcgctccatctattgatgatggaggggggctaccatttgggagccttattgttttctcttcttttacaagacacagcaggtgtcaacagcagcatcgacggttggtcttggattccctactggtttctctccagggcgaccaacttgctaaggctttcatggctctctcttcaggttccatggctgcatgaaatgtagaaggaaaaaaaaaaagaggtcgtgtaaaggtcattccttggacgtgattcccctcctccagctttgtcaatacgagttcccagcctctttcccacaaaaaaaaaaaaaa

SEQ ID NO: 19035 - DNA, 1194 bp, Zea mays
atcttgtcgtattcggtttgcctttaaaaccgtacgtgaaaattggtgctgtatgaccggcgaggggcgtggtcgccgagaagctagctagtcgacgtgctgcgggccggccgtctagctgcgtgttccttctgccatgtgcgctactgtgctcttaagtccgaccgagcagccactgagctgaggaaaagcagcagctgcactcgcggactggtcgtgttggttgccacaatctcgatatctctcgccgccttttctttcctgaaaactgtagagaaataggaacggtacacacactatcgatccacgctaggagcgcgtagcgcaaagcaatgatctgcgcgcggcacactggaaacctggatcactatacacaaaagggtaagaggatcggtcgatcagtacacaggatgcaatcgtaagagttgtccgttagatcggttaactgggatccttttggtcaccgccgctactcagatttggcgatgccggcggccaaggaacccgcccaggaccgctctcttccgcctcggcgcctcttctccgccattgcctcctcgggccgtcattgtcgccggcgtgaccttccaccacgtcccaggtgaaccctccccccctcacccgaatccttcagtgcagcgcaagcccccgccgcatcgctgttgtcatctgactgaacacaacttctgctctactatattcatattcatttctccgtttcttttatgctgggtgaaagtgatacacatctgcgaaaagatgaggttgctgcgcatctgcaaaaagatgagtgtgccactaggtgatgctttactgcctgatgctgcatctcacatctttgatgggtctggcctgattcataatccagcaccccagcacctagccgtatatactgtcacatacaaatttcgagctgggttgctaaatttctttgatgcaactgtgtccatagcctcccaaagagcatctccacgtcaggaactgtgcatgtcaaaatttgatctgtcagctgttgagctcaggggcaatagtgcttctaaacacagatgcatccatttcagagtatacaacacataccatttgcttctgttttgcagtgtaagcttatcttctcttgcaatgttacttttgatgactgaatgttgcttttgactgacatgtgagatcattgttttgataaaaaaaaaaaaaaaa

SEQ ID NO: 19036 - DNA, 2015 bp, Zea mays
ttttttttttttttttgctcagatggagatggaggcatggagcaatgttttcggcggtggcaactggcaaggaagctcccttgccaagccaacgcaaaattcctggtgttactagtgtaactaaggcatggctaagttgcttgccctggttacaaatcaaatgattccttgcttgcccccctttccctccaaaattctcgctgcggccctcgtcttcctcctcttcttcttctgtaaagtgccaagtgccaactgcattctggcttacttggaacaccactccttgattccttcccattccaccagtctcatcttgcatagtgctagaacttatccatttgcttgctactgctcttgcccagcatgagcaaacggccgatgatgacaacgccggcgggcggagaagacggtgagccatccagcggcgctcgcggagccggtgcgccgccgccgtctcagccggtcggtaccggccgctacgcaagactgcagagcgccggcaccgggaccagtgccgccgacggcgaccggcccagacgtcatgtgacctatatggaaggccgttttgaagcggcggagcagccgccaaccgatgacggttacggtgccggggacactgccccgccccagacgcgcacgcaacgccccaggccgacctacacgcctgtgtcgcagaggagacgagagccggcgattgatgagcagccacggttgtacggagattacccgcgccggggcagcccggcggaaccgccggcgcgaacgccaacgcggccccggggtagccgtgccgggctgggaggagctgcgggaggggcgctgccaccggggagcagcagcctccccagccccgaaacagctgtttcgacaactggtgggatccccggctcgtcgggaggagcaccaccggtgcaaccccggcgtggtggcctgaagaccaataagaccatcgagcgcgtcagcacgctgggggacgagccggtaggactgggtgggagtgggagttcggagccgccgccgccgccaacgcaaccgaagccggagccacgtttttctcttcctcagcagccggaggaggggccgtatgtcgaccagccgccgaagcagccgtcgtcgtcggggtcggggacgaagaggccagctggagcgtcgccgacgctgatcaggaggaaggagaaggcgacgaagccgctgacggtttgcttgacctgctgctgcatcctgttctggctcctggtggtctgcgtcggcctcggcatcctggtggtgtacctcctgtaccaccccagggcgccgcggatccacgtgagcacggccaccctcaacgccgggtacatcgacgagctcccgccaccgcacctgggcaaggcgctcaactcagacctctacgtgctggcggccatctacaacccgaacaccaaggtcgacgtcgtcctgcgctacatgcagctggacctctacttccaggggaggctgatcgggacgcaggcggtgtggccgccgctgtacgagaagcccggcgactcggcgctccgcagcgtgcacctggtggtcagcgaggtggtcatgacgcaggaggacgccgaggtgtggaagaacgtcaccaccggcggcggcctcgtggagatgcacctccagggcaagttccacgtccagctcaacttcggccgctggctcccgttcaggtacacggtcaggccgacctgcgccctctggctcgacccgccgccggccggcgcgctgcgcagggcccgctgtttgaatccttgattagggcattttaaggtaaatgcgcgaagcaacttccgatcaattctttgcacaaaaaaaaattcaatgctgctcgcatgccttgcttattagtcgaacaacccgtgttttttgtttataccgtagctattttttcctggttgaaacacatttggaaattgggattcttgcagttctattattattattgtaaaaaaagtcaaatggaatcagagatcgagccagtgacaaaaaaaaaaaaaaaa

SEQ ID NO: 19037 - DNA, 1343 bp, Zea mays
cattgggtacctcgaggccggccgggagagccctcagcccctcagcgagcgcgagtcccccgggccccccccggggcgtccgggaccctgggagtcatctccacgctccgggttcgcgcccgactcccctacaaattcgctccaccggcggctccggctgcaaaccgcgactgactgctgaccccgagcggcaccagcgcgcccgccccgccatggctatccccaacgcctttgactcccccctcgcggccaggtccgccgtcggcgcggcgctggcggccgtcatcgccgtccgcgcggtccgccgccgctccctagacgcctcgggcggggtcgccggcttcgtcgtcatggcggtccacatctcatgcggctacaggtacggggcgctgctgctggccttcttcttctcatcgtccaaggtaaccaagatcggggaggaccacaagcgccgcatcgaggagaacttcaaggagggcgggcagcgcaactggatccaagttctagcaaatagcacaattgccactgtactggttgtgatatttgcactaatgactggagggcaagatcagtgcatggactcaaatggttcaaagcttataactggcatcataggtggtatcattggccactactgttgctgcaatggagatacttggtcatctgaaatcggtgtgcttagtaatgaacaaccaaggcttattacatcccttaagcctgtcaggaagggtacaaatggtggagtcaccttacaaggacttcttgctgccacaggaggaggccttatcattggtctcactttcgttgttgttggactgttgactgctgaatgttcttccgatatggccatcaggcagctcctagtactacccatctctgctgcagctggtttgcttgggagtctaattgattcattgctgggagctacacttgaattcagtgggtattgcagtgttcggaagaaggtggtcagcaaaaggggccctacggttacaaagatttctgggatgactatcctggacaacgatgctgttaatgcagtatctattctgctaacaactgtacttacagcttatgtatgcatttacatcttttagaaaactagttgggtaaatcttgagttgaaccctatttttcattgggcaatgtattgtgaccttagcctgcacggttcctggaaatggaacagcctgcaacttctctgtgtattggtagaatttgtattatggcacagaaaggccgattcatctccagcttgatactaatggttcactggaaactttttttattcccattgcaaaatgttacgatattggaattatccttcatacggattttaacct

SEQ ID NO: 19038 - DNA, 1697 bp, Zea mays
gagatgtgacacaatgcaacgtgatttagtagggaagaggaggacccggaccggagccagtcagcggtgagagtagaaacggagagtgtctgcatgccatggagatggagccgatcctcctcctctgcctctctcttcttgcccacggggcggagccggcgtgcagagaggccaggttcacggggacagttctcccgctgatgagggtgcagcagctggtgctgccgcctactacacattcaccgccgccgaacaggctacggttccgccacgacgtcagcctgaccgtgccggtggccgtgggcgcgccgccacagaacgtcacgatggtgctcgacaccggcagcgagctctcctggctgcgctgcaacgggagccgcgtgccgtccacgccgccgccacaggctccggcagcgttcaacggctcggcttcgtccacgtacgccgccgcccactgctcgtcgccggagtgccagtggcgcggccgcgacctccccgtcccgccgttctgcgccgggccgccgtccaactcctgccgcgtctccctctcctacgccgacgcctcgtccgccgacggcatcctggctgccgacacgttcctcctcggcggggcgccgcccgtgcgcgcgctcttcggctgcgtcacctcctactcgtccgccactgccaccaactcctcggactcggaggcggcgacgggcctcctcggcatgaaccggggcagcctgtccttcgtgacgcagactgccaccctccgcttcgcctactgcattgccccaggggacgggcccggcctcctcgtcctcggcggcgacggcgccgccctggcgccgcagctaaactacacgccgctgatacagatctcgcggcctctgccgtacttcgaccgggtggcctactccgtgcagctggagggcatccgcgtgggcgccgcgctgctccccatccccaagtccgtgctcgcgccggaccacacgggcgcgggccagaccatggtggactccggcacgcagttcacgttcctcctcgctgacgcctacgcgccgctcaagggcgagttcctgaaccagaccagcgcgctcctggccccgctcggcgagtccgacttcgtgttccagggcgcgttcgacgcctgcttccgcgcatcggaggcgcgggtggccgcggcgagccagatgctcccggaggtgggcctcgtcctccgcggcgcggaggtggcggtcggcggggagaagctcctgtacagggtgcctggcgagcgtcgcggtgagggcggcgccgaggcggtgtggtgcctgacgttcgggaactcggatatggcgggcatgtcggcgtacgtgatcggccaccaccaccagcagaacgtctgggtggagtacgaccttcagaatggccgcgttggctttgcacccgcgcgctgcgacctcgccaccgccacccagcgcctccgcgcccgagcataggtttgacgcgcgcgtcatggcgtttgtgctcgactgctcgttgtgggtctaccattcatggcacacagcagcagggcacgaaatcgttgacagagatcaggtactagagattagagaagtagagatggtctctccgatcacctgctgctgtggtcaactttgtattacgcgatcaggtatacaagacactgacaagctgatattattattattattgcaaaaaaaaaaaaaaaa

SEQ ID NO: 19039 - DNA, 1884 bp, Zea mays
tcagtccatgaggtattgcttcagacgcaacaagactgctagacttgagcagatcgctgtttctgttctttttatcatttcaaccaacctttatatacccgaacagttcaaatgcagcaatagtttgaaacgacaaatccgtaggctcagccaaaatcaaaatcattagacactataccctactataacatgtcatattatacagaaacagcaagaaggaattgtaacatccagtgatgctgttctttttgttgcactacggaagcttgccagatttgagagcctcaaagcgtgcagtgagagtttcatagtcaagaggcatatttggatgaacacgagaatgaaggtttgtcttcggcaattcagggaaatcttgatcatgctcttcgtcttctgagtgacggttttctgaaaacagctcactcttaggaggcaatggcctttccacagactgaatctccacatcattttcaccttcggattctgaacacagtccctcagaatcatcaaactttatctctgagtgcaccttccgagcagcacggcagttccttctccgtgtcttcgtagagtccaaatctgcagggtagccgtctttgtcatattctacatggttctttccactgaaccttcttgtactgtatgttttcccttcatgaggtttttgttcatcaaaggcatttgcatcttctttcaaggaggatctactcgagttgctcatcgactgtctcttgcggggatgagtgaattcatgagttgaagctttgcgatcttcatcttcatcaaatggatggttcgttattgttggcattgtcaaaatcagctgcagcctttgcagcagatgctgctctctcagcagactctgcagctgctcgagcagctgaagctgcatctttgaattgcatagtgcccctgtcatcatattcgtcatccgaacacctatagctgaagttaactggatctggctgcacggtatatggtgtcagaatagtcttaacaggcatgttggaagcttcaacaaatgtacttggccctttaatcaactcttcaggaggtttcagaagctcctgctcactctcagtggtatcccaatcaatctgatgctcttttgctatatccttcagaactttcagtttaatttgcccggaaggcttcttaatcgacagcttctcaatcagaaggttgttaacagcagcatctgggcgcaagtcaactgcagcagaaacaaaatctttgccatacttcttttcaaaaatgtcacgtatgcgaccaagttcagggagttcagagcaccttggagctgcaaatatcaaactgcagataccttctttcaagtctgctggacattccttctgttttgcgatgataggaaggcgtgtaacaatcagctcgcagaagagctcaatgatctcgttggctgccataaagttctgttccctaattacatgttcaaccctgatgcgtgcggtatcctcctgtttgtcgcggaggagcgcggcaatgtcgcggcgcatctggcgcacctgcgcctccctccggttccgcagcagcttcatccgcgccgtcgccatccgcgcctccgtcttgcacttggaggcgctgaaggtgcggcggagcagcacggcggcgaccgcggcgccagccagccgcctcagcgcgcgggcgggggactttgactcggacgtggccatcatcatcgccgccatcgcccttcgttcctggggctcggactcgccgccgaggtgggtgggggtgcggtgccgctggcgtgggtgcgagccttggggctcgggcgactgacaagggttttgtgcgtccgtctcgtgccacccagcccaacggtcaccttgacttggtagttggacacagctgccgctgcactgc

SEQ ID NO: 19040 - DNA, 2210 bp, Zea mays
catcgcgtgccccgccgccgcccgccgtcccgagacccgattccccgtcccagagacgagagacggcacaacccttgctgccgtcctggtcgccacacggccacaccaacccaacacctcttcttcctccgctctcagcttaccccaccacaggcgagggaggcgactccttcctcgcggctacccgctccggccccgatcgcatctcctttgcacgccacggcccgcgcgcagtgtccaccggcacggccgtcctccgtgtgtgggggcgcatctggtgctagcttgccgggctagggtttggcttggcctcgtctaccgccccgtctcgtctgataggcacaggttccgtgcacgcgatcgtcgtctctccatccgttgtgactgcttgccgtcccccgcttgcttcgtcctgctacgggagggccactgctgccatcgcgtccaccgacgaatttccccacagagcattagagcaattatcttggagttgcagatctgtacctgaagattcatattgaaatctggaagcttctgctgttgagtacagagaaatatttcttgccttttgaggaagactgcagagcccctaaatgtgaaacttgtttcttttcttgtctactcctgaatgctgacgaactcagcctctcacgttacttagctgaaggtcgtactggtacagacaccgaggatggagcaagcaacaggtgtaagtggtcctgaacacataattgatattccaagggaaattggtcctcctgcttcggtttctcgtagtgctggtagagagaaccatgaagaatcgaatcctgtggacaggccttcaacaagagctctagtacctgccttgcaggcaccatcagcaataggtgctgtacctattacagggcatacttcaggcactaggagaaatgacaactatgttcgtcggcacagaagcccattgaattctggactgtggatttcaattgaagttattgttaactttagccagattgttgctgccattgttgttctttgtgtgtcaagaaaggaacacccacaagctccattacttgagtgggtcataggttacactgttggttgttttgcaacgttaccccatctctattggcgctatatacaccgtaatattgtaaatggtgagcatgagtcatcacatacacctcaagggtccgctcataacaactcaaatgaagcgactcatgctgcaagtgcatcagaacgccgcagaaatgctgcccgaaatgctgtgcttgctaatcctaggatcaatgcgctgtttgaccacttcaagatggccctggattgtttctttgccgtctggtttgttgttggaaacgtgtggatatttggtggccgttcttctgctgctgatgcaccgaacttgtacaggttgtgcattgtgttcctcacttttagttgcattgggtatgccatgccattcatcctatgtgcaatgatatgctgttgccttccctgcattatatctgttatgggttttagagaagatacaaacaatacaaggggtgcttcctcagaatctatcaatgctttgcctacatataaattcaaaatcaagaaacgtcgccatggttcaggcagtgaaactgaaggccaggaaggagggatattggctgcaggaactgacaaggagcgatcactctctgctgaagacgcagtttgctgcatctgtcttgcaaaatatgcgcacaatgatgagctccgtgaacttccatgtgcacactgtttccacaaggactgtgttgataaatggctcaagataaatgcactttgccctctgtgcaaatctgagatagtgagctcgtctggtacttctgatgcccgccaatcagaccagaacaccgttcctgtgcaggagatcgaaatgcattaggttggtctgttcccgcagcttatcacataaggatacatctgatttgtggctctcaatcttcatgtataaagttggagattgatgtatggattgtagagacgcgtaggtttttttttgtatttaacactgctatcttggagaagttacagctattctcgctgtcacccaactatggcaagccaatactacccaggttttcccccatagcgtgggctgcaccttatgttctgctcttgatggcattgaaaaaaaaaaaaaaaaaaaaaaaaaaaaaaaaaaaaaaaaaaaaaaaaaaaaaaaaaaaaaaaaaaag

SEQ ID NO: 19041 - DNA, 5704 bp, Zea mays
  misc_feature (2699)..(2699): n is a, c, g, or t
  misc_feature (5683)..(5683): n is a, c, g, or t
agacagacactccgcacggcccttgcggccgtcctggccgccccgcggccacaccttcccaacacctcttcttcctccgctctcagcttaccccaccacaggcgagggaggcgactccttcctcgcggctgcccgctccggccccgatcgcatctcctttgcacgccacggcccgcggcccgcgcgcactcgccatcggcacggccgtcctccgcgtgtgggggcgcatctggtgctagcttgccgggctagggtttggcttggcctcgtctaccgccccgtctcgtctgataggcacaggttccgtgcacgcgatcgtcgtctctccatccgttgtgactgcttgccgtcccccgcttgcttcgtcctgctacgggagggccacggctgcctaatgttatctgcgttccctcccgtgtggcctcacagagcattagagcaattatcttggagttgcagatctgtacctgaagattcatattgaaatctggaagcttctgctgttgagtacagagaaatatttcttgccttttgaggaagactgcagagcccctaaatgtgaaacttgtttcttttcttgtctactcctgaatgctgacgaactcagcctctcacgttacttagctgaaggtcgtactggtacagacaccgaggatggagcaagcaacaggtgtaagtggtcctgaacacataattgatattccaagggaaattggtcctcctgcttcggtttctcgtagtgctggtagagagaaccatgaagaatcgaatcctgtggacaggccttcaacaagagctctagtacctgccttgcaggcaccatcagcaataggtgctgtacctattacagggcatacttcaggcactaggagaaatgacaactatgttcgtcggcacagaagcccattgaattctggactgtggatttcaattgaagttattgttaactttagccagattgttgctgccattgttgttctttgtgtgtcaagaaaggaacacccacaagctccattacttgagtgggtcataggttacactgttggttgttttgcaacgttaccccatctctattggcgctatatacaccgtaatattgtaaatggtgagcatgagtcatcacatacacctcaagggtccgctcataacaactcaaatgaagcgactcatgctgcaagtgcatcagaacgccgcagaaatgctgcccgaaatgctgtgcttgctaatcctaggtactcatgccttctttttttccttaaaaaaatggatcggtatttacaatgaatatgtttgactgtcacttgttttgtttatttatggtgctgcaaaatggctatgcattaaagatgaatgccctgtgctatctgcaggatcaatgcgctgtttgaccacttcaagatggccctggattgtttctttgccgtctggtttgttgttggaaacgtgtggatatttggtggccgttcttctgctgctgatgcaccgaacttgtacaggtaaatgtgaactgctcttcaattgatgagatgtcactatgtcagcttctttatcctgctgctgactttctacttcccaccaggttgtgcattgtgttcctcacttttagttgcattgggtatgccatgccattcatcctatgtgcaatgatatgctgttgccttccctgcattatatctgttatgggttttagagaagatacaaacaatacaaggggtgcttcctcagaatctatcaatgctttgcctacatataaattcaaaatcaagaaacgtcgccatggttcaggcagtgaaactgaaggccaggaaggagggatattggctgcaggaactgacaaggagcgatcactctctgctgaagacgcagtacgtctatcttgaatttttagttctttttgtcaccatcacttatttgttttcttattactcttttggtattgcaggtttgctgcatctgtcttgcaaaatatgcgcacaatgatgagctccgtgaacttccatgtgcacactgtttccacaaggactgtgttgataaatggctcaagataaatgcactttgccctctgtgcaaatctgagatagtgagctcgtctggtacttctgatgcccgccaatcagaccagaacaccgttcctgtgcaggagatcgaaatgcattaggttggtctgttcccgcagcttatcacataaggatacatctgatttgtggctctcaatcttcatgtataaagttggagattgatgtatggattgtagagacgcgtaggtttttttttgtatttaacactgctatcttggagaagttacagctattctcgctgtcacccaactatggcaagccaatactacccaggttttcccccatagcgtgggttgcaccttatgttctgctctttatgacattgcatgacttctttcgagtttctagagcgaaataggcaggcgagtttcttttaaggctatctctagcaacggtgtgtaggtggacgtgcaaagtaagtaacgttttgcactgtagactatactgtttacaaagtgaagtttgaaatacagagttagacagatgatgagatagggagacttaagagatagtataaggcagttatcagcatagtgtgcatatggccgtagtaaagtttgaattaaaaagtgagataagaaagtttgaaataaaaggtgagataagagatatgatatagangatgttgggaaagtttgaaataaaaagtgagataaaaaagatttgaaataaaaggtgagataagaggtatgatatagaagatgttggagatagtctaatcaagtggttgtagtgaaacattttcgtgcatgcaacttttgaaatactccctccattctaaactatactataggacggttggttttttctatatatatattgtttttgctatgcacttagatatatattacatctagatatatcatatatagttataatgtatttagatgaaattgtcttatagtttgggacttggaatggagggtgtattttcatgctacaaattgaagttaccgatatcagtttatgaaaaccttcggctaagagcctgttctgcacttctgcttgatatgaggccgagaagctgagagctttatgaacaataacgaataacaccatggatatgtttattttctattggtaggctctatatggagttacaatagctgattttctgttttcacttgtgcaaagttgttttcatagctaatgtcttactttctaaattattgttttttgaatttatagcttttactatgtacttaaatataaatatagcgtgtatgtcaatataatatatagaaactgtagactgtagcaaggcatgaacacataattagttttgtttaatgtctgagcaaagacgcaagcctaaaatcaatgcaattcatgtctgcttgtttaatgttgagtgatgctgcgcgcctagggcaaagtaatgcaattcattgtctgctttcttcgtgtgctgaagaacgtttcgcctgcccgtgatctctctactgtgcttgtactacaatgaagtttaaaaaaaaaagagtgaccctggaaattcttatacataaaatttcgaaaaataaataaattcgtgtacatacacaaatacgtttacaggtagtacaaattgcattattttgcatcgtacgtgttttgcctgtaccggcgcaggtagtacaaattgtcaaattacattcacgttcacggggataacggcagcttctttctttcctcggtgtcctgtgcaaacttcagcgactgcttgcgctctggtgtggacgagcgtctctccccggacgcggctgccgcctcccccatccgctgctcgaacggggtcctgaactcgttggaccccttccgctccagcggcgagcgcgaaaccgagtccatgcgggagtggtcgctcagaggcgacgcccggggcccaccgaaatcgcgcgtggctgtggcatcctcctgctccgccccctccctcttcctcccatggctgctgccgccgttcgtcgacggcgagtcgctccatccctgctgctgcctgaagtggggcgcagacatgtccttgcggtcgtagtgctgcagccacgcgcggaaccgcttgagcgacacgctcccggacccgggctccgccgccgcccggacctcgtgccgttcccggtagatgaacgtgacgaggtaggcgaggagcacgagcgtggccgccacggcggtgatgaggaacagcccactgaagttccacagggtgaggctggcgttgtccgcgtcgacgccgtcgacgcatgacccgggcacgccgaaccacttcctctcgatgaggtccatgtcgtcgccttccgtcagccccacgatggcgcgcgacacctccgtcgccatgggagagcctctcgcaaacgcgaacccgaggcccgtgcccttgtagacggggccggacatggtgtagccgtcgcagtactgcgacagaaagaccttgaggtacgggacctcgtcgaacaccgcagcgaccccgccgccggccgatcccttggacagcgcgtccgcgtactcggccggcgtgctgtagctcctcagcctgctcgggtcgaatttcatctgcagaagctcgccgtggacgaaggaaccctcctggtacccgacgtagtcaccgttgtcgatgagatcattcacgtccgtcactgccggccggagcttctggaccgtcagcatcgatgtcaagctggccgtgtagctcgacgtcaggatcaggacggcgaacacccatatgaccatcaggaacttggacaggttgctcaccacattctcccctgcacaccatcaccatgagaggctgatcagttactgtgcgcgaagaagcagagagctatcttaacttactgtgcgcgaagacaagggtggagaaggcgtagtggaagatgatgccgaactgctgcagtggcgtgcctcggaactccgggttgatccggtgctcgatcacccagatgacgaagccggtgaagatgaaggcggcgaggctgacgagccagagcgcgggcgtgagcggcttgaggaagaagaacatgcccgtggccgtctgcgcctgcaccgccacgaccatcgaccatcccgactcggtgtacggcatggtgaagtccgcctcccccatcctgaccaccgtgatcgacacgtcgccgacgaccgcatcggctttctcctcgggaatcagctctaccatctggtcgtaagaagacgaactcgcgttcccgatgccgtagtacggcgcgtactggtagtacaccgggtagggcagtgccttgatggccgcctcgaacacgtcgatgcagtagccggagaccatcgtcctgtcgctcgtcgtgtcgttgtacacctgcacgaactgctggaacccgtgcttcaccggcacggcgatgacaagcgaccgttccaccggcgagaaagcccacccgtccggaactcgcgtgtcagattctcccgcgccggggaaacttactttcttcaaaccttcaccgctgccggcgtcgaactcctgcgagaccccactcttcgtggtccagaaccccaccgtcgtgagcccgtcagcggcgaagttcacgatctcgtacgcccggcgtctgcggttgcccgtccagcagcctgaacttccctgccagcccctcgaatgtcgtgtcgagcacagncttgagcaacttctcgccggt

SEQ ID NO: 19042 - DNA, 1472 bp, Zea mays
cattgggtacctcgaggccggccgggaagacccgattccccgtcccagaccccgcgtccggcacaacccttgctgccgtcctggtcgccacacggccacaccaacccaacacctcttcttcctccgctctcagcttaccccaccacaggcgagggaggcgactccttcctcgcggctgcccgctccggccccgatcgcatctcctttgcacgccacggcccgcggcccgcgcgcagtgtccatcggcacggccgtcctccgtgtgtgggggcgcatctggtgctagcttgccgggctagggtttggcttggcctcgtctaccgccccgtctcgtctgataggcacaggttccgtgcacgcgatcgtcgtctctccatccgttgtgactgcttgccgtcccccgcttgcttcgtcctgctacgggagggccactgctgccatcgcgtccaccgacgaatttccccacagagcattagagcaattatcttggagttgcagatctgtacctgaagattcatattgaaatctggaagcttctgctgttgagtacagagaaatatttcttgccttttgaggaagactgcagagcccctaaatgtgaaacttgtttcttttcttgtctactcctgaatgctgacgaactcagcctctcacgttacttagctgaaggtcgtactggtacagacaccgaggatggagcaagcaacaggtgtaagtggtcctgaacacataattgatattccaagggaaattggtcctcctgcttcggtttctcgtagtgctggtagagagaaccatgaagaatcgaatcctgtggacaggccttcaacaagagctctagtacctgccttgcaggcaccatcagcaataggtgctgtacctattacagggcatacttcaggcactaggagaaatgacaactatgttcgtcggcacagaagcccattgaattctggactgtggatttcaattgaagttattgttaactttagccagattgttgctgccattgttgttctttgtgtgtcaagaaaggaacacccacaagctccattacttgagtgggtcataggttacactgttggttgttttgcaacgttaccccatctctattggcgctatatacaccgtaatattgtaacgggccagcatgagtcatcacatacacctcaagggtccgctcataacaactcaaatgaagcgactcatgctgcaagtgcatcagaacgccgcagaaatgctgcccgaaatgctgtgcttgctaatcctaggatcaatgcgctgtttgaccacttcaagatggccctggattgtttctttgctgtctggtttgttgttggaaacgtgtggatatttggtggccggtcttctgctgctgatgcaccgaacttgtacaggtaaaatgtgaactgctcttcaattgaagagatgtcactatgtcagcttctttaacctgctgctgactttctact

SEQ ID NO: 19043 - DNA, 4693 bp, Zea mays
tgctttctctctgacgggcatgcatggccccagggttgcagtggtcaccggagggaacagaggaatcgggctggagatctgcaggcagctggcgagcaacggcgtcctcgtcgtcctgacagccagagacgagaagaaggggtcacgggccgtggaggagctgcagagcgccggcctctccgacgtggttttccatcggctggacgtcgccgaccggccgagcatcgcgcagctcgccgagttcgtcaagcgcagattcggcaagctcgacatcttggtgcgttgttgtatgctcaagttattctgtcgcgttgtttcaggggttcagtcggtctcacgtttgggttgttcaggtgaacaacgcaggcgtcgctggaaccaccatcgatcctgaaaggttaaaagatctccaaaagcaggatcctaaggcaggttttcgagcgattatttttggatggtttcttacattttgccagcacacacacacacagaaaaaaaaagaacagtgtctgagttcagctgataaggtatactgcatttaccatggtccatggctgtaggaagatttgaaaacttttgttgatggttacatgggaagtctgcagcaaagttatgagctcgccaaggactctctggagataaacttcaacggcacaaagcacgtcaccgattgcctgatccctctcctcctgctgtccaaatcaggaagggtcgtcaatgtttcttcacaagttgcacagcttaaggtaaccttcaaatcaggcgctgaaggattcgcaaaaaaaaagacgctctgcaaacaggcgaatgacgctctgcatgcgttttctttcttttctcatcagttcatgtcaaacgaaggagcgatcaaggtgctaagcgacatcgacaacctctcagaggcgaagctcgacgaggtcatgagcgctttcatggaagatttcaaggacggtaacctagcggcccgcggttggctccccgtggtgtcggcctacgcggtgtccaaggcgctggtgaacgcccactccaggctgctcgccaggaggcacccgtcgctggtggtgtgctgcgttaccccgggcttcgtcaggaccggcatgaactacggcatgggcctggtctccgccgaggaaggcgccgcggcgcccgtcgcgctcgcgctccgggcggagcccgccgactccggactcaactttgagctgttggacgtgtgcgagttctgacttcccgtctgacgttccctcgcaagataaacactgttggaagtttttaaaatatatagttttcatactcttctgttgtaagaagaagaaaaacttaaccaatttcaacgcgtcattgaaactgagatgcgttcaaaatcgcaaatgttccgatgggtccacctataacggtcaaactttcatccaacttttgacggataaggattcatcgcacggtaaatatggcagaggaacccaaccaatcacacttttatttggcgcaagcgcaacaaacctccggcggcggcggggacggccaagcccatcgatatttgaggacgccgttgagctcctcggctcctgctattggaatctggacgacgccatcagcctctacttgagcaacgccggtggcagcaccaagccgccgtcagattcgcccgccgatccgatctttgctgaggaggacatgtcgacggaagaggacaagaacaaagaccacggcgatgcaatccacggcgaccgtgaaggcgacgcgggcgctcctcggtactacggcagtcgcggtaccgccgtcgagaacccctgcgtcgtgggggcgccgccatctgcagtagccaccgggtggggaggagcagatcccgatggtgtcagagaaggcgaaacagaagccaccgggtggggagcagagccaggcgacatagtagccaccggatggggagaagcagagtctgccagagaaggcgaaataggagccaccgggtggggaacagagcccgacggtgccagagacgacggcagcaccgccgactggcagtggcaggaagatggtgaatacaatggcgaatactacgacaacaatacgggctacggcgacggcagcagcaactggcaggaacacgaacatggtgaatacaacgacgacgaacattacgacaatacggggtacggcgacggaagcaccaccgactgggaggaacatggtgcatacaatgacgaagactacgacaacacgggctacggcgaggacgaagaagttgaagcctactacccgcctccgtacgagctgaggtacgttgggtacttccacggcgccaaggtgcacgcggcgagggaggaccggttcctgctggtcaacttgcagacatgcagcggcgccggtgaactcccgtcgcagatgcagaaccgggacctttgggcggacgagacggtcaggggggtgatccaggacagctttgtgttctcccttgaaaaggggggcatgagcaggggcagctactcgctcccggacgagtgcgagaaagtggctgcgttctacaggctcgaggaggatcagctgccggccctgctcgtcattgaccccatcacggggcagttgctagcgaagtggagcggcgccatgatgcctgacgagttcatgctgttcgttgacgaatacataagatccaaaccgagcacgctgtccaagcccaaaatcgtcagggaaacggccgtgctccccgcatccgtgggcgcaggcggcgagcaagagccggcacgtgcaccttccgctgcggccgtcgaacaagagccagcaccgcccgagagtcctgcgcctgctgctgatggagctggcgagcaagagcaggagatttctaagaacgactcggcagctgccggcggtgcctgcagcgaacaagaacatgcaccggtgcctaatgctactgagttgcccgccgagctggtcgacgacgacgacgacgagcccatggaaggcgaggagatgtacaagctgaggattcggttccccagcggcaccgtggtcgccaaggagttcggctgcaagaggaggatcgcgtcgctcttcgcgttctgcagatcggcccttcgtggtggagggcagcacgtggaggagaacgcgatccggatcatgagattcgctggccctggctgctcgtggcaggcgatacaggacaaggatgatggtgccacatttgaggatctgggcctcaacttcacaaccgtgtcagttgttttcgatgtctaggtagtgattagtgaaggattctaatacttagtgggatgttattttttttggtttttttgtcttctttctttaattaggaataaatagtgtattgattttagcattgagctagataagatttatataaacaaatttgtcttatatcttatcaagatagatatacgaatttagatttgaataattgtttgccttttttgtagtaggagcaaataatacataaaaatatatatataattttgttttgttttttataattggcttaacgacataactaaaaattggtaccaaatttttatacatatctattttttggatccctgtgaattgtgatctatccctagttgggtcagcaagcagtcgacgttgtttcctcatttgatagaattagtcgagcagttgacgttgttttcaatttcttatcactgctatacttgatggctatatttgttattcacatgtgttcctttttgaaaggaaggccggctgtttagaagaaaaaggaaaaaaaaaaggtccgctctctttgcataagtttaaagcataagcgatgaagttctcatatgcttctgtaaacgaattaaactatgaactggctttaactgggttgaaccaactaaggtgtagctaatagttaatgagactattagatggaggtaagtttagatgtctccggctaaaattaactaatagctaaactattagtttgactgtttaaaatgttttcagctaatttgagcaactaatgcatttaaaataggctttagttgtcctctccgcttgagaccaccctgccttataccccgcattgcacccctgctaacgtcgacgttaacgccgcagccctctgagtcctgatcgttgtttgatttcctgtttagtttatgtaacatcaaaaatttaaatatcaattataactattaaatacagttttaattagtttaataaatttgtttcgtattttaatctttatctatgtaattaattttatattaaaatatatttaatttttataattattatttaaacattcgatataactagattaaatattagtcggttgaaatcaaacacccctcctcctcgcatgcctcaagcaagaacaatcataaaaagacattagcgacatcaccagcatcacacgtcgtctcttctcgacaaaggtcccaggccgtttcgagtttctacaaccatctcctcttccaagtgaatcgtcacggatctggtaccttcatctgtcatctgacttgctctagtactactggtacacttcttttgcttcattttggtcctgttgttcgagggattcagcctgtatttgcgcacaatgctgccgctctctcctctctttctcgcaaggaaacaaaacgtctattggcagctaccataccatcagcacattgcaggtttcgcttgttgatctagaatctcctaattcgggggtatctggtttctaagaactaatttt

SEQ ID NO: 19044 - DNA, 2596 bp, Zea mays
gatgagcccacttttttatgcacgcccagcacgcccagacggcggaggaagggggaaagaggagggcagagcagcaacagtacatcgagcgagggagtagagcaaattgaatcaggtttcgtgtcgattcggaggctttcgcttctgcttgcggagttgcggtggagatttgaggcctgcggcgaagatggcacctgcggaatccggggagaaggcgaccagcttcgccatggcctgcagcctgctcagccgctacgtcaggcagaacggtgccgccgctgccgatctcggcctcgctatcagaggtgaagcctcttctcttgttgaggaaaaatttggggtctcgaggaggtcggtaggtgttctttatctgttgggagtttagcggtgtttgttggggagaagcggtgaattgaggtgcgattcatgctaaaagttgctattttgaggtgctcccgtagtcgtctcgtgtcagatctggtcccgaagtcttgacctggaagcaaatatgtcacttgtatttggtttcgatcaagaatttgggcttctggctgatctaacatccgaatctgatagcttcctgtccatctctgtacagtctatctgaaaattatcggctgaacttttactgaagcagagtgctctatcctgtttcagctgaatccgatgcaaagaggacgtcgacggacatggaaaagggggagacggggaaggagaccatggatctcttcccccagatcgctggattcggctcggaggccgccacgaaggaagcccctgatgcgaggtacttgacgaaatagatacctctctgttcttttgggtttcagttcacagccattctcatgtcatgttagcatggtactattgctgtagtcagttgatgactgaaaacgtaaaaaaaaaaaaaacaatctagctgctgtgagaagcagctcttggtggccagttttttatttgtcaaacagttgtgcctcagatcgatgtagatggttcgatctccacacacagcagtacaacccagatctttgtcttcagaaaatagtgagaagttaatttatcatctgaaactgaatatttgaagagtattgttcgtagggcttctcacactgcaaaccagactgccaaacaatctccggcaaagctttctgtgatgtgtgccaaagctttcttgctatgtcgtagtggttgaatggtagaaggtccatccatgaatctgtagaacttggcgctccgaaactaaatgaatgaacaattggtgccacgcaagttctgaaacttcaaaattttaactcgttgaagtcgtttcatgcgtataagttagccaccaaatttgacaaccggaaacatcctgattctcagggagccagagaagcgccagctgactatcttctatggcgggaaggtccttgtgttcgatgacttccctgctgagaaggcgaaagacctgatgcaaatggccagcaagggttcacccgtagcccagaaccctggcctgctgcctccctccacagctgcaaccgttactgacagcaccaagatcgcagcagtgccagccgcaccaattgctgtggccaacgcccagaagagtgcagcaggtagctgactcgtgcaccccaccttgttcatatgcacgcggcatttctctgaatgattgatttctgtcttgctcactgttcccaaattgtataatgtttgcagatataccgcaggctcccaaggcatctcttcgcaggttccttgagaagagaaaggatcggtaggttactcttgctgctgttgggacgacaaggctgttgttttaacgatacagctcttcgaggaggatctatctaatctgtaatattccctgtttcacgagcggccgcccgggcaggtacccgggttccccttcagatgttacacctgtgaagaaggagatggcggatggtcagccatggcttgggctgggacctcagatcgccaaccctgatctgagcttgtccaaggaggcgagccagtgatcgatgatccagcatcaccatcttcaaaactgcgatactcaacagccatgtgtggaagtgttctgttttgggcccctatcattccggggtttttttcgcatggataaataggttgtacgaaagtaaagaacacagctaatgacggacttcagtaaggattaccggcgctggggcaggtttggctgatcagcctttgctggcctgacccaagtggccattttagaaagatgaaaatgtaatgtagtagttgctagaacaagttggcatcttgggatgttctgtgttgtttggctttggcactggtgcgtgtcagtgtcacaaagctatttattttcacagatacatgctatatgattgttttttttatatcttctggttgtctctgtagggttatgaaatatcacagcttttctttctatgtgattgtgatcaatgcccctggactatcagaatgttgttctctgaagttacaatctactactcccgttgatctagtaattgttgagaagttttgtgttttctagatgcatagattttattatgcactcagatattcatcatgtttagatacatagcaactagaaagcccaagt

SEQ ID NO: 19045 - DNA, 1304 bp, Zea mays
atgaatgggaataaagatgagcccagggcctcttgcttgttatgcacgcccagacggcggaggaagggggaaagaggagggcagagcagcaacagtacatcgagcgagggagtagagcaaattgaatcaggtttcgtgtcgattcggaggctttcgcttctgcttgcggagttgcggtggagatttgaggcctgcggcgacgatggcacctgcggaatccggggagaaggcgaccagcttcgccatggcctgcagcctgctcagccgctacgtcaggcagaacggtgccgcggctgccgatctcggcctcgctatcagagctgaatccgatgcaaagaggacgtcgacggacatggaaaagggggagacggggaaggagaccatggatctcttcccccagatcgctggattcggctcggaggctgccacgaaggaagcccctgatgcgagggagccagagaagcgccaactgactatcttctatggcgggaaggtccttgtgttcgatgacttccctgctgagaaggcaaaagacctgatgcaaatggccagcaagggttcatccgtagcccagaaccctggcctgctgcctccttccacagctgcaaccgttactgacagcaccaagatcgcagcagtgccagccgcaccaattgctgtggccaacgcccagaagagtgcagcagatataccgcaggctcccaaggcatctcttcgcaggttccttgagaagagaaaggatcgccttactgcgaaagcaccgtacccgggttccccttcagatgttacacctgtgaagaaggagatgtcggatggtcagccatggcttgggctgggacctcagatcgccaatcctgatctgagcttgtccaaggaggcgagccagtgatcgatgatccagcatcaccatcttcaaaactgcgatactcaacagccatgtgtggaagtgttctgttttgggcccctatcattccgggttttttttcgcatggataaataggttgtacgaaagtaaagaacacagctaatgacggacttcagtaaggattaccggcgctggggcaggtttggctgatcagcctttgctggcctgacccaagtggccattttagaaagatgaaaatgtaatgtagtagttgctagaacaagttggcatcttgggatgttctgtgttgtttggctttggcactggtgcgtgtcagtgtcacaaagctatttattttcacagatacatgctatatgattgttttttttaaaaaaaaaaataaaaaaaaaaggttatgaaatatcacagttttctttct

SEQ ID NO: 19046 - DNA, 1729 bp, Zea mays
aattcggcacgccccccccccccccccccggtccacaccgtccccgtcctcccactcccccctcgcaaccatttcaaatcgctctctcgacccaactgtactcgccgtcgtcaattcatcatccatccccatccccccatcgactcccagatctctatccccctctccctgtcctcactctctcgagcgcgttgtggcggatgtcctcgtcggcgcgtttcgatctccgggcctcgtcgcatcagttgcagccgccgccgtcgcacgccagcatgagcagcgacgggggcgcgttcgcaaacgcggagaacctggagcactgcgcccggtacctgaaccagacgctcgtcaccttcggattcccggcatctctcgacctcttcgccaccgatccggtctcgattgcaagaacttgtaactgcatctatgcgctgctgcagcagcgacagagggacattgagttcagggagtctacaaatgaccagcggcagcggatgcaatctgatatctcacggctggaagctaagatagagagaatggatgctcaattagcagcgaaagatcgagagctagccactcttactcgaacggaggccaaaaacactgctgctctgaagtctcagattgataagctgcaacaagaacgtgatgaatttcagaaaatggttataggaaatcagcaagtacgcacccagcaaattcatgaaatgaagaagaaagagaaagaatacataaagttgcaggaaaagctaaatcaggtattgatggagaagaaaaaggaatcatcccgttctggaatggagataatgaacttgttgcagaaagaaggacgacaacgcggaacatggaatggaaaaaagaacgacaatgattattacaaaatgattgttgatgcatatgaagtaaagaaacaagagctgatgcaagagaatgcagatttacgggcactgttacgttcaatgcagatggacatgcgtgactttctcaatgccccgaatgggtcatcacaatctactgttactgataatggaagacaggagtcagggtctcctcagtctccgcttggtggcaagacggatgtttttgacttgccctttcatatggccagagatcagatagaagagagtttgcgcacaaaaatgacttcaatcaaggcacgaatgacacaacttcaagatgctcagaaaggtgcagaagtgacttctgaggcaactgaccgggagcttgagcttgaagctcaactggttgaagcaagaagcatcatccaagagcaggcctgcatcatgtccaagcacttcaagtctgataagccaagtggcaggaggcatagcggtctggatggcgagcgtgaggcatctgccgaggtgtaaaagcatgtctgtagcaaggatatatctgttctgcaggacctcctgattttagtaagtaccgaggtagtatgttgcaggatataacatggtcctgtgctgttgtagcccgagtttaggtgctgtctatgcagtatgatgtgcaggagcatatcctccagcacatggctaacccgatcacatctaagtcacatgtagcgtaactgtaatcatattcatactatatgaagaatgtcagtgtagcaacccttgaaaaaaatggacctttcggaccttacatctagaaaaaaaaaaaacaagataaaaaaaaaaaaaaaagcggcccagcggtgacagcacgttgtgacccttgttccctgctg

SEQ ID NO: 19047 - DNA, 2132 bp, Zea mays
gggaccctcgaggccggccgggattctgatgctatagtgtcagtatactatgtcattttagggtgggtacgtcccacattcctgcagaaccaacacctctcggctctcgcgcccgcctgccctggccgctcgcccggtcccactcccgcataggcgccgccgccgctacccgctacccccggcatccggcgctcggcagtcggcaggttcttcccctggcatccggcactcggcttcttcttgccccggttctcggcgcggcggcgcccgctcctcctccccccggtcgcccgctgcaggtcctccccccgcagcacgcgcccgctgctgcagcctgcagctcctccggtcctccccctgccggcgcccgctgcgagctgcagctcctcccccctggctggcacagctgcagcttcaactctcttgaaggcaaaagaattgaatcgcgctctgttgatgggcagcttgcatgctctgcgggcgccgacgccgctcgttgggagcactaggattggcttcagttcggggctccgcttttgctccgacagagtcctcagagggttaactcccattggcgcgatgaagtcgtataggctatcggagctcagcgacaccgaagttagcagcctcaaagctcgtccccgcatcaatttctcgtctatttttggcacggtgaatccaatcgttgaagatgtccgtgtgagaggtgatgcagcagtgaagcactacacagaaaagtttgacaaggtcatgcttgatgatgttgtcgtctgtgttagcgatcttccagatgcagagcttgatccagctgtgaaggaagccttcgatgttgcatatgacaatatatatgccttccatgtttcacaaaaaatacctgagaagacagttgaaaatatgaaaggcgtaagatgtaagagaataactagatgcattggttctgttgggctgtatgtcccaggtggcactgcagtcttgccttcaactgcattgatgcttgctgtgcctgcacagattgctggatgcaaaactattgttcttgccacaccacctagccgtgatggcagcatatgcaaggaggttctttactgtgcaaagaaagctggtgtgacacacatattgaaagctggaggagctcaggcaatctcagcaatggcatggggaactgcatcgtgcccaaaggctgagaagatttttggacctggtaaccagtatgtaacagctgccaaaatgattcttcagaacagtgaagctatggtatctatagacatgcctgctggcccttctgaagttttagtcattgctgataaatacgcgaacccagttcatgttgctgctgatctgctatcccaggcagaacatggtccagatagtcaggttgttctagttgttgctggagacggtgttgatctgggtgccattgaggcagaagttagcaagcagtgcaacgcgcttccaagaggtgaattcgcttcaaaagcacttagccacagcttcactgtgttcgcgaaagatatggttgaggcgatatcattctcaaatctgtatgcccctgagcatttgatcatcaacgtaaaggatgctgagcagtgggaggagttcatcgaaaacgcagggtcagttttcttgggccaatggaccccagagagcgtgggcgattatgcgagcgggacgaaccatgtccttccgacctatggttacgcaaggatgtacagcggtgtatcgctgaactctttcctcaaatacatcactgtccaatccctaacagaggaagggctgagaaagctggggccgtacgtcgcgaagatggccgaagtggaggggctagaggcgcacaagagagccgttacccttaggctgcaagaggttgaggccaatgtaactgtctagctgctgtccatggtctattgcaacgttcagactcgatgtgggatgctggagttcttccctaggaacctaggggaactggactattgatgtcttccaaacatgctctggaatgttagaaagaggcgtttcaactggtgcagctaataatgttcattggaccctgatttgtttcacgaataaacttgagcagaacttactgtgtatatatgcagtgttctcgtattagttatttccctaaaaaaaaa

SEQ ID NO: 19048 - DNA, 2087 bp, Zea mays
gcctgccttgcctaccccctcgcccggtcccactcccgcataggcgccgccgccgctacccgctacccctgcagccggcactcggcaggttcttcccctggcatccggcactcggcttcttcttgccccggctcccggcgcggcggcgcccgctcctcctcccccggctcgcccgctgcaggtcctcccccccgcggcacgcgcccgctgctgcagcctgcagctcccagcccaactggcgattgcagctcctccggtcctccccctgccggcgccggctgcgagctgcacagctgcagctccccccctggctggcagagctgcagcttcaactctcttgaaggcaaaagaattgaatcgcgctctgttgatgggcagcttgcatgctctgcgggcgccgacgccgctcgttgggagcactaggattggcttcagttcggggctccgcttttgctccaacagagtcctcagagggttaactcccattggcgcgatgaagtcgtataggctatcggagctcagcgacaccgaagttagcggcctcaaagctcgtccccgcatcgatttctcatctatttttggcacggtgaatccaatcgttgaagatgtccgtgtgagaggtgatgcagcagttaagcactacacagaaaagtttgacaaggtcatgcttgatgatgttgtcgtctgtgttagcgatcttccagatgcagagcttgatccagctgtgaaggaagcctttgatgttgcatatgacaatatatatgccttccatgtttcacaaaaaatacctgagaagacagttgaaaatatgaaaggcgtaagatgtaagagaataactagatgcattggttctgttgggctgtatgtcccaggtggcactgcagtcttgccttcaactgcattgatgcttgctgtgcctgcacagattgctggatgcaaaactattgttcttgccacaccacctagccgtgatggcagcatatgcaaggaggttctttactgtgcaaagaaagctggtgtgacacacatattgaaagctggaggagctcaggcaatctcagcaatggcatggggaactgcatcgtgcccaaaggctgagaagatttttggacctggtaaccagtatgtaacagctgccaaaatgattcttcagaacagtgaagctatggtatctatagacatgcctgctggcccttctgaagttttagtcattgctgataaatacgcgaacccagttcatgttgctgctgatctgctatcccaggcagaacatggtccagatagtcaggttgttctagttgttgctggagacggtgttgatctgggtgccattgaggcagaagttagcaagcagtgcaacgcgcttccaagaggtgaattcgcctcaaaagcacttagccacagcttcactgtgttcgcgaaagatatggttgaggcgatatcattctcaaatctgtatgcccctgagcatttaatcatcaacgtaaaggatgctgagcagtgggaggagttcatcgaaaacgcagggtcagttttcttgggccaatggaccccagagagcgtgggcgattatgcgagcgggacgaaccatgtccttccgacctatggttacgcaaggatgtacagcggtgtatcgctgaactctttcctcaaatacatcactgtccaatccctaacagaggaagggctgagaaagctggggccgtacgtcgcgaagatggccgaagtggaggggctagaggcgcataagagagccgttacccttaggctgcaagaggttgaggccaatgtaactgtctagctgctgtccatggtctattgcaatgttcagactcgatgtgggatgctggagttcttccctaggaacctaggggaactggactattgatgtcttccaaacaggctctggaatgttagaaagaggcgtttcaactggtgcagctaataatgttcattggaccctgatttgtttcacgaataaacttgagcagaacttactgtgtatatatgcagtgttctcgtattagttatttccctagttgcttcaaaaaaaaaaaaaaaaaaaaaaaaaaaaaaaaaaaaaaaaa

SEQ ID NO: 19049 - DNA, 841 bp, Zea mays
gggctaggcccccacgccgccccgggcgcctgcctgccctagccgctcgcccggtcccactcccgcataggcgccgccgccgctacccgctacccccgcagccggcactcggcaggttcttcccctggcatccggcactcggcttcttcttgccccggctcccggcgcggcggcgcccgctcctcctccccccgctcgcccgctgcaggtcctcccccgcggcacgcgcccgctgctgcagcctgcagctcccaccccaactggcgattgcagctcctccggtcctccccctgccggcgccgcctgcgagctgcacagctgcagctccccccctggctggcagagctgcagcttcaactctcttgaaggcaaaagcttgcatgctctgcgggcgccgacgccgctcgttgggagcactaggattggcttcagttcggggctccgcttttgctccaacagagtcctcagagggttaactcccattggcgcgatgaagtcgtataggctatcggagctcagcgacaccgaagttagcggcctcaaagctcgtccccgcatcgatttctcatctatttttggcacggtgaatccaatcgttgaagatgtccgtgtgagaggtgatgcagcagttaagcactacacagaaaagtttgacaaggtcatgcttgatgatgttgtcgtctgtgttagcgatcttccagatgcagagcttgatccagctgtgaaggaagcctttgatgttgcatatgacaatatatatgccttccatgtttcacaaaaaatacctgagaagacaggtgaaaatatgaaaagcgtaagatgtaagagaatactagatgca

SEQ ID NO: 19050 - DNA, 3068 bp, Zea mays
cattgggtacctcgaggccggccgggatcttcaaaaactacccacggcccgtcccctcgagctccccgaaaccccacttctcggatcgagactagggttagggtttcgtcactcccgccccgattcgaaccaatccgcctaggcccccgccgcgccatggccgccggttccattgtggtggacttcccctccatgggcgccgccctctgcttccccaacctcgaatcactcctccgagactccgcctcgggtttcctctccgccgtctccgccgccccggcccccggcgccgccgacctcaccaacttccaccgcgtcttctcgcgcgtcctcagcacctactcagacccgccgctcgaggtcgtctggttcttctccgcgctctccttccacgaccgccctgacgacctccgctcactgctccagctcctctccgccttcgccgcttcctcgcctggggccgccaagccgctcgccctcctcgcccccgtcgtctccgagcttttccactcagataagccgcgcagggagaccgaggccgtcgtcgaggctgtcctcagctacatcagcatctgcagcagtcgccccgccccctcttcgactgaaggcaccaccgccgacgctgtgaggctgctgccggctttcggcgatcttgtcaaggtgtggagcgtgcggcactcgagggagaggtgcccgttccaggtgctgttcccgctcgctggtgacgaggccaggcgggagctcatgaaggaaggctgcagcgttgactacctcgctggggtggtgctggttgaggcgttccttctcaggctctgcctcaaggtgcagaatgcaacaggagtgcctcgctctgagctgcagaaggagctcaagatctgggcagtcagctccatcccggtcttccagagccaccaattcttcggggtcctgctgaacatgctcttgaactctccgctgcctgtttactctctagtggtatgtgtttcctgactaatgagcaatttgagagcatgacacagcaagctagtattattatggattcactgcttattaacaaaattataagagtattaattaagcattcacaaggcatgtggtagttgtatggaccataaaaatattaacaaacatggcaaatagcttataaactcatttcatgaattaagaaacatgagtcatgatcatgctttttcattacctgttctgtaaactagttatttacctttgtgaaataagaaatgtgcaacttgttgccttgttcttcaattgtgcttggaataaggaatctatcctaatttgtggaaactaaagaggagaacagaacggtatatgactattgtgtatcgcaaagctggtgttactatagcattttgctgtcatcatctgcaaggagcatgatttaagatggagttgtgtctcatctttgtgatatgcaaacaggttgaagcctgaactgtggtttgtcctagtatacccttttgtttcggatcatgattatgccttttttatgcggaaatggcaaaataggggtttatgtacaattttacttggttatatgttcagttttgcaagcagtgcagtactgtacacatgtttttgatcactcctataaagttgccagactggttgatttttccgagtagttggttacttcaattttcactgtttagaatctaaaagtatcatatgtcagataccagaccaggagtaacgcctttattgactgagttttgtcagtggcagtttcagtttttcttgactcatgtaatttgtgttgtgtttggtttcttggtgactcagagtgctgatgatgaaatcttggtgagggatgttctatatgattctcttatcctggtggattattcattcattaacaatggtgctggagttgatctcttgcctgtatatgtgtcgagattgattatcactcttgatgctgtcaatgatgccaggtgataaagagtttttgtaaccaaacttagttggggggggggggtggaaatatcttctcatttcatttctgctgacaggaggaaaggtgatcaaggtagagcagtgtcatttattaatgccttctcaacctcaaatattcccaattttctcatcaagtgggctacttgtcaagctggctctggtgcactcagcaaaccaatttccaatacgccccaagctattctcaagtggcttatcgaccttgaagataaggggctcaaagtgtttggagattacagttcttgggttatgaggaggtttgtttgcaatgaggtcaagaatgggtatgtgaacatggttcagtcagatgcagaccttttcttcgttgataaacagagtggtagggaacttatggacaccaaaggcagcgaggatgatgaagctgttgaggagatggagactgcaggtaatgcttttatggctgctgcccagtcaatgaagggggtaactaacggcataaggaagaggaagagctgcggaaacgaagatgcagctgctgtgaagtttgtgaagtacaaggtagaagacagctcagtgaagggctacctgttagcagctaatggcatgagcagtggcagtgaggtagagaacccacagtcggaagatgagatggaagaatccgactgatgcatagaaaacgacagcacccactaatgcttactttggggagagttgctttgaagagtttcttggacaaccgcctttttggagtctggaccagccttgtttcagatgccgcttcttaatgatgtcgtgcagtaccctgttctaggccaataatctgcaggagggcccctctccagctaggcttttttcggatatagtggtaaccgttagctgaccctacttgacaaggagcatgtgatgtctgctatgagctatatcgtgttctttgttgttataatgctatatagtagagacctcaatgtagtcttgcttcattttgcttttgtaatagatgggtacgttgttgttatcccacggaaccagttggaactaatgaactcttaacctttcctgtgtaaaaaaaaaaaaaaaaaacaccagggggggcccgcgacccggggcccggtacc

SEQ ID NO: 19051 - DNA, 1076 bp, Zea mays
cttccgaagcccgccgttcgggatacctctgctccaaataactccttccctcggcccccccgggcccgaactcctctcaggtcgagcctagggttagggtttcgtccctccggccccgattcgaaccaatccgcctcggcctccgccgcgccatggccgccggctccatcgtggtggacttcccttccatgggcgccgccctctgcttccccagcctcgattcactcctccgcgactccgcctcgggcttcctcgctgccgtctccaacgccccagcccccggcgcagccgacctcaccaactttcaccgcgtcttctcgcgcgtcctcagcgcctacccggacccaccgctcgaggctgtctggttcttctccgcgctctccttccacgaccgtcccgacgacctccgctccctgctccagctcctctccgccttcaccgcctcctcgcccggcaccgccaagccgcttgcccttctcgcccctgtcgtttccgagctcttccacgccgacaagccgcgcagggagaccgagaccctcgttgaggccgtcctcagctacatcagcatctgcagcaaccgctctgccccctcttcgaccgtgggcgccaccgcagacgctgtgagcctgctgccggcctttggggagctcgtcaaagtgtggagcgtgcgctactcgagggagaggtgcccgttccaagtgctgttcccgctcgctggggacgaggccaggcgggagctcatgaaggaaggctgcagcgttgactacctccggccggggtggtgcttggctgaggcgttccttctcaggctctgcctcaaggtgcagaattgcaacaggggtgcctcgctctgagctgcagaaggagctcaagatctgggcagtcagctccatcccggtcttccagaaccaccgattcttcggtaagtgtttcacggccaatttcttattcttccttttagcatcacttgtagtgactcgagtttgtgttggcatgttttgcccgtggatttaacaggggtcttgctgaacatgctcttgaactctccactgcctgtttactctctagtaggtatg

SEQ ID NO: 19052 - DNA, 5732 bp, Zea mays
  misc_feature (5082)..(5082): n is a, c, g, or t
cattgggtacctcgaggccggccgggccctcccactacccactcgacattttttgaacccaaacccctcacttccccttccctcgacctcccccgaactcctctcaggtcgagcctagggttagggtttcgtccctccggccccgattcgaaccaatccgcctcggcctccgccgcgccatggccgccggctccatcgtggtggacttcccttccatgggcgccgccctctgcttccccagcctcgattcactcctccgcgactccgcctcgggcttcctcgctgccgtctccaacgccccagcccccggcgcagccgacctcaccaactttcaccgcgtcttctcgcgcgtcctcagcgcctacccggacccaccgctcgaggctgtctggttcttctccgcgctctccttccacgaccgtcccgacgacctccgctccctgctccagctcctctccgccttcaccgcctcctcgcccggcaccgccaagccgcttgcccttctcgcccctgtcgtttccgagctcttccacgccgacaagccgcgcagggagaccgagaccctcgttgaggccgtcctcagctacatcagcatctgcagcaaccgctctgccccctcttcgaccgtgggcgccaccgcagacgctgtgagcctgctgccggcctttggggagctcgtcaaagtgtggagcgtgcgctactcgagggagaggtgcccgttccaagtgctgttcccgctcgctggggacgaggccaggcgggagctcatgaaggaaggctgcagcgttgactacctcgccggggtggtgctggctgaggcgttccttctcaggctctgcctcaaggtgcagaatgcaacaggggtgcctcgctctgagctgcagaaggagctcaagatctgggcagtcagctccatcccggtcttccagaaccaccgattcttcggggtcttgctgaacatgctcttgaactctccactgcctgtttactctctagtgagcgctgatgatgaaatcttgttgagagatgtcctttatgattctcttatcctggtggactattctttcattaacaatggtgttggagttgatcttttgcctatatacgtgttgagattggttatcactcttgatgctgtcaatgatgccaggaggaaaggtgatcaagggagagcagtgtcatttatcaatgctttctcaacctcaaatgttcccaattttctcatcaagtgggctacttttcaatctggctctggtgcactcagcaaaccaattaccaatacaccgcaatctattattaagtggcttgtcgaccttgaagtcaaggggctcaaagtgtttggagactacagttcttgtattatggagaggtttgcttatgatggggtcaagaatggccatgggaacatgattcattcagatgcggaccttttcttttttgataagcagagtggtagggagtttatggacaccaaaggcagtgaggatgaagctgtggaggagatggagactgcaggtaatgcttttatggctgctgcccagtcaatgaagggggtgactgacggcatgaggaagaggaagagctgcggatacgaagatgcaacagctgtgaagtttgtgaagtacaaggttgaagacagctcgctgaaggactacctgtcagcagctaatggcataagcagtggcagtgaggtagagaacccgcagtctgatgatgagatggaagaatcaaactgatgcatagaaacgagatcacccgctaatgcttactttggacagttgcttttgagagttccttggacagccgccttttttggagccaggaccagtcttgtttcagctgccgcttgttaatgatgccgtgcagaatctgcaagacggccccatctccagctaggcattcggatgtagtagtaaccgttagctgaccatacttgacatggagcatatgatgtttgctatgggccatatcgtgctctctgttgttataacgcagctatagtagagacctaaaaatgtagtcttgcttcaagttacttttgtaatagctgggtacttcgttatcccacggaaccagttggaagtaatgaaatcttaaccttctcctgtgtaaaaaaaaaaaaaaaaaactgacgacaggcccgcaaacagcgccctttctttttttcttttgtgaatgatgagtgaatatggtgaaatattaccaacatgtttggtttgatgaatgaggtagtctatcatcttcttacttactttcttgtttggttttggtttgtggaatagacttataatacatcccctcatttaggatggattgttttttccaaccaaacacactatacatctccttttctttttggtcaatggtgattgagaacgtgatgaaatcatgaaactatcagatgtaagcaactggaaagccttccggagttacgaggaagaggaaggcattgttttttctgtatgcatctccgttctcagtgacgcatatgtcgccggcctcccccttatcgccagcttcttcatgcgcgcctcccctgacgatgtgatcctctcctcttctacccatgccgatctgcgctccgcgctgacgcccatgcccacgaatcgactagtccgagggtctccgctgccggccctgcgagtctacgctaccggacaagtcgtcacgacgcactgctcggccttggcgttcgctgcgagtgcggccgcctggccgacgaccggaaggcatttgatagaatgctgcaccgagacgtggtcgccaggaccgccgtgatgtccgcgcgtcgccacgcggaatgggtctgcgattgcacggtgcccatggcctgtacggtgctcggtggtactggacctggtgttcatggggtaggtctaagttttcactttgcatgtggaacccaacgggatctcttctgtagggtttctgtcagcttctagtcgtgtggtgtgggctactcgatgaatgaactacttttactttatactggtactgtcttatggaattacctagaatgaaacactatgctgcatggttggtattctgatgaaggctggagaacttcctgaagctgaatctacggtcaggtgtcattggttccagatgcatatgtatggatcacaattcttggggctagcaggacacatgaaataccctttgttcctgcgatctcgtatgctaccggtgggtggggctctacagtgtccttatggacaagatcagacattcagaccacaaggatattccagatatatgggtagttttgtgtacagctgaacaaagggtaggctcgtgaatcattatcaatgaaaatgttgcccgtcctgtagcatatccacatccaccgtatgctgttactgtcttggctattgatctgacagactgacataatggattctgctgttggaaatttggattttcctgaggagttagagactatagttttttttttttttttttattaattctcaactcatgtccttccatgccacgctacagtttatttgataacatagtgtatagcatagataatccatctctaaattgctgtgcagattgacgacatatatcatgttgaatgcaggatggagacttttatcagtacttgcgaactaagagttggtcggtaatcagtgcggcacacgacggagggcaggatgctggattgctcatctcgcatttgctgtagtcaaattgtgaagcctgtgcaggtggactgatcacttcgccggccaacttaagcagcgtcttttccagttcctcgccgctgttccacggatgaacctcagccttgagaagctgcttgttgtcgcagatgagatgccacagggggtagttctcccttgccatgacgtggtccccttcccccagcttgagggacgggcagtaatctcccttcccgtcaccgatgtagatgaagcgccgcttcttgtcactgcctgttgcctggatcctccccagtatcttgccctgcacttgcacatgttgtcagggcaaaggctgcaaccgtgcgttaccggtgagtttccgcatctcgacatgactgttgactatgtgcattgcacagagatttcatcagtgtcgaaagtagagtatgggcatccagacatcttaaactagaaaactatgctgtttgtaatcgtggtaccttgcacatgttgtcagggcagaggctgcaaccgtgcggcgcggacgcggggtcgtggaacggcgagatcctgagcctgccgtccgcgtcgacgctcgccggattggtgacgatctcggagaagcagccgagcacgccgtggtgcgccaggacggtctcgatgaagaaggtgttggcgtcgctcaccaccttcaagtcacacctgcaaacgggagcagcagcagccatgccattgccagcatcaaagaacatcggtcggtcggtcccaaacgcaagtgctgcagcggcaggtgagaacgtggtcggcatggtgtggttgtgccgtgcgtaccccagcgccgccgccgtcttgactgcggaaacgacgtgcgtgtcgagcggcgcgctcctgaggcagtcgcggatgtcctcgggcgtcttccccctggcgtggagctccgccatcatcctgtcctggaaagagaaacccgaaatcgacttggcgcatgtcttccctcaggaaggacgagggaggttagttaccggacgaggagaggtagcagtaccatgagcgggttccagcgcatggttgggcgcaggcgctggaaggcgtcggcggcgccgagcttggtgatgacccagtcgtcgctgtcccagtcgatgatggtccggtcgaagtcgaagaccaccaccacttcgggggcgaacgcggacgccatgggcggcggatggcaagggggaggaggacgaggacaggcaggactcccgggttcgcggctcttctttcgcgccgtggacggcaggttgggcctgtggagcgctgccggtgccgtccccgtctcctctcctctcctctcctctctgctttatacggagtatatgtgatgagaagcccatctgcttgctgacttgttaaggtttgcgcgtcgcgtcgtggtcagcagtcacatgtnttgccttttgccatttgctcatcgccgtggctttgcactctgctgccgtgtgtttgctgtttggcttctctttcccccggcctcgtttcattcctatctcggatttgctttgcgcttgcgtgttcctagtaggagtaacatgtaagaaggaaaaattcggatgtacgaatatgagtttgctagcaaaatggattcgggatctgaaaaaactcataaacaatttcaaatgtagggccgcaaccagaaaatggaggtctaacataaaccctatttaaatggaattcatccaaaaaaaattagggcctaatctcaggagctgtatatttgagacccacagagaagcggcctaatattgccctttgtctgaaagatttaagagactgtttgatttatcccttaataaagagataagtgtgaataaagcccttagtttgaattggcataacctaacttttagaagaattgaaagagatttgcagtaatcatagcttatctgactctgatgataaagttgtgtggttacttaataaaagtggttttccgttagatctttatataccagatgtatacgtgatttggccaaggtgccttataaatttatatggaaaaccaaaattccccagaggatcaaggtgtttctttggctagtg

SEQ ID NO: 19053 - DNA, 1792 bp, Zea mays
ccccggcgtaccagtaccagcccaccgccgctgctccggcgccgcaagtcgcgaagccgcggcagctggaccggcggtactcgcggattgccgacgactatcactcggtggaccaggttactgatgctctagctcaagcaggacttgaatcatcaaatcttattgttggcgttgatttcacaaagagcaacgagtggacaggcaaattctctttccatggacgtagtctacatcacattagcaacacaccaaatccgtacgaacaagccatctcgattattgggcgaacactatcgaaatttgatgaagacaatttgattccatgtttcggatttggagatgcatcaacacatgatcaagacgtcttctgtttctctcctgacgagagaccatgcaatggatttgaagaagctcttgatcgatatagcggaacttgtaccacatttgcgcttagctggaccaacatcatttgcgccaattattgagatggctatgaccatcgtggagcaaagtggcgggcaataccatgtcctattgataattgcagatgggcaggttacaaggagtgtagatactgcatctggacagctgagttcgcaagagcagaagactgttgatgccattgtgaaggccagtgaattgcctttgtccattgtgttagtaggagttggtgatggcccctgggacatgatgaaggaatttgatgacaacattccttctcgagcttttgacaatttccaatttgtaaatttttcggagataatgtccaagaacatggcacaatcaaggaaagaggctgcatttgctctttcagcattgatggagataccacaacagtataaagcaaccgtggaattaggaattttaggtcgtcgctcttccaagtctcccaacagagttcctctacctccgccttccgcaagtcatgatgcttattcctattcatctaaaagctttagcaaaccaaccacctaccctcagagttcttcatcctcatcagcctatcctcaatatggaactccacatacagccaccccggccgcaccttcgtccacttatgacaaccaggtctgtcctatctgtcttgtgaaccccaaagacatggcgtttggctgtggacaccagacctgctgtgactgcggacagagtctcgagtcgtgtccaatctgtcgcactcccatcaccacaagaataaagctatactagcaagtggtggctttggatcattgccaatgggtggtatactggagccaccctgcctcacactggaggatcgcgacggcatgtcccagtaaccgtcggaacacccgctccgtagatcgattggagctaaggattgcagggccaagcttggatcgattggagctgaggattgcagcgttggtctatcggacagggttgccccagtattcatatccacgagtaatgatccaaatcgcagcttgcaaaaaacaatctctatataaacgagaagaaagagagaggagaacacaaaggtagtggtgtggtggagcagtcaattgcgtgtcgggccatgacacgcaacttcccttggtgccttcgttacttgtcaaaccagcaacactagttgtacatatcagaatttcgtgcttatctggacttctgatgccaggcttagaggattctttatttgtgcgcgtacttctagtttcgtccgagatatatgttgatttgttctttgcttgcaattgtgtaaaaaattcaatccgcaaaattttgttttggtgaatcagaaaaaaaaagtatttggtaggtgaaaaaaaaaaaaaaa

SEQ ID NO: 19054 - DNA, 1768 bp, Zea mays
cccacgcgtccgcggacgcgtgggcgccggtgccacagcagggaggagggtacgccgcgccgtaccgggacaagcccgccgctgtcgccgttgctgctccggcgccgcaggctgcgaagccgcggcagctggatcgccggtactcgcggatcgccgacgagtatcactcggtggaccaggttactgacgctctagctcaagcaggacttgaatcatcaaatcttattgggcccggggatttcacaaagagcaacgagtggacaggcaaattctctttccatggacgcagtctacatcacattagcaacacaccaaatccgtatgaacaagccatctcgattattgggcgaacactatcgaaattcgatgaagataatctgattccatgtttcggatttggagatgcatcaacacatgatcaagatgtcttctgtttctctcctgacgagaaaccttgtaatggatttgaagaagctctcgatcgatatagggaacttgtaccacatttgcgcttagctggaccaacatcctttgcaccaattattgagatggctatgaccattgtggagcaaagtggcgggcaataccacgtcctattgataattgcagatgggcaggttacgaggagtgtagatactgcatctggacagctgagttcgcaagagcaaaaaactgttgatgccattgtgaaggccagtgaattgcctttgtccattgtgttagtaggagttggtgatggcccctgggacatgatgaaggaatttgatgacaacattcctgctcgagcttttgacaatttccaatttgtaaatttttcagagataatgtccaaaaacatggcacaatcaaggaaagaggctgcatttgctctttcagcattgatggagataccaccacagtataaagcaaccgtggaattagggattttgggtcgtcgctctttcaagtctcctgacagggttcctctgcctcccccttccggaagtcatggcgcttattcctactattcatctaaaggctttagcaaaccgagcacctaccctcagagttcttcatcctcatcaccctatcctcactatgaaactccacatacagccaccccagctgcgccttcagccacttatgacaaccaggtctgtcctatctgcctcgtgaaccccaaggacatggcgtttggttgtggacaccagacctgctgtgactgcggacagatcctggagtcgtgcccaatctgtcgcactcccatcaccacaaggataaagctatactagcaagtagtggtttggatcattgtcaatgggtggtatactggaggagccacccagcgtcacactggaggatcgtgtcagcatgcccatagatcgattgcaatcggaaagctggagcggcactccatagatcgatcgattggatctaaggattgcagggacaaagcatggatcaattggagcgaggattgcagggccgttgattcatcgctcagggttgtcccagtattcatatccaccaggaatgatccgaatctcatatcgcaataaatactataaaataataaacgagcagaaagatgagaaacacacacaaaaaaaagtggtggcgtggaggatcagacgattgcgtgtagggtcatcacacgcaactcagcttggttactactctaatctgcaactttagttgtacatacccaactttaggatcagaggattccttaaaaaaaaaaaaaaaaaaactcgagactagttctctctctctctctctctcctcgtgc

SEQ ID NO: 19055 - DNA, 2492 bp, Zea mays
gtcagtctgcagaaagagcagcaggcagggcagaggcgccaccaaaccaaaccaaagccgggttttcatcagaaaagaaggcgccaaagccagggatggagcgatgagtgagcgacacccggaggacagcgacggccagggccactgttgctgttgctgttgctgttggcttcgtgctcgtgcagcggcagggacagggagatggccgagagcccgagacgcgaacaagaagcagatcatgcgggaggagacggtagggcgggccggcggggcggggcccctgtaaagcacgagccttgttagcaaaattatatataaataaaccccactccatcgattcctctgccgtttttagcaccgaatcatcgcagacgcacgccacgccgcagcactcagcactccggttcgggcgttcgggcaggcgaattagggatacgttggaggagcaatggcgggaaggcgagaggagtggggtggagaggtactgcagcggcaacgggcaggaggaggaggaggaggatgaggaagagcaagaggatgaggatttcatcgacatggacctgagctctgccgcggccaggacgcccgtggcgcatgagttcgagttcatgtcggcgccgctggaccggtggggcgagaccctggctgcgtcgccggcagacgagctcttctacaaggggaagctgctgccgctgcacctgccgccgcgcatccagatggtggaggagctcctggacggccggggccggggccgcggcagggacagggacagggacagggagctcctgttccgcggcgtcagcagcacggccccggcgacgccgtacgagtcgtgcaacgcgtcgccggccaactcgtcgtgctacgactacggctacgccagcggggagctcaacgtcgaggagtacttccaggagtacgcggccggcctggcgctggccgaggacgccgccgcggcgccgaggaagccgtggtccaggaggctacggttcatgaggcagctcaacctgggcctccggctcagggcgtccaaggcgtacctcaagaccatcttgttcgcggccaggccggggagcccggccgacgagaagagcggtcttggcgccgtcgccgcgaggggcgcgcgggaggagatcgccgcccatggccacggccacctcagggcgtggacgaagaacccgttcgcccagaccagaatgaacaccaggtgcgtcgcctctcacggtggcaccagccgcgccgctgccgctgccgctggagggcggtgcaaggaacgcgagcacggggcgcacaggcgctccttctccagcgtcatcgtccgctactctccgtcgaacaagacgtcccccgtccccgcgctgccgccgtcctcgtgctcctcctcgtcggcctcctcgtcggtccggacctcgagcgggtcgtccgacggcggcgcggggccggcgctgaggaggagcagcagcgcgagctcggaggtggagaaccccgtccaggggctcatcgcctactgcaagaggtcccagcagctggcctccgtccggaagagcgccagcgacgccggcttccgcttcctgtcgtcgtccgcgtccaggatcgccgccgagtccgagtccgagtccgacggcctcgacgagctcaccgagatctgcagaggatgacgatacgatagtgctccatgaacgatgaatcccgatcattgtacaatgatgcaaatgcgttctggagattttgtgaaggaaaaaaaaactgaaacttgtggcgttgaccgcgcgccctgtgtcaagtgtcatgatgatatcgttcaaatgaatggcatctgaactttgagccttgactggttcaggaggacattgacattgcgtgttgtggaacagctgtagggtttttccatggatgaggaaaaccaatagcagagccttatttgcaacgaaaaaaaaaaaaaaaaagtacattacaagctcgttatggaacagctgagtttcatggatgagtagaatcaatagcagagccttacttccattacatcactttagagcccgttcagtgacaagggtattcaaataaatacctaagatttcaatacaaaaaataaatataaaagataattttagtttttatcaatcttatgctcatctaagactccattttaacgtgttataaaattgttgatatataaatatataatatataatatatgtggtattatacgtatcaaattttaagactttatatagtattatacatgttaaattttttatcccttagagctggtttggtggacatggaattagagagaatccatagaaagtaatctcctccctcttaaaatttgaatagggaggagattcctcctacatggatcccatccaattctctgtccaccaaatcagctcttaataattttaaatacccatgtttcaaatcctgggtccgcaactgaaggcttcggctctggcttttctatagaaaaaaaggcaatctctaccaaacac

SEQ ID NO: 19056 - DNA, 880 bp, Zea mays
tttttttttttttttttagaagctacaaaaagctgttttattgagaaacagttgtgttgtggttaaagccggagatttacaaaataatgccgtagaaagcaagcaactgtgtgttttcgctgctcttcctataatcctatacctcgcctacaaaattatagaaagtgcgtagggacacggaacaggaatcagagcgcaaggcttgaggttgtcaggacaggagtcgctgacgtccggccgtcggtacggctccgtgcgggcggcggcgacacgagccttgcgcttctccatgaaccgctgcagcgatgccttcctcgcaactggcaggtcagcgcccgcagacgcagagccggagacatggtcgcggcgcttggcaccggtcgcctctgtttctgcacgttccgctgctgcgccggcggcgaggcgaagcaggcccgccgccttgtcggcggggacgtcagcgagcaccagcacacgccctccgtacacgatggtcaactgcgccggcgccgcctgaggcaggtctaggtcggcagggctggcgtcgacgtcggcgcccggcatgagcgggagcggccgcagaggcgcgggcggcctcgcgtgcatcctctcggattcggccgccttgacgtactggctgagcgccccgcacgccgccgcgaaccggcttctcgctgccgcagcgccgcccgtgcctactggagtagtaaccgctgttgccgccatcgtcgccgacgagctgctggctgctgccgcgcgctaccttgggttgggagttgggaggaccttgcttgcttcccggtttcgtgcgtgaggtgaaattgtttggtttggcttgggctttttttcgattaggatgttctaggtaatggtctcgtgc

SEQ ID NO: 19057 - DNA, 1295 bp, Zea mays
  misc_feature (1088)..(1088): n is a, c, g, or t
  misc_feature (1193)..(1193): n is a, c, g, or t
  misc_feature (1223)..(1223): n is a, c, g, or t
  misc_feature (1276)..(1276): n is a, c, g, or t
gccgctgccgcggcggcggccggcgaggacggcccgcgcgtccggacgttcgacggcagcggcggcgcgcacgccagcgcgcgcgggcccgcgaccggccgccgcgccatgttcctgtgcagggtcatcgccggccgcgtggcggagggggccggcgcccacgccgccgcagcggccggaaaggagcacttcgactccgtacgggttggcaggggcggcgagctggtggtgttcgaccgccgcgccgtgctcccctgcttcctcatcatctacaagctgtaactgtaaaaagagcgggtcagctacgtaggcccccccccccaattagtcctgctgctaattcttttctcatttgtctgctaaccagtcaactgcatatagtagccatactgcttcttcatcaaccctcaggatcgttagccttcgccaccactcgtctcgctggtgactgtcgaagtgccccgtgcctgtgcctctttcgcagtcgcagcagctgcgcaattgcagatactgtgcgcgtgcagtccgtgcgcgagtttaaggcgcgcacagaggctgcgcatgtccggttcgctcgcacagtgcagtgcagtgcagtgcagtgcgagcgagcgagagcttgtccctgtgcggcgacgctggttgcttattccttgccgttgtcgcgttcgatgcgggcgggccgcggcgcctccgtgccccgccggagccagagacaaaaggaatagacagaagtgctcggatttggatttttcactgctcgccttcgtttcaggcgtcgtcttctgttcacctgcatcatctgagccactgctgtacctgtacgtatgtatatgcttgcaatgcaatgcccactacggcagcccagcgttgtttcatttgcatcgctccattccatatggccataatcttgtatcaggatacagatgaaattcagatggacgagagctacctggaaggctggaagcagattttgacgatcaattaaggctatccgtagcaaatcagaggatttacgctatagatcagtaaagttctgaatagggatgaaataaaataagatagctgccgaagatattgggatcctntgcagtcgagacagtttaagcagcgggcgcccggcagagctttcagagagggatcgagtagtcccattatattgccatgtgtgtgtactgctgctgctagtgccnccctgttatagatcttgtgatgatatacgngtatttgtactgttcatggaagtattgaaatagcaacgacttgtcagagactngaaaaaaaaaaaaaaaaaa

SEQ ID NO: 19058 - DNA, 1036 bp, Zea mays
ccctgccacggcgcggacacagagagtggaaaccggaagggaggaagagagatggattcctccacctcggcggcggcggcaggggaggcggccttgccgccggaggacgacgtctgctccgtctgccacgaccgcttccggatcccgtgccaggcgaactgctcccattggttctgtgaggttgcaagacctacccttcttcatccgaagactgttcagagaactaatggacccccagcggaccctcccactcgtgttcagggcgcggatgctgatgatggcatgctgggcctctttggattcgtcgatgacctgctcatcctgctgatcgtgttcctccacctcgccgcggtgtaccggtcgttgctcctgtaccgccacgggggccagtagaagtcgctgtgcataaaccgtttgtttagctggtttccatgtggagttctctgagatcgcagcagcggatttggaagatcgccgactcgccgagtagatggcaacgtcacggacggcttagcctgtccctgctctgtaccattctactacgcctgtttttctgagactctgacacggtgaactgaactttggttggttgatgcaagtgaatttcccttcgttttactcgtcaggaaaagaaagggaaagagtttgcgttcgtttgtctttgtttctgctctttggaagttggaattgaaactgcactgatgtttgcgtttcaggaactgcattgacgtggatcctgctcagttctcttagcatttacttatgggccaagtttgtagaagtttagtgggctgtagacccattggctgtcatgttgggccaccgcgacgaggaaagaagaggtaggggatcgccctggccgggtagttggctcttgcgggagggatgagatgggaatgggatggcgacgggcgggcgtgtgcggctgcaggcggctcggaaggggcacggtggagacgcagcggagccctcgcctcttctcctgctcctgctgcccgcctctcgccctgggcccccctgctgacctgacgagctg

SEQ ID NO: 19059 - DNA, 1124 bp, Zea mays
aacgacgaataacaccgagtggcgaccgcctgagtcctgacgcgcccgtgtcggcaagccgccgacgacttgacgtggggcggggaaacaaaagaacgcgggcagcgccacggcaagcgcgtccctgccacggcgcggacacagagagtggaaaccggaagggggggaagagagatggattcctccacctcggcggcggcggcaggggaggcggccgtgccgccggaggacgacgtctgctccgtctgccacgaccgcttccggatcccgtgtcaggcgaactgctcccattggttctgtggagagtgcatcatccgcgtttagcggccgcccgggcaggtacaggcttgcaagtgtcccatttgtcgccgccttataaatctactggtgcctgctgcattatcagggcaggaggatggtccacaagctcaacgtattctaggagagattcagcactataactgtatatttggtggagcaccacgcagcctaactcagaggttgcaagacctacccttcttcatccgaagactgttcagagaactaatggacccccagcggaccctcccactcgtgttcagggcgcggatgctgatgatggtcgcactgagtgcaatttatgtgctgagccctgtcgacattcttcccgaaagcatgctgggcctctttggattcgtcgatgacctgctcatcctgctgatcgtgttcctccacctcggccgcgaccacgctatcgttgctcctgtaccgccacgggggccagtagaagtcgctgtgcataaaccgtttgtttagctggtttccatgtggagttctctgagatcgcagcagcggatttggaagatcgccgactcgccgagtagatggcaacgtcacggacggcttagcctgtccctgctctgtaccattctactacgcctgtttttctgagactctgacacggtgaactgaactttggttggttgatgcatcatgcaagtgaatttccctaaaaaaaaaaaaaaaaaagggaaagagtttgcgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 19060 - DNA, 1350 bp, Zea mays
gaatgctatacagagagagaaggcgttgcctcgtatcgaatctaacggcggataacaccgagtggcgaccgcctgacgcgcccgtgtcggcaagccgccgacgacttgacgtggggcgggggaaacaaaacaacgcgggcagcgccacggcaagcgcgtccctgccacggcgcggacacagagagtggaaaccggaaggggggaagagagatggattcctccacctcggcggcggcggcaggggaggcggccgtgccgccggaggacgacgtctgctccgtctgccacgaccgcttccggatcccgtgccaggcgaactgctcccattggttctgtggagagtgcatcatccgcgtttggaattatggacctcctgtacaggcttgcaagtgtcccatttgtcgccgccttataaatctactggtgcctgctgcattatcagggcaggaggatggtccacaagctcaacgtattctaggagagattcagcactataactgtatatttggtggagcaccacgcagcctaactcagaggttgcaagacctacccttcttcatccgaagactgttcagagaactaatggacccccagcggaccctcccactcgtgttcagggcgcggatgctgatgatggtcgcactgagtgcaatttatgtgctgagccctgtcgacattcttcccgaaagcatgctgggcctctttggattcgtcgatgacctgctcatcctgctcatcgtgttcctccacctcgccgcggtgtaccggtcgttgctcctgtaccgccacgggggccagtagaagtcgctgcgcataaaccgtttgtttagctggtttccatgtggagttctctgagatcgcagcagcggatttggaagatcgccgactcgccgagtagatggcaacgtcacggacggcttagcctgtccctgctctgtaccattctactacgcctgtttttctgagactctgacacggtgaactgaactttggttggttgatgcaagtgaatttcccttcgttttactcgtcaggaaaagaaagggaaactgagtttgcgttcgtttgtctttctttcttctctttggaagttggaattgaaactgcactgatgtttgcgtttcaggaactgcattgacgtggatcctgctcagttctcttagcatttacttatgggccaagtttgtagaagtttagtgggctgtagacccattggctgtcatgttgggcctgcttcctgggccgcgacgagtaaagaagaggtatgggatcgccctggccgggtggttggctcttgcgggagggatgagatgggaatgggatggcgacgggcgggcgtgtgcggctgca

SEQ ID NO: 19061 - DNA, 3275 bp, Zea mays
  misc_feature (2494)..(2494): n is a, c, g, or t
  misc_feature (2712)..(2712): n is a, c, g, or t
  misc_feature (2812)..(2812): n is a, c, g, or t
accgctcatatctccctctccctctccgcctcggccgcttcccctccccgctccactcttccccgcgccctgtcccgttggccgcgaatggttctcgcgcgagtcctcccgctgcccgccccgtcgtccgcgccccaccgccgcttactcctgccgactcaggcggcgccggccccgccgcgtgtgctcaccgtgcgggccgtcgcctgccgcgcagcgaacgccatggcggccgttgctctggacccgcccgcggtcgctccgagccccgcagaggtcgcagccgtggggcatcggggaggagctgccggaggggtacgatcagatgatgccgaccgcggagccgtcgcggaggcggcgcgccgggctgctgctgcatccgactttcgttgcggggcccgcacggcatcggcgaccctccggggacgaggcgctcgctttcctgcattggctccgcgacgccggctgcacgctctggcaggttctaccacttgttcctccaggtaggacggctggggaggatgggtctccttattctggacaggatgccaactgtggcaatacccttttgctatcccttgaggagcttgtaaaagatggtctactgatgtcagatgaacttcctgatcctgtggatacagagtatgttgaatttgacactgttgcaaatctgaaagaaccacttattgcaaaggcagcagagaggctcctactaagccatggagagctcagaacacaatatgactgcttcaaaaaaaatccaaatatatcaggttggcttgaagatgcagctctttttgctgctattgacagaagcatcaatgcattctcttggtacgagtggcctgaacctctgaaaaatcgccatcttggagccttggaagatatatatgaaaaacagaaggattttatagagacatttatggctcagcagttcttatttcaaaggcaatggcagcggattcgtaaatatgcacaaaagctgggtatcagcatcatgggtgacatgcctatatatgttggctaccatagcgcagatgtttgggcgaacaggaaatcatttttgctggacaaaaacggtttccccactttcgttagtggcgttccacctgatgcatttagtgaaacgggtcaactatggaacagtccattgtacgactggaaagctatggaagcagatggtttttcatggtggataaagaggattaaacgtgcccttgatttgtatgatgaattccgtattgaccatttccgggggcttgcgggtttttgggcagtcccttctgatgcaaaagtagcactggttggaagctggagggctggaccaaggaatagcttttttgacacgctcttcaaagctgttggtagaatagatataatagcagaagatctgggggtaattactgaagatgtcgttcagctaaggaaatccattggggcccctgggatggcagttctccagtttgctttcggaggtggttctgacaaccctcatttgccacacaaccatgaaatggatcaagttgtgtacactggaacacatgataacgatacagttcttggctggtggcaaaatttaccagaggaagaaaagaaaattgtgatcaagtatctaccagaagccgagaatattgacataacatggacactgattacggctgccctctcttccgtcgcgaggacttccgtggtaaccatgcaggacattcttggccttgacagttctgctagaatgaatactccagctacccagaaaggaaactggaggtggaggataccgagctctgttggcttcgacagcctcagccctgaagcagcaaagctgaaggagctgcttgcgctgtacaatcgacagtgaagtccgctattgccatcgaagttccttcaataaaataggcaacaaaatgtgagcggtttggttgccaagttctatggtacgcggccccgcacagaggttgtgttctggttggctggaaacttgcgtgcactgcaagttaagacttgaacatgaagcactattgtatgtgtgtgcattctcattttttattaaccattttgtttttggtcgggtctatacaagtgttttcccccattgctttgcagcaaagcattaccaatttggatccgtttcttccgggtgacttagggggtcttgggttgtgtaatgtaactcgaattcctttaggccgcgttcgttttggccggtttggcctattccgggcttggttccagactgaaagaaatgacccggtttggaatcggaccgtgtcttcgagaggtgttcgttaagatctgaatcaaaaatgagagcggtctggtttagattttttttctcccaccacggtctggaagtaaacatggtatactgcccttcggatccgatccgcagctctggcggaggcgaagaggcgactacgccttatgacggtgtgctgcggtcttctctctggtaaggcctcaccgatgctttccttcccaaaccgtctgtccctcnacaatgctttccttccctaaatgcactgtcgccgtgtcgcttctcgtcggcaccgtcgctgctactgtgaccatgcactgcgcgccgaccacttcttctgtgtgcgcgcccgccaaccgcagcattgtcgcgtcaggaaagttgagtgtcacaccagcatcctgcagcgccaatgtggcggcatcgtaggccgcgacagacatcttggtcgtccctcngcaatgctttccttccctaaacgcattgtcgccgtgtcacttctcgtcggcactgtcgtcgctactgtgaccatgcactgcgcgccgaccacttcttctntgtgcgcgcccgccaaccgcactattgtcgcgtcagtaaagttgagtgtcacaccagcatcctgcagcgccaatgtggcggcatcgtaggccgcggcagacatcttgatcgtcgagtacgtgccgaggcagatcctgctgggctcccgcagctcgccgccagatctccgacgccactaatgtatggagagaagagagggtaaactgttgggcttgctgtcaaacaggggttgcaagtgtctttattccaggctgaaacgaacgagctattctgcagttttgtattgattccagacttggattcatcactgtccaagtttcagtgaaccaaccggatgcactatatccggaccaagatcagaaacgtgggtgattttaatcctacacaaacgaacgcgaccttaggttgctcgcgtactcgccggcagcgttcgacgagcaaagggtaccggctttctggcgag

SEQ ID NO: 19062 - DNA, 1203 bp, Zea mays
gccggccgatactcgatttctatttctctcaatcggttctctcgttctcctacctcccttgcgctctgcgactctcttcttgtctctggtggcgacgagctgacgattgggcggccgccgccgccgacctacgccaggtgcccgagtctccacctttggaccttcaccggcgacgaacacccaccagttgacttggacagccagaactttggaaatggcaagatcaccaaaaggtaggaacctccaagctcgtcaacgtaggtcagcttcttcagatgtgcccttgagctcctgtgagacgaaaggaacaagcaaaggaaatgatgtgtcagtgacatctgagaagaatgaatggaaaggagcaacttgcccagtttgcttggagcatccacatgatgctgttctcctcctgtgtacctctcaccacaagggctgccggccatatatgtgtggtaccaactaccgtcattccaactgccttgaacactttaaaggagcttatgcaaaggaaaaaatggctcttggtgtttcagctgagtctgcatctggccttccattatcctcaaacacactgccatcaagcaaccagccatgtgtaatggaacttgcctgccctctgtgccgtggagaggttaaaggatggactgtggttgagcctgctcgtcagtatctgaaccggaaaaggagaaattgcatgcatgatgggtgctcattccatggctcgtataaggagctttgcaagcatgtgaaatcgaagcaccctacagcaaaacctcgtgaagttgatcctgctactgcagatgagtggaaaaggtttgaatgtgagagagagcggcaggatgccatcagcactatcaggtccatgaacccaggatctgtgatcatgggggattatgtccttgagttgaatggtggtggcaacaaccatttgctctcagatggagataactttgacttaggggaaaggctcaacttcttcacatccttagatcgtactttgaatgagagaattgacctgtacgactcgtcagatggtttggatgaggggtttgacttcttggcatccctgtttacccatggcaggagaatctctactggaggctcattgagcagggcttatagaagacacagggacaggcctagacgttcaacgaattctgctgatgcttctgacattcagcatgagtcagctagcactcaaag

SEQ ID NO: 19063 - DNA, 1552 bp, Zea mays
gttgtaggacgaaacgagttctttgtcctgggcctttgtcactcttctctgtgtaacgacttcctccctttcctgccgcaccacgcaatcaccggggcggaggcggctgccggcgagcacttgggcgtctccggccaccgcctgcctcgttgtggctccccgttgactcccgcgatttgttacccgctggcgctgccgcacacagctcaaaaggagtagcagcgcccctggttgccggttggagcgtcaaggatgagcgggaggaagaatgcgggcaaggtttccccctggttgctcgtcctcatctgtttagggtgcttctttgtgacctacaacctcctgacgatgcccagccggggacgggatgggccgcgcaagttcctcggcggcggcggggatcgccactcaactgcctcgttggggtcaggctctgattcggaccccgcgaagcggttccacgtcgcgcttacggcgacggacgcactgtacagtcagtggcagtcgcggataatgcactactggtataaggagatgagggaccgacctggttccgacatgggtggcttcactaggatccttcactcgggcaagcctgatggattgatggatgagatacccaccatggtggttgatccccttcctgaaggcaaggatcagggatatattgtcttaaataggccttgggcttttgtccagtggatccagaaagcaaagatcgtagaagagtatatattaatggcagagccagatcatgtctttgtgaagcctttgccaaacttatctcatggtgatgagccagcggcatttccatttttctacatcaaaccgactgagaatgagaagatattgaggaagtttttcccagaagaaaaagggcctatttcaaatattgatcctattggcaactctccggttataatcaagaaggctcagcttgagaagattgctccaacctggatgaatgtttcattaaaaatgaaagaggatcaggagacagacaaagcattcggatgggtcttggaaatgtacgcatacgctgttgctagtgcactgcacggtgtgcaccatagtctccataaagattttatgattcagcctccttgggacctgaaaacggacaacacattcatcatccattatacgtatggatgcgattattcaatgaagggtcagcttacttatgggaaaatcggtgaatggcgttttgacaaaagatcttaccttcaatctcctccaccaagaaatctttcactgccccctccaggagttcctgaaagtgtggtcacccttgtgaagatggtcaatgaggccaccgcaaacattccggggtgggaggacgatagatgattgatggtctggctgagttgtagtttattccagcacccagctggtatggcttttgttcaaaaacatggaagaatatcattggtcaataaaagaaaagcatttgattaatatcaaaaaaaaaaaaaaagcactgtggccacgtttctatagtttaacataggttagtgtccgggaagaaaaaagatatattaacgttgatctagga

SEQ ID NO: 19064 - DNA, 1554 bp, Zea mays
ctttgtcactcttctctgtgtaacgacttcctccctttcctgccgcaccacgcaatcaccggggcggaggcggctgccggcgagcacttgggcgtctccggccaccgcctgcctcgttgtggttagtttccctcaccttccccttacctcactgccatattccttctcccgatccgtcagtttcgccagctgaagacgatcccaatctcagatccaactaggaactcacccagcgctatctcccggcaggctccccgttgactcccgcgatttgttacccgctggcgctgccgcacacagctcaaaaggagtagcagcgcccctggttgccggttggagcgtcaaggatgagcgggaggaagaatgcgggcaaggtttccccctggttgctcgtcctcatctgtttagggtgcttctttgtgacctacaacctcctgacgatgcccagccggggacgggatgggccgcgcaagttcctcggcggcggcggggatcgccactcaactgcctcgttggggtcaggctctgattcggaccccgcgaagcggttccacgtcgcgcttacggcgacggacgcactgtacagtcagtggcagtcgcggataatgcactactggtataaggagatgagggaccgacctggttccgacatgggtggcttcactaggatccttcactcgggcaagcctgatggattgatggatgagatacccaccatggtggttgatccccttcctgaaggcaaggatcagggatatattgtcttaaataggccttgggcttttgtccagtggatccagaaagcaaagatcgtagaagagtatatattaatggcagagccagatcatgtctttgtgaagcctttgccaaacttatctcatggtgatgagccagcggcatttccatttttctacatcaaaccgactgagaatgagaagatattgaggaagtttttcccagaagaaaaagggcctatttcaaatattgatcctattggcaactctccggttataatcaagaaggctcagcttgagaagattgctccaacctggatgaatgtttcattaaaaatgaaagaggatcaggagacagacaaagcattcggatgggtcttggaaatgtacgcatacgctgttgctagtgcactgcacggtgtgcaccatagtctccataaagattttatgattcagcctccttgggacctgaaaacggacaacacattcatcatccattatacgtatggatgcgattattcaatgaagggtcagcttacttatgggaaaatcggtgaatggcgttttgacaaaagatcttaccttcaatctcctccaccaagaaatctttcactgccccctccaggagttcctgaaagtgtggtcacccttgtgaagatggtcaatgaggccaccgcaaacattccggggtgggaggacgatagatgattgatggtctggctgagttgtagtttattccagcacccagctggtatggcttttgttcaaaaacatggaagaatatcattggtcaataaaagaaaagcatttgattaatatc

SEQ ID NO: 19065 - DNA, 2101 bp, Zea mays
cactcttgtcttctactgctagtagtatatattaaagggaattaaacttagaagttataataatgctaaaattgggactttaggaatttttttaatcgttatcataatcgtagacaacgtaataagatattacggtctaaactatactaagaacaacctaatgcttttactaattgtcataatcttctcttaagcactttggttactagaacacatacaagagtatgaagcagcctgtccaagcgctgcaaatagccggccgaccaaggggtattaataggcctgtatatgccaagaaactagtagtacatatatatatcggttcttttcagtgggcacgatagaaatggcaccggaattattcctaggccaaactctgattttagttatcttagaattattgaaaatctaacatagagagctatatataacttcgaactgatatcaaatcaatttgagcatattcaaaatcaggagatatataaggctaatccatccatctctttgtcatgacacatctttcaacctcaatctcttttgttatcttgagcttcttgcttgacttcttgaccagaatcatcgccgcgcgcactttgtccctttagtcatagatccagttaccaaattatatgtggcacaaaagcatagccatatatttgaatttattatccattgaccaaaatttctacggataattccgtactaatataagttatcaaatactaatacgctatgagagacaggagctagcataaatggggtgaagtgaagggggagagacgaagggagtgatagcatgcatggaccagatgagcaacttcgtctgtattgtatttatatacgaagtaaataacagcattgacctcccctctcccctacctcccctactatataacaggcccctggaatccatggaagccccacaataaccaggagcgagctacctgcgaagccacatctctccttccacttcatcgatagtacgcatctccatattcaggtaaataacatcgtctgcatgccgcgcgcccctaatagcatctcgatcacatttttgtgttcttgacttctcctctggaagccttgttgtttaacaaagttatatcagtcggtcgatctttggacctccttccacttcatcgatagtacccatctccatattcagaggcacaagctaagccatgagcaacggtggtaaccgcagcaggggcggcgcgaggttcgagctgcagctgcacctgtcgccgccgccgccggctaggagggtggaggtggacggcggaggcgacggcagcgactcgtcgtcgtccccgagctcgtgcgtgtcgtcggacggcagcccagggagcaagtcgccgatggtgatcggcgcctgcacgcggtgcatgatgtactgcatggtggccaagaaggacttccccacctgcatcaactgcaagcagccctgcctcgtggacctcctccactgctctggcgccggcggcagcggcggcaaggccaagtgaaaggacggtcagcgtgtcgtaccgtaccccggccgtcggtccagttgatgctcatacggatggttagctcagaccttagcttgtgggctttgtgcgctcatctcgaggcgcggtgggggagtgaccgccgttggatcatccactggatggacatggcctacttggtttagtaataggctagtgtagtactccccctattagctagctgctgatgctattagcttatcttcgtttatgatgttgttgcttctttaaccgcggcatcggtatgtgatcgccggcgtggttcactgcctattattgttgctggcaatggtttttagctgtaacaatgctatgtttaaatggagaatgtcatctttcgatggttgtttctagaaacaagaataggctgagttgtgagtacaaatagcctccaagggtgatcctcactcagcatagtccgggctgctgcacatatttgatgctcgctaataggatatgtttggtttgagaaataacctagtccatcatctttgtagaaaacggtaacgcctaagagggggaggggtaaattagaacttataaaactttctctaaactaggccacaaataat

SEQ ID NO: 19066 - DNA, 755 bp, Zea mays
ggagatgatgtgggctctcgaatatgatccaggcatttgctccccttttgaagaggataatactggggctgtggtccacaaaattgaaggaaaggtaaaatcaatacgtcagtttggtaagtacgagagggagaatatgaagaagagggcaaacgatggtgatggacctgtccctatttcggtcttcctggttgctagtgtcctaaaagagaacagtacaaagcttctgcaagaggctcgagggattgatgccattattaggatattgaataatgttaatggaaatctggacgccaaaagagcttgcgttgttgcactaaagcttcataggaagtatcacaaaaagttgcaggaaaagaaatcctaacatcatatggcgagattgcacgcaacacaacactgggacttatatttcctttcattttcccactcactgtatcggaggaagaaggtggtttacatatacagtcgcgggcgagacctcataaatataagtgacttattgtatctacaatatcaatgatccacgtccacagcctactcaattgtgaacatcaacctagtacatgataatttattcacaatcacaatggacttggcaaatattatcccatcagtatttgtcatgaacctcagtctactctcgtatcatcttaggtttttggatcccttcgttttgaaggaactgaaatttacttaatggagtaggttacttggtttaaaaaaaaaaaaaaaaaaaaaaaaaaaaaaaaaaa

SEQ ID NO: 19067 - DNA, 2048 bp, Zea mays
gggagattcacaaatagcgcagctgtcgcccccgccctccagagggtggcgaaggcggagctgacctgaccggctgacccgcccaacccaacaacctctccgctggccatcttcctcccgggatccctctccctccttcgatccagctcagctctcttcctcccgccccgtacggccgtactcttcttgatccgttcactcatacttctcgagagaaaaggaagaggattcgatctgttgctaccgctagctgcggtactagcagcagcagcagcagcaggaggaggtaccgtagaagaagggaagggaatccatgaagagatggggcagcagcggacaggccgccgattccttctaccaggtccgccccgattgcagccaaaacgtccccaacaccaagttcaagatcaaggcggggaagacactgagcgttaggaaatggcatgctgcgttcacgcgtgatggatgcctggatatcgcctctgttctgagccgcatacagagagggggtgtgcaccccacgatcaggggagaggtttgggagttcttgctcggctgctttgaccctgggagcaccttcgatgagagggaccagattagggagcggagaaggatgcagtatgccagatggaaggaagaatgcaaagagatggattctcatgtcggcagtggtaaaatcatcaccgccccgattataactgaggatggattccctattaaggatccgttggtattacttgaggctacttcagacacgcaaggtacttcaatcgccaccggcaacagtggaaatggaattgagaaccgtgtcttggataaacaaattattgactggaagcttaccttacatcaaataggccttgatgttctgcgcactgaccgcaccatggtattttatgagaacaaagataacatttcaaagttgtgggatattcttgctgtctatgcatggatcgacaaagaagttggttattgtcaaggaatgagtgatttatgttcacccatgatagtgctactccacaatgaagcagatgcattttggtgctttgagagattgatgcgtagactgcgaggtaatttcagatgcacacaacagtctgttggggtggaaaaccagcttcagcatcttgcttctatcattcaggtgcttgatccaaagttacatggccacctagaaagacttggcgggggtgactatctcttcgcattccgcatgttcatggtattgttccggcgagaactatcatttggggactccttgtacctttgggagatgatgtgggctctcgaatatgatcctggcatttgctccacttatgaagaggataatactggggctgtggtccacaaaattgaaggaaaggtaaaatcaatacgtcagtttggtaagtacgagagggagaatatgaagaagagggcaaacgatggtgatggacctgtccctatttcggtcttcctggttgctagtgtcctaaaagagaacagtacaaagcttctgcaagaggctcgagggattgatgacattattaggatattgaataatgttaatggaaatctggacgccaaaagagcttgcgttgttgcactaaagcttcataggaagtatcacaaaaagtgaggaaaagaaatcctaacatcatatggcgagattgcacgcaacacaacactgggacttatatattgcttgtttctgttcctttcattttcccactcactgtatcggaggaagaaggtggtttacatatacagtcgcgggcgagacctcataaatataagtgacttattgtatctacaatatcaatgatccacgtccacagcctactcaattgtgaacatcaacctagtacatgataatttattcacgatcacaatggacttggcaaatattatcccatcagtatttgtcatgaacctcagtctactctcgtatcatcttaggtttttggatcccttcgttttgaaggaactgaaatttacttaatggagtaggttacttggtttacattctaccacttttcaaaatttaaatacaagtatatctcaaattt

SEQ ID NO: 19068 - DNA, 2114 bp, Zea mays
aagtcccggcccaacccatctgtagcactaggcaacagcgaagctgagcagagagctgtcactgcatctgcctcatctaccagtacgtacgtgctcgatcgatttgatcattcggtttttggattcttcaattgtatagtactgtgatcgagttatactgtgtaactgtaggatggtgatgatgtcgggacttgctgcctactgttcactaagtatgacaacgaccgggactgcgccgttatcatggaatacacgggcaccgccggcgcgactcgctttccagaggcggcggcgcatgagtacgatcacggccacggtcacgtgcaggcgcgaatcggcgatgacggccccggagaaggccgacgtgctgcggtcgctagacgggtgggcggagtcgaacctgctgccgctgctgaagccggtggagcgggcatggcagccgcacgacctgctgccggactcggcgtcgccggggttccgcgaggcggtggacgagctgcgggcgcgggcccgagagatccccgacgactactacgtgtgcctggtgggcaacatggtgacggaggaggccctccccacgtaccacgccgccctcaacagcttcgtgggctacgacagcccctccagcgccgacgcctgggcgcgctggtcccgcggctggaccgccgaggagaaccgccacggcgacctgctgaaccgctatctctacctgtgcggccgcgtcgacgtccggcgcgtggagcagaccatccaccacctcatcaacgccgggatgcgcctcgcctccgacaagtgcccctacaggggcttcatctacacggcgttccaggagcgcgccaccgccgtctcgcacggcaacacggcgcggcgcgccatggcgctgggcgacgccagcctggccaggatctgcggcgccatcgcgagcgacgagaagcggcacgaggcggcctacacccgggtggtggaccagctgttcgcgctcacgcccgacgccgccgtgcgcgcgctcgagtacatgatgagggagaggatcctcatgccggcctactacatgttcgacggccgggacccggacctgttccgccactacgccgccgtcgcgcagaggctcggcgtctacaccaccgccgactacgccgacctcgtccagttcttcgtcgacaggtggggcgtggcggacctaggccccggcctcaccggcgaggggaggcaggcgcaggactacgtctgccggttgcctgagagggtgcgcaggatggaccagctggacgcgcgacgaaggctgcagccccagactcgtcaggtccccttctcttggctgttcgacaggcacgtggagctgctgacctgacttgattgatcggcagtctgcagcccagctagcggtccttttgccccctttggcagagcccagagctatcaattctgttactgcgtctccttctcctctacttctacttcttcctcgttggccactccgtagttccgtatgtgtctaccgtcaagtgactgactggaaccatgtactgtgtgtcagtcatcattcaatccatttggtgccgcagcgtgtcaaaaaaaataaaagcaagcagcccaatgtcagcgagtactgtggctccaacgatatcccaaacttttacctcaattccttgtgtaccttcgcagatcaacctgtgtctggtggtacaaactgaaaaatgcagctttacttttcacttctatagtagaaagaagctatgtgttgatccagtttcgataaaactaaaaacgtttggtaaaacagagaagattcagtttcttttgtcaaaaatgtttggtacaacgattcatctcgatggtcaaaaaaagtaaaatatctaaaaatgtttgtttttattatattttagtattgtctcgctcaccttctacttacctaaaccttattaactcgtactctcacgtgcatctttttctcttcgtggctccacccgccacctccacgcctaggcagtaaagcctccatcttcacactagtctcatcagtcggtttcttcccacgttcccatgtgtctcacaaactcttcaatacagaattctatatacattgcttgtcattgtgttaagtttggtaaacc

SEQ ID NO: 19069 - DNA, 1487 bp, Zea mays
ccggccgggcccaagtcccggcccaacccatctgtagcactaggcaacagcgaagctgagcagagagctgtcactgcatctgcctcatctaccagtacgatggtgatgatgtcgggacttgctgcctactgttcactaagtatgacaacgaccgggactgcgccgttatcatggaatacacgggcaccgccggcgcgactcgctttccagaggcggcggcgcatgagtacgatcacggccacggtcacgtgcaggcgcgaatcggcgatgacggccccggagaaggccgacgtgctgcggtcgctagacgggtgggcggagtcgaacctgctgccgctgctgaagccggtggagcgggcatggcagccgcacgacctgctgccggactcggcgtcgccggggttccgcgaggcggtggacgagctgcgggcgcgggcgcgagagatccccgacgactactacgtgtgcctggtgggcaacatggtgacggaggaggccctccccacgtaccacgccgccctcaacagcttcgtgggctacgacagcccctccagcgccgatgcctgggcgcgctggtcccgcggctggaccgccgaggagaaccgccacggcgacctgctgaaccgctatctctacctgtgcggccgcgtcgacgtccggcgcgtggagcagaccatccaccacctcatcaacgccgggatgcgcctcgcctccgacaagtgcccctacaggggcttcatctacacggcgttccaggagcgcgccaccgccgtctcgcacggcaacacggcgcggcgcgccatggcgctgggcgacgccagcctggccaggatctgcggcgccatcgcgagcgacgagaagcggcacgaggcggcctacacccgggtggtggaccagctgttcgcgctcacgcccgacgccgccgtgcgcgcgctcgagtacatgatgagggagaggatcctcatgccggcctactacatgttcgacggccgggacccggacctgttccgccactacgccgccgtcgcgcagaggctcggcgtctacaccaccgccgactacgccgacctcgtccagttcttcgtcgacaggtggggcgtggcggacctaggccccggcctcaccggcgaggggaggcaggcgcaggactacgtctgccggttgcctgagagggtgcgcaggatggaccagctggacgcgcgacgaaggctgcagccccagactcgtcaggtccccttctcttggctgttcgacaggcacgtggagctgctgacctgacttgattgatcggcagtctgcagcccagctagcggtccttttgccccctttggcagagcccagagctatcaattctgttactgcgtctccttctcctctacttctacttcttcctcgttggccactccgtagttccgtatgtgtctaccgtcaagtgactgactggaaccatgtactgtgtgtcagtcatcattcaatccatttggtgc

SEQ ID NO: 19070 - DNA, 1116 bp, Zea mays
atctgattcctcgtgggccgccacaggctcctcaatcctcatggtctgcgggcggcagcatgccgatcggtcggaccggccgaccggaggatttccggcactccactagccccacgcgatctgcctgtcccacgaggcgaatcagtagcttcgctccggcctccgggggctccgcggctccgctagtccgctccggcgccacggcccggctcggaggggcgtttcggggagggcgaagcggacgccagcgtttccgtttggttggcgtggaggcgaagctgctgctggagcgctacccgggtttcctccgttcactagcgctcgcgatctgatgatcgttggctagttgctctgccagagtcccagccagcgctcctccgccatgatccaggcggtgatggtgatcagcacccaggccaagccccgccttctcaagttctacagtttccagccacccgagaagcatcaggacctcgtccgctgtgtcttccaattactctctgcaaggcccgagagcgcgagcaattttgtcaaggtggactccatctttggcccgggaacaaaaatggtctacaagcatttggccacactatactttgtttttgtctttgatagctctgagaacgagcttgccatgctcgacctcgtacaagtgtttgttgaaacattggacagatgcttcaagaatgtatgcgagcttgacatcgtatttaacttcaacaagctgcacaccattttggatgagatgatatcggggggacaggtgatcgaaacaagttcagaacagataatgaaatctgtggaagagattgaaaggctggagaaacaatcgagcacaaccagcttcatacccaagtcgattacagagcgttttacccgttgagcttccactcgtttccagaacaatgtgacatttaaggtgtgaacagaactgagatatactattcagtctcattttagttctccgataagaccttgtatgcccccgccccccggctgtattctgtaagcctgtaacctggatatgaatgcggcatctgcagtccaataatactgcctgcgttataagaaaaaaaaaaaaaaaaaaaaaactcgagggggggcccggtaccaaaa

SEQ ID NO: 19071 - DNA, 1147 bp, Zea mays
cctcgaggccggccgggcggaccgtccgaccggaggatttccggcactccaccagccccacgcgatctgcccggcccgcgaggcgattccctagcttcgctccggcctccgggggctccgcgccgccgccccggcgccaggcacggaggggcgtttcggggagggcgaagcggacgccagcgtttccgtttggttggcgtggaggcgaggctgctgctggagcgctacccgggtttcctcccttcactagcgctcgcgatctgatgatcgtgggctaattgctctgccagagtcccagccagcgctcctccgccatgatccaggcggtgatggtgatcagcacccaggccaagccccgccttctcaaattctacactttccagccacccgagaagcatcaggacctcgtccgctgtgtcttccaattactctctgcaaggcccgagagcgcgagcaattttgtcaaggtggactccatctttggcccgggaacaaaaatggtctacaagcatttggccacactatactttgtttttgtctttgatagctctgagaacgagcttgccatgctcgacctcgtacaagtgtttgttgaaacattggacagatgcttcaagaatgtatgcgagcttgacatcgtatttaacttcaacaagctgcacaccattttggatgagatgatatcggggggacaggtgatcgaaacaagttcagaacagataatgaaatctgtggaagagattgaaaggctggagaaacaatcgagcacaaccagcttcatacccaagtcgattacagagcgttttacccgttgagcttccactcgtttccagaacaatgtgacatttaaggtgtgaacagaactgagatatactattcagtctcattttagttctccgataagaccttgtatgcccccgccccccggctgtattctgtaagcctgtaacctggatatgaatgcggcatctgcagtccaataatactgcctgcgttatatgcttgatcgtctgacagtgctcgctaaggtttagacatgccccagtaacaaattagcaatattcttatcctgagaactagtgtatccatggtgtccgagaaaagaactagtgtatccatggtgaccagaatagaactcttcggaatt

SEQ ID NO: 19072 - DNA, 1652 bp, Zea mays
ggccgggaaaaaaaaaaaaagagccggagggagatcaaaaggaaggaggcaaagctttgcttctgagagagggagagccggagagcgaagagaagcaggccaacccacccccaccccctgcactgcaacacaatccccccatggcctctgctccagctgctgctatataagcgcgacccgggcgcccccgctgcccgccgggagtagtcctctcctcccatccatctcatgcttcggtccacgcacccacccagccccaccagcggcagctccgcggcgccggcgtccagctccgacgccgcggcgatggtcgggggcggcgcggcggcgggcagcggcggcgcaccgagcggcgccaagctgctgcagatcctcaacgtgcgggtcgtgggcagcggcgaccgcgtggtggtgctgtcccacgggttcggcacggaccagtcggcgtggagccgcgtgctcccctacctcacccgcgaccaccgcgtggtgctctacgacctcgtctgcgccggcagcgtcaacccggagcacttcgacttccgccgctacgacacgctcgactcgtacgtcgacgacctcctcgccatcctcgacgcgctccgcatcgcgcgctgcgccttcgtcggccactccgtctccgccatgatcggcatcctcgcctccatccgccgccccgagctcttcgccaagctcgtactcatcggcgcgtcgcccaggttcctgaacgaccacgactaccacggcgggttcgagctgccggagatccagcaggtgttcgacgcgatggcggccaactactcggcgtgggcgaccgggtacgccccgctggcggtgggcgcggacgtgccggcggcggtgcaggagttcagccgcaccctgttcaacatgcggccggacatctccctccacgtgtgccgcaccgtgttcaacaccgacctccgcggcgtgctgggcatggtgcggtccccctgcgtggtggtgcagaccacccgcgacgtctccgtcccggcctccgtcgccgcctacctcaaggcccacctcggcggccgcaccgccgtcgagttcctccagaccgagggccacctcccgcacctcagcgcccccggcctcctcgcgcaggtgctccgccgcgcgctcgcccggtactagcggagcgcctgccacctacggtcctggtggtcatcggtattttttaccgcctcgatttaccctgtgccgagaccggggacggggatcagataatgtggcgacccgcgccgtttgctgtgcgcgccatgactgtagactgtagtacgagtgtacgacttgttctggacttctggtacccgatttttttactgctttttaatggagagccgagcagtagcactggtaaaaaaaaaaaaaaactcttctcctgcacctccacccaggtcctggtgggcctgctcgcgacacgtggcgagtactcgaggcggtgcacgagctcggtccagattcgccttcgccttgtcctacctgctacctttgttattttactgctggtagtttactgctatgagaatatgagatagggatcagccgccgccccgtcggatattctgactttaaaaaaaaaaaaaaaaaaaactcggaggggggcgcccggtccccatttcgccctatagagg

SEQ ID NO: 19073 - DNA, 2458 bp, Zea mays
ccaatccgtatcaatcccctccaatccatatggattgaaaataaccgaacaagccctagaggggcatcgacgtgtcggctaccacatcagtcgtagagctgcgtcagacaccacatcctccgatcgggcacacagaaccatgcagcgagcgccccacttctgaaggctagggccacaacacccctcaccgccaactaggcgaccatgagcacacggcccctgcagctcctctacgagctgctgggagcatcgcgcaagagagacgcaaaggcagcccaaggggccagccaaccagcaagtcgtcgacaacgttggttggcgcagcatcgaagcacaagcccccgccccggcagacaacacggagaatccatcagacatgcaggacacaagcgactggcggcgagcacgacgacactgggagacgcgcgcacgtcgccagcgggcttgtgcgccgccacctgtggtgctaagctgtcacggcatatgacagggacaacggggcaagcaagtggcggagatccacctttcgcgcaaccgtaaccgcccctccccgacacctacgacgttgccaaggaggccgtgcacgcccacgacggcgccgtgacccaactccgtgggggccttgacagacccaattcccctgagctcagcggccgacgccaagctccacaccaactgcagctgcacagcggccgacgccaactgcagctgcacagacgtcgtcacgccgctgccgcgaatccagaaccaccgccacgccacggccttgacggccacagccaccccgagctccttccccacagtgagcccacacaccaagagacagagagcttgcgcgtccaagccagcgagagacctgaaccgacgcgggggcctctagagcaacaacagaagtcatatgaattatgttttttagtacgagacatcatttggaatatgtagatataatcatcatgttatttccatggtttggtcacttagattgttttttgaataagtttgttaccgtaggggatgcctacattatttctttttttcttttatattataaaggagaaagagatgggtatgtacacgagtttacatatatacagtcattacaatgcttgcacccatgttcttaccgagtcgaccgacattttttcgttctataggagttgagtatcagctcctggacaaacatttccttgcacagggttattgtgggtgggatttctttgaagatacagctatttctgcatttccatatgcatcatagcatggttgtgattacttccattgaccatggtttgctcacatcatcctttgcactgcccaatgtgggttggatgtccttgggggtgacatcaacaatttgccagcacctgcaagagttctggttttgttgacactttgttttccataggcgagccaatttcctagattgtttgatttcgaggtctagatattggcctattattacattgacatatggctcagtaggaaatcgtttgttatgtgatttttctacctcaatatggaggaacgcagtatgattctgctattctcttgctgttatttcattcatcagtacagagacgcttttatagctgggtgatgaccaggagcactcactccacgtcacgcgacaagctacagactgaccctacatctacatgctacagactcacacgtctactagtactcggccagacctacgcacacacgttggtgccgagtttattattcctaacatatatacctagtgctgcatggattatgtaaaagaggtaagggcgtgaatgttatgatccattgactggagtaattcgatgagctaattcataggaatgaattaatatagcttcggaccatctatattattttcgtgtacgttgcaatttccattcatggaatcacatatttgtaaacactatatatcatacaacactataaaatgacaactgtgacataccttttaagaaaaggaaaccttgagatatgcactctcgagttcctacgcacactggcacgtcaaacccaaagcagtccactctgatcatcgttgccttctacgaaaacagaaatgggcaatgttttagtgcttcagctccatcatcgttttgaacataaaaaggtgttatcaatctatgcagtcaactatcatatcatgcagttatgttcattgtccattgttgcttaaggttggtgttgactatcccatagtctcgattgtctagaccacctacgccattaacaaggacaacttaaggtacaaatggtggcgcattaacggctcatgccttatggccaaatggtatgtggagttgttattgttaccaacctgttacaatcgattgtcaaccaggacaaagatagatgctttttagtgtgcccaattgccatcaactcttatatggatttctcaattctacaatatggaaaaggcacactctatataatggaagacagtcaatag

SEQ ID NO: 19074 - DNA, 2517 bp, Zea mays
ctttccaccaggggtccacggcgcgccattagcgaaccgcgacctattcgccgtcgccaatcgccatctcctctccatctcgacatccgcagggcgttcgacgaaatgcgacgcaaacgccgcgcggcgcgcgcccatgtggccaggcgtctcccccccgcacgctcctcctcatccggcctcgcgagcgcgcgagggagacgtcgctgtgccagcgcgaggcggacgtcacctcacctccccgccccgcgtagcttttctgacccggatgctacgctgcgtctccactactccgcctcccgccctgccgtccatgtcacgcctcggctccttcctttcgcctcccgactcctgcctgctgccccttgtcctcttccccacctcctccggaatctggccgcgcacctactcgtcgccctctcgttttcccgtctccgctttctttatcctgcgggcggagcgggtagggtggggcggtcgttgctctcggatcaagagaaagggaggaaaaaaaaaacagcgctttctttctgtggccggcggttcgcccgtctctcactggctgtgtggccactggccaagcgggacacggaactcgagctccgtttggggattccggatcacttcgaggtcacgaggctaaagggattctgatcatcacttaagctcaagatcatgagttggttaaacaaaatttttaagggttcagtaaacagagtttcaaggggtcactatgatggagactggcatgaaggtcattcatctgatcacaccagagatacttacgatgacagtgataatgaagatatagatcgtgccattgcattatcgctagctgaggaagatcagaataaggggaagtcggtggctattgatactgactataatctggaggaagatgaacaacttgcacgggctctgcaggagagcctgaatgcagagtctcctcctcgacagaatgttcctattgaggatgtgccagtgcctcaatggaatattcctgttgagcgggtgcctcctcgacagtatgttccagcaaatgaaccaaccccacatgtttacccacggggtggatccaggatttgtgctggatgccaaaacccaattggccatggacgtttccttagttgtatggattcagtttggcatcctcaatgcttcagatgttttgcttgcaacaaacccatatcagagtatgagtttgctatgcatgatgatcagccataccacaaatcctgctacaaagagttttttcatccgaaatgcgatgtttgcaacaactttattccaaccaatagagatggcctcattgaataccgagcacatcctttctggatgcagaagtactgtccttcccatgaagatgatggcactcctcggtgctgcagttgtgaacgaatggagccaagggagatcaagtacataacattagatgatgggaggaaactctgcttggaatgtctcaattctgcagtaatggattctccagaatgtcaacatctttacatggatattcaggaattttttgaaggtttgaacatgaaagtagaacagcaaattccattacttttggttgagaggcaggctctgaatgaagccttggaagccgagaaaaatgggcaccacctaccggaaaccagaggtctatgcctttctgaggagcaagttgttagaacgatcttaaaaagaccacagattggaccaggaaacagaatcttagatatgattataggaccatacaagctgtctcggcggtgtgaagtgactgcaatccttatattatatggtctgccaagattacaaactggttccattcttgcccatgagatgatgcatgcatatcttcgtctcaaaggattccgaaaccttagtattgaggttgaagaaggcatctgccaagttctatcccacctgtggttagagtcggaaatcatcgctggttctagtagcaacgttgcatccagttcagaagcatcatcatcttcatcatcctcagctcctacctcttcaaagaagggtgcgaagaccgaattcgagaagaagcttggggcattcatcaagcaccagatcgaaacggattcttccgaggcatacggaggtggttttagagctggctatccggctgttgagcgctatggcttgaaaagaacccttgatcatatgaagttgacagggtctttcccatattaaagcaacagaagtaaaggagggggctttcttccagttgtgaggatacactccacattggaggttttggtttgggttatacataactgatatgcataccaaacgaggggaattgtctgtaaatcaggagaaccctctgctgcgcggaaacttattgcaaactgtctttttataggaaaacgatacatgcaagttttcagacagggaacttgagaggatcatatgtaatttttgggcacttgtttttgactcctttggttatcaaaaacaaggcaacataataagattgaaatttatcttcatctttaaaaaaaaaaaaaaaaaaaaccc

SEQ ID NO: 19075 - DNA, 818 bp, Zea mays
gccggggcttaccaccggcctcggcctcggcctcggtgccggcgccgatcgcccaggccgcgcaccccgcccgtcgtagtactgtcagtcatatcatagcaccccgctcagatttccacaacccaaatctacccacctcctcagacctcactccactcaccgttgccaaaagctcccacccacctctcatgggcagggttcatgtcacggcagccggccgcccgcccgcccgcgttcggcggcgcgcatgcagcatacaccgccccaggcccgatcgatggaggggaggggagcgcccgcgagaaccctaaaaagcctccgctcaacctctatgctggatgggatcagctggacggaggcctggagcgtccagcactccagcctgccacacgcctgggctggggcccacctccccgctataaagcggagccgccgggttaccgttgaagtctgaggagacctgatccacaagcaccgccgccgtgtgccagagatgagatgccatggaagagcaagaagacgcatggaattgtgacgccaaggagagcgaggcacaggagcacggtgacacggtcggccggcagatctgcagtggctgccgccgtctccgcacgatatctcgatcggatactgttgagatagctagccggccgccgttccattcatggtacttgtactcgtccgatcgaattcctggccgcacacgccatttctttgacttttgtgctgccgctcgatcggtctaataaattaaggggctcgggcgatatgcattccctgatttattttttttccctgccgaaattaagttatatatc

SEQ ID NO: 19076 - DNA, 3769 bp, Zea mays
  misc_feature (2278)..(2278): n is a, c, g, or t
caacagtacttcaatcaaatcttaaaggttgtgcttgaagtattagatgactctgattcatccatgagggagcttgctttatctttgattactgagatgctcaactaccaggtctgagttttccccttttttgaacatcaacattgatctactccctttttacattagaaatacatttcccccagaaagatgcaattgaagactctatggagattgtttttgaaaaactcctgcatgtgaccaaagatgctgtggccaaggttaccttccttattttacccattctaattcgcagacttgattgtttgtgttaaaattctttgtttctgtgcagatttcaaatgaggcaaaccaatgcttaaatgttctattggcaaaatacaaccctttcacatgtcttgctgtatgtagaaagttttgttcttatgtattattgatgcttcgctttctacttattacagtttactatacttcgattttaaggtctttttttttgtaatgcagattactgtacctttattggtcagtgatgatgagaagatgcttgttgtgtgtatcaactgcttgacaaaggtatctcatatttgcagttggtattgctgtctgatcatttcccactaatttgaatggcataacatagactttatagtgatttaacaaagtgccgatgtctgttacagctttgatttagtgcagagagcatcatgtgattgtgtatcagtcttgattctaaatttgaggtcgtaatattgcttccttttaaatggatttgacagtcctactggatgttgttgcttcgccaaaaaccattattgcacttatttcattttagataccctagttgcttatgcacaaccactattgatgctaatcaatctgaacttttgtgatatttaactcttcttttgtaatttctgagtgcggcattcaagagtgtcatgtgtactcgctggaggaaaatgaactaatagtatgagaaaatcatgttagtttaaatggattttgtccttacgattgtggcgtgtctgtagtcaaggatgtttgggagtaggccagtcagcctctcgtaacgaaatgaaatgacatgcagccctccactgtttgagagagagaaaaggaaatacctaggagtatgaaaaaaatagttttttttcaaaatttgcttaaaattccattagtgtttcggattgctttggcttgtacaaacattgctgactgttgttttctcgtgacaattgtgcagcttgttggacgcctttctcaagaggaattgattgttcaattgcctacatttctgccagcattatttgatgcttttaacaaccaaagtccagatgtccgaaaggtcagtaccatcatattttccttgctttgcattattctgtaggtaccgaccttttcttatatcttgaaatttcataatacattgctctaatgacttttcacagccaaagtccagatgtccgaaagactgttgtgttctgtctggtggatatctacatcatgcttgggaaagcatttgctccatacttggaagggcttagcagcacgcagctccgcctagtaaccatttacgctaaccggatttcacaggcgaggtccggcaagccaatcgattctaaccaatgaggttgtaacattgttattatttgtggtctatatgagcattgctccggtagggtggttttcttgtcatttgtttgtgtatgtgtatagtataaacaagcgcctcccatctgttaagagctcctggtttttgccctgtgtgattatgcattccctctttacgccttttcctctcttttcccccctttggtagcttgtggagagtgttaatgagtgtggcttcttttgtactacttggtacatactctgtacaaagaaaggaaagtgtagtttcgtggagaacagttatgcaagtgatttttttgacgccattttccttggcgggatgacaaaaagtcgacgcggccgtcgtgctcgtgcgcaaaactgttatgtattctcttcttcagctcgatcacttctcttcgtattacgtctgttagaagagtgaaagtagacgaaagagtgaattgctctgtgggtccttcaatttttttctactagtcacctagatttaggaatcctttcttttctctggaaccatgaactttgtctacgtcctagccatcgtccaaagcaagacatgtactcggagtttctgctgccttcgtggcatctgacgtgggaggacatggcatcaatgtggcgtgcaatgacgtaatggctcgagcanagcacggcgaatagcccaggccaggcgatcgacatgttgcacagcttcgcggcctctgctccctgaccgacgcctgctcgtaggagctccgcacggacctcgtttgctatgttaggtcatctccaggccgtctaaagtactgttttatacggtaggttacactgtttatatagcaaataaataaaagatgcgaatggaagaataaagcaaaagcgtcatctttcagaaagcgcagaagacatggatggaaaagaaataaataaaaagacaagtaaaaaaaaggacaaacccagtcccaaagagaacacacaaaaaaatacaaataataaacaacctaaagatctttccgccgtagcgatggcatcctgtaaaacccaggaaagcacaatcacaagggcaaatgctaccgctggtgactgctgcttgtaacccaaagcaaaccgctggatcaagctgtctactgtggcggagacggcggcgaagatgatccacatggaaccgataatagtacaaaacttggcatgataacagattgacaggaaaagacatacatcattccgcctcatcgaggaactatcattaatggcccctggtgatgctctggcctctctgcgtgagtccctgtccctgtccctgcctcgctgccgttcacggtcaccctcgcgggaacgctccagctctcgaacccgctcccgctccctctccagagaacggccacgctcccgctcccgctccctctccctctccaaggaacgctcccgctcccgttctcgctctcgctctcgagaacggtcacgctctctttccctgcaagagcacaactcaacagattatctttgagaaaacaacgcagtaaaggaacgaacgactaaagatactgaatgtagacttggttcatcattagattcgtaccggtaaggccatgaaactattacacattgaaaatagcacttgcaatccctaaattcgtgtggttctgcccttttagattcatatacaacaaagctagctataataggaccaaaacttgagcaagtatgtttcagactctcagtcattcagcagttgttcactgaggcatgagattcaagtcgtggacgagcttttagtgaatctaaaaggagagacattcatggataaagtgtttcaaagtttaggggcataatcacataaatagcgctagtatatcactaacgcctagactagctattttggcaagcagtgacttggagacttcacaaagcaccaacggatggtaaatgcaaataacaatacaaactaaagagcgatatttctcgagacagcaaccacaagaatgactaacgcaaatagcatggtcaagctcaggatacgccatatcatctaagcgcaacttgtacagcacagcttagggagtagggacattggatgcagtttactctatatatggttcttatatatccttcagaatttactggtgatgaggtttaaaacggtccatgcatccataag

SEQ ID NO: 19077 - DNA, 1038 bp, Zea mays
cccacgcgtccgcccacgcgtccggtgattgttactggcatcatgtctggtcttgatgaacgccttgctggtatggttgatgtggcagttgttaaccctccttatgtgccaactcctgtggaagaagtcggatgtagaggcattgcttcgtcctgggcaggcggtttgaatggccgccaagtgattgacaggatccttcctgctgtgcgtgagatgctatcagaaagggggtggctgtacatggtggccctcgaagataatgatccttcagacatatgccatctgatgagcgagatggggtatgcatcccgcgttatcttgaagaggtgtactgaggaggagagcctttatgttctcaagttctggcgagacccacacgctgttacaagtgtgtcgccgaaatcttcaggctctgaatcatggttttctcagttgcatttcaaatccctttggcacaagggctcgtagcagttcatgccctcatcattttggcagtttggcgtcttcatcagctccaaaacatagcaagagatcttctgcaaatctgagatggcagtatgtttagatgtgtttggataaaatggttactgttggtttctgaccgtctcaggcacagtgaaagaatcaagaatcagcctagcttgattggtttaaggcgcagagcaaacatgtccttagaccagaaagtactgaaccttattaatttggtagcttaaatcgttaccttatgttctcttggtgtgtgtggtgtgtcaatgtttttaaggttctcttggtgtgtgtgtgtgtgtcattgtttttaaggtgtcgccaaggcgtccaaaaatcataggcgccttgctcgcctaggcgtccagtcgataggccaacgtcttatctcgacttatgctttaagaaccatggtttgtgtatgctacgttgctactatggattctttgccttgctaggtttggaatatgtgttttctttatatatcattgcgtctaaatgcttatttcaggtctgcgcgctcctctctctatatatctcacatcgtgc

SEQ ID NO: 19078 - DNA, 1538 bp, Zea mays
ctctcgtctcgtcacacaccatccgaaagccaccgggcaaccaaccaggccgccgtgtgatcccgatcgcgtactgcgcgcacgcagtacagctcgcgcgcgcaccagacagacgccttctccctctcccgcagtacagggtacagcctcgcgctcacacaagacaccatctccctgcctgcgatccgatgcgtccaacgttttcagccggggtacggtcctaccaccgctgtgcctaataattggcggctagctagctagctagctgcagctgctgcgatcctggatcggcacagccggttcttgatgtggagggagcggcggcgggcgctgctcctgctggtggccggcgcggcgctgggactgatcggtgccgcgctcgcgagcgcgccgccggaggccgcgctgaaggtcgggttctaccatgcgacgtgccccatcgcggaggacgtggtcctcgccgagatgaggctcatcctcatggaggacgccacggtcgcgccgtccctgctccggatgcactaccacgactgcttcgtgcagggctgcgacgggtcgatcatgctccagtcgaggaagaaggggaaggcggagcgggacgcgctgcccaaccgtagcatgcgagggttcgacgccatcgagcggatcaaggcccggctcgagaccgtctgcccgctcaccgtctcctgcgccgacatcatcgccatggcggcgagggacgccgtctacctgagccacgggccgtggtacgacgtggagaccgggcggcgcgacggcaacgtcaccgtggccgagtacgtcgacaacgacctgccgccgccggactccaacattgtcgacgtgaagaccttcttcagcgtcaagtcgcttaactcgaaggacatcgccgtcctcttcgggtgccacagcatcgggacctcccactgcggcccgatccagaagcggctctacaacttcaccggcaacatggacggccaggacccgtcgctggacccggcctacgccgccgagctcaggaagctctgcccgcctcctcccagacccggcgacgatgctaggaaggtcaaggtgcctttggaccccggcagcaactacaccttcgacctgagctactaccgccacgtgctcgccacgggcgggctgttccagtccgacggcagcctcctgcacgaccccgtcaccagaggctacgtcgagaaggtggtcaaggcgtcgtcgcccgacgagtactacgcggacttcgccgcggcgatggtcaagatgggccgcaccgacgtgcttgtcggcgatcatggggagatcaggccaacgtgtggcatttttgttgactaggttcaggattgggttgaagatgcgaagataatctgtacgggtttctgtcaacgtgtactgtgcgtgctgttagatcagaaagagcacggtcgctgttaactgtgtatccgggaatgctgttctgttcacacacggtcgtcactgatctactgaattgtcagccatgatgtaattatttatctacgtattagttgtatattcttctc

SEQ ID NO: 19079 - DNA, 2183 bp, Zea mays
atatctattggctcgcttttattccacaaaaatggtttacagaaagcgagagaagtccgtctgctggttgcaaccgagcaggatgctgtcattgcccagaacggcggcggcggtgactgtgtatgcgctggtcgctcttatcgccggcgccggcgccgtcgccgccgcggcgggaggtggcgagcagccgctgtcgaggatcgccatccaccgcgccaccgttgcgccccagccgggtgccttcgtcgacgcttcgcctgcccttctcggccgggaggggggggacagagaatgggtgaccgtcacatatagtaaccccaggccctcgaaggatgactggattggagtcttctcccctgctaatttcaacgattccacttgtccaccagagaatgaatgggtggagccccctcttttatgcacagctcctatcaagttccaattcgcaaactacacgaatcgtgattatggaaacactggaaagggatcgttgaggcttcagctgataaatcagagagagggtttctcttttgcattgttctctggaggcctgtcgaatccgaagctcatcgcccactcaaagagtgttactttcatcaacccaaagactccggtgtacccgcggttagcacaaggaaaatcctggaacgaaatgacagtgacatggacaagtggctatggtaccaatgaggctacaccatttgtcagatggggcatagaagggcaaatccaaaccctttctcctgcaggcacccttactttcagtcgcgacaccatgtgtggtcctcctgcaaggacagttggttggcgtgatcctggtttcatacacacaagttttctcaaggacttatggcccaatctcttgtacacataccaagttggtcatcgcatttttaatggttctatagtttggggacatcagtatagcttcaaagcacctccttatcctggggaagactctttgcaacgtgttgtaattttgggggatatgggcaaggctgaggttgatggttcaaatgagttcaatgactttgagcctggttcacttaacacaacaaaccagctaattaaagacttgaagaacattgatgtagttttccatattggagacatcacatatgccaatggctatctttcacaatgggaccaattcaccgcacaggttgagcccattgcttctaccgtgccttacatggttgggagtggtaaccacgaaagagattggcctggatcaggatctttctatgcaaatcttgactcaggtggtgaatgcggggtaccagctcagaatatgttctacgtgccagcagaaaaccgtgagcagttctggtactcaacggactacgggatgttccgtttctgcgtagccaataccgagttggactggaggccaggaacggagcagtacaggttcatcgagcactgcctgtcatctgttgatcggcagaaacagccatggctcatcttcctcgcgcaccgtgtcctgggttactcgtcggccaccttctacgccgacgaaggaacgaccgaggagcccatgggccgcgagagccttcagccactctggcagaagtacaaggtcgacatcgctatgtacggccacgtccacggctacgaacggacctgcccagtatatgagaacgcgtgcgtggccaaggggtccgacctctacgccggcgccttcacggcgacgacgcacgtcgtggtgggcggcggcggcgccagcctcgccgactacacggccgcgcgggcgcgatggagccacgtgcgggaccgcgactttgggttcgtgaagctgacggcgttcaaccacacgaggctgctgttggagtacaagaagagccgggatggcagcgtgcacgaccacttcaccatctcccgcgactaccgcgacgttctggcctgcggcgtcgacaactgccccagcaccaccctggcgtcgtgagcgagcggtggtgtcgattatattcggtttgtgtcgctgttggattttgatttcaagatcgatgcactgtgctgtactgttgtggactgaatgaaatacctgagtgaggaagcagctgctggtgcagcaggtctacatgctgcttcggattgtccccacggccaaaaatgatcacacccctgaattctttgcttgcgccttgcacctctaaaagaaaaaaaaaaaaaaaaaagcggcc

SEQ ID NO: 19080 - DNA, 2548 bp, Zea mays
gtatgatggattcacggtggcaagggcaagggaagaggccaggccatcgcaggcaacacccgtgccgtgtgtcgtgtcgtgcgaggtcacgggtcactccagccaaaaaacagatgatgatgatgatgatgtgccatgctgcggggcaacaagaaactgaacaccacggaaatccaagggccggcccgcgcccgccctcgtcccttttgtatgtatgtgctccctctctccctccctccctttgccatttgccgatttgggcagcagcaatgacacttccctgcgccggcggctgcgagatccaagccagcggcattaactaccgcatcgccgtctccacccgacctctcaaggtctggagcagatcagacgacgacgtccattcccaagaccaccacagcgtcgtccgccaggtgctccgggacgtctcctgccgcgcgcgccccggcgagctgctcgccatcgtcggccccagcggcgccggcaagtccaccctgctcgagatcctcgcggggcgcctctccccgtccccgccgccccacctgctacgcatcgacggcgccgccgcccacagcgccgacctccgccgcgtctccgcctacgtcacccagcaggacgtcctcttcccgctgctcaccgtgcgcgagacgctgctcttcagcgcgcgcctccgcctaggcgcgcgcctgccctccaaggacatgcacgcccgcgtcgaggcgctcctcgacgacctcaccctgcgccgcgtcgccgccaccaggatcaaggacctctccggcggagagcgcaggcgcgtctccatcggcgtcgaggccgtgcgtgacccgcccgtgctcatcctcgacgagcccacctccggcctcgacagcgcctccgcgctccacatcgtcggcgcgctccgcgccatggccgaggcgcgtggacgcaccgtgctgctcagcatccaccagccgggagcgcgcatcgtcaagatgttcgactccgtcctcctgctagccgccggctccgtcctccaccatggcaccgtcgaccagctccgcgccctgctcggggacgcgggccttcacctgcccccgcacgtcgatgacgtcgagttcgccatcgactccgtggacgcgcttcgccgccacgccagcagcagcctgcaggcgccgtcctccggagaccgagagggccggtgcacgctgcagcgtctgttccagctgcacggcaagcaggtggcggacgcccccgtggccgtgaccatgatggctagccgctacgccaactcgcgggcgcgggaggtggcggtgctgtcgcagcgcttcttcaagaacgtggcgcggacgcggcagctcttcgcgtgccgcaccgtgtgcatgctggtggcgggccttgcgctgggctccatcttctacgacctcgggcaggacaaggtggcggagcgcgtgggtctcttcgccttcctgctcaccttcctcctgtcatccacaacggaggcgctgcccatcttcctgcaggagcgcgacatcctggccagggagacggcgtcgggggcgtaccgcgtgtcgtcgtacgcggtggccaacgcggtggtgttcctgcccttccagctggcgctggccgtcgtgttcgcggcgccggtgtactggctggcgggtctccgtcgaacggcggcggcgttcggctacttcctgctggtgatatggctgatcctgtacacagcgaactcggtggtggtgtgcttcgcggcggcggcgccggacttcgtggtggggaacgcggcgatccagggggtgatgggctccttcttcctcttctcgggctacttcatcgcgcggtcggcgatgcccgggtgctgggtgttcatgcactacctgtcgttgttcaagtggccgttcgaggcgctgctggtgaacgagttcgccggcggcgggaggtgcgtggtgcgggcgctgggcgagtgcgtggcgactggggacgaggtgctgcggcgcgaggggctcggggaagagtgcaggtggcgcaacgtgggcgtcatggtggccttcatggcggcctacagggtgttgggctacgccgtgctgagggtgaggtgcagcctcgcgctcaacaagaagggggccgtggccgccggaccacctggcctcggcctcagccgccgcctgagaagacagctagccatcatcggcaccgctgcgtggccctcgccatcgtcttcttccaccccctcgctccctgttaattaaattaaattaaattaaattaaattaaatggcaaccaaatacactagtgtatgtgtgcttacttgttttgttcggtgattcgtacggagtgcttacttaatattgtattgtattatacttggagtaggaagtatggtatccaaagatagcatctgttccaatacatcttgtaatcagactctgctctaactcgtaccaacatgctgagatgtcccaaggcatggcattgtggaatctataaactctccgactataactatatatatgcttattttgtatggtacttgtattttcacgcgtgtctggttctctctcgtgc

SEQ ID NO: 19081 - DNA, 1680 bp, Zea mays
cagcggctagagcagagcccccttcacaccaaaaatttcctctttgcgtcgcgccccgtcagctgagtccccgcggatgggctcggtctcgcggggctagggtttggtcggtcgtctcgtcggcgtcgagggcgccggcgctgctagctagtagtagctcgctcgcgctagggttctcaggagccatggtgatgcagcgcttctcgtggccgtacggaggccggagcgcctccttgtgcggcagcttcaccgggtggagggagtatcccatggggctggtcggggccgagttccaggtcgtcttcgatctgcctcccggggtttaccagtaccggtttttggttgatggtgtctggaggtgtgatgagacgaaaccctttgtatgtgatgaatatggactgatcagcaatgaagtgcttgtggaaaacaatgtgcaacctgttgtgcagccagagccttctatcagaggaactaatttggatgagggtaccgttttgacaacaatgcccccggagtcatcatctcagaacccaggcgtgcaaatagcagttttccgccatgtggtctctggaatattattacacaataccatatatgaagttgttcctctttctagcaaggttaggtttatttcttgcaagtcagcgcttctctttagactatgtgaataatcggacttcatatgaacatttcagttagcagttttggacactcagctacctgttaaacaggcatttaaaataatgcatgacgaggtatgtgtgttgctgtacatgcaagagttgtttccaatcattcactttccctctgtggtgcttgtttgctctcacttcaactttgctctgtttcatcttcattattgtagatttttaatgctgtgctagcaattatttgcctcatcaagaagcagtttaatttgttttcctgttatggtttacagttttaaaataaaaacaaattgctcctagaaacaggcaattcttttatctgcactgcgtacgtggcatcatttgatattttaagaatagctttgaactttttgtgcctcatagggtcttgctctggttcctctttgggatgaccatcagggaaccataacaggcatgctcactgcattagattttgtattaatgttgagaaaggtgggtggaataaattactttgtttctccgtgagagcattctgtgttttttcgaatgatcatttgctatgcagttgcagagaaatattcgagttactggcaatgaagagcttgaaatgcagcccatttctgcttggaaagaagcaaagctacagttctatggtgggcctgatggtgctgtcatgcagagaacgccattaatccatgtacttctccatatatttgctgattctttcatttgattcaatgtgtaagcagttgcaagatcagcactttcataatataaatatattacttgtatgaaattctagatatggtctccaatacaacattaagcttaatgtcgtttgtgttaaaaaattacaaatcatcttatgtcttgaaataaggagaaattgtttgggtttctcctccccaactttcagaattacctatttctattgtatgtttgatcatttggacttccattccatcaacaattttggtttattcagtgaggaactatgtttttaaccactctgtagtttgtacagacaggc

SEQ ID NO: 19082 - DNA, 3385 bp, Zea mays
  misc_feature (2509)..(2509): n is a, c, g, or t
  misc_feature (2735)..(2735): n is a, c, g, or t
gcgtcgcgccccgtcagctgagtccccgcggatgggctcggtctcgcggggctagggtttggtcggtcgtctcgtcggcgtcgagggcgccggcgctgctagctagtagtagctcgctcgcgctagggttctcaggagccatggtgatgcagcgcttctcgtggccgtacggaggccggagcgcctccttgtgcggcagcttcaccgggtggagggagtatcccatggggctggtcggggccgagttccaggtcgtcttcgatctgcctcccggggtttaccagttagcagttttggacactcagctacctgttaaacaggcatttaaaataatgcatgacgagggtcttgctctggttcctctttgggatgaccatcagggaaccataacaggcatgctcactgcattagattttgtattaatgttgagaaagttgcagagaaatattcgagttactggcaatgaagagcttgaaatgcatcccatttctgcttggaaagaagcaaagctacagttttatggtgggcctgatggtgctgccatgcagagaaggccattaatccatgttaaggattccgatagtttggcggatgtggcactgactataatcagaaatgaaatatcttcagttcctatctttaagtgcatgccagattcatcaggagtgcctttccttaatcttgcaaccctccaggggattttgaaatttctttgctcgaagctacaagaacaggctggaggctgttcccttctgcacaatcagcttctcagcattcctattggtacatggtctccacatacggggaggtcaagtagcaggcatctcagaactttgctactgagttctcctttaaatacctgcctggattttctgcttgaagatagagtaagctcaattcctatagttgatgacaagggagcgctccatgatgtttactcactcagtgacatcatggctctggcgaagaatgatgtttatgctcgcatcgaacttgaacaagtgactgtgcaaaatgctttggatgtgcaataccaggtgcatggtcgacgacagtgttatacttgtttacagacaaataccttgctggaagtcttagagggattgtctattccaggagttcgacggcttgttgttattgaacaaagtaccagatttgtggaaggaatcatctcattgagagacatatttacatttctccttggatagcatctgtgtagccattccatacatgaaaaagcttgttgtacttggttcaaacgaaataaaaaggttacaaatgtgatagccatcttctatcttccttcttgatttggttcatattataccgcagacactacataattgaattgcaccgaaggaaagaataggtaggtgcttcaggatggagaagtgttcaggtgattgtttcctgctcgaccagtccagccgccaattatttgcaggcttccagaattgttacttgcaagttaggagcttgactacctttttaagaactttgagatttttctctggttgtattctttgaacattgatacaggctacagaatcattttcataggatctttgaaacagggggatttttttgaaggaaatgaatctcgtggatttttcttccttggaatgaagtcgaaggacctcttcaaatgcgagcatatatatcttttttttgtggaaacatgaacgacgtcatgcaaatgattttcttgaagcattgctgtcattccagttctataagatttgaagtgtttctgtacaattacaatgcttttcatgaccccatttggttttgctttctgttttcaaacaactctgagatttggctcatgagaattgtatatgttcaattatcagtgcatcttggtgtgagtgacattaggcaacggaattttgttatgaaagactgaactgtacaagaaattgctatcataaggaaagcgaattaaggaattttggttgatgctcgaaatatgtcaattattcgcactgtgctagtgattatgtacagaatcagggaatgtctcgcatccaattagggagtgggttggttgggttggactgtgttatactgtctttggtggatcatgtaaaatatgtgatgcgatattgtagatgataatgtttgatattgtttaaaagtttgacattgtttgtagagtgaagtttaaaataaaagatgagatagatgataatgtttgatattgtttaagagtttgacattgtttgtagagttaagtttaaaataaaagatgagatagagatatgataggagagctgttagagacgcctttagaccgagttcagcggatccctcaccgtgagtggctaaacgactatgggttcgagtatttcgggtttagagctttgggctcgggttttaactgagcgcagaaacggactggcttcgacgtggagacgcgagccatctttcttgcaggtcgcgtgtttccgtagtgggccacataaatgaatactttcaaaggaggccaaatgctgctggcgtgcctganttcagcactatacagaaggtaatcattgctctacacatgcttgcctatggtgggactgtcgataggttggacgagtatttcacatgagccagagcacaatacttgagacattaagtgagatcacccgaatagtggttagtgtgtacgagtctgcttacctctgagcaccaaatgcagacgatatagcaaagctactagctaaggctaacgagtggaggttctcgantatgttaggaagcattgactgtatgcattgggagtgggagaagtgtcccaccgcttggcatggccaatacagaggacacttcaaaaaaccaacactaattttagagactattgctagctacaacctttggatatgacacacctttttttgtataccagggccgttaaaaaaaaatcctcaactaaaagggataacatacacccaactcccctcacaaatgtgcaaacgtggactaatcattgggttttatgaggatatctgcaagctatctgcgggtttcaacatggtgaagatcaatgtcccctttctcataatgatctctaagaaatggacatcgatgtagactgcgagcaacagctagcggcaaaacactcaacctctatggtagactgggcaatgctagactgtttgcgagaagaccaagaaaccagggaggaacccaaaaactgataagtcccagaagtggacttgcgattcacatgacatcccgcaaaatcagcatctaaataaccgcacaaagatagaacggacaaagagtagaggaacataggtacctcataatctgtttgacggcttgtctgtgagaagtgtgtggctaagcctgaaattgagagcatagacatactacaaattgtatgtttggcctcgtt

SEQ ID NO: 19083 - DNA, 1736 bp, Zea mays
cttcgctgctcgcgccgcttcaccccagcagggcagagccccgctctcccttcacgccaaagatttcctcttccgcctgcgcttccctttgccccgctctcccccagcctcgctcgccatataatacgggccggccggccggccagctgggtccccgcggatgggctcggtctcgcggggctagggtttggtcggtcgtctcgccggcgtcgaggccgccagcgctgctagctagctctctcgcgttagggttccccgtagccatggtgctgcagcgcttctcgtggccgtacggcggccggagcgccaccttctgcggtagcttcaccgggtggagagagtgtcccatggggctggttggggccgtgttccaggtcgtcttcgatctgccccccggagtttaccagtaccggtttttggttgatggtgtctggaggtgtgatgagacaaaaccctttgtacgtgatgaatatggactgatcagcaatgaagtgcttgtggaaaacaatgtacaacctgttgtgcagccagagccttctatcagaggaactaatatggataagggtaccattttgaaaacaatgcccccggagccatcatctcagaacccaagcatgcaaatagcagttatccgccatgtggtctctggaatattattacacaataccatatatgacgttgttcccctttctagcaagttaacagttttggacactcagcttcctgttaaacaagcatttaaaataatgcatgatgagggtcttgctctggttcctctttgggatgaccgtcagggaaccataacaggcatgctcactgcatcagattttgttttaatcttgagaaagttgcaaagaaacattcaagttattggcaacgaagagcccatttctgcttggaaagaagcaaagctacagttctatggtgggcctgatggtgctgccatgcagagaaggccattaatccatgttaaggattcagataatttagtggatgtggcactgactataatcagaaatgaaatatcttcagttcctatctttaagtgcatggcagattcatcaggggtgcctttccttaatcttgcaaccttacaggggatcttgaaatttctttgctcgaagctacaagaagaggctgagggctgttcccttctgcacaatcagcttctcagtattcctattggtacatggtctccacatacggggaggtcaagtagcaggcaactcagaactttgctactgagttctcctctaaatacctgcctggatattctgcttcaagatagagtaagctcaattcctatagttgatgacaatggatccctccgtgatgtctactcactcagtgatatcatggctctggcgaagaatgatgtttatgctcgcatcgaacttgaacaagtgaccgtacaaaatgctttggatgtgcaataccaggtgcatggccgaagacagtgtcatacttgtttacagacgagtaccttgctggaagttttggagggattgtccattccaggagtgcgacggcttgttgttattgaacaaagtaccagatttgtggaaggaatcatctcattgagagacgtatttacatttctccttggatagcatgtgtagccattccatacatgaaaaagcttgctgtacttggttcaaacgaaataaaaagcttacaaatgtgatagtcatcttcttgtttcaaactaaaaaaaaaaaaaacggtaaaaaaaaagg

SEQ ID NO: 19084 - DNA, 1122 bp, Zea mays
ccccagcagcgggacctcggccccccccacaccaaaaatttcctctttgcgtcgcgccccgccagctgggtccccgcggatgggctcggtctcgcggggctagggtttggtcggtcgtctcgtcggcgtcgagggcgccggcgctgctacctagtagctcgctcgcgctagggttctcaggagccatggtgatgcagcgcttctcgtggccgtacggaggccggagcgcctccttgtgcggcagcttcaccgggtggagggagtatcccatggggctggtcggggccgagttccaggtcgtcttcgatctgcctcccggggtttaccagtaccggtttttggttgatggtgtctggaggtgtgatgagacgaaaccctttgtatgtgatgaatatggactgatcagcaatgaagtgcttgtggaaaacaatgtgcaacctgttgtgcagccagagccttctatcagaggaactaatttggatgagggtaccgttttgacaacaatgcccccggagtcatcatctcagaacccaggcgtgcaaatagcagttttccgccatgtggtctctggaatattattacacaataccatatatgaagttgttcctctttctagcaagttagcagttttggacactcagctacctgttaaacaggcatttaaaataatgcatgacgagggtcttgctctggttcctctttgggatgaccatcagggaaccataacaggcatgctcactgcattagattttgtattaatgttgagacagttgcagagaaatattcgagttactggcaatgaagagcttgaaatgcatcccatttctgcttggaaagaagcaaagctacagttttatggtgggcctgatggtgctgccatgcagagaaggccattaatccatgttaaggattccgatagtttggcggatgtggcactgactataatcagaaatgaaatatcttcagttcctatctttaagtgcatgccagattcatcaggagtgcctttccttaatcttgcaaccctccaggggattttgaaatttctttgctcgaagctacaagaacaggctggaggctgttcccttctgcacaatcagcttctcagcattcctattggta

SEQ ID NO: 19085 - DNA, 1183 bp, Zea mays
aaacatccgacccaccagatggtcgtgagtgtccgcacgaacccatcacacgctccgcccactcccccaggcgcacggccgcacctctccacctccggcgactaccaccaccatggcggccacctccctcgcgcgcctctcccgacgcaccaccatttccgctaccgccgcggcgccctccctccggcgcctcctctcagtcacctccacagcctctgtcgcggcaaccgccccgccgccgccgccgcccagcgcgactggcgccgcggccgtgggcgcggatcgggtgcggtgggactatcgtgggcagaggaagcttgttccgctgggacaatggatgcccaaggtggccgtggacgcttacgtcgcccccgaggccgtgctcgccggccaggtcaccgtccacgacggcgcctccgtctggagcggcgcagtcctgcggggggacctcaacaagatcacgctcggcttctgcgccaacgtacaggagcgatgcgtcctccatgccgcatggacggctcccacagggcttccagctgagacactcgtggaccggtacgtgacagtgggcgcctactgtctgttgcgctcttgcaccatcgagcctgagtgcatcattggccagcactctgtcctcatggaaggttcgctggtggagaccaactcgatcctcgaagctggctctgtattgcccccaggaaggcggattccgaccggcgagctctgggcaggaagcccggccaggttcgttcggaagctgaccaatgaggagatcatggagattccgaagctggcaactgccatcaacgatctgatgcagagccatttctcggagttcctgccttactctaacgcttatctggaggtagagaagctgaagaagtcgttctccatccccctgtaagagcctgttgccctcactcgtccagttgaatggacgaggaaataaataaaggtgcccaaatactagatgttttgcgttgaaatctaacttgtgctgggttggatctgttacgtcccaattttttttgttcattgttgtgagcatggggacacgtgcaggaatgtcttcgtgtctttttacccaacccaatggacactatgttctgcaaaaaaaaaatagaaaaagaaaaaaaaaaaaggtcttaaaaaaaaaaaaaaaaaaaaaaaaaaaaaaaaaaag

SEQ ID NO: 19086 - DNA, 1147 bp, Zea mays
gggtacctcgaggccgactacttcctagctcaaacgtctggtccaccagctcgtcacacgctccgatctcctcccacacctctccacctccgacgacgaccaccaccatggcggccgcttccctcgcgcgcctctcccgccgcgccaccacttccacctccgtggcggcgcccgccttccggcgcctcctctccgccacctccaccgcccccgccgcggcatccgccccgccgccgccccccagcgcggccgccgccgcggccgtgggcgcggatcgagtgcggtgggactaccggggccagcggcagctcgtccctctgggacagtggatgcccaaggtggccgttgacgcgtacgttgctcccgaggccgtgctcgccggccaggtcaccgtgcacgacggcgcctccgtctggagcggcgccgtcctgcggggggacctcaacaagatcacgctcggcttctgcgccaacgtccaggagcgatgcgtcctccatgccgcatgggcggcgcccacagggcttccagctgagacccttgtggaccggtacgtgacagtgggtgcctactgcctgctgcgctcttgcaccatcgagcccgagtgcatcattggccagcactctatcctcatggaaggttcgctggttgagaccaactcaatcctggaggctggctctgtattgcccccaggaaggcgaattccgactggtgaactctgggctggaagcccggctaggtttgttcggaagctgaccaacgaggagatcatggacattccaaagcttgcaactgccatcaacgatctgatgcaaagccatttctcggagttcctgccttactctaacgcttatttggaggtagagaagttgaagaagtcgttctcgatccccctgtaagagcatgttgccccgctcgtccagttgaatgaatgaggaaataaaggttccccaatgctagatgttttgtattgaatcgaacttctacttctgttacgtctttttggggggttctttgttgttttgagcatggggacacgtgcaggaatcatgtcttgatatctttttacgcaacccaattctgtgttgattactttcagttctactaatggggcgggggggggggcgggcggggccggggggtggccgag

SEQ ID NO: 19087 - DNA, 2406 bp, Zea mays
  misc_feature (1946)..(1946): n is a, c, g, or t
tcattttataaaatccaattgatcttctagaactatcgctctcgtgccaaacgtggtgccacaaagaactttagccaaaaccactcgccaaagtaaatacgacggtttaagagttaaaagagtctaaacatctaagtgattttctaattaaattaaattagactcacacaaaaattcaattaggagtactgatttcgttgtattcatgataaatagtttgtttgtttggctttcatttatatcgatttgtacagtttttatagtattatattatatatatatatatatgttatagcagtttgaaggcagaccagcacgatcccatcaatcaaatcaaaatcattcagagtagcagcactataaaagaaaatcatgcaaagaaaggataaaaaatttgaaatccaatgaccagacgacgctccaccgaggcagcaaaactatctcgcggcccaggcccagaccttcccgcgagctctggcgccagtgagaagcttccatagaaaatatctgacaccgatcctgctcggctactcctccaatccttccttctcgtactttctagaacattctgtctccttcctataaatagcagaacaccacccatgtctcccgccaaaacaccgacccacccaccagcctattatactcaacgcgacgaactcatctcaccaccgcgccctccgccggatggagcggccagacgtgacggtcaagcaggaggaggaagacgaagtggtggtggtgttggacgccgacggcgatgcttgcgggcactggccgggagcccgcgcggcgccggagccttggcagacgccggtgggatccgcggttccgccgttccttgcgaagacgttcgagcttgtggaggacccggcgacggacgccgtgatatcgtggggcgccgcgcggaacagcttcgtggtgtgggatccacacgccttcgcggcggggcaccttccgcgccgcttcaagcacggcaacgtcgccaccttcctccggcagctcaacacctacgtccgtaatcacatatctcaattcgtaattaacaaacattgcaatgttagtgtagtatactaatgttattcttctgctattcaattttgctgattctctttgctaatttatcgtggacgtgctttgcccgtttgccgtccgcgcgcgtgcaatgctgtgcagggattccgcaaggtgagcccggacaggtgggagttcgcgcacgccgacttcctcgcggggcagcgacacctcctcgtgaacatccggcggcggcgcgggggcgccgcgggatccacagcatctccgtcttcggcgggagccggcggcgaccgtgacagcgagctcgaaacgctgcggcgggaccgggaggcgctggcgcgggagctgacgcggctgcggcgcgagcaggaggaggcccgcgcgcagctgctggacatggagcggcgcgtgcggggcaccggagcggcggcaggagcagtacaccgccttcctggcgcgcgccatccggaacccggccttcctggacggcctgctggcgcgccgctgtggcgcgcacgtagaggccggcaggaagcggcggctgctcgatgccgctgcggccggccctgacccagcggacgtcctcgacatcgaggagctggcgatggctgcgggcgccgaggtcggtgtggcttccatcccagccgttgcagcggcgcagatttccaacacagccaacgccacggacatgatatggtacgagcttctcggggaggagcaggtggagatcgacgccgaggtgcacgacctcgtcgcggccgccgcggctgccactgatgagttggcgcagccgtgggcggagatggacgagaaagaggttgcggagcttgtgcggcagatagactgccttgcctcgccgagtccctgatcagtgatcaccacgaggtggagaccgtgcagctagctgcacngtaatatggtccactattagccatgcattgcctgtgtcactggcaatgccattggcatatgacggctgctgaagtacaacggtggcgctggcactgtggtacggtactgcagtgcgccacgctctggattggaccctaatggtcatttggtgtgtagtgtcgttagccttgctgtttgattgtggttattggattattaggtctgcgatatgctaatttggattctgcgtctgttttgtgggatccgacggtggcggtatgctgcacacaaaccggccgtggtgatggatgcagcagcctgatccagtgagttgatgtattcttaagaatttgaccaaagagcaactctaaccaagccttaattttttgccaaaaaaaaaaaaaaaacctcttagtcttattctctcccaataaaagtctatcatctatgttgtgtcctctcttatttctaagaatgtaa

SEQ ID NO: 19088 - DNA, 1281 bp, Zea mays
cggacgcgtgggtctgtacaccctgtcattgccggctccgtcggccgtcttcccgaggatgctgcggctgcgctggcgtgccgtcctccccccactcccactccctccgccgcctggcttgcttcgccgcctgcctccgcaccggcgcgccctctcgtcctcttccggcactatcccgcttccaccgccggtgatggaggcttcctacaagtttgggccctacaaaatcgacgccagggaggtcttccacgccacgcccctctcctacgccatggccactttctattgattgctcactgcagtatagttcatgaaactttacttacctttgtgttggttctcttctttttagacctggttatcttgtctgtctagggaggatcaagtttgctttaggtactcatttagtgagggctctgttttgttgagccactgacttcacttcatatttggttcatctttccatggagaccatctacaattctatgacatgattatttctttttcacatcatgcaacagttccacttccagaatgattgtatgcctgcaactcaagttgactttgtgaatcaatttctactgtgttgtcattcggggcagagctgtcataactcatagacccacctggatatatttatttgactcaaagtttgatacatcatgtgtttaggaaactgtgttcttctatatgcactggtttttccttgacaatacctacatgttcttgtgtgccccaagcgtgaagtgaaaagattcgccgatctaagttctgatgagattagtgacttatgggttactgcaaaggaagttggtgcacgtcttgagcagtaccacaaagcatcgtcacttacctttgctatccaggatggtcctcaagctggccaaacagttgcacatgtccacatccacctcatcccaaggaagaaaggggattttgagaaaaatgatgaaatatatgatgcgattgatgtgaaggagaaagaattgaaggagaagcttgacctggacattgagaggaaagataggagcatggaagagatggctaatgaggccaatgagtaccgtgctctttttagttagtttctaagctgagctgactgtttgctagaaataaggtttgctacctgttcttcattgttgcagttcagttatggttgcgcactgacattgtgatgatgtcccgttctgtaccgtggagaattaataatttgttgcaaggaatgcattcttagtgacaaaccttttagatttgcaccccccaaaaaaaaaaaaaaaaata

SEQ ID NO: 19089 - DNA, 830 bp, Zea mays
acatctgtacaccctgtcattgccggctccgtcggccgtcttcccgaggatgctgcggctgcgctggcgtgccgtcctccccccactcccactccctccgccgcctggcttgcttcgccgcctgcctccgcaccggcgcgccctctcgtcctcttccggctctatcccgcttccaccgccggtgatggaggcttcctacaagtttgggccctacaaaatcgacgccagggaggtcttccacgccacgcccctctcctacgccatggtgaatctccgcccgctgctcccgggtcatgttcttgtgtgccccaagcgtgaagtgaaaagattcgccgatctaagttctgatgagattagtgacttatgggttactgcaaaggaagttggtgcacgtcttgagcagtaccacaaagcatcttcacttacctttgctatccaggatggtcctcaagctggccaaacagttgcacatgtccacatccacctcatcccaaggaagaaaggggattttgagaaaaatgatgaaatatatgatgcgattgatgtgaaggagaaagaattgaaggagaagcttgacctggacatcgagaggaaagataggagcatggaagagatggctaatgaggccaatgagtaccgtgctctttttagttagtttctaagctgagctgactgtttgctagaaataaggtttgctacctgttcttcattgttgcagttcagttatggttgcgcactgacattgtgatgatgtcccgttctgtaccgtggagaattaataatttgttgcaaggaatgcattcttagtgacaaaccttttagatttgcga

SEQ ID NO: 19090 - DNA, 2263 bp, Zea mays
gtacccgggccccccccctcgaagtccggctacgtaggccccccccccccccccctattaaacaagaaggtacaaggaaaagggagaggcccactgacaaaggtgtttcttggttggtcaaaacacaatacatatctccactaagtgctgatgcagccaaaacgtcccttactgagaagcaagcaaaggaaaggcgggaatcaagggggggtcgcaatgctttcctagacaatcttaatgatagagagaaacagatcaaagccattgaagaatcctttagagcagccaagtcaaggcctgttcaccagactaaacgtgggatgcaagctgagtgggttatgcctttgctacctgattttgataggtacgaggagccgtttgttatggtgaattttgatggcgatccaactgctgattctgagcagtacaacaaacttgagagacccgtacgtgatgaatgtgaatctcgggccgtgatgaaaagttttagtgtaagtggttcagacccttcaaaacaagagaagtttttggcatacatggccccagcaccccatgagcttaccagagacttggatgatgaaaacgatgacatccagtattcctggctaagagaatatcactgggaagtaagaggagatgataaagacgatcctacaacataccttgtcacatttgataagaaggatggtgcaaaatatttgcctcttcctaccaagctagttttgcagaagaaaaaggcaaaggaggggaggtctggagatgaaatcgaacattttccagtaccttcccgtatcactgtgagtaaaacagctcatggtggtaccatggagcgcggagaatcttctggcatgcatgcgaattcaaagccacgaagatctcatgttgatgatgatcttgatgagcatccaaagcgtactcgggtagaagatattgaccaatatagtgaagaatattctgagtgatgaactgataaatcataattatcttgcaccaacgaatttgatcagtacatgtgaagccgtcaaggcataagtggttttatggtgcatggtgatgcagtgaaagagaatacctggcagtgggaggacatcatggcttggccagtttcttaagggcagagtatgtgaagcaaagctgagtgtaaccagacttcaagactttgatctctgtagtgatcatagaaagtatcacattgttgtaaagaagttttgcctttaaagtcttggagcggttctcaactgtttgttttgataatatatagaccccccattttaaaaaaaaaaaaaaaaaaggcccccccaatcgactgtgcaagtacagaaatttgtttacattattaggatgggcaggtcatattatgctagacacatcttttttggcagccctgagggcctgctaatcgaaggtcatatgtttatgcacttgaacatccagtgaaaattagggtagcatgacgaggagtaaattgcagctggtggacacgttccaggatagtcaatggttgcctgatagcctctggaattatattcattttcaacattaattgttttattattaacattactttttgtctaaaatattgcagaagtatatgagatgataggagggtaaccatgaaacagtttgtggtccctacgtttcaattttattccagcacaaagtggcaatgatatgatggctgcattggtctggtattattaattcatgacaatattttagtagcagtaataacagcaaaatttcttcaggcttaggctgacatgcaggagatgatattttgtttccattgctgtgtgctgtatttgccttagctttggcacttaaatattgcatagttactgttgtcatcttaagtagtctggaggaccatttctttgctggcacccaggtattcttttatccataatccatttcctaatgtttcgtctagtagtttttatgtttgataattttcatctgatgttaggtttggtcgagttttatggatgctaagatatggttcctctcgaatgacagcataattgtggtatgtctgacatcttgtacacaaatgccatcaagaatcatttgggacttgacatcttgtacactaatgccatcagcaatcatttggggcttcatgtctgatgtgtgttgtttacatcgtaactcctggactgttgcatggaataatattgtagctgtagctgctgtaagtcacaaatttcttgttttgttttacataggttgtccatatgctctttaagagacttatcagggggat

SEQ ID NO: 19091 - DNA, 1748 bp, Zea mays
ttttttttttttttttggacaactgcagtagtaccatggttcacaggcagtgacaagcttcttaagcatacaaacgaaggaagatagacacaacctaacaaggcgctgcctgttttctggactacaaattattgaccagacttggacgttagggtgtcgcaccattgacaagccatgcgaatgagatgaaggtgatgatgatgaggggtggtcacttgtacagtcatcctgctatatatgcctttcgccccccatggagctagctgatagacatgccgtcctagtttgctcgtgtgtacacagctgggagggagctattatatttagtggatcgggtcagggttgaacttgagagactccttccagatgagctcctttatagcttcttcggtgagcgatggctgctcgaagtcgaagctgaaaggcgccggacagatgggctcgtcgtttacctcgtgaagggacgccaggtatgggtggcacagagcctcatcaacagtaatcctcttgctgggatcgaacacgagcatcctctcaagcaagtccatggcgccgctagacatggtggggaaccgcacgcggaactgttgcttagggtgctgaggcagggacctcacgtatctgcgggcgtggtcgctccggaggaacccgaggctggtgtcgtcaggtgagcctaccagctcggttatcagcctcagctggtggacataatccttgccaggaaacaggggctctctggtgaccatctcgccgaagatgcagcccacggaccacatgtcgatggcctgggtgtactcggagcagttgagcaggagctcaggcgccctgtaccaccgcgtgacgacgtactccatcatgaagtcggtctccgtcgtggtcctcgccagcccgaagtccccgatcttgaggtcgcacttggcgttcagcagcatgttgctcggcctcaggtccctgtgcaggacgttcgccgagtgcacgtacttgagcccgcggagcagctggtacacgaagtactggcagtggtcgtcggttagttgctggtttgatcgtaggaggtggtgaaggtcagtgtccatcagctcgtagacgatgtagacgtcgttgaagttctccctcctgggcgggcgtatgatgtcctttattgaaatgacattttcatgattcatgtgcctaagcagcttgatttctcggagagtgcgcttggcgtcgatctggttgtcaaacgcgttgccgatcttcttgatggcgacctcctcgcgagtctgcgcgttcacagcagcacagatgatgccgcaggcgccgcggccgacggggcggatgggcgggacgtacttggcggagacctccaggaggttgccgtacacgttgtactgcacgtagcggccgccgtgcgtgtgcgtgcccttgatctgcgcctccccgccgtggcccatacccaggcaccctccagcgccggcgccgcctccgcctgcgcctcctccggccccctccatgcgcatgtattgaatatatacggaccaccacctccccttctagctagctagctagctatactccctcttctctccgacgatgagaaataaacacaagacgacccagcaaggaccaacgcaggacgacggcaagctagcatgcgagcaagcaagctctgatgatgctgcctcgagctctagctgagacagacagatagatagatagagatagagagaacgagctggctggctagcggagcgcgcgtgcgcgtggtt

SEQ ID NO: 19092 - DNA, 1641 bp, Zea mays
gcagcaggacaaatgcttcttatgtggtcaggtggggcatctagccgctaattgtgaaggaaaggcaaagagaaaagctggggaatacgatgagaaaggtgaagctattgttccaaagaaaccataccagttcttgaatatctggacccttcgggagtacttagaatatgagttcagaatgccaaatccgcctttccagattgattttgaacggattgttgatgatttcatcttcatgtgctttttcgttggcaacgattttcttccgcatatgccaacactagagatcagggagggagctatcaatctattaatggctgtgtacaagaaagaatttccttcgatgggtggctatttaacagattcttgcacgccggatctgaatagagtcgaacacttcattcaagcagttggctcttatgaggataaaatatttcagaaaagggcgcgtttgcatcagcgtcaagcagaaagaataaaacgggaaaaggcccaagcaaagcgcggggatgatctggatccccatgtcagagatgatcttattgtacctgtttcaaatttccgagggtcccgccttgcatctggagcagtaccttcaccatatgaacagaatggatctcagagagaaaggtacaaccaaactcggaaagctccaagagtatcatcatcaggttccagcattgctgctgctattgttgaggctgaacaagatcttgaagcacaggagcgtgaaaataaagaagagttgaagtctatgcttaaggatgctcttcgtgagaaatcagatgtcttcaattctgaaaattcagaggaggacaaggtaaagcttggagaaccaggacgcggggataggtactatgaagagaagtttggggcaaggacacctgaacggatggaagaaatacggagggatgttgctctcaaatatactgaaggattgtgttgggttatgcactactactatgaaggggtgtgctcatggcaatggttttatccttatcattatgctccttttgcttcggatttaacgagtctgagtcagctcaatataactttcgaacttgggtcaccattcaagccatttgatcagctaatgggggttttccctgctgcaagtgcccatgcacttcctttaaagtatcggcaactgatgactgatccaaattcaccaataattgatttttatccaactgattttgaagtagatatgaatgggaaaagattctcttggcaggggatagcaaaactgccctttatagaagaagatcggttgctggctgagattaaaaaagttgaggatactttgacgcctgaagaagcaaggagaaacagtaccatgtgcaatatgctttttgtgaatggcgcccattcactttctccctatatctactctctcaacagtaaattcgggcatctgccagacaaagaccgtggtgcaatcaaagaaaaacttgatccttcagctagtggaggaatgaatggttacattgcactctgtggtggggacccgtcccctcctgtcttcagatctcctgtagatgggcttgaggacatcatggataatcaagtgatatgctcaatctacaagctttcagatccacacaagcacatggttcgtccaccagctggtggtatcatacc

SEQ ID NO: 19093 - DNA, 2344 bp, Zea mays
cattgggtacctcgaggccggccgggacgtcccccggcagcagtagccccagcccccagtgccgcagttgcgctcagctatctctgctgagccgattagataaatccggcggaggaagagggaagaattatcgtgcgatatttcccccctcccactccctctctctctctctcgatttgcccgagaaatttttttggttgtttcccgcatcactctccactaggccgccgtctcccccgctggtgctcgtcgcttcctgcccaattcggcgccattcgcccggcgcactccctattaattccctgcctcggtagtcactggccgattgccacgtgaaatttcctgttccgttgcctttcgggtgcgcctgaagtacccacacgctactagggttcaatcgtcgtcagcaggcttacctctcaatcactgcggggcggcggctcgagagtttgtggacagttggcgaagagatagttaggttttttttttgtctcccgtgtccgatggaggaatcggacttgggaggtaatctgggtaagcaaacggaagaggataaggctgcgggagaatcaggggatgagggtaagatcgagaggagccaatctatcaatctgaatagagtgccagcagttgctgtagaggcgatgagcacccagggaaactgtgagacgcacggtgcagcagtgccaggaactaaggatgcaggcacaggaaaggcagggcaatccagtggcgatcgacaggaggagaagttacccaagtgtgagcaggtcgactatggaagtgaagttgaaggctgcgcagatgatgagaaccctggcaagagggctgctttagttactttggttggaaatgaatactgcggcgacgaggatgagagagttcaagtgctcaccattgtcaagaaggacgagcatgcagatgacattgtcgaccgtattaatcctggcacagttgcagggtacagtgaagtgaagggtgctgtaggtgcttctgccgccacttctgcggtgcgacctgctggctcccgatcgtcaagtttccatggtgtgactaggcatagatggagtgggaaatatgaagctcatttgtgggacagttcttgcagagtagagggacgtagaaggaaagggaaacaagtttatctaggaagttatgataccgaggaaaaagcggccagggcttatgatgttgctgctattaaatactggggcgaaaataccagactgaactttccgatttcacaatacggcaaggagttggaggacataagggatttgtctcgagaggaatgtgtgacatacttgagaaggaggagcagctgcttttcaagaggagcttctatttatagaggagtgacaagaaggcagaaagacgggagatggcaagcacgcataggactggttgctggaactagagacatttacctgggaacattcaaaacagaggaagaagctgcagaggcttatgatattgctgccattgagatacgtggcaaaaacgctgtgaccaattttgaccgaagcaactatgtcgataagggtatgcactgtatagaaggcgaaggcttgaggctgcttgcatccaagccagaagaatgacttccaagttcaatgcagtgattgtcgatcgagcagatttggccagacgtatatgcagcttagttggtacatatacagataggagaaccggttgcagtttgtcaatattcctgctttacatgacttgggattacagttaaatcgacccgctagcaaaaaaaagtgtgcaaatgttagtagatttggccagacatatatgaagattttggggttgtatcataaggcctcgtaggatagatctttctgcaaatgttagcgaagccagtgtttatgttctgtttgctagattagcgttatcagtttgcacgttccccttttttttctgaataattgtccttgtatgatcttgagggaatgcgtttacctggtcgtttgccattctttttacctttgtgcactgtggcgctcgtcgtgggcccaggatatggagtgcagcgacgccgtgacctcgacctgaatttcacgagtgtaaaccaggtgttggccgcagcgtcggaagagaccaagacttttccatggttccaattcacaacaacttgcaaccagaactacggaactagcgattttacctggtcgttggttgatctctccagctaccatgtgaatctatttacgacttgaggagtttctgcaatctaatcaaagttcaggtgctaccgtgctcccacacaccacaaaaaacacaccgataatcacacggaaaattacaaccgaaatactgtgaacagcggagagaggaggga

SEQ ID NO: 19094 - DNA, 1270 bp, Zea mays
ttgcgtgcgtgcaggctcttgtcaggaatcactctttgatgctgttgttaggagtcgggacggacgtcatcaggtttgatctctcacccagggtaagctcaatgttcctctttttattagctttgaatgtgatatgcatgtgtttagctaaatgtttggaatatgatcgctactggttttttgtgtgtttaatcaagtggtcatttagttttgagggtgtagggactttaggatctatttgtttgtcaatcggagcaaagaaaatcataattcaaatttgatttcttcgagacgcgcccagcgccgcactcgcgctcgaactcggccgacgaagcagtcgcctaggcagctgacggtggcagctctagcatgcggtcggcgctgtcagcctgccccgcgaggtcgaggagggagagggagcgggacatcatgcccctggcgacccaggcgccaaggcggaaggtgctgacgaggaggtctgtctccctcactttttgattttttgcattagattagaccttttgcttaggaagttgtatctgatagaagaactatgaattgacatgttgtcaaagttttcgcttcccgtgaaaatgcatactctcaaggtctgtgttgacattgtgacccgttcagatcctacgtactccaacatcagtcatttggccctcctgtgatttggggctcaatgtcctattaatatcacgtgcagagaccttcccttatggagtatgagagttacagatctcgaatctcagacaggcattgcacaacgcaggtgtaccaactcctctacttcactgaacatgttcatctataagccttccacttgctttgtgaggtcctcatttatatgcctcaaaacaatggctggctgaattattcttttttttgtttatgtgacggtgtcacttcatcagttatgtatgaattggtaatacacaatggtgcttttatgaaaaatgcatgtagacttgttctgactgtgccaaggatctgaaggtgtgtcccatatgctagagggtgatctccacacgactgaagctctagagaaacaccatcagggggagccggtggcggcgagactataaaactactttgtctggtgggttacttttagtatctgaatatggggattttgaaatgggaatttaggcgctatgggatcaggttcccgtttcccatcttatggttaaagaaacgaccaaatctatacgcgtgagcattaggtgtttgttacacgaagtttaaacttctaccgaaagagttg

SEQ ID NO: 19095 - DNA, 3418 bp, Zea mays
  misc_feature (3401)..(3401): n is a, c, g, or t
ttttaggtatgatgaggcatctgctgatcttaagccatatcgccaaaaagatggtgctcttctctctattgggacactttgtgataaactgaagcaaacagatccatataaatcagagcttgagacaatgctggtccgacatgtctttcctgaattcagcagtcgtgttggacacctgcgagcaaaggtggaatgctctggaaatttgttttcctgcttatgtacagtgaataagtatttctaatgctgtattcatattctttgatgatttttggtaaattatactagctcttcactggtcaataatgatatagaagattaagttggattgccatggggtacactaaatctacaattttctataatgggtactccatttcaaaatgcagtttgatttggtactatacttccccatttgatttatcttatatatcatgccgctcatgacaataaaatcaatattataaaactgttacctcttctaaatgtgagtgtcatggtacctagcaaaaaatgccagttagctattgggtaaaaaaattctgatgtttgaattctcaaatatgtgcatacaaaaaaaatttgcagggagtaccaaatattaaacacccatattttaattgacacaaaattacaactattcccttttccagtggatgcattagttgtactagtgtcgttaatcaataaaaaaccattgggtactattgatcaaatgaacagaattgaccgacgtacattaattaatgaaatgaaatcatttgatgtatttttatatcagtagtaggtgctaggttggtgtttccttcttgggaccttcaaatatgatctaggtctcttcatggttaatttctatctcatcaattctattttacagtaatgatctgatatattgaatcttacaggcagccatgggttgctgggcagtatgcccatatcaacttttcagacccgaacaattttcgtcaggctatgcactgtattgtctcaggaatgcgtgatccagatcttcctgtgagggttgattcggtctttgcacttcgttcttttgttgaagcctgcaaaggttatattatcttgatatttctagtgctaaattgtggagactagtccaaataattgattataattttacctctgcagatttaaatgagatccgacctatacttcctcagctccttgatggtatgaaaatagttaccttggtctagtaaatttatgataatttaatattctggattaacatacctgtttagtctagtaaattgattataaattaatcttttggctcatcatgcctgctgaacagaattttttaagctgatgaatgaggttgagaatgaggatcttgtattcaccctagaaaccattgttgacaaatttggcgaagagatggcaccttatgcactaggtttgtgccagaatttggtatgttctttccaaggtctttttccatgaatattataataaaagttctgtaaatgttttccatcttacaaaacttgctgttttaaaatgataggctgctgctttctggagatgtatggctagttcagaagctgatgatgaagctgatgattccggtgctttggcagctgttggttgcttgcgagcaatcagcacaatccttgagtcaattagcagcctcccacatctttttacgcaaatagaaccaacattgctgcctataatgcgcaggatgttgacatctgatggccaagatgtttatgaagaagtccttgaaattgtttcctatatgtcattttactcgcctacaatttcactggacatgtggaccttgtggccagtgatgatggaggcgcttaatgattgggctatagatttctttgagaatattcttgttccattagacaactacatttctcggggaactgatcactttcttgcatgcaaagatccagattaccagcaaagcctgtggaaggcacttcaatctattatgatggacgaaaacatggaagattctgatattgaacctgctcccaagctcattgaagttgtttttcaaaattgtaaaggcaacgtggatcactgggttgagcactatctcaggattacaattgagcggttacgtcgagcacacaaaccatacctgaaatgcctccttgtacaagtgatcgctaatgcgctctactacaatcctgcgctgacccttgagattttaaataagctcggggttgcagctgacatttttaaccattggtttgctatgctacgacaagttaaaaaaagtggggcacgggttaatttcaagagggagcatgataagaaagtttgctgcttgggcttgacctcccttattgcgcttccagctgctaagattccagcagatgctttggatcggatcttcaaagcaacacttgagctgcttgttgcttacaaggaccaagttgcagaagctaagaagcaaaatgaagaggctgctgatgatatggatggttttgatgctgatgaagaagatgatgacgaagttgactctgataaggagatgggtcttgatgatgaagacggggatgaagtaagcagtcttcagctgcagaaattagccgcagaggctagaggcttccaaccagccgatgacgatgactcagatgatgatttcagcgacgatgagctacactcaccaatagacgaggtggatcctttcattttctttgtagaaactgtccaaggtttgcaggcatctgatcctgccaggttccagaaccttatgcatacattggatttttcttatcaagcgcttgctagtggcattgcacaacatgccgagcaaagaaaaaatgaaattgagaaggagaaatctgagaaggcaaatgcacagtgacgtcataaagcatttctggttcccttcgattgttttgccattttgccggtatagcattggtggacggttaatttcctgcgatttgcaggccgcaggtaagagtttttgcagccttagccaaagtgtaggacaaattcaatcttgtgagatagcatcttggataacctgtcacctcgaccatgttcgtcgtggccagttgtagacgtcttggttgtgcaagaaagtttctctcgaggacagttgctcgttttgttagggccatcaatttttttgggcggcttgtaagttatttgagaatcccacctcaggttgaggggttgtattctcgagtcgtcaaagtttagtaccggtgcggtgtagattgtatatggtttcagttgtctagaacgttgtggcttcatggacgggctgtggtataagtttttattattttttaatttttttgtcaacaagacattgtaattggggtttgtttgtttggtaagagcaagaaaggtcggcactgttaaaaaaaagaaaaaaaaaaaaaaaacccccccaccacccccaccaaacncccccaaccagggattt

SEQ ID NO: 19096 - DNA, 1472 bp, Zea mays
  misc_feature (1469)..(1469): n is a, c, g, or t
aaagctgttagacgcattggggtcagggaaagattacattcggctcgagcactttcgtggtacactggtgagaagaaaagtttgtggagtgcttcagctcaggttattggtttacttgttggcgaccacacattacaaatgggcaagcaccttaaaagtattctggctgttgttaagaaaataatggaatcatctattattgcttctggagctatacaattaggtttatctgatgaagctgtcctgccattgtggaaagagacttactactctgttgccatgatggagaggttacttcttcgctttccggagttgtattttgagcaaaacatggaggacatatggataatattatgcaagttgttgatccatcctcattcgatgttgcgtagtatttcaagctctctggtagcatcatattttgctacagcggagaagaggaaacatgaacagaaattggatgccccatcatggttgcttgttcaaccgagcaggctattcataatagctgtttccttgttgaagcaattgaggagtgaactgagtgatactacggcaaataatctgattgtacagaatcttgcatactcagtctgcaacttgcatatgttgattaggcaatcgaccttcacacatcagttttggtctagcattagttctgatcgtggtgctttccttgagggttttgaattgcttggttcaagaaaagcaaaaaatatatttctcctttgtacttcaacatctagtgatgtatctggatctagcctcgacaccaacgaagagcctacatctttgttagtttcgtcaatcctaaagaagatgggaagaattgcaatgcaaatgcaggatacacagataaagaacgtgttcaattgcttcaatatgatttcatcagctcttggtcctgatgaatcactaacctatgagagagctcactagtcccccccccccaaagtttctgaaggatttgctgggaaagttgttagtgatgaagtgaagcaactggcccagggggtccagaacaagttacgtgacctgattggttccgagaaatttgttgaagtctacaagagcgttcggatgggcctgaaacagaagcgggacggtagaaagcaggcacagaagattgttgcagccgtggacccagaacgcaatgccaagcgaaagcaacgaatggcagccaagcaccgggaacacaagaggcgaaagataatggcgatgaagattggcaggtggatgagatagcttggtatttaggctctgcggaattcggtgaatcatataattgtagaggataatttttcgtgctacaagtgctggcataaaattatgtttctgttttatatgctgtctcactgacttactgcccgacgtaattttactgttgagttaccgaaaaaaaaaaaaaaaaaaaaaaaacaaccacatcaaaaaaactcaaacccgggggggggccccgtccccattcnccc

SEQ ID NO: 19097 - DNA, 2486 bp, Zea mays
tggtgagaagaaaagtttgtggagtgcttcagctcatgttaccatttagtagctttgctatatttttgcatatactaaaaaaagatatattgtacatcagcagtggactgggttggtggttgcaatttgcttttgcatttgggtgttattgaagtacttactacttagcccctttatgcttatgtttcaaagtactattgtccttttacatcaactgttgaagtggttcttgtgctttataggttattggtttacttgttggcgatcacacattacaaatgggcaagcaccttaaaagtattctggctgttgttaagaaaataatggaatcatctattattgcttctggagctatacaattaggcttatctgatgaagctgccctgccattgtggaaagagacttactactctgttgccatgatggagaggttacttcttcgctttccggagttgtattttgagaaaaacatggaggtatgattaccttcgtgcactactactatatcaaattgcagatgtatgtattttgtttttttatctagatcttgccatgtgaggggcaggcctggtgcagtggtgagggctgtctcactgagtcgccaggtcgtgggtttgaagcagtctccatacatttgctagggcaaggcttgtcttggtttatccctttctcaaaccccacttgccatgtctgccgtttatctcgatcttgccatgtgagagcctttgacacagagtctgtcccctagatcttgccatgtcttttatgttgctttatctcatgcctcagttgcttaaacgtaaggcaatagtcaaccgtcacgcctcgctttactgctttgataatgttgtcaaacaatcatattctttatctccagcattttttttgctgccatgtctttttaccaatttaatgagatttatactagttgactcaagtattcaaggcacttgttgaccatttacttaagtattggggcctcagatttatttgttcttaaacatagtatttgtttcaagccttgaactggtcatgtcggttgcaacatcaagtttatgacaccaagaaaaacatggaggacatatggataatattatgcaagttgttgatccatcctcattcgatgttgcgtagtatttcaagctctctggtagcatcatattttgctacagtggagaagaggaaacatgaacagaaattggatgccccatcatggttgcttgttcaaccgagcaggctattcataatagctgtttccttgttgaaacaattgaggagtgagctgagtgatactacggcaaataatctgattgtacagaatgttgcatactcagtctgcaacttgcatatgttgattaggcaatcgacctccacacatcagttttggtctagcattagttctgatcgtggtgctttccttgagggttttgaattgcttggttcaagaaaagcaaaaaatatatttctcctttgtacttcaacatctagtgatgtatctggatctagcctcgacaccaacgaagagcctacatctttgttagtttcgtcaatcctaaagaagatgggaagaattgcaatgcaaatgcaggatacacaggtaagctccattacatcagccaagtcattcccttgtatgtttctcaggatggtggcttgcaattcatatgtattacttatttttcatccatatgcagataaagaacgtgttcaattgcttcaatatgatttcatcagctcttggtcctgatgaatcactaacctatgctgatcacctcttggccccattgtataaagtttctgaaggatttgctgggaaagttgttagtggtatgttaatattcctgtcttggtattgttcattatttgttttcagcatatcggaggtgtgtaggcaagttcagtgcttgggcttgccatctgtctgagtaccgttcttttgttgtggtttcagatgaagtgaagcaactggcccagggggtccagaacaagttacgtgacctgattggttccgagaaatttgttgaagtctacaagagcgttcggatgggcctgaaacagaagcgggacggtagaaagcaggcacagaagattgttgcagccgtggacccagaacgcaatgccaagcgaaagcaacgaatggcagccaagcaccgggaacacaagaggcgaaagataatggcgatgaagattggcaggtggatgagatagcttggtatttaggctctgcggaattcggtgaatcatataattgtagaggataatttttcgtgctacaagtgctggcataaaattatgtttctgttttatatgctgtctcactgacttactgcccgacgtaattttactgttgagttaccgaaccataccgtaagtaaaaattaagaggcatatgcaatgaagacagagaattgattgaattctatttttttggggtggatggataagtaacaatatattattaaatgtgcaattaagagttttctggc

SEQ ID NO: 19098 - DNA, 491 bp, Zea mays
  misc_feature (366)..(366): n is a, c, g, or t
  misc_feature (484)..(484): n is a, c, g, or t
aacaaagccgaggtaagcaacaaagcatcttgagtgttcgacagcgagccatggagaagacgtccgagaacgccatcccgccggcggcatccccgctgatgctgttcgggtcgtgggcgagctcgtacacgcaccgcgtcagctggcgctgcggctcaagggcctggagtacgactacgtggaggaggacctggggaacaagagcgacgagctgctgcgccacaaccccgtccacaagaaggtgcccgtgctcgtccacggcggccgcgcgctcccggagtccgtcattatcctccagtaccttgacgacgcctggccggagacccgcccgctgctccccgccgacgccttcgaccgcgcgctcgntttccttgggttgccacttcgccgacgacaagctcgggccggcggtgggcgcggtgttcgcgttcgacggggggagggccaggaggcggcggtgcggcaggtgcacgagaacctggcngctgatc

SEQ ID NO: 19099 - DNA, 1933 bp, Zea mays
gccggccggaacgcaacaaagccgaggtaaagcagggagcatcttgagtgttcgacagtgagccatggagaagacgtccgagagcgccataccgccggcggcatccccgctgatgctgttcgggtcgtgggcgagctcgtacacgcaccgcgtgcagctggcgctgcggctcaagggcctggagtacgactacgtggaggaggacctggggaacaagagcgacgagctgctgcgccacaaccccgtccacaagaaggtgcccgtgctcgtccacggcggccgcgcgctcccggagtccgtcattatcctccagtaccttgacgacgcctggccggagacccgcccgctgctccccgccgacgccttcgaccgcgcgctcgcgcggttctggtgccacttcgccgacgacaagctcgggccggcggtgggcgcggtgttcgcgtcgacgggggagggccaggaggcggcggtgcggcaggtgcacgagaacctggcgctgatcgagtccgagctccgcgacggcgcgttccggggccgccgcttcttcggcggcgacgaggtgggcctgctggacgtcgtcctgggctgcggctcctactggctcgccgtgttcgaggaggtgaccggggtgcgcctcgtggacgccgacgccttcccgcgcttccacgcctggctgcgcgacttcgaggccctggacgaggtccgggagaccatccccgcggtggaccgcctgctcgagtacgcgcgcggcctccgccacatgctgctcggcctcgcgggggccggcgccggcgccggcgcggacgcgccctccaccgacgcccccgccgcaccgccggcctcggctgacatcgccgtcgacatttgaacgcagggcgtcgtcgcgccgggcgtctgccagcgccgtccggctagccatcagtagctagtacgtagtaccagtatagtttgcagagtcgattgcgccatgtgtggtggctgcgtgcctgtgcctgcctgccggcctggcctggagtgcggttctgctgccgccacagttaattggcccagtttgtctagctgtcgagtttttttttttcaactctctctgtctctctccgactcttcccttctttttgataaagttcgtccctgcagttaaatctctgtttgctgcgacttgttcttcttgtgtgtgagagtgggacgaaatctcgtgtgtttgtatgtggcagtttggctcgcttgtttgaatgtaagccatgtgcgcctggtcatttctactgcaaaaaaaaaaaaaaaaaaaactcccggcgccgcccggtacctactgctatagctcaatagctgtacagtagattacgaagctttgatccgaattaactgcgccggttaatgcgcgtgtcagcatgcacggtggtgctcattgctcgctcgggaaagaagcatttattaaagcggcagagcgactgatggagcgtgtcaatatacataccgatttcctcctcccatgctgttctgttgagaattgatggctgctcgtgtttgccctagccctgcctgatgaatccggataccggctgggtggcccctgtcctgctgcccggttgcagttgcagttgcaagcaacaccgatcaatttatctcgtggttgatgacgattgacgacgcatggtacaaacacgtgaaatgggggacgtatagtagtaactgcgagcgccgttcagatagattatgggcaatatccaccctgctatgctacccaccgcaaactactgcagcgcctgacgaagatgacggtagattaaattgcggcagcggcaggccggccccgagacaaaaacatttcgaaaccgcacgagctgcagcggcaggcagcatcaattgcggcagctactagaaattagtgccggggcaggggtgtgtgcaagagaatcctaagcacagtaggtcg

SEQ ID NO: 19100 - DNA, 2846 bp, Zea mays
  misc_feature (1996)..(1999): n is a, c, g, or t
  misc_feature (2018)..(2018): n is a, c, g, or t
  misc_feature (2024)..(2024): n is a, c, g, or t
  misc_feature (2070)..(2094): n is a, c, g, or t
  misc_feature (2358)..(2362): n is a, c, g, or t
  misc_feature (2451)..(2485): n is a, c, g, or t
  misc_feature (2615)..(2623): n is a, c, g, or t
  misc_feature (2658)..(2662): n is a, c, g, or t
  misc_feature (2800)..(2840): n is a, c, g, or t
ctgcagcgcggacatggacgcttcacgaagcaaattccgaaagggagaccgaaccgagcaaaaggaaggagcaaaccatgcctagcccagtcagtgagctttcacctcagcgctgccgcctgccggccgcatatatatactgtgacaatgtataagctgtgacgtaacgcagtaaacttgggcatgaaacgttcgtggccggccgggtattgaagcgtacgtggacgcgcatgggatatgtaggccgtgccggtgccggtgccgtggcagccacgcgagcggaaaggcaaggcaaagcgcgcgcagcagtaccagtaccaccactggcggacagtaaaaacacagggcgcgccgcgcgcgcaggcgcagtgcagctgatggtaacagttcggcggacccggtcgcttttggtcgagccgtctatccggccggccccggctactgttgctttcctccatccggcggtcgccttcctttcctgcccggccggactactcgacgtccgagtccgatccaacagtggccgcacttccgcgggctggtgctggtgccggtgccgtgtgcgtacgctctcggcgcacgctgcctgtgcatcaacagtggacgtgtgtgcacgtatgtagtagtagatcaatgatcatgcagcgcccagtaaacgaagacgctgctctcgctgcgtctccatccccaaaataaaaggtgacacgggagtttccctccctgtaaaaataaaagatagtagtctataaatgcatctattctggccggccaaatgcattctgggttgcatgcatgcatgcagcagcgatgcaggtgggtcagtcttcggtcaaacgcacaccgcaagattccttcgtgcgccgggtttggtcgtgaacatgcaggttttagtcaagactcgagcgcatggatcaaggcttcaagcactttgaccaaagattatttttttcagtcatcggtactagctagctagggtttggcatttgctttcacagtcaccgccacatctttttcgtgagggcccgaatgcagtacggcacggttagtcccgggtcgtcagcagaaactacactacactgaagcttggccagctgattgttgtgcaagccaaagcattggggaacaagtcgagacgtaggtggtcaggtctcctcgatcactgcggctttactactactatactagagtagtactaactagtgctccacgcaaatccgccagagctgcgacgaaaaggcatcgtccgccggtcggcgaagacttccaatgagaaccattttacccccataaaacaaacagctcttccggtaaagtaaaagctgcagtaaccaacttcacagtttcacactcccccacagtgaatgaacaggaagaaagtccacggccagccgatgtgccgtgcgctggaagcctgcccggccggcccatcgcggacggacggacgggcgcgggttcccatggcccaacacgccacatcggacccactcgtgagctccacttccagtgccaccgccgtgtctgtgggcctgtggctagtcccgctctatataaacccccaggagctcaacaaagccgaggtacgcaacaaagcatcttgagtgttcgacagcgagccatggagaagacgtccgagaacgccatcccgccggcggcatccccgctgatgctgttcgggtcgtgggcgagctcgtacacgcaccgcgtcagctggcgctgcggctcaagggcctggagtacgactacgtggaggaggacctggggaacaagagcgacgagctgctgcgccacaaccccgtccacaagaaggtgcccgtgctcgtccacggcggccgcgcgctcccggagtccgtcattatcctccagtaccttgacgacgcctggccggagacccgcccgctgctccccgccgacgccttcgaccgcgcgctcgctccctggtggcgccacctcgccgacgacaagctcgggccggcggtgggcacggtgttcgcgtcgnnnngcccgaggcaggaggcggnggtgcnggcaggtgcacgagaacctggccctgatcgagtccgagctccgcgnnnnnnnnnnnnnnnnnnnnnnnnncttcggcggcgacgaggtgggcctgctggacgtcgtcctgggctgcggctcctactggctcgccgtgttcgaggaggtgaccggggtgcgcctcgtggacgccgacgccttcccgcgcttccacgcctggctgcgcgacttcgaggccctggacgaggtccgggagaccatccccgcggtggaccgcctgctcgagtacgcgcgcggcctccgccacatgctgctcggcctcgccaaccaggaaccggttggtttcctccgttnnnnnaccactgccgctgccgccgcaccgccggcctcggctgacatcgccgtcgacatttgaacgcagggcgtcgtcgggtcgggcgtctgccnnnnnnnnnnnnnnnnnnnnnnnnnnnnnnnnnnnagtaccagtatagtttgcagagtcgattgcgccatgtgtggtggctgcgtgcctgtgcctgccggcctggcctggagtgcggttctgctgccgccacagttaattggcccagtttgtctagctgtcgagnnnnnnnnncaactctctctgtctctctccgactcttcccttcnnnnngataaagttcgtccctgcagttaaatctctgtttgctgcgacttgttcttcttgtgtgtgggagtgggacgaaatctcgtgtgtttgtatgtggcagtttggctcgcttgtttgaatgtaagccatgtgcgcctggtnnnnnnnnnnnnnnnnnnnnnnnnnnnnnnnnnnnnnnnnnttctag

SEQ ID NO: 19101 - DNA, 2116 bp, Zea mays
aggccggccgggatcatcccgtgagcaacgaaagaaggcgcgcggttgctgtcgttgattcttgatggttggtggcttggtgccctgccagctagtgcttcttcatcctttctctaacgagtgagggacgatgatgcactcccagtcgcaggctcccactcccaccttgcggtgctgccgcactctagctgagctgccagctcggatctccatggcctctcttttcctcctcctcctcgtcgtcgtggcggcgctcctctggccgcctgccgtcgcggcgcccgaggagcacctcgtcaccggtctcccgggcttccatggcgccttcccctccaagcactactccgggtacgtgaccgtggacgagcgcagcgagcggagcctcttctactacctggtgctgtcggagcgcgacccggccggcgaccccgtcgtggtctggctcaacggaggtccgggatgctccagtttcgacggcttcgtctacgggaacggacccttcaatttcgagcctgggagctcgcctggaagcctgcccaagctgcagctcaacccctacagctggtcaaaggtctcgaacatcatgtacctagactctcctgccggtgtggggatgtcgtactcgctgaacagatcggattatgtaacaggtgacctgaaaaccgcagctgacgcccacaaattcctgtcgaagtggttcgagttgtaccccgagtttcagttgaacccgttctacatctcgggggagtcgtacgcaggggtctacatccccacgatcactgacgaagttgttaaaggcattgagagaggtgtgaagccaagaatcaatttcaagggctatctgattggcaatccgttaactgacgtggactacgatttcaattccttcgtgccatttgcgcatgggatgggcctcatctcaaccgacatgtatgaggatgtcaaagcgtcctgccgcggcacattcttcggcgccgtggatgatctgtgccaggagaagatcgacagagtgcgctgggtaatgcgtctcaggactggagccacagaacagaacacattgagtcgacagcatcgtcgtctgatgggttgggccattgggtgtctgcaggaactgaaggacctgaacaagtacaacatccttgcgccttgctaccatcatcccgaaatccaagaggtagagttcagcaacagcagcttgccgcggagtttcagaaggctaggagagacggacaggccgtttccagtgaggaagcggatgtcggggcgttcttggccgctccgtcttgctctcaaggacggccacgtccccatgtggccaggccttagtggcagatcacttccctgcacggtatgctgctgctggtggtggtgtgcttgcaccttcttttctactgcgttttatttggcatttccatgtctacatgactgcatgtagagtgatgaagtcgctacggcgtggctggacgacgaagatgttagagctgcgattcatgccaaaccagtaagatatatgtagtgtgtgtggtagggaaagaaaaagacaaccctcaaagttagcactgatcctctagtctatgtgcacatcatcagaaaagctcaattggatcatgggaactgtacactgcaagaatagacttcacccatgatacagggacgatggtgagctatcacaagaagtttacagctttgggatatcgcgtgctaatctacaggtacatacaaaaccggttgattacatatgaggtagtttctagtagaactttgtagcgagtgtactacacaactcttttcggactagaacatatatacccaccctcgctcgatcagtgcgctagctgattgattctatctcacatttgggttggaaacagaaaccaaaaggtttcatgttgtattggttgaatatatgtttcagttcaaagactagtggtgtgaaattaaagttgaaaacgacatgtgcccaaaaaaagataacatgatcattaagttgatctaatataatatgattcctgctttcatttgcatagaacaatttgtcagaatcatcaaacaatttatttaagaattgaagaatgtacgtataaaaaaaaaaaaaaaaggaaaaaaaaaaaaaaaa

SEQ ID NO: 19102 - DNA, 1879 bp, Zea mays
gattcttgatggttggtcgcttgggcccccggcagctagtgcttcttcatcctttctctaacgagtgagggacgatgatgcactcccagtcgcaggctccgcactctagctgagctgccagctcggatctccatggcctctcttttcctcctcctcctcgtcgtcgtggcggcgctcctctggccgcctgccgtcgcggcgcccgaggagcacctcgtcaccggtctcccgggcttccatggcgccttcccctccaagcactactccgggtacgtgaccgtggacgagcgcagcgagcggagcctcttctactacctggtgctgtcggagcgcgacccggccggcgaccccgtcgtggtctggctcaacggaggtccgggatgctccagtttcgacggcttcgtctacgggaacggacccttcaatttcgagcctgggagctcgcctggaagcctgcccaagctgcagctcaacccctacagctggtcaaaggtctcgaacatcatgtacctagactctcctgccggtgtggggatgtcgtactcgctgaacagatcggattatgtaacaggtgacctgaaaaccgcagctgacgcccacaaattcctgtcgaagtggttcgagttgtaccccgagtttcagttgaacccgttctacatctcgggggagtcgtacgcaggggtctacatccccacgatcactgacgaagttgttaaaggcattgagagaggtgtgaagccaagaatcaatttcaagggctatctgattggcaatccgttaactgacgtggactacgatttcaattccttcgtgccatttgcgcatgggatgggcctcatctcaaccgacatgtatgaggatgtcaaagcgtcctgccgcggcacattcttcggcgccgtggatgatctgtgccaggagaagatcgacagagtgcgctgggaactgaaggacctgaacaagtacaacatccttgcgccttgctaccatcatcccgaaatccaagaggtagagttcagcaacagcagcttgccgcggagtttcagaaggctaggagagacggacaggccgtttccagtgaggaagcggatgtcggggcgttcttggccgctccgtcttgctctcaaggacggccacgtccccatgtggccaggccttggtggcagatcacttccctgcacgagtgatgaagtcgctacggcgtggctggacgacgaagatgttagagctgcgattcatgccaaaccaaaaagctcaattggatcatgggaactgtacactgcaagaatagacttcacccatgatacagggacgatggtgagctaccacaagaagtttacagctttgggatatcgcgtgctaatctacagcggagaccatgacctgtgtattccttaccctggtaccgaagcgtgggtgaaatcaataggctaccaagttactgatagatggcggccatggtacttcggagaccaagttgccggatatacagaaggatacggtcacaatcttaccttcctcactataaagggagccggacatgctgtgcccgagtacaagcccaaggaggctctcgcgttctacagtcgctggctggcaggagagaagttctaagaagaccaggaccattacagatttcacaagccttcagttattcgtcgctcatcggacaattactgtgtgcatggactcagagtagatgtatgcagatcagatccgttcactcggctgtgtaagcctctgtatacagctgaagagatttttaacgtgggatcttcacctctactcaattaaccatgggtcagatccattggcaatattattctactattatataaagaataatttaaatatacagaaaaaaaaaaaaaaaaaagcggcc

SEQ ID NO: 19103 - DNA, 3011 bp, Zea mays
tatatatatatatattccatttgtacgcacggggacaggcgctacgagacacgaacagcggcagcacggagcagagacgacgagcccgagcccccggccctgccgctgcccatctataaatatcgcgcacccacacctcgctcctgtcacacaagaacacacgcgagctccagatcgcacttgccagccttgagccactaatcacctggcagcactctacacggcgagagggaatcgaggagagcttacgaggtagttagtagctacaagacacagcaccataggcatgccggaggcgccggtcgtcacaatgcgagacacggcggcggcggcgccgcccgcgactcaccgcgacctgctcgagtacatcgagcgcgtgacggcgggggcggcccaggtgcagcgccgcgtcctgtcggagatcctggcgcagaacgcgccggcggagtacctgcggcggctgggcgtctcgggcgccgcgccgggcgccgtggaggcgttccgccgcgccgcgccgctcgtcacctacgaggacatcctgcccgacgtgctgcgcatcgccaacggggacacgtcgcccatcctctccggcaagcccatccgcgagttcctcaccaggtgagccagcctgcctgccccgtgccgtgtgaggaggtctgtagtgtgtgtatgtgcatgtcgacgtcgcacgcgcgcgtgaagagtgatagtaataatggccgtacccgtacgtgcgatgatggtggcagctccggcacgtccggaggggagcgcaagctgatgccggcgatagccgacgagatggaccggcggtcgctgctgtacagcctgctgatgccggtgatgagccaggccgtgccggggctggacaggggcaggtgcatgtacctctacttcgtgaaggcggagtcgcgcacgccgggcggccacccggcgcgccccgtgctgacgagcttctaccggagccgccacttcctggagcgcccgcacgacccctacaccgtgcacaccagccccgacgaggccgtcctctgcgtggacgcgtaccagagcatgtacgcgcagctgctgtgcggcctggtgcaccgcgccgacgtgctccgcgtgggcgccgtcttcgcgtcgggcttcctccgcgccatccgcttcctggagaagcactggcagcgcctgtgccgggacctccgcaggggcgcgctcggtgccgaggtgaccgaccgctccgtgcgcgccgccgtggcgcgggtgctccgcgccgacccggcgctcgccgacgccgtcgaggccgagtgcgccaggccgtcgtggcaggggatcatccggagggtgtggcccggcaccaagtacatcgacgtcatcgtcaccggcgccatggcgcagtacatccccacgctcgagttctacggcggcgggctgccgctcacctgcaccatgtacgcgtcctccgagagctacttcggcatcaacctcaaccccatgtgcaagcccagcgaggtcgcgtacaccctcatccccacaatgtgctacttcgagttcctgcccttgccacagcccggccccggcggcaccgacgacgccgatcccgaccatcgcgacctcgtggacctcgtcgacgtcaagctcgggcacgagtacgagctcgtcgtcaccacctactcaggtgcgggtgcgggtgatgaaatggaacagctgctagctgatgagtcagtgacactagctagctagctaacgaacgtacacgcgcgcacgccgtgcaactgcaggtctgtaccgctaccgcgtgggcgacgtgctgcgcgtggccgggttcaagaaccaggcgcccatgttcaagttcctgcggcggaagaacgtggtgctgagcatcgactccgacaagaccgacgaggcggagcttcacgcggcggtgagcggcgcggtgcagcacctggcgccgttcggcgcgtcgctggtggagtacacgagctacgcggacgcggggaccatcccgggccactacgtgctgttctgggagctgcggctccgcgcgggggacgtgccggtgccggtgccggcgtcggtgttcgaggactgctgcctggccgtggaggaggccctgaacagcgtgtaccggcagggccgcgccgccgaccgctccatcgggccgctggagatccgggtggtgtcggacggcacgttcgacaggctcatggactacgcgctcgcccgcggcgcctccatcaaccagtacaaggtgccgcggtgcgtgcacccgggccccgtggtggagctgctggacgggcgggtgcaggccagctacgtgagccccaagtgccccaagtggagccccggcggcggtaagcagtggagcagcgacgccgccgccaagaagcccgccgccgccgccggcagcaataatggaggaggggcggtcgtcgcctgatcgtcgtccgtcgagatatactagtgaactttaattaattagctggctaattccggaaccgtcgttgttgttcgtgggagagagagactcgatcttgtggtcgatcgattgtgatagctgatctatccgtgtgcatgtatgcatgcatggctacgatcgaatgattatctagctgggtaatcatcgggtgtgtggtagcttattaagtattgtacgcgtcgtgatatcatgtgagctagcttttgtttctttttattttcttttatgtggttttgtaataaagttggagtacgtagtagtgagtggcccttttgtttttttgacagattttggcatgttgtgtttagacgttgattgctgctctgagcttatctcctccagacatggctaagagaccgtacatggagtagtttgcagggtagataaaggttaattaattccttgcattgagggtgctgtctgctgtgcgtggaacacgtacacccgcaatctggagcatggaaaatgcatggtcactcgagcggcatgcatgggttcgatcctcctgtgatctgcaggcgcgtctatatatatgatactccataagctt

SEQ ID NO: 19104 - DNA, 1696 bp, Zea mays
ccgggtgtataaatagccagctgtcctcgctcgtccccaacacaaattagcaaagccgcgcgcattacattacattacatacaaacatacacagtttggccgttaattagccagcgctgacaaattaaccctcgtcttcgtcgcctgacccgccgccgaccgccgtacgtgaccaccaaccaggctatagagctacctccagccgccggcccgcgcgtcgtccgccgcggtgtacgtacgtctgccgcggagccacgcgcgcggacatggctcagctgaaggccgcgcgcgccaccgacgtcccgcccgccatgccggacccggacccggacgtcgtcgccgccgacctcggcgcgtgcgtacggcacgggcgcgttgacggtttggcagcaggaagcggcagggcggaggcgacggcgacggcgacgaccaccgcggcggcggccgatcagggacgacgacggccgccgctggtggtggtagggcaccgcggcaaggggatgaacgcgctggcgtcgccagacccgcggctgcgcggcgacatcagggagaacaccctccgcgccttcaacgccgccgccgccagccaccccgccgtcgcctacgtcgagttcgacgtccaggtgaccagggacggctgccctgtcatcttccatgacaacttcatctacacgcaacaagacggccaagtctcagcgaagcgtgttaccgagctgaacctggacgagttcctgtcctacgggccgcaaagagaccaggggaaggccggcaagccacttctccggaaactcaaggacgggaggatcctcaagtgggacgtgcagtccgaggacgcgctctgcacgctccgtgaggtcttcgagggcgtccaccggcgtgtcggcttcaacgtggagctcaagttcgatgacgacctcttctacacggaggagaggcttacctgcatcctaaaatccgttctcaaggttgtcttcgagcacgccaacgacaggcccatcatcttctccagcttccaacccgatgccgcgcagctcatccgcaagctgcaagacaaataccctgtgctcttcctgaccaacggagggacgcaggtgtacgccgacccgcgtcggaactcgctggaggaggccgtcaagctgtgcgtcgccggcgggctgcaggggatcgtgtcggaggtccgggcgatactcaggcagccgtcggcggtggccaagatcaaggaggccaacaaactgtcgctgatgacctacggtcagctcaacaacgtggcggaggtggtgtacgtgcagcacctgatgggggtggacggcgtcatcgtcgacctggtgcaggagatcgcggaggccgtgtcggcgttcacggtcgttacggccgtgcaggcgtcgggctcccaggacggcggcggcatcgtggtcggcgagaggatggagacggctgccgtggcggtggcagggacgccgagcttctcgccgcgggaggtgtccttcctcctgaggctcattcccgagctagtgcaatagcgcgttcttgctgctttgctggtggaatctcgcgacgagatcctctgtatccgtagagttaggtcactaacgtgtgaatccggcctttttgtttgtcaactgaaatcgaaaaaggttatgggttaaaaaaaaaaaaaaaaaacaaaaaaaaaaaaaaaacattcgtagagactacc

SEQ ID NO: 19105 - DNA, 807 bp, Zea mays
  misc_feature (798)..(798): n is a, c, g, or t
gcacgagatttagagacaaggattttaagactgcaattgactactattccaagctagtcgcaatgatgtcgacgccttcggctaccgtttttgctaggcgcagtttttcctacttgatgaatgagcaagcagagcttgctctacgggacgcaatgcaggcccaggtctgcatgcccgagtggcctacagccttctacctccaagcccttgctctttcaaagctcggcatggaaaccgacgcgcaggacatgctcaacgacggagcaacatttgaggccaaaaagcaaaacggctggcgcagttaggaaataaaagtctcctaactactccgtgtcgttgcccttcgtggaaaaaaaaggcgcaatcgctagtgtcctccaaatcagttcattgggacgtctgttgcacgaccaaggagtgggattgaaatgcactgttttatcgtgcaatctctgccctaatgccggcaacgagcggtggtgttatgatcaggagtggaagaacaggtcagggggctttgagtgcacaggcatagcttgctctcccgtgagttgcgctttgttttgcgagtggtggtggcaggatctgctgattgttgcaactgcagttgtaattaaagggatgctttctcacaatttctccttttggttcacgtcgaatctttgggctgcagaggacaagagtggtgtgcaaagagccgggttcattgtgattagctacggagaataaactagaggttcggaattccattcgattctaaaaaaaaaaaaaaaaaaaaaaaaaacaaaaaaaaaaacnagaaatgaa

SEQ ID NO: 19106 - DNA, 850 bp, Zea mays
gcacgaggttgacagccgtccgattggaatgagtcccggttttggacggggtgggcgagtggcatctttcttctataagcttctagcagcatccgccaccgccgcggaggcccaaatatatctccccgcgtccgctagccctagccgccgtccgccgacttcatcgtcgccgtcgtctagacctcttcacgcactggaaaggttaaagtccgacatcaatggcgaagcatcatcctgatctcatcatgtgccggaagcagcctggcatcgcgattggccgcctttgcgagaaatgtgatggcaagtgtgttgtctgcgactcgtacgtgcgcccatgtacgcttgtccgggtctgcgacgagtgcaattatggttcgttccagggaaggtgtgtgatctgtggaggagtcggcatctcagacgcttactactgcaaggagtgcacccagcaggagaaggaccgggacggttgccccaagatcgtgaatctcggaagcgccaagacggatctcttctatgagcgcaagaagtatggttttaagaagagatgaccgagaagatggagctgtgtgtggttcactttggctgtgtggtctgttctatggcactgaatactgagagtaggcagctgagacagcagctttgtattcctgttatggtttgataattgatactggcatggaaatacagctgtgatatgcgttgtaataactaagtccaactgtatgatgcaagagactgcttatgtaatctgtgcttgatggtaatggttatgaatggacttgaaatattggcaaaaaaaaaaaaaaaaaaaaaaaaaaaaaaaaaactctgcgttgttaccactgct

SEQ ID NO: 19107 - DNA, 1607 bp, Zea mays
acctcgaggccggccgggacactctacgccagcccactcatattacaatgggcaaaactggaagaggactatggtcttgcaaaacgtgctatgaatgtatatgatgaatctgtaagagctgttcctggcagtgaaaaaatggccatgtatgaaatctatatagcacgtgctgccgaactctttggtgttccaaggacaagacaaatatacgagcaagcaattgaatctggccgcccacgcgtccgccctcggacaatgtgcatgaagttcgctgaactagagagaagccttggtgaaattgatcgttcgcgtgccatctatgtgcatgcatccaactatgctgatccaaacaatcctgacttttggaagaagtggaatgattttgagattcagcacggtaacgaagatacattcagggagatgcttcgtatcaaacgcacagtggctgctagccgcagtcagacacatttcatactaccggagtacttgatgcagaaggatcagaggttaaacctggacgaagcagttgacactctgaaacgtgctggcgtccctgaggacgagatggcagccttggaaaggcaactggctcccggaccatccactgcaccagcagcaacaccaactgccccagcctctgctaacaggacgatgaattttgtcagtgctggagtagaggcgcaggcagagagcagcaggcaacaggctggtaacaacgaggacattgagctgcccgacgagagtgacgacgaggaacccgatgtccaaattgcggagaagagtgttcctgctgcggtatttggtgagctcggcaagagagctgccgagaagaacgaggaaagctcaggtgcccaaggaaatgagcagctgggcgccctcgagaggataaagagacgacgccaatagtaagccgttgctaagattgtgcagccgtggtatcagcacgagctttatttaacgatgttgtacttgttacatgtaaacaatttctttgtacaaacattgaaggaagttgatcggcgtggccatttctgtgtagtcttgggtttgtttcttctccctcgaaagaacatgacaccaaaacatcatttctttggttcgtttctagattttattcgtccaaaacattagacgtgaagaaagccatcaatatcatgaaaggacaggcaacgtccgaaatcatgaaaggacaggcaacatccgtagtcagcgaggattagaatcagctttactaaattttgttttcctaaattctattatttggttgcacgtggaatttaatcagctttactaaattttgttttcctaaattctattatttagttgcacgtggaactgagatttggattcactagaattggattataactagaaactctctcacctaatacaaagccttgcgctggtttttaggtcagttttggatttaaaaaatcattgggctggtggggaccgtggggtcgaatttttcggacgatcaggccggttggcccatactctgcgcatgactacgaaaagccctgcgacatcatcaaagttcacaaggccaaaatacatcatggagcacacaaaacttgaataaatgaacaaaggcaggggtaccgagc

SEQ ID NO: 19108 - DNA, 1094 bp, Zea mays
agcatcatcatatgggcatgcattgaaaattcatagaaaaagtcatgtatcaagatgttttagcttttctagatacattgattttactatgcatctagtcatgtatctaaatacatagcaaaagtcatgtatcaaaaaaagacaaaacatctcataatttggaatggagtgcaatttaagcaccatggcaagtttttcaattccaaattacacttgattctgtgcttcttctggaaccatgtgtccctcagctcctgttgtagtatgtcatattattcctcactcttgatttacttgtttgagtcactgttacctgcatgcgactttggattcttgaggaagttactttcaacttcttgcttctgtcctgacgcagagggatcagaagttacacctggacgaagcagttgacactctgaagcgtgctggcgtccctgaggacgagatggcagctttggaaaggcaactggctaccggaccatctactgccccaccagcagcaccaagcactgccccagcctctgctaacaggatgatgaactttgtcagtgctggagtagaggcccaggttgagagcagcaggcaacaggctgctaacaatgaggacattgagctgcccgatgagagtgacgatgaggaacccgatgtccaaattgcggagaagagcgttcctgctgcggtatttggtgagctcggcaagagagctgccgagaacaacgaggaaagttcaggtgcccaagggaatgagcagctgggcgccctcgagaggataaagagacgacgccaatagtctaactctgcctgccaagatgagagcccatgtgtgcaccatggcatccgtacgatctttagcgatgttgtacttgttacatgtaaacattttttcgagtggacttttactcctgtgcaaagcatttacgtaagttgttcggggtatacccgctgctaatatgatgccgaaacgttattttctttggtctagaattttcttctgatttgatagtcagaagccagctattcttggccgcaatcttattggcagtcgtaatacaatacaaaaaaaaggagaaaactaggaatattttctaaaaaaa

SEQ ID NO: 19109 - DNA, 1823 bp, Zea mays
  misc_feature (1795)..(1795): n is a, c, g, or t
  misc_feature (1801)..(1801): n is a, c, g, or t
cctcgcaggcctcccccgggccgaaaaaaactcacatcgttccctacaccctactccctccgtcagccagcgaagttccttcagtcactcaacaccttacgtccctagccatcctccgccgcctccgtctctgcttccctagagccgtcgcgatggcagcagcccctgccggtgcccctgcaatcaccgcatcctcctcctttgtttcttcgtctccgttctgtctcaaggcatcgatgaccagccagcgccgacccgcggggagagtctccatcgtcatccgctgcgtcagtagcccgccggccgtcgacacatctttcaagactaatgtcccgcgcaatgctaatatggccaaactccaagcaggatatttgtttcctgagattgccaggagaagagccgctcatttgctgaagtttccagatgccaaaattataagccttggaataggcgacactaccgagcccattccaaatgtcataacaaatgccatggcagagagagcacatgccttgtcaacaattgatggctacagcggttatggagctgagcaaggtgaaaagaaactcagagcagcaattgctgcaacctactatgcggaccttggtattgaagattcagacatatttgtctctgatggtgccaaatgtgacatatctcgcttgcaggtcctttttggatctaatgtgacaattgcggtccaagatccatcataccctgcatatgttgattcaagtgttatcatggggcaaactgacttatatcagcaagacgttcagaagtatggaaacattgagtacatgagatgcggtccagaaaatggattttttcctgatctgtcaactgtccctaggacagatattattttcttttgttcacccaacaatcctactggtgctgctgcatctcgggaccaactaaccaaattagtaaaatttgcaaaggacaacgggtccatcatagtctatgattctgcttatgcaatgtacatatcagatgacagcccaaagtctatctttgaaattcctggagcaaaggaggttgctattgagacagcctcattctcgaaatacgctgggttcacaggtgtccgtctaggttggactgttgtccccaaggagctccttttctcggatggacatccagttgctaaagatttcaatcgcatagtttgcacttgcttcaatggtgcatcaaacattgcgcaagctggtggtttagcctgcctctctccagacggtctaaaggctatgcaagatgttgttggcttctacaaggagaacactgaaataatcgttgagacatttacatcactcggattcaacgtgtatggcgccaagaacgctccatacgtatgggtgcacttccctggccgcaattcgtgggatgtgttcgctgagatcctggagaaggccaatgtggtcactactcctggcactggatttggaccgggtggcgaaggctttgtgagggtcagcgcgttcgggcacagagagaacatcattgaagccgcaaggaggttaaagcagctgtataagtgagcaccgatgcagcttctgtgccctcctagacagatgtatcaataagaacacatcagggcaccaaaaatcgcttggtgaagctgccagaagatgttagattttgaacttttttttttaattctcgtgcggtgtctacattcaaaccatttcgaactctagacaatgcttgttgtaatcctgagacccttcattcactggtgaagttgtgattgtcttgtctgtgttcaaaaaaaaaaaaaaaaaaaaaaaaaaanaaagtnctctgcgttgttaccactgctt

SEQ ID NO: 19110 - DNA, 844 bp, Zea mays
gtactgattccccctccacctatctacccgccgccgccacgcccgccgccgacgacgatggcaactaccgcctcaccctccaccacgaccaccccccggtccttcctctcgtcgccttccttctcactcagggcatcgaagtcgaaccacctccggacgacgagaaggctgcccgttaatgtacgctgcgccagtagctctccggccgccgatacatcttacacgacgaaggtttcgcggaatgccaacatagccaagctccaagcaggctatttgtttccggagattgccagaagaagggcagctcatctgctgaagcatcctgacgccaaaattataagtctgggaataggtgacactactgagcccattccggaggtcataacaaatgccatggcagagagagcacatgctttatccacagtggatggctacagtggttatggagctgaacaaggtgaaaagaaactaagggcagcaattgctgcaacctactatgcggatcttggtatcgacgaaactgatatatttgtctctgatggtgccaaatgtgacatttctcgcctacaggttctttttggatctaaagtgaagattgcagttcaagacccatcatatcccgcatatgttgattcaagtgttatcatggggcaaactgacttatatcagcaggatgttcagaagtatggaaatattgaatacatgagatgcagtcctgaaaatggatttttccctgatctttccaggtcccacggacagatatcatattcttttgttcacccaacaatcctactggtgctgctgcatctagggaccagctaacacggttggtcaaatcgcaaag

SEQ ID NO: 19111 - DNA, 1405 bp, Zea mays
taagactcaaccactaaaccatcacaaataatatcttactctatacgtgtcccctaaatcttaggtacatgtctcaccaatacttaatcatatcgtcgacacgacctgctcagccgtatcctcgtgaccgttagtgtttatctgacttctctagtcccttagtcaagacccatctctcgtctccgttgttctaggtccattagcacgaaccagctgactcatctcacgttattgtgttgataattaatcatcaaacactttaaccacaaatgcacgtatcaactttatgtttagccagctatagcgcaaactttcagctaaattctacataaaaaatagttaaacactttcagctatgtagggcatgacaaacagacctgaaggagaaagctgatggatgtttaacgtcgtttcatcagttaattaatggtatatacgtgtgtacgttgcgcgaattaactcacttgcgccgttccaaattaacaattctttatatgctgtatttaactgacgcacacacaatggactgttatacaactaatggactataagaaccaaagctggttacgttgcccataccacagagctagagagctaagaatttccccatggcggcctctcttcaagctctcgcctgcgccatgctcctcctagccgtctccccgctcgcttgcacggcctccaagacgctgctgcaggacaggtgcgagagctatgcgggtggcgaccggagcagctacgactactgtgtctggacgctgcggcgcgacaacaagagcgccaccgccgacgagctgggcctcgccgtgatcgcggcgaggatggccagggcgacggccaaggccaccggggtcaagatcgcctggctgcgggccaacgagacggtcccggtgcggcgtgactgcctggccgcttgcgccagggagtacgccgccgccgtgcgccggctcgggcacgccgcgtcggccgcactggccgggaagctgcagcacgcgcagacgctgctcgcggaggccacgggcgcccccacgctctgcgacgccgcgttcgcggccgcccggcaggacacgccgctgactgacgcctacctcggcctcgacgaccagatcgagttggccatcgccatcttgccggcgccgcggccgtcgctgccggctaggacgtgatgtgaactatatgtataaagcgctattcatcgggcgcgttgtttttttttgtatggattggagtaataaaataattgacatgagtgggtgcttggtttgtagggacaaaaaaaaaaaaaaaaaacgtgcgtaacagaaaaaaaaaagagagaaaaggaaccgaacatatattttctcttattaattgacatgagtgggtgattagtttgtagggactaatttttagtcactctatttta

SEQ ID NO: 19112 - DNA, 2121 bp, Zea mays
tattttcttcatgacagatactacttgcatgttcgacaataatcttatattggtataaaccaagttagtgtgccttcatttgacaattcatacgactgaatttggatatgtatgaggtaagaggttgtgcagattagaaacaacaaggtgaccttctatggttcatatgaatggttactgttgtttatatgctagtattagacttgttaaatattttcaattaggtcaagagagttaccgaccatacgtccacgcatgtgacttgtgcatattaattcatggacatagaagttggcgatttcaaatcaacaacaattatatgccacacctcgatcgacttcttgtcgacgacgacgagtcagcaacgatggcgcattcatatgtcatgtggagaaaatacttaaaattgctcgtattttcgtagtttgaaatatgtacaaaacacttgccatcctatataagtcgtatatggtatgcttctcatgaaattcaatagctatgaaaaattaatagcactagcaatttcataatgtattgcataaaagtaataataccataaaattaccttcaattccataattcgtttatgccatcatcaacgcttacatgtgtatatttgcaattttcatatttttcgaaaacacttcttgttatttcagatattttggatgtaactatccatatattctaaaaatgctccatgtactttcgaattgagttcatcatgtaggactttccacagtatgtaatgtgctttccggtaatatacacatcatacaatatatgctattccataatatgctttaggatttacttcttgtaaatttctaaatattctaggttttttagtattgctatataaataaatatacatagataaaatgaggaaaattacttcatgtaactttctattgcactctagggataaacataacaattgaacaaaagtaatgaaaattcataattcaaatgcttaacagcaaagatataacctactaaataaatagtgtaatataaaagtacataaatagagaataattctggtcccgattattgcatgaaaatagttttcatcatttccagcattttcatgattattcttgagctttcctatagttcaagagatactactaatcatttcctttttttagcggactttataattttctgataaaagttaaaaaaaaccgttaggccttccagtcccatttcatccaattagtcatgcgcgcgctctttgctgcccgctcctttttcttttcttttcctctctttgttgttttttttgcagggcctagcccatatagccctaaatgcgcacgccggccggagtgaggaaccttgttagggtttcctgttgctggctgctcttgctggccgccgtcaaatctttctctacccatttttcctcctcttctttcttctctggctcgatggaacgacggaaggatgcaatccgcgcgcctacacgctcgcctgtgggttggcggcggcagctgtggggcccacgcccatggctgcggcatcgcggcctgcacactcgtctttgaggcagcatcggggcctgagcccgcgccttctcgcggcggcggctgcctgcgtgctcgcctgcgtcggcggcgacggtggcctgcgcacccgcgcgctcggcgacagtctgtgcttgttttgcggcgggcggggccacgtctgtgcgtcagcgcgccttcaaaacagaggcggcgcgatgccctcgtagcggggtagcggggctaagacggctgtatgccggcgtgccggagcggcgtcagcagagttgtgcttgcgtgccggagtgctcttacttcttgcctgaagtagttacggcgaagcccgcgccggcttgcggcggcgtggccagcgcactcgcctgcatggcggtgcggcggccgctgtgcccgcgtgcagccgcacaccagcttcacacgagcagcggtggctgccttgcgtgttgaaacaaataaatgtaaaaaaaatcatgtctgttacacacctttagcatgatcagatgagcatgtggccatattcctgcatgcgccgtgtgatttggattcgtaccttcttgaaagttacaagggcactcgtgctgataacgtgttaaaa

SEQ ID NO: 19113 - DNA, 847 bp, Zea mays
cattgggtaccgcccggccggccgggcaacaaaattctgctgattgggctccccgctcgatccaaaccctctcgctcccgttggcggtgtgcggcgaggtgaccacggcggcggaagaatggcgaaaggcagcgggctgatctgggcgacggcggaggatctggcgcggaataggccggtggtgctgtcgctgtacaggcagattctgcgggccctcaactcgccggagctgccgcttgggcacgcggcgcggctggccaagaaggccgagtgccgggccatcttcatcttcggcgccgaggagaggtcgctccacaacatccgtgacctcgtcgaggctgcgcgacacacgcttgggctgctcaaccgtggccgcctcccgtagagaggaacgaggaatctatctgtaagttttggttctggtgcgtgccgatgaatggctaaattggtctgttctagtataagctactatcaatatactgtacacttgctaattaaaagaaagaagttttatgtatgaatgaactgcaacttgagtcattgaaaagttgttgctggtcttctttagtttgagttaggggatgcgtcatgcgtggttttgaaggtgttctgcttgcaatattacatcataatctgtgactgatgcactgatgtctagactttgacatttcttgcatcatctttgtttcaaatatgccacgccaacctaactagttcgatcataatttgataagtaatctctttgcagatggtcgtaactcgctcagaatccactcttgattttatgttttattagttgcaattatggtgtgctgcacggcgtcgctcgctatgctgctgcctgcag

SEQ ID NO: 19114 - DNA, 2483 bp, Zea mays
ctgccatagaaaggccttggacctctcactagatgctcatacagtcatacttttaaggtgcttgtccatcagtgtttttgaatgatcttccatgcagatattctttgcctgctgattctgagcctttattatctgcactgatcacatcctaatcgaaaaagttttacaatcatgtctcattctcatgatgtgcatatgcagtgaaaaacttcaacccaagaatggcgatgtcttggacaagagggttaaatcatggtgttgttccgaggcatgccgctcaattggtagagagcagaagccttgcaattgcaagcaaggcgaagaagggtggaaaggctgatgctggcaaaactcctgctctcagccaagagctcaagagtacaacagtgttcggggcaaacatcttcaaggagggttctgatccgaaaatccaaccagactctgagtatcctgactggctgtggcacttgctcgacaatcgtcctgtactaagtgagctgcggaggaaagatcccaagacactctcttatgaagacctgaagcgttttgtcaagttggacaaccgatccaggatcaagataaggaatgacctcaatgctaagaactgacctggagtcttggacgaaacaggacctgctctactgttctttttattattaatataatactagacgacatgaataatttttctggagtttttggcaaaacatagcgacttgggatgttaaaatgttaagatgtgcttggtttgttactcttttaggcagcttacgacactgtcatgctttttgttcttccatcttgggaaagatgcagctttgtgcccagtacttagcaaattatcaagttccatggttctgcataaaaaaaaaaaaaaaaagcatacgattcagtcccggtttatgtatctcccagttcatctgaatcctttctggggtattgtaagtttggattttcattgcctgtgttaattgggttttcctgcacgatcaactctctcattcttcatgacctgctagattcaatacgtgtgtgtggatgttctgcatgatgcctatatctgttgttccagtttttttttttaaaaaaaagatacgagtctaaatcacgttcatttcatttgtgcgtgtgttctattttttctgttttaaacaaatactgaaatacctcactcaacaaaacagttttaatagttcgagaccaaagtccaaactattttcattgctcaagttatgagggaaaatcgaacgaggaaattatctagctcctgtctccaatactgatgaatcatcaaatcctacattactgatgaatcaccaaaacatgcattactaatgaaccataaaaaaaaatttctagttcttatcagaaggcctgaccgattatgcgtaacggttccatttctgtattctggagagcacatcggcatcaactgtagtgctacagtgctactcaaggaagagtatctgaatttcatatcggcatcaactgtattttgtcctcctgtcatcttcggaggacattatcggcatcagcagtatctgaatttcgtatcgaatatcctgtactaacatgtccattagctgtcccagggatctccactataccagtttccaatttcccgtacgcccggtataccggtttccaatttcccgtacggctcgtttggatcattggatttaaatttcattctaataataataatttaagcatatatcaattaaactaattcgattttatgtaaaatatatttgtatactattattagtaagatattgaagatatttatgttttacattttcactataaaatagtgagacgaagagtgtcatgtaagttacagagtagaaataaattctactaatgcataaaattatttctcatcatctatatcattaatttgagatagtcttatatatatttgtataatattattagcaagatatcgaagatatttatgtcttatatttttactataaaatagtgagacgaaaagtgtcatgtaagttacagagtagaaataaattctactaatgcataaaatcatttttcatcatctatctcattaatttgaggtagtcttatatctgaactttggaaagtagtggaatgtcaaattctaaactaaataagttattttattaaatgaatttcaaatcctgtaaaatgaagggatccaaacactctgatacagaaattgagcgattttgtcaaacgccgccaagcatgtttggttgcaaaatgttggtgtgattaaattactttcaattcaaaattgaatagaaagatatttaatcccctcaatctcctatcgcatagaaccccatagaaccgaacaagaccttcaaagatttagccaacctgcacttctcatcagctcaataagatgcagatttgccaaattgttcgtcgaaagaacaaaaaatcgtatccaaatgccatcagggaacagggatgcaaaacgttcgtttcatgattcagtc

SEQ ID NO: 19115 - DNA, 1104 bp, Zea mays
cattgggtacctcgaggccggccggggttgtagtagtttggactagggatatctatacgcgtctcggcgccggccgcgagggtttcccacccccagccggcgtcaccctcatgagccagccgccagccccaggcttctagcctctgtccaagccggcagcccgccacccgcgaggccgcgaccggcgaccgcccgcccctgacgtggtgactgcgtcctcctccgctctccgtgcgccaccctgaagcggtgaggcgaggacctccaggcaccgccctccctggttcggcggctccctcgaggccttcctccccaccggttcagcagctcccgatccgcacggccaaaggccgattcgcgctcctccagccttcctccgcgtccaacagcaagtgaaaaacttcaacccaagaatggcgatgtcttggacaagagggttaaagcatggtgttgttccgaggcatgccgctcaattggtagagagcagaagccttgcaattgcaagcaaggcgaagaagggtggaaaggctgatgctggcaaaactcctgctctcagccaagagctcaagagtacaacagtgttcggggcaaacatcttcaaggagggttctgatccgaaaatccaaccagactctgagtatcctgactggctgtggcacttgctcgacaagcgtcctgtactaagtgagctgcggaggaaagatcccaagacactctcttatgaagacctgaagcgttttgtcaagttggacaaccgatccaggatcaagataaggaatgacctcaatgctaagaactgacctggagtcttggacgaaacaggacctgctctactgttctttttattattaatataatactagacgacatgaataatttttctggagtttttggcaaaacatagcgacttgggatgttaaaatgttaagatgtgcttggtttgttactcttttaggcagcttacgacactggcatgctttttgttcttccatcttgggaaagatgcagctttgtgcccagtacttagcaaattatcaagttccatggttctgcaggcggaaaaaagaaaaaaatgttgggaggggccaccagaactacaactca

SEQ ID NO: 19116 - DNA, 903 bp, Zea mays
aagaaccttccttcgaaaaatgcacacaaaactagggtttccaccccagccggcgtcaccctcatgagccagccgccaccccacgtccccacccatccgccagccccaggcttctagcctctgtcccagccggcagcccgccacccgcgaggccgcgaccggcgaccgcccgcccctgacgcggtgactgcgtcctcctccactctccgtgcgccaccctgaagcggtgaggcggcgacctccaggcaccgccctcccccggttcggcggctccctcgaggccttcctccccaccggttcagcagctcccgatccacacggccaaaggccgattcgcgctcctccagccttcctccgcgtccaacagcaagtgaaaaacttcaacccaggaatggcgatgtcttggacaagagggttaaagcatggtgttgttccgaggcatgccgctcaattggtagagagcagaagccttgcaattgcaagcaaggcgaagaagggtggaaagggtgatgctggcaaaactcctgctctcagccaagagctcaagagtacaacagtgttcggggcaaacatcttcaaggagggttctgatccgaaaatccaaccagactctgagtatcctgactggctgtggcacttgctcgacaagcgtcctgtactaagtgagctgcggaggaaagatcccaagacactctcttatgaagacctgaagcgttttgtcaagttggacaaccgatccaggatcaagataaggaatgacctcaatgctaagaactgacctggagtcttggacgaaacaggacctgctctactgttctttttattattaatataatactagacgatatgaataattttttctggtgcctcctcgccacctaaacccacggcctgcccatcgcc

SEQ ID NO: 19117 - DNA, 1404 bp, Zea mays
aaaccgagtctctccaccgtacaccgaaaagccggcccgttggcccggaattattaccgtctgtttgtcctcgtctccctccgctgtccgattgtgcgctgtcgcagcctctgccctctcccagcccgctcctccatctccggtgagacgcgaattgaatcgcatcgaatccatgggcagctcctcgaataccaacacgagcggcggggccagcgacaaggaggagaagaagaaggaggacaagatcaaaggcaaggactcgtcggggccatccttcaaggagaacgaaagggtcctcgcctaccacggccccctcctctacgaggccaaggttcaaaggatcgaaaaccatgaagatgaatggcgctactttgtccattatctcggttggaataagaactgggatgaatgggttgcaaatgaccgcttgttggaattgacggaggaaaacgtgcgcaaacaacaagagcttgataagaatcaggtagttgacaaaacaatgaagtctggacggtcaacacagcataaaccaaaagtctccaatgcggatgcaaaagctgataaagatgacactaagagtctcatttcagtgaaggggaagaaacgtaaaagtcagcttgggactgagattcaggacaaggaaaaaagatcatcacatagtctactagtgttgcagtttcctttgccactgaagaagcaacttgtggatgattgggagtttgttacgcagatgggtaagcttgtgaagctaccacgatcacctactgttgatgatattctaaagaagtacttggaacaccgggcaaagaaggatggcaagataaatgactcctatgctgagattctgaaaggattacgctgctactttgataaagcattgcctgcaatgcttttatataagaaagagcgagatcagtatgctgaagaagttaaaggtgatgtctcaccatcaactgtatatggagctgagcatctattgcgcctttttgtaaaattgccagagctacttgcttctgtcaatatggaggaagatgcgttgaacaagctacagctgaaactgctggacgttctcaagtttcttcagaagaatcagatcaccttctttacctctgcgtacgatggttcttgtaaaggtgcagatgaggataaaaccaaatgattgcatgtgaacgttttatatcatgtaacatctttcgatggacttgtctggcactattgttgatatgaatgtcgcttaggacaacaatcggtttatgtaggatagatgctgcagattcctgaaagacggtacttgaactgcccggagcatgttgtattttcttaagatgctggaactaagacggcttagttgaattttcactatcaagtgagtctcggtcttgccccaaaaaaaaaaaaaaaaaa

SEQ ID NO: 19118 - DNA, 2262 bp, Zea mays
aaaaagacggcccgttggcccggaattattaccgtctgtttgtcctcgtctccctccgctgtccgattgtgcgctgtcgcagcctctgccctctcccagcccgctcctccatctccggtgagacgcgaattgaatcgcatcgaatccatgggcagctcctcgaataccaacacgagcggcggggccagcgacaaggaggagaagaagaaggaggacaagatcaaaggcaaggactcgtcggggccatccttcaaggagaacgaaagggtcctcgcctaccacggccccctcctctacgaggccaaggttcaaaggatcgaaaaccatgaagatgaatggcgctactttgtccattatctcggttggaataagaactgggatgaatgggttgcaaatgaccgcttgttggaattgacggaggaaaacgtgcgcaaacaacaagagcttgataagaatcaggtagttgacaaaacaatgaagtctggacggtcaacacagcataaaccaaaagtctccaatgcggatgcaaaagctgataaagatgacactaagagtctcatttcagtgaaggggaagaaacgtaaaagtcagcttgggactgagattcaggacaaggaaaaaagatcatcacatagtctactagtgttgcagtttcctttgccactgaagaagcaacttgtggatgattgggagtttgttacgcagatgggtaagcaggcccaagtggcaagctcattagctcattcagaaaaagactttgcaactccattctcattcagaaggaagactttgtaactccatgtattccaattatttttaatggaaattcagcaatctgtcaacccttgtggtagtcacttgaatattacagacatttgctgaattggcagttaaataagaaatgccgtccatgcaataggatccaaagaatgcggcaaacattttccatatatttatttatttctccaaaacatcaaacctcaagacagatttgtccgtgcaatagggtccaaaagaacactaatatttgagtttgtatttttttctggacccactgataaatagggaaactctgtatatcattatcatctcaaagagcgaaagggcctctagcgtaatggttaaggcttccgagtagcacttccaggccctgagttcgatccccctcgggagtgaattttggatttagttaaaaaaatcccttagttgagccccgcccgctctcggggatcgatatcctgcccgtcatcctccgactgggccgttgcagagtgggcagttgatcggcccgttagtgatgggggccagggttcggggttttttcgtccgggaccatgtttcagtttcttcttaatataataccgggagggcggtctttccctcgccggccgagttttttttattatcagctcaaagaaaacaagctaaccttagtgataaactgatccgaacaccagatgaaagtcttctttgaaatagataaccatattcgcctcactttttttgttcaccacaactacctgagatttccttggtacgctgcagcttgtgaagctaccacgatcacctactgttgatgatattctaaagaagtacttggaacaccgggcaaagaaggatggcaagataaatgactcctatgctgagattctgaaaggattacgctgctactttgataaagcattgcctgcaatgcttttatataagaaagagcgagatcagtatgctgaagaagttaaaggtgatgtctcaccatcaactgtatatggagctgagcatctattgcgcctttttgtaaaattgccagagctacttgcttctgtcaatatggaggaagatgcgttgaacaagctacagctgaaactgctggacgttctcaagtttcttcagaagaatcagatcaccttctttacctctgcgtacgatggttcttgtaaaggtgcagatgaggataaaaccaaatgattgcatgtgaacgttttatatcatgtaacatctttcgatggacttgtctggcactattgttgatatgaatgtcgcttaggacaacaatcggtttatgtaggatagatgctgcagattcctgaaagacggtacttgaactgcccggagcatgttgtattttcttaagatgctggaactaagacggcttagttgaattttcactatcaagtgagtctcggtcttgccccaaaaaaaaaaaaaaattgtacctcctctgtcccaatttatacgccggtttataattcgtatggacaaaaa

SEQ ID NO: 19119 - DNA, 2021 bp, Zea mays
gcttatctttagctgcttctcagaataaactaaaaatatgcaataaatagaactcacaataaactaaaaacagataataagtgaaagttgtttttcatcattgtttcaaataacctgattttctaataaacagcaggtctcaaactgttatggaaaatacggcgacttatggagagttatatgtaaagacggagacgaatgtatattcgttttaggggtgcatctacacccctaaaaatacaaaccaagttataatgagtttatttttatcttatatgcaccatcacctatgcacaagacaatcacaccatcaagtttgttatagcttcgctaccgtgtaaagaatggtttgtctctagaaactttgcatgttgtgtgacccacaagggattcgcagatgctggcacaagcaatataatgacttaatgagaggtgtttttactggctttccgtgtggccataatagtaagacatcgttttttttttttttttgccaacccaaagtttgataagaaactaagcatcaggtatcaacaagtagccatctggtaataataccaccatttgcacgtcctagcaaactgatgcctccaccaaatttacaaaatccagaggcaatcactaaaatgtggacagtggaaccgctctatattcctaaatcgcaaaagaacatgaaatgtcctgcaatcactaaaatgtggacagtgtaacggttgttcagacgttgtcatccttttgctgggtgatggtcaaaacaagcccaaagtggtcacttggaaagacaggcagttcaatcctttggttctctttccgaatcttcttctccttgaagtaggagacaccaggtattgcctccttcccgatcatctcaatgctgtccatcttgaagtctgctagcttgcacacaaaccggtccaatcgcttctgcagcttgcggttgcctgacagcatgccattggccttggtgtcgtaggtccagccatcctctccaggtttcagctcaacccaagcatcagtccacccatcctgcagagggaaagggccgtctcccttgtcgtcccagttcatgtccccacagagtatggcattggggaagcctcccagaatttccagggatcgctttgcctgagccacacgttctttgctatacatctgatcccacttgggaggtgcagggcatgggctctcgaggtgggttgtggccaaaatcaactttgtgatctctcctgtcctaacacttgcgatgcatagttctcttcccattgttgaattcgaaaatgggatgcagtcagatggcttcgtcggcattttgctcaactgtaattattgaggtcaaaagaaatcagtaaaaataaatgaactctgagaaaagaaaggaaaaatgccaacctcacaatttccaaaggaaggtcaactatagatttgagatgattctatccatgagccacatgaatcccaatcaaaatagccatttgtaacttgtgaggatttactgtatatgtgaagttatgaaacatgtagtcaaattgctttagactgatgaaaaatgcttcactaaaaatatgcataagtgcttggattgaccatagtgcaaaatgaaactattctaacacacgcatccatattctccaggcattatatcaaccaaaaatgtgtaatagatgacatgaccagtcaaagaaaatatttagcaatttctttgggaatcttacaaatagttttccatgcaggttctgttacaagaaattgagtgagaaccacagttattaaagcggtaaaatgttaaaatgttatgaaccaactttttttaacatttaaacgtttaagcgaacgttgaaacgtcttttcagacttgacatagaagttcaaatatagaataagttcatacataagttgagttcacaaaccaaatagtataaaaagaaacagatcaagttcaacaacttctttggagctgcaattgggtggggcttcaattggaaaattgctttgtttcttttggcagttgttccaggacttgg

SEQ ID NO: 19120 - DNA, 851 bp, Zea mays
atgggctttacactggggcccaacacgaggctcccggactcctcagttccttcgctcctctgtaacccggggcggccgacgaggccgggaccaccgacggcgacgatgggcggcggcgagggcaagtccaagaaacgccgctcttctacctcctcagcggaggaagaagggggggaacggaagaggcgggacaagaaggagagcaagaggaggagccgagacgacagggaggatgacgatgacagacacaagaagaaggggaaacacatcgacaggaacaaaggaaaagagagagattcgaaggataggcattccaaggagaagacgagcaagagaaaagacaaggacgctgccttcaaagaaatatccaaggatgactactttgcaaagaacaacgagttcgctacctggttgaaggaggaaaagggcaaatatttctcagatttgtcttcagagtctgctcgtgatcttttcttgaagtttgtgaaacaatggaacaaaggcaagctgccatcacaatactatgaggggattacgagtggcccacgatcagcgcacaattggaacatcaaagcatgatacgttttctggttaatcgggtccttcggcttgagatgttttttgctttcctggcgagatttttctaatagttgcatctagcaactgcttttaatattctgggttgttgtatttaagctgatgttcagaatgtctgtctaagcaggagggtagatcgtgggtctctctagtatccagtgtttaacatcaacgctacttttccattgatcactactgtttgatcctacaatgagcaaacatactgtttctggggaaaaaaaaaaaaaaaaaaa

SEQ ID NO: 19121 - DNA, 1426 bp, Zea mays
  misc_feature (308)..(308): n is a, c, g, or t
  misc_feature (319)..(319): n is a, c, g, or t
  misc_feature (343)..(343): n is a, c, g, or t
  misc_feature (382)..(382): n is a, c, g, or t
  misc_feature (1000)..(1000): n is a, c, g, or t
  misc_feature (1095)..(1095): n is a, c, g, or t
  misc_feature (1155)..(1155): n is a, c, g, or t
  misc_feature (1170)..(1170): n is a, c, g, or t
  misc_feature (1176)..(1176): n is a, c, g, or t
  misc_feature (1320)..(1320): n is a, c, g, or t
gcggccgggttcccttaacaaggcgggaatcccttcccccaaccgccttggacaggggaccccttctttccccacccatgcaaaagatttgttcagtcccatgaggtttcttgtcagaatcctgaaggacggttttcagtgggagaaaggcatgacattgctttcccccggtagagttgagatgtccggtatcaatccagtttttatgaggattcaaaagtaaagtgttgtcaggtgctttgctcttgcacctcctgaagcgattctgtatgatgggctaccactaggtgccattgaagctataaagncagcatatggnccagttgtgcagattctgatcctnccaaaggacggggtttgatctcacaatgaagataaattngacaaaacttccgctagatgaagagcaaaggaatactatcttgacacaaattgcatctattagagaggttgtgttccctcccccccgcccgcgcctccggaaacatttagcctcaaagacagttgcacccaatgttaacaagcttgttgctcttgttcaccgccctaatgaatcctttttccttgctccccaggcagataaagttactattgtgtatccaatgagattccaggactccattgatattgttttagcaacttccttcctgcaggaatttgtggaggcaagacgaacagctgcacttaataatgttccttcttgtatgtggtctccggtaccacctcttgagttaaaaggagtatctgctgatgcacttaatgcaaatgctggctttgttactttcgttgtttaccctcggcatgttgagggtaaaaagctagatagaacagtttggaatttgttgacatttcatgcttatgtaagctatcatgtaaagtgttctgaaggattcatgcataccaggatgaggcgcaaggttgagtcgctgattatgacgactaagcggtaaacgcgctgaatcccttaatcgacccccaccaaaaccaccgagtaaatgcntacagtggatacgtccaaccttcgcataccactaatttccctattaaataaaacgtggaacatccaaaccgtcaactggtcgaaaaacatccggnctatatagcggcgaatggctctatctaactcgcaactattcaccactaaatcaaaggttnttttgcggggtcggncgtggncgtaaacacaactcaaatccggaacccctaaaaggcaagcccccctattcttaaagcttcgacggggaaaagccggccgacacctgggcgattaaacggaaggtgaaaaaaggcgaaaaggagcggggccgcataggcggctgnccaagtggaaccgggtcacgcttgggcgtaaacacccacaccccgccgcggtttaaggggccgctaccagggcgccgccagggggcacctttttcgggaattgggc

SEQ ID NO: 19122 - DNA, 1232 bp, Zea mays
  misc_feature (923)..(924): n is a, c, g, or t
  misc_feature (932)..(936): n is a, c, g, or t
  misc_feature (948)..(948): n is a, c, g, or t
  misc_feature (951)..(953): n is a, c, g, or t
  misc_feature (956)..(957): n is a, c, g, or t
  misc_feature (967)..(972): n is a, c, g, or t
aagctcctgctgaaacatttagcctcaaagacagttgcacctaatgttaacaaccttgttgctcttgttcaccgccctaatgaatcatttttccttgctccccaggcagataaagttactattgtgtatccaatgagattccaggactccattgatattgttttagcaacttccttcctgcaggaatttgtggaggcaagacgaacagctgcacttaataatgttccttcttgtatgtggtctccggtaccacctcttgagttaaaaggagtatctgctgatgcactaaatgcaaatgctggctttgttactttcgttgtttaccctcggcatgttgagggtaaaaagctagatagaacagtttggaatttgttgacatttcatgcttatgtaagctatcatgtaaagtgttctgaaggattcatgcataccaggatgaggcgcagggttgagtcgctgatccaggcgttggaccgggcgaagtctgatgctgagaagttgaagaagttggtacacggtggatctttcaaaagactgagcctgaagaacgagggggactcgcgtttctgaagggaattggcaaatgttgttgttttccatttggctaatgacttctgttgtgggaagcttacttccgttcagttttgggagcgaaggctcggaaccggttaaatccatgccattgaattttaatgtaaattcgcgttgcttttacatatttactagcctgaaatctctcggcgtatcagttccatgacacatcgcctttgcaaccggagagcctgctgcctgcatcttggtgcaagtagtttgtttttgccatgagatgtctgagtctgatcttttttggcattaataaatgtgttgttcttggatcaaaaaaaaaaaaaaaaaaacgcgagagaacttctaaattcgtaaannaaaaaaannnnnaaaaaaaaaaanaannnaanngggaaaaaannnnnnaaaatttcgataccgccaactccgagggggggcccgttacccaatcgccctaataggagcgtattacccgcgctcatgggcggcgttttacacgtcgggattggaaaaaccctggggtacccaattaatcgccctgaagaaatccccctttccccgttgtgtaaaacgaaaaggccccccccgatcccccttcccaaatttgcccccccgatgggaagggaaattgaacccttaaattttgttaaattcgggtaaatttt

SEQ ID NO: 19123 - DNA, 1630 bp, Zea mays
gcgcccacgcgtccgataacttaagaccatcgacctttatttatccgagtgatgagcgtatatgtggaagcacctgtgttttcgttgcctttacatagctcaatgttacgtcttggaaggaagaggttacttcgtctggtcgtcagtttgaaccgcctggcatgcacatgatctatcttccatactccgatgatattagatatcctgaggaagttcatgtgacttctgatgatgcaccgcgtgcaacagatgaacaaatcaagaaagcttcgaatatattcaaacgtattgatctgataaatttctctgcatgccaatttgctaacccagctttgcaaagacactatgggatcttggaggccttagctttaggcgaagatgagatgcctgatataaaggatgagaccctgcctgacgaagaaggcttgtctaagccaggggtagccaatgctattgaggaattcaagacttcagtctatggtgaaaattatgaccaagaggaggcagaagcggcagcagggaaagcttcccgtggtaatgcttcaaaaaagcggaaggaggtcactgatgcagctgcttgactctatctgcgccgatcaataggtggttttcttttgtcctcgccgtttgtgttcgtctcaataacagcaggaccgtttcgagcgctcggcggctatttgctctgcaagcgctgtgatgcctgtatgtactctgaaatccggccaacgtttctgttcttttcgacatcatcagcccaagcacgtcctagaggcggtggcagcgttggtggcggctgctatgcgatgggggcaccacctccgttgatgtattgtctggtgcgggactgcgagtgacctctgaggcgggggcggagaataactggatctacctaacgtcggaatggagacctgcaggtccatttgaaattaaacagaaggttggtaagagtgtgatggtgctcattttgcgttttagaggatccatacttgcatgtagccaaagaaactattttagtaccttttttccttgtactttttttttgtcttattgctttgcctggagctacttgaaatgctccacagttatgtcctctttttaactgagatgtcgttggcctgaacaaaggatgcttgacgcttcgaagtcacacgcaatgataaattcagtttgcagcaaaacgatgcatttggacgctcattttactccttgaaagctgatactaagtgtcacgcgatacctattacgatagggtggatctttttccctttgtctcgtggtccttttgtggagctgacaacttatatgagctgcggaatcagcaggagcgtttttctcagtggatggttaatattttgatctcagtagcaactcactgaaaccagaaatgacagcggtgttgagaaaatgccttgctggcaggtttggaattttttttaaaaaaatatgtgagaccgtcgacaggggatataagaatacagaagaatggaaatgagttgctggcaagtttgacaaaaacagcagacatggtcttggtggctcagctggaattaatacccaaaaaaaaacagtttaccttcccaattggaaatgaacaaatgaaaacttgacacggtttccaaagtttgggggt

SEQ ID NO: 19124 - DNA, 2812 bp, Zea mays
  misc_feature (6)..(6): n is a, c, g, or t
ccgggnggaccttcccacgccctgcgcccctttgctgtctcaaacctaccttaaacccttgttagtttctagaaccttccagacctccagttcccgacctcggcgccatggacctggacccagaggggatcttccgcgacgacagcgatgaagacgaagacagtgtccaggagagggaggcgaacaaggagatggttgtctaccttgtcgacgcctcgcccaaaatgttcacccccgccaccacccaggacaatggaaagcaggagacacatctccataccattgttaactgcatcacagagcctctgaagacacaaattattggtagatcttatgatgaagtcgcaatatgtttctttaacactaaagagaagaagaatttacaggactcagccggtgtttatgtttataatgtcggagacagagagcaacttgatagacctactgcaaaactcatcaaggatttttctttgatagaagattcttttatgagcaccattggaagtcgatatggaataacagctggatctcgggagaataccctgtataatgctctttgggttgctcaggcgctgttgcgcaagggatctgtgaagaccgtgagtaaacgaattcttatattcaccaatgaagatgatccttttggtactattacaggagcagtgaaaactgatatgattaggacaacacttcaacgtgcaaaggatgcacaagatcttggcctgtctattgaacttcttccactgagcccgcctgatgaccagttcaacatgtccctgttttatgcagatttgattggtctggatggagatgagatgaccgaatatttgccatctgctggtgataagctagaggatatgactaatcaactgagaaaacggataatgaagaagcgccgacgcaggccccccccccccgcgattaccaatgatgtgtgcatagaagtcaatacatatgcgctggtccgtcctactactacagggacaatcacatggcttgattcactaagtaacctcccattaaaggttgagaggtctttcatatgcaatgatactggggctctacttcaggatgcacagacacgtttccagatgtacaatgacacaattgtcaaattttctgtacgtgaactctctgaggttaaaagggttgcaagccatcatcttcgccttataggtttcaagccattggattgcttgaaagattaccataacttaagaccatcgacatttatttatccgagtgatgagcgtatatttggaagcacctgtgttttcgttgctttacatagctcaatgttacgtcttggaaggtttgcacttgcattttatgggaatccaactcgaccacaactcatagcccttgttgctcaagaagaggttacttcgtctggtcgtcagtttgaaccgcctggcatgcacatgatctatcttccatactccgatgatattagatatcctgaggaagttcatgtgacttctgatgatgcaccgcgtgcaacagatgaacaaatcaagaaagcttcgaatatattcaaacgtattgatctgataaatttctctgcatgccaatttgctaacccagctttgcaaagacactatgggatcttggaggccttagctttaggcgaagatgagatgcctgatataaaggatgagaccctgcctgacgaagaaggcttgtctaagccaggggtagccaatgctattgaggaattcaagacttcagtctatggtgaaaattatgaccaagaggaggcagaagcggcagcagggaaagcttcccgtggtaatgcttcaaaaaagcggaaggaggtcactgatgcagctgcgcagataagtgctgcttatgactgggcagaacttgcagacaatggaaaactgaaggaaatgaccacggtggaattgagatcctacctgaccgcgcatgatctcccggtttctggtaagaaagatgtacttatcagcaggatcttgactcacctgggtaagtgaagccgggtatccgaactgttagtttcctgagacccgactgacatctgtagtgctgtctcgcggatccttgtggaccgtaatcctcccccgtgcaggctacgtgccgattttttgtatagcgacaggacagcaccagttgccaatgtaacctgtgttaagtttcgtcttgtggtatcatctgcttgtcattgtcaacatgaaacataatgtaattctggatacttagacccacaatatggagcataactgcataaggtatgttaaagcataggccctctttagcatggccacttgctgtttcaggttttatgctcagggtactgttgcatgctgcgaaatggctttggcttcaaatgagcttggagacaggagaagctgatgaagtcatgtgttgggcaatccttgtcatctatagggtagccagccttgtccgcatctgaatatgcgagatcattggtcctggaggctttaatatgaacaccaacaccatgatctagagtccgaacgtgtggaacggaacccaagattcagcagctcactagcaaatcgctggtaccatacacgtggtgcctgttttaatccagggaaagacctgtgaaggagacaaacatgattagggaaatccttgtcattgaagccggatgattgaaaagcataaacacgtttagacagatcaccatgcaagaatgcgttcttaacatccaattgatgtacatgccaccgtcaagatttttatgtcccaaaggaaatgtccttgtaaaatgagagaaatcatccatgagcacaagataaaacctgtaaccacaattactgagaac

SEQ ID NO: 19125 - DNA, 1331 bp, Zea mays
  misc_feature (6)..(6): n is a, c, g, or t
ccgggnaaaaaaacattgggtaccgagcaccagaccagaaccccgccccccagttgctccttccaccgttccacgcgtccacggtccacccacacgcaaggtcgcaggtcgcaacccgcgggcggaggggcaggcacaggaccgttgcgttgctgccgccgccggcacgagatcgaggagggatcccccgctctcacgccgctccaggtcgagggccgagcgagatggtgaacaccttcttcctcttctgcgggtgcgtggaccaggccagcgtggcggtggtggagaagtggggccgcttcctccgcctcgccgacccgggcctccacttcttcaaccccctcgccggggagtgcgtcgcgggctccctcaccacacgcgtccagtccctcgacgtccgcgtcgagaccaagaccaaggataatgtcttcgtccaactgatctgcacaatccagtaccgtgttgtcaaggaaaatgcagatgatgctttctatgagttgcagaatccccagcagcaaatccaggcctacgtctttgatgttgttcgggccatagtgccgagaatgaatctggacgatctctttgagcagaagaacgatgtggccaaagctgtattggaggagcttgaaaaggtgatggcagattatggttacagcattgagcacattctcatggttgatatcatccctgacgctgctgttcgtaaggcaatgaacgacataaatgcagcccaaaggcttcaactggcaagtgtttacaagggagaagcagagaagatccttatggtgaagaaagcggaggcagaagcagaggcgaaatatctttctggtgtcggtatcgctaaacagcggcaggcgataaccgacggccttagagagaacatcctgaacttctcacactcggtgtcgggcaccagcgcgaaggaggtcatggacctgatcatggtcacgcagtacttcgacaccatcaaggagctcggggacggctccaagaacaccacgatcttcataccccacggaccaggccacgtgaaggacatcagcgagcagatccgcgacggcatgatgcaggcctcaagcagcaacgtgtaaatcaccgactctctgcacgattggagacggctcggctcaggatgaggcctggagtaccatgttcatagtgttaggttgttgttagtggtaaataatgagtgctggggcttttggcgagtcttgagttacatgcggttgtacaactagtgtggtttgttttatatataaaaatgtatatttacatggttctgctcctggaattttgactttttatggtttggcaaaaaaaaaaaaaaatcg

SEQ ID NO: 19126 - DNA, 820 bp, Zea mays
  misc_feature (783)..(783): n is a, c, g, or t
gtctccccctcttatatgaggaagcagtggtaacaacgcagagtacgcgggggagtatatttgatatagaaattgatttaaatagaaaatcttaaaaaactcttgtcttatccacattagacaaaatgaactaaagaagaatttagaatttaagtatctttcagtatctttcagtatctaagtataaatactaagaaaaaacagaaagaaggattgatttgtggcaatagatgtctttcacatacaactagaaaaaagtaattccctttttgaatggcagttccaaaaaaacgtacttcgatgtcaaaaaagcgtattcgtaaaaatctttggaaaaaaaagacttatttttccatagtacaatcttattctttagcaaaatcaagatcattttctaggggcaacgagcatccaaaaccaaaaggtttttctgggcaacaagcaaacaaataataagattttgaaataatctgaattgaactatccaaaaaaaaaaaaaaaaaaaaaaaagaactctgcgttgttacctctgctccactgaggaaaatgcagatgatgctttctatgagttgcagaatccccagcagcaaatccaggcctacgtctttgatgttgttcgggccatagtgccgagaatgaatctggacgatctctttgagcagaagaacgatgtggccaaagctgtattggaggagcttgaaaaggtgatggcagattatggttacagcattgagcacattctcatggttgatatcatccctgacgctgctgttcgtagggcantgaacgacataaatgcagcccaaaggcttcaactggc

SEQ ID NO: 19127 - DNA, 2012 bp, Zea mays
ttttttttttttttttgtgataaccagaattaaattcccttgcattctggctgtttcgactacttttgtcagtgtaacatgtacacgggccccaaaaaaatgcatcacagaaatgccaaaccaggtagttactctacagcacattccccccagttaacattcccaagtcccaacccaacccttgcaccaggaactaaccacaatgtttcggaaggaccgagcagcatgtctcaacacaaacctatttgagccgcagaaggaccgtaaccccgggacgagagagaggggtctggtctttcatcaaggtttcgtgttcttctgccgcttctcttcgagctgcgacgcctcgttcagcatgtccgtagcgtcgctctgcatgttcagcttcgagagcgcgacggcctgcatgtagaacgcggttggccaatctgggtacgcgcactgcgcttgcatggcgtcacggagggcggcgtcaggctggtcgcacatgaggtggcacaagctccgcctcgcgtacactgttggcgacaccatcgtccccacgtcgacgaactgcgtgtagcagtctatggctgccttgaaatctttgtcacggaaagcaaagtacccacgtttcctagcttccagcatgtccctcatctgctgcgtccattcctggaacgatagctcgttgctcccttcatcatccctgtaatgcgtgttcactagaatctgatggatggcagtcagatccatcctggaacaggcctcgcccatgggagaaagagggtgttgcggttgtggagggggaggtgcttcttcttcatgcttcggaatgccaagcatctcgtaggatggtacctctgattttatttgcaagggctcaagtacggaaaccagctttttagtgttgggacgatccctaggttcgtactgtaggcactgagaggcaaggtcaaccaatgtggttgcctcttctgttgagtagtttccctccagatgtgaatccatcagtacttggatattgttgccttttatcatatcaagagcacgggatggaggtatacgttttccacttaggaggtccagcagtatagtgccaaagctgaatatgacactttctgatgttactcttccatttctcaaatattctggaggtgtatatgcaaggtttgtgctatagcttttcccatccctgctgtttttcatcaggccaaagcatgaaagacgaggatcaccattctcatcaaagaggaccctatatgcatttaggtcatgatacaaaggccttccttcggtgctacaatattccagtgcttcagcgatgtagtatgcaactctcaggcgcatagcccattcaattgtctggttttcccagtggaagaggtgcttggcgagcgtgtcgttgggcatgaactcggcgacgagcaggcgctcctcgccgtcgcagcagtagccgatcaggttggccaggcggcggtggcgcagcttcccgacccccttggcctcctccgcgaactgcttggggtcgggccacgccatcttggcgaacttcttgacggcgatcgcgcggcggctgggctcgaggcggcccctgtacacgaaattcggcgccttgtcgccgctctcggacacgatgttgtccggcgcgaagccggccgtggcggcgcgcagctccgccagcgagaactccctgagcggcggcacctggtgggcgcccgcgcgggctgccggcggcgcctggttctggttctggctcagcgagtaggaggggcggcgcgggggcagcgcccccgccgccggcttcttctccggctgcgtccccgcccgtagcgaggagccgcagcagcccatggacgcccgccggatggcctccgccgcggctgcgtgggcgtgggcgtgggcgtgtgcgtgtggggctggccgggttgggttctcctggcttggagagtaggctgtcgagcggcggaggagaggaggggagagaaggggacagagaaggagagggaggaaggtttcgcggtgggtgggtt

SEQ ID NO: 19128 - DNA, 1964 bp, Zea mays
aattataataaaaaaatatttttaataatataaattttatatataaaaactattattttaaatattttatatttttaattttttttttttttaaatatatttttattttttttattatatttttttttttttttttttaaaaaaaaatccccttgcattctgcctgtttcgactttcgtcgatgtaacatgtacacgggcccaaaaaaaatgcatgacagaaatgcgaaaccaggtagttacaatcgcaggactctgcagcacactcccccagctacattcccaacccctggaccaggaacaagccatcatcagggttttgtgttcttctgccgcttctcttcgagctgcgatgcctcgttcaacatgtccgtggcatcgctctgcatgttcagcttcgcgagcgcgacagcttgcatgtagaacgcggttggccagtccgggtacacgcactgcgcctgcattgcgtcgcggagggcggcgtcaggctggtcacacatgaggtggcacaggctccgcctcgcgtacaccgttggcgataccatcgtccccacgtcaacgaactgcgtgtagcaatctatggctgccttgaaatctttatcgcgaaaggcgaagtccccacgcttcctagcttccagcatgtccctcatctgctgcgtccattcctggaacgatagctcgttgctcccttcatcgtccctgtaatgcgtgttcactagaatttgatggatagctgtcagatccgtcctagaacaggcttcacccatgggagagagagggcgctgcggttgtggagggggaggcgcttcttcctcatgttttggaatgccaagcatctcgtaggatggtacctctgattttatttgcaagggctcgagtacggaaaccagctttttagtgttggcccgatccctaggctcatactgtaggcactgggaggccaggtcaaccaatgtggttgcctcatctgttgagtagtttccctccaaatgtgaatccatcagtacttggatattgttgccttttatcatatcaagagcacgggaaggaggtatacgctttccacttaggaggtccagcagtatagtgccaaagctgaatatgacactttctgatgttactcttccatttcttaaatattctggaggtgtatatgcaagatttgtgctatagcttttcccatccctactgtttttcatcaggccaaagcatgaaaggcgaggatcaccattctcatcaaagaggaccctatatgcatttaggtcatggtacaaaggccttccctcagtgctgcaatactccagtgcttcagcgatgtagtatgcaactctcagacgcatagcccattcaattgtctggttttcccagtggaagaggtgcttggcgagcgtgtcgttgggcatgaactcggcgacgagcaggcgctcgtccccgtcgcagcagtagccgatgaggttggccaggcggcagtggcgcagcttcccgacgcccttggcctcctccgcgaactgcttgggatcgggccacgccatcttggtgaacttcttgacggcgatcgcgcggcggccggcctcgaggcggcccctgtacacgaaattgggcgccttctcgccgctctccgacacgatgttccccgccgcgaagccggccgtggcggcgcgcagctccgcgagcgagaactccttgagcggcggcacctggcgggcgccggcgcgagccgcggagggaggcggcggcggcggcgcctggtgctggttgagcgagtaggagggacggtgcggggggagcgcccccggcggcttcttctccgggtgcgtccccgcccgctgcgaggagccgcagcaacccatcggagcccacccccgggtgggtggcttccgccgcggctgcgcgtgcgtggcgtgggtgggcaaccctgtgtgtggtgtggggctcgggggctgggctgggttccccggacagtag

SEQ ID NO: 19129 - DNA, 2083 bp, Zea mays
ttttttttttttttttcacaaacataacatgtttattatcttcggcgacagggccctcctgaacaaccggcaacctatactctaaactcccatgcaacagatgttatatacatgggcccaaaaaaatgaagaacctatcacacaagtgccatcacagggctccagagtacagggagcaaagagcatcttctctgcagttcacttcttacttctaattctagaccacgcaatatactatgcgctttttacagggtggaaaaggttggagaatatactactgtactacatagtgtgcgatctatgttatatgtatagaagacgtgccacttctctgagctgacaatgccattcaaggaactcttgtgctcttttgcctcttctcttctagctgtgatgcctcgttcagcatgtccacggcgtcactctgcatgtttagcttggatagtgcaactgcctgcatgtagaatgctgttggccaatcagggtagacgatctgcgcttgcattgcatcacggagggccgcatcaggttggtcacacataaggtagcacaagcttcgtctggcgaatacagtcggtgacaccattatccccacatcgacaaactgagtatagcaatcgattgctgccttaaaatctttgtctttgaaggcagagtcgccacgtttccttgcatccagcatatccctcatctgctgtgtccattcttgaaaagacagctcattgctcccttcatcatctcggtaatgcgttgtgaataggatctgatagatggcagtaaggtccattctggaacaagcttctcccatgggagaaagagggcgctgtggagtaggaggtgcctgtggttcttccactggctttgcaattccaagcatcacataggacggtacctctatttttttctgcaaaggctccagaatggaaaccaacttttttatgccaggacgatctcttggctcatattgtagacactgagaagcaagattcaccaatgtagtagccacctcaattgagtagttcccctccaaatgtgaatccataactgcttggatgtttctgcctctcatgatatcaagcgcatgtgaaggcggtatgcgtttcccactgagaaggtcaagaagtacagtgccaaaactgaaaatgacactttctggagtaaccctgccatttctcagatattctggaggtgtatatgctaggttcgtgctatagctttttccatccctgctgtttttcatcagaccaaagcatgacagccgagggtcaccattctcatcaaagaggaccctgtatgcatttaggtcatgatataaaggccaccccttggtactacagtattccaatgcttgggaaatgtagtatgcaactctcagacgcatagcccactcaatagtctggttttcccagtggaaaaggtgcttggcgagggtgtcgttgggcatgaactcggcgacgagcaggcgatcgtcgccgtcgcagcaataaccgataaggttcgccatgctccggtgccgcaggcctccgacccccttcgcctcctccgcgaactgcttggggtcgggccacgcgagcttggcgaacttcttcacggcaactgcgcgcggcggggcaccgccggggcccctgagctggcctctgtagacgaggttgggcgccttctcaccgctctcggagacgatgttccccggcgcgaacccggccgtggccgcgcggagctccgccagcgagaactcggcgagcgccggtacttccccggaggcgcgggccgggggcgcggcctgctgcgcgttcagggaggaggtggggccgttcgtcggtggcggtggcgggcggtggcggtggcggggcggcttctccgccgcgtggggccctgagcgcagcgacgagcgccagcaacccatcaagtcaagtgtgaaaggtgcgcggctcactgtccgggccgtttgctaccctttccgcggggcgctcgtgtgtacgcgcgtggcgtgtgcgagaggagacagtttttgtaacttgcccctgattctgattctctgggcctgcttgttcggtccgggattggagacccggccggcctcgag

SEQ ID NO: 19130 - DNA, 513 bp, Zea mays
ctcttgctagcgtatcaggttcatcttcaagttttgcggtggctgcctactagaagttttgcggtagcgtgcaagttcgccatgagagggcctgtgttaagcgccgttagctccttgaacgccggttatgcatattgcggcttatatgaaagggaagacgagtaccggacgccagtacataaggtcgagccgaccgtccggctgggcctcaggatctttgcggtcgtcaacgctatcatgctgactattgttaacatcatcataagcgagagcctcctcgggaagatagtagctccggctgggatgatagtcatggtggggtttgtatttgcaatcacaacagacgacgatgccgaacctggaatcacccaaacagagtccatggtgtgattttcatccgcaacaagcgggacccttttcttctagattgtttttactactagacatcagaatgttcattttttttggttcgaattatagataagagcttggtttgtctcgtgtaaacccacg

SEQ ID NO: 19131 - DNA, 1844 bp, Zea mays
agattgtgcaagatgtttgtcctactgaaggagccattttagggcctgactctgttttaatctctaagcagacagaaggagatatatcaaataggtgcattgttgatgttaaaattgaggaagatgataaggaagctgataaaaattgcagcaatgttgatgataagaggtccagtgatagtactcatcaagctggccctatcaacatcaattgcccagaaagtacagataagctgcaaggaactgatgatgccgttgaccaagtaaacatgcatagtagtgtcctcaactcttcaaatgagcatgcaatggccatgcactcagaagtgagatccagtttacactctgtagatgtacttcaaacagacaaagctgaaggtactggtactgatcctagccaggtggaagaatgttcacatcatgctgtctacacaccgatgacagctgggaattctggttcctcagctttcttaacttcagatagtggtatcaaggacaatgttcacatctcaaacatgtctggtgcctccactgttagtcctgcattcacttcaaactatcaacattctctgccaggagatatgcccctgtcgaaaccaaagccactagtaacctcccttaccccaaaggatttaatgcctgtgcagttcagttcagttcttcctgatcccactgcatttcgttttgagggcataaagcccaactttgaggacagcagtggcaacaaagtcagcagtgccctaggagctaaagacatttgcaagtacccagcttttaaagacccatctgataatgagcatgacacattgtttcgtaatattgatggttatatgaataatcatctgacaactgaattgccagttttttctcaaagaactgcaagtggcactgtgagtacttcgcagacaaaattccagaatggcaggtccagcagcgtgtgccttccaaacagttctgaggggattcaatggcccaggaaacctgaagaagtaccggaagattctttgaggccttgcgctcgcaatgcaaaaactgagggtggtgagaaacaaaagcgacctggtgatgtcaagttatttgggcagattctcagccatcagccaaccttgccaagttctggctcgttgtgtaatggtagccagagcaagcctccctcaccaaagattgacaaaacatctgtgagattgaccaacaatccaagggatcttgtagttttttcttccaggcctggtgtcagtccacatgtgggtctggaggaaagatcagtgaggagctacggccatctggatggaagcacgatacagcctgagcctctgctggtgatggcgaagtgccagagatccttggccagtgtaccattttactcggctaagaacagcacggttggcgtgtttccagattatcaacaaccttcaatgcagccacatcaattagatcccaagccgctggaaatgttttctgattcgcagaagaggaatgggctggaactcgtctcgggtttcggcggtgctggtatccttgttagcaacgtctcagaccatgtggctgctctcaaggctcggtatggtcccggttctaagataatgggcagtgacgcggatccttggaaagacataggaagcaggtagcaccgatagcggtagccagttctagtgcttgttttgttgctcgctgtatcatatttagttcttttttttttctgtaacttgaatgaaatcgtcaaatgaaggaaagtgaatggctttcctgcccatactatttgtaagctttgcagtagttgccgggttatgttatttactggcattaacattttaacctttattgcagcaccataccctttggta

SEQ ID NO: 19132 - DNA, 2601 bp, Zea mays
gtgccaaagtgaaataggactatcataagtgaatggagggagtagttagtaaattgctataattgcaattgccgctgtatgtcactgtatttttttggaatggtatttgaggtttatttcaactgcttgcgttaatatgtgatgcccgttacatagggggcttccatgtgcggagatattttttcttacatttatctttattgggcctctttggatgcatattgcatgctcatgacaaatggcaaatggtttcatcttcacacaagatggcagtttcatttcacttattgtatttaactgatgaattctctgctcgagttgcataaatttgctgtaccattttgacattttctacaggctgtgaaccgcattgcatttcactgatgagccccctcttgtctgagtggaattctttcgtccgggctgtgtaattgtttgcacgttgcagagacaaaatttttggtgtcttagcgtgtttctagaacaatgggatttgagcttattttcagttgtgtggcgctgatatcttagtgtgttgcatgttgagctggtttaatcagcgtgttcttggtggttttgcggtgttgcctcacctgctgagcccttggtgctcagaggtgtcagtattgtgtgcattagtattgtttgaacgtactgatatggcgatccttgctgtaaatgaaatttgggtttctcggtgtgggaacaaaatctacagagcttttccttattggggttcttgctaatggtgcactcaatcctttggtatgatggttgaccggctgtcgcatgtggttccgaatgaggacgctgtttcacttgtgaagatggaggaggatcctgaggcagcagcccggaagctgacagagactgcgttctcccgtgggagcggcgataacatcacctgcatcgttgtgaagttcgagcatgacaagcctggtggcggcggctactcgcctccaggcgacaagagttgattccatttgctgttggttatacgctttgccggtgtcccttttaccctgggccggattttgctggccccatccatggtgccccccgcggctggtacttgaggaaggagctggttcatgttcgtcgcctgtcttgtctatatttatgccactaattttggtctccggtcagtggggttaccggcgggcagtgcttgcccatttgcatgtttatcgtgggttcatcgtcctatacggcattgttgtagacttgtagttgctgttgcctgttgtatcaatgagagctaattctgtgaggcgcagggggatgggtgcactttgagatgttcccggaccgatctccttgcaaacacctccgctgcactgtatgtttctgttatatacagatcattgtccttgcacggccgtcagccaaggacgaatggccagtgaaaatgtggtggtgctcactgcccaaaagcctctctcaaggcagagggctttgcagtgtggccaaggtctgcagctggagaggatgctgagttgcaggctacagcgttggagtaatagtgggcacatggttcactaacctactgatttcatgagtagggatcgatgggcacccacagacatgaatggaacgtgggcatcagttcacggtgcacctatgcgttctcagtagctaactgtagagcgcctttgccaccggtttgtcaggtcagcagtttctaaatagaaaaatactcccctccattcataaatatatgacactgttgactttaaaaaaaatttaatcaatagttttattaaaaaataataatttataatttatttatttattatatgttttatcatgtagtttgcgtttgacttaatattttatatatttaaataagtattttaaataatacgagtagtcaaagtttaaaaaaataaataaattgtgtcatgtatttatgagccgaggtagtatacgtctagacataatattatataccttgacataatatacgtctagatgcataataaactctatgtaaattaaaaagctaaaacaatttagagcctctttatatcttcacggtttgatagaaatagaagcttgggtgggaaaaaacgtccaatagctacagatagagtctgcggatgactacagatagcatctccaagtgtgttatttttttaaattttactctctaaattattatttagagtcatttatataaaaatcattttctatatcttttcaatttttaacagcctttctatatcttagaaagattcacgttttctatatttagctagcgagaaacacgaaatagataaccatttagataagttgtttgagtgtattttttttacaaaagtctatttatatagattacgaaaaatataaagaggctcttagagttgctcttctagcaagttcaatagttatgtaaattttagctctctaatcatagatttaagaagttgctaaataactttaggagtaaataatgtgaattcttctataattctttaaatatatgttgtagttttgttttgtatctatccaaataaaaaaagaataagtcacaaatttcaacaattaacttcattacctacataatgcagtcaacatttttgtttaggaagttgttaaatg

SEQ ID NO: 19133 - DNA, 1420 bp, Zea mays
  misc_feature (1396)..(1417): n is a, c, g, or t
ccgcccggggcccccctcacttgcctcgcgtgggcaggagcgccagcggcttcgtccgatctctcacctcacttcagtcttcagccacgcacactccctccttccctccccgatcactactctccctctccagttcacacccaccgccccacctctcccactcaaatccagggccatcgcagatccaccgcctccccgatccggtcgcctacccagccgcccgatcggatcctgcagtgtggatggaacgctgaattgtggatattcaagttttagaggaaaaagggcaagcatggaagatttctatgatataaaatcatctaaaattgatgataaacaaatacatctctttggaatttttgatggtcatggcggttcacgtgctgctgagtatttgaaggagcatttgtttgagaacctcatgaaacatccagagttcatgacaaacacaaaattagcaataaatgaaacatataggaagaccgattcagagttcttggatgctgaaaggaattctcatagagatgatgggtcaacagcatcaacagcagtgctagttggtgaccatctttacgtggcaaatgttggagactcaagggctgttatatcaaaggctggcaaagctattgcgctctctgaagatcacaagccgaacagaagtgatgagaggaaacgaatcgagagtgctggtggaataattatgtgggctggaacttggagggtaggtggtgtacttgcaatgtctcgggcatttggcaaccgtctcttaaaacaatttgttattgcagaccctgagattcaggaacaagaaataaatgatgagttggagtttctaattatagctagtgatgggctgtgggatgtggttccgaatgaggacgctgtttcacttgtgaagatggaggaggatcctgaggcagcagcccggaagctgacagagactgcgttctcccgtgggagcggcgataacatcacctgcatcgttgtgaagttcgagcatgacaagcctggcggcggcggctactcgcctccaggcgacaagagttgattccatttgctgttggttatacgctttgccggtgccccttttaccctgggccggattttgctggccccatccatggtgccccccgcggctggtacttgaggaaggagctggttcatgttcgtcgcctgtcttgtctatatttatgccactaattttggtctccggtcagtggggttaccggcgggcagtgcttgcccattcgcatgtttatcgtgggttcatcgtcctatacggcattgttgtagacttgtagttgctgttgcctgttgtatcaatgagagctaattctgtgaggcgcaaaaaaatgggtgcactgtgagatgttcccggaccgcgccccttcaaacnnnnnnnnnnnnnnnnnnnnnngct

SEQ ID NO: 19134 - DNA, 5233 bp, Zea mays
  misc_feature (4874)..(4874): n is a, c, g, or t
tggtgaggaagaactgcggggagggagaatgccatgaagaggcagctgtgtgtggaaggagaaagaggcggctgctgggagtcaggcagtcagctgagtggaacgtaagttaacctaaaattgtggtgttgggctgatctgggctaattgataatggtcttctttctttcccctttttctttttcctgtttttcttttctgctaggttagaatgggcctactaagaggttctacagttgtgctacttgcttattagcttctagttagtgatatataactaatatttgatctaatttatatatttatctatataattaaggtgccgcctcgccttaagctttaccgcttaaaaagtaaaaaggggtggcttgccttatgtcgccttaccgctgtaataactatggattctgttgggtttcaactctgacgtatcccaagtggcattaaaggctttgttgttgttgctgctgttgtggccttgagagatttatttcaactgcttgcgttaatatatgatgtccattagattgggcgcttccatgtgcagagatatttttcttacattattgactttagtggacctctttgcatgtcagacagatggcaaatggtttcatctcctttacctaagatgtagtttcacctatattatatttagctgttgaattttctgcttgagttgcatatatttgctgtaccatttagacattttctacaggctctgtatcacatttaattgatgagcccccgtctgtttgagtggacttattttttggctgggctgtaaccgtttgcacattgcagaaacaaaattgtaggtatcttggcgtgttttcagaacaatgggatttgagtttattttcaactgctggcattgatattctagtgtgttgtatgtcgagctggtttaagcatgtggcctttttggtggtttggcggtgttgcctcaccttggtggtcagagttgttggtattgcagtgcgtcagtattgtttgaatgtactgcagtggcaatccttgctgtaaatgaaattcaggttcctcattgtcgggcacaaaatctacagagctttccttaggggcgcttctttcttgctaatggtgcactgaatcttcctatgatgctcgactgaccgactcgtcttgttttcacaggacgctgttacacttgtgaaaatggaggaggaaccagaggctgcagctcggaagctgacagagaccgcgttctctcgcgggagcggcgataacatcacgtgcatcgtggtgaagttccagcatgacaagccgcgcagtggcggtggcgattccccttcctcgcctcgtctctaggcgacaggagttgattccatttgtttttggttatacgtgttgtcggggtcctttttaccttgagccggattttgctggcccccgaggctgatacttgagaaaaggagtcggttcatgttcattgcctgtcttgtctatatatgcccccctccctaattttgcttctccggtggcagtgctgcccattggcatgcacatcgtcggcattgtcgtagacttgtagtttgctgttgtatcagtgagagagagagttaattctgtgaggtgttcattttgagatgtcactggaccgatcttcagtccagctagatccgtaagatgtgcagtgcataatctcgtagaggtgatgatattcgtcagaagaatcagtgagagattaccgtgtcacattactgtgtttttctaatgtaatgggtgtactgtttctatatatgtgtgtatatagtctctaccttaatcagggttagggtttaggggccggccgatgccagctcacacagacccaggccgactgtagagggtctgattccatcgtgctacactccgttccgctttgtcatagagaccctcccctcctatagcaagcaagcaataaagatgatctgccatttaccagcgatcattgcaagagcatttcccatccgtaaaatggtgaaaccgatcggcgtctcgaagaatgatttggcgtccgcatagagcagatatgtgcttggccacctcatggcagtcactgcacatcctggtgttcttgatcaccctgatgggcgtcccgctcgcatctgagtggatcagcccataagtgatagctagcttctcggtgtggctgagcagcagcttctccttgtcttcttcggggacgttatacgctatgcagctagtgtccgccacataccctgccttccttatctgaagaaccagacgaaccagttgttggtatatctccgcggtgtctgggtgtggtggcttcccctcgacttggaacacatggatgctttgctcgatctgtatccagctccacccaggtcgagtgttcagcgctctcgctttcattgcatacttgaggctctcggcttcatcgaacatctgttcacgctcgtacaagctccccgcctgcaggtagttggctgaattgtacggctctagcttgaacagtttccttgcagctgcctcggcaagagcaaggtttccatgtaccacgcaaccggttagaagggctccccataggctcgccgctgacttgaatggtgacctgttgatgaagtccgtcgcttcatccaggtacccgcaccttgccaaaagatcaaccatgcacgcgtagttctcaacggtcggtgtcacgccgtatctgctctccatggcatcgaaatagtcccacccttcagtgatcaactccattgatctgcaagcagtgagcagcgctgtgaaggttatactgtctggcttcaatcctgctcctgctcctgcactagcactacacatgtcgtcgaacagcgctattgcctcacggccctgcccatgtgctgccagcccggtgagcatcgcattccaggacaccagattcttctcctcctgaatcctttcgaatatccgcgtcgcacttgccaggtttcctgacttggagtacatgtcgattagggctgttgcaacaaccatgtcgcggtcatacgctcttcttcgcagtgcgaagcaatgcagctccttccctttcgccagcaaagccagccctgcgcaagcccgcagcaacacagacatggtaaccacgctaggctggacgtggtccttctgcatctcattgaagaagtagaacgaatcttcgtagtctccattatggcagctcccggagatcagcgaggtccaagaaaccacattgggtgtcaatccaatcgccttcatctgccggagcagcagcacagcctgcgagctccgaccgttcatcgaatagccactgatcagcccgttccaagtggttatatcagggtcaagcctgttccttttcatctcctccacaaggtccagtgcatggtcgaactgacccgcgttcgagtacccagcaaccagcgagttccatgtggtgatattcctaagctccagcgtgtcgaacaccttctgggcgtattccaggcggccacacttggcgtacatgtcaacgaacgccgtcccagtgtacacgtccggctcgagccggtgcctgaggaagaagcaatgggcttccatgccatgcgcaagcagccccaagctggccacagacttgagcaggctcgacatggagctggagtccggtggtatccctcgctccagcatgctccgaaccacgccgaacgcctcccggtcgcgcccgtgccgcgcgcagcccgacagcacggcgttccacgtcgcgaggctggggctggcctccaccggccccgacctcgccatgcgctccgcgaggtccagcgcgtcgtcaacgagcccgaggcgcgcgcagcaggcaacgacgacgttccacgcgacgggcggcgcgtcctccgtctcgagcacccgcctggccgcgcccacgtccgcgctctcggcgtacatgccggcaaggaagcccggcacgagcgggtgtgcggcgacatggcccgccttggcggcgtgcgcgtgcacggcctgcccctcgcggggcgcccccgcgcggccgcacgcgtggagcgcccgcgcgcacgcgtacccgtcgggagccaccccgcgcgcccgcatctccgcgaacgcggcgatcgcgtcgccccactcctccgcctcagcgagcatggccacgcgcttgttccacagcatcgtatccacttcctcgtctccctcttccttcccctcctcctctgctgccgtcgcttcctggagcaagcgccgggccgaggcccagcggcccaggcgcgcgaggaggtcggcgagcgcgcacgcgacgcgcgggtcccgggcgcggcccgcacggacggccagcgagtgcagctgtggagcgaggtgacgcgccgcggagaggcgctcggtgtcttcgtccccgtgggggacatctgcacactgccgcaggagggagaccaggagccgcccgtcgcggaatgtctccacgcctcgcagcgcttccgggagcgagctggctttgagcaggagccgaggcgggggtggaggtttggcatgatggtggtggtgggtgggcggcgtcggcagcgagagggagatagcttgcgcggtcattggaggggaaatggaaaaaaaagcaagaggatttgatttgctgcgcaagaagtgaggataaggggatctgagaaagcaaagctgctgattgaaagtgggcttgggccgacacttacgagtcggcggcctcaaatactctgtacggagcacaaaagattacaatcgacgccggcgaggtcatgcgcgttgacggccgcggcagccgccctacaaccacccccaccgacgccgctcctcgccccgccctggaccgactcaatacgaagtatactgggctagatggaataactgagccagaacagaaaaaaactagaacaggtataaataaaaaatcttanttaagaggggttatataaagaacaggttctaaatcgcgatcaattcccttttcaaaaggctgctgcagcagctcgggctcctcctgcatgccacaaatggcccacaaaaaagaagaatcctagaacaaaatgggaggtcgctaaccaacttctaggagagacataattaacagcattgatctcggtagctacgccacccacggaatttaaagagcctaaaggagcatgggtcatatattctgctgaacgtcgttcttgccaaggttggatgtcttttttcatcctactcaagtccaaaccgttggggcctctgctaatatgggccgctcataggtttttggtcacaaacaactatacgc

SEQ ID NO: 19135 - DNA, 1037 bp, Zea mays
gctattaatgctggcttaattttttactgctggatagggatctttggggaccagaggggctgactatttggacaggtagcatgcttggatgctctaggcgtcgccatgtacacttgtattgtatgggttgtcaactgtcaaatggcgctctctgtgaactacttcaccataatccagcacatattcatatggggcagcattgcagtatggtacctcttcctcatagtttatggttccatgaacccgaggttctcaactacagcctacatggtcttcatcgaacagctggccccagccctctcattttgcttggtgacactttttgttgtgctggcaacacttgtcccctacttcacgtatgccgcgatccagatccggtttttcccaatgttccacaacaagattcagtggaagcggtacttggggaaggctgaagacccagaagtggcaaggcagttgtcatcacgacaccggacgtcgtcgcagcagaggatggtcggtatctctgctcgtcgggacggcaaggctatgcaaataacaagggagacagagatagaagttcaggagtagcattgtcagtagattttgcgttttgtacagcttataggatattgtctccggcaggatgacagctgaactgattggaacccggaatgtttctggattgctgcttctatgatggctgtcatggaagctgatggtagagcaagactacaaattgcttagataggtcacaactcacaaggaggccaagagatcctgttgtaaagttcaattttagcagttcaaggctttgtgtttttcccccctgcttctcttacatcatagatgcttgtaaccagattggtagtttcgttgtttttattcctctttaccccccttgcctgccccctctcaactgtattttaaacaataatgtaaggcatcttgtttgagtggctttcatgctttatttgggaaagaatcataattgagtgagtgatatagaatgtaaagattggcctctaatatttgtttaaaacaccaaaaacagaaac

SEQ ID NO: 19136 - DNA, 3339 bp, Zea mays
tgatataattttttttaacattttaaatggtgtacttcagtttttagtacattatttaaagtttaagatcctttgtaattagtaataaaaataagtttaaattgattttattgaatattatttagtttcagatacgaatagtatcggatattttacgattttgtcgaatgttgttgagtatgaatcttaaaccggataaagaaaaaatgaattcgaatatatctatttaacatctatattaaaatcgaacacgaatacagatatctatattagcattttatccgaatatgaatacgaataatttggatctccggacatccgaatccatccctaatctccttcctattttatccaattccatttctagatctctagggaatcctacccattcgtttgctaatagcaaaaatctcggcgcacgctcgcgggcggtccatggccccgcacgggcccacctgccttctggcgagcgatgcaggcatgcagcaaccgacttgggcttgaaatacccctgaggccctgacccccgcctcgccacccactgccacgctaaccgtcgcaaagaacagctgctatgctgctcttcccgctccgcctcgaaccagcgtcaatccactcgtccaccgtcgcaccagcaccacgaccacccgcggccgcgatgaacaacttccccgacgggacgcacgtgtggctgcagagctgcgcgcggcgcgggtacctccacgccgacgaggacgggtccggcgtctccctcagcaacagccgcgccacgctgaacgcggcgtggcaggtgcaccggatcgtgcatgggggcgtcgactacgtcctcctccggtccgccgcctacggccgctacctcgcgctctcagcgtccttggcggcggacggccaccgcggccgcgaagccgcccagcgcgacttcaacgagccgcagcagctcaacgtcaggtggagggccctctcggcgggggacggcagcggccacgtcctcctgtgcaacgtcttggtgagcgaggaacgcttcctccgcgccaacggcaggtaccgccgctggaactccggcgtcaccgtcgatgtcgttggcaacgggggcaggagcacgatgatgcattggacggtcatggagatccccctgagaccagcgccgcctgcccttccaaatccatctacggttagttcactgccccttctctttccactcctctcgttgatttggacggaacattgttcttgttcttggaacatgtcgattccaagaactgctgaatcttggctattgcattgccctgggtgcagttcttacgtttgattggcagagttctgcatttgttcttgaattcttgctcatctgcattaggttggctttagggacaagacaatttatccaagatacctgtgttttatgtaattttgtctgtcattcgttaacttgcaaaggatcaagttaagttagctattggtttctgtgtacgctttgttctcgttacaatgtctattgctgtggcaataggatctgggagtccttacatttggcctgttccatactcccactggtgcactgtagtccttacatttggcctggctaaattctgccttggttctagaattcttgctcctctgcgtaaggtttattctctatactagattatgatcttacgaagatctgcaaaggattgttgatttgttgagctgttgctaagtgagatgttgctttctgtatgcgttttgttgtcgttacaatgtgcattcagctacggagatacctgtgttttctgttgcaataggatctgggagtccccactggcctgttacagcggcggcgcactgggcgcgtgacggaccggcagcgaacgatccggtacatgcgggcgaacgatgaggggaacttcctcggcgcggagacattcaggttcttcgggcggtccgtgttcaacctgaggtacgaggtggcggtgaaagtgaacgaggacatgctgacgatcacgctgtgcgcgcacgctggcttctacggccggctgacccctctggtcgtcgacctgcctcgcagccaagaccctctggacatcgtcgtccttcccaacaattcaccaggtgaaaactttgcagttccctcagatgtgtggcaaatgtccgtggatcctactactgtcatactgatgcgcattgttttcagctgctatgggactgcggcacccaaatgtggatgaccccgtaccctgggagcaggacttctacagcaacttcatgagtgaccctcggatacagtgacatgagaatacgtcgacttcgtttcttggttcatgtagtttcggagaacacggcagctcttcttgtttctggtagttttgctggaggcgcattctactgactgaaagcggtttatcttgcccattcagtactacgcacaaactgatctggtaactaccgtttggatggagttgatgcttgaacgattctgcgcagtggtgttggctgtacacgtgtactcagcacattcgtctctattggtcataatacacattttggtgtcttactctatattttctcccgaattctaatacgtcagattcttttaggactagcttgacaaccctatttttaaagaaaattttattttcttaaaagaaaataaactattttttaaaaaaaattgaaaaatctcttggaaaaatatggttaccaaactagtccttaatacgaagaatttgaccgataatgtttggcaaccctgttgtgatctgctgtcccttccgaggtgttcaccgcttcgactgccgtaaactgttgaacactccatttggatgttcccaatctactgtttaaccacacaagaaaaccgagcaccatttttactggtcttgcgtgtaccgctaactgttgggtgttctgaatatacagggctgtgcattgttgtcttggttatctgctgcttctatcaagtactagctagctaggtgcatctactctgctaagatatctatatatcactaaagcatactttgtttaaatggaatatttattcaaacatgttcgaaatctttaccatgaacagccaaaagtcccgagtaatttgtgaagatagtggtggtgggggtcttatacatgttagattacaagctgataagaatatttttaaatgagacctaaattcctctatgtgttttacagttcagtttatgtacaggaccctttgtaataacgggatcgcgtttcatcagaagttaatctggaaattaaaaatacctcttaagattaaaaattttatgtagttcttattaaaaggagtggtgttgacaaaggataatttagcaaaacacaattgacagggtaagaaaaaat

SEQ ID NO: 19137 - DNA, 1967 bp, Zea mays
ctgccaccctcctatataaaactccatgtggattgtggatagcggaaacactcgtggaaattcggcacgaggcaaatcagcacctgggcttgtcatcaaccgccgcgccgcgccgactagtcggtggccgtagcgcacctgtaccgcccgcaccgcgcggtcgaacacctcgcgcgcatccatggccaccacccacctcctcactccaccccgcgtccaccacccttccccctccgcttcctcctctgtggctcgcgtccgcgccaccgcctcgctcgcgcacccgctccacctctgccgcctccgcctcgccgccccgcgctcgcgctccccctccccgcggcacgggcggcgcgccatgtcggtccgcagctccctcatcgacccggacggcggcgcgctcgtcgagctcgtcgccccgcccgaccgcctcccggcgctgcgcgcggaggcggaggcgctcccgcgggtgcgcctcgcccccgtcgacctccagtgggcgcacgtgctcgccgaggggtgggccagcccgctccgcgggttcatgcgcgagcacgagtacctgcagagcctccacttcaactgcgttcgcctccccgacgggggcctcgtcaacatgtcgctccccatcgtgctcgccatcggggacgccgacaaggagcagatcgggggtaagccggacgtcgcgttacaagggcccgacggcggtgtcgtcgccatcctgcgcagagttgaaatatatccccacaataaagaagaaagaatcgcaagaacatggggtacaactgcacctggtttaccctatgttgatgaggctattgcgtcagctgggaactggctgatcggtggcgatctggaggtgttggaacccatcaaatacaatgatggtcttgatcactacagactttcacctcggcaacttaggaaggagtttgacaagcggggggctgatgctgtgtttgccttccagttgagaaacccagtacacaatggtcatgcactattgatgaatgacactagaaggcgtctcttggaaatgggttacaagaatcccattctactactacatcccttaggtggttataccaaagcggatgatgtcccactgccagttagaatggaacaacacagtaaggttttagaagatggagtgcttgatcctgagactactatagtgtctatatttccctcaccaatgcattatgctggtccaacagaagtgcagtggcatgcaaaggcacgaattaatgctggtgccaatttctatatagtaggccgagatcctgctggaatgggacatccaacagaaaagagggacttgtacaacccagatcacgggaagaaggtcctgagcatggctcctggtttagagaaactcaacatactgcccttcaaggtagcagcttatgatacagtagcaaaggagatggccttttttgatccttcacgcagtcaagattttctgttcatctctggaaccaagatgcgcacttatgccaaaactggagagaatcctccagacggtttcatgagcccgggtgggtggaaggttcttgttgactactacaacagcctgcaagctgaagaagcgactccagtccctgtatgaggcaagctactatttgactaagagattattcaatggcggggaaacatacaagcaagtgatcagatcatttgagcttttttccttattgattctttaggttagtagttgattgatatatgatcagatcttttcgattgtttgtttgtcttaaatatgagactctgaagcatggaaaaactaaagatctgcacaagttgagccaaaacagcatggccattgttctgtagcgaagccggttgaactatataataaaagatgaaagggtgcatattttcttgttgctgtagtagaccatctatgttcccaaaaaaaaaaaaaaaaaaaaaaaaaaaaaaaaaaaaaaaaaaaaaaaactcga

SEQ ID NO: 19138 - DNA, 883 bp, Zea mays
gtgcggtacagtgcaaagacaaaagctttcccctctccgccccccgccgtcgcccccacacgcgcacagaacccccccgcccccaattccaaatcccgagtgcccgcggccacagaccgacccccatcacacacgcgcatcgcgccaccccatccgtcaccgtcgacccgcgagcacccatggcgaagggaggaggtggaggccagcgcgagggtagcgccctgaagagggcggcgatcgtcgcaggggggctcgcgctggcctgggtcaccgtggagaccgctttcaggcccttaatgggccgcctccgcgctgccatctccagctccaccgacaccgcccgcgaccccgaccaggaggagcctcccgcgcctgcctctgcggcggaggcggagaaggcgtccgcaccagaggagcctgccgcggtggaggagaaagtcgaggagaaggtggtcgagttggaggagaaggtggaggaggccgccgccgacaaggccgagtgaaggcgacggccacatggcgccctgtctggctgctcttctgaacgggttcttgaggttagccgggatcgaatccaagatcgtttaaaataaaacctgtgtttaaacgtttatcatgcaaattatattggattagcatgtgtgcaattttcgtttgtccaggctgagaactaaggaaccatggtgcacatcaagccactaaccattatgctgaaatgcaaatcagatagtgacttggaaaacataggaagttgcgttcatgtccatgtacgctctggtcggtttttttccttcgtcgttagagaagtattaaattgaagttgaatctgtacaatcctattcagtacaaatttgagtctttattgacaaaaaaaaaaaaaaaa

SEQ ID NO: 19139 - DNA, 786 bp, Zea mays
aagctttcccctctccgccccccgccgtcgcccccacacgcgcacagaacccccccgcccccaattccaaatcccgagtgcccgcggccacagaccgacccccatcacacacgcgcatcgcgccaccccatccgtcaccgtcgacccgcgagcacccatggcgaagggaggaggtggaggccagcgcgagggtagcgccctgaagagggcggcgatcgtcgcaggggggctcgcgctggcctgggtcaccgtggagaccgctttcaggcccttaatgggccgcctccgcgctgccatctccagctccaccgacaccgcccgcgaccccgaccaggaggagcctcccgcgcctgcctctgcggcggaggcggagaaggcgtccgcaccagaggagcctgccgcggtggaggagaaagtcgaggagaaggtggtcgagttggaggagaaggtggaggaggccgccgccgacaaggccgagtgaaggcgacggccacatggcgccctgtctggctgctcttctgaacggtatgctgttggttccgtgaatctgttctgtgaatctggaacttgtcgcttaaagtttaccagtaaagttgccttaacttttggcttaaagtgccatttagatttagttaacgtcgttgaggggtttgatgtgatggtatctgtgtttttaaatgtttattgaactgctgactacttgattatgatattattaactaaaaaaaaaaaaaaaaaagcggccgcagcatcaggtgttctaaaaaaaaaaaaaaaaaagcggcc

SEQ ID NO: 19140 - DNA, 1523 bp, Zea mays
acacattttcaatttcgtactgggagactgggcgtagggcgagctgagctcccaagtcgacgtggcggggatggctgcgacggccggcgtcggcggtggtggaggggctaacgcggcggtggcagagcagatagcacaggcagtgcggtccacctccaatctcctccagctcatggagcagtcctcccccgctcaggttcacttggcaaaactacccaagaacctgttggaaaaagcatcctttgcaaagaacacggagcatgtactgcaccagctacctcaagtaatttcatccttggatgcttatatggacaggagtttgcaaagtgcatctcaaattaagactgtcacacagctcttgtcaaacatggagaagacacagctgaagtccatgttgccttcctctcgaaggaaggaagatcagaagagtactgaacccttaagaactcagggttgattgacgtcaccgagacatagtggaaggataagcttttgccgtcttatgctagagagatctgagtatgatggtttggctgattggctctatgcatctatccggcataaggatccatcgctgcctaccgtttgcgccacattttaaaatttggttggggaatgctgttatggtgtaatggagctgttttttatgagttggaggtgctacaaggaaagcatgtctgtttatttgtcgtccgctaaatcattttaactaaattgcggcaaataaaaaagaacggatggattaattgccacgcctttgggtctaaaaaaaaaaaaaaaaaaaaaatcaaaaaaaaaaaaaaaagcagaaaattaaggtagaaattaataagtgatcaaatgtttaacatggcgctgcgtgttgaaaagttcaattgcatgcataccctatgaagtgaggcgaatgcctcccctgcgtaccagcaggcttataaacccctcggtgttgaggtccaccttgaatgggaaaaaaacatgaatactgatgacttgatctggtgcatattttaatgccattccaactggaatctcgctcgttcttgtttcagtttgttctttaccaaatgtctaacacgtcttggcacatatatgttaaccctattgctcacgtgttccatttagtcaactaagaggcttggtaaaaaaagatgattgtctgcttgactttgatgcaaatatgcaatagagatatgtacgtggcagtagaagataaggttgtctctaacagcacacgctaaagcgtcctgtaccttaaacgtagaggaccgttacatcccctacgcatccaacaacgtcctctaaaacgtcctctaaaatttagtgcctacgcgtccaacaacgtcctctaaaacgtcatctaaaatttagcgcaccacacaggaaccgtaaatgtggaggctcctggggtgcgctatccgcgcgacggatcgagctcccgccgcgctgaaacatccgcatcctcccttcgcgcgctggcgactgcgtctctcgtggcgaagccctcgatccagcgtgcttcgctg

SEQ ID NO: 19141 - DNA, 718 bp, Zea mays
ggccgcttttttttttttttttttctgcagcagctcatatagtttcgccaagatatacgcagtgaagcagacaaacaaaaacgacgactcggttccaatttttttttttttttttgcagggaaaaaaatattcatcatagaatcagttaaacctgtagtctacactctaaaccaagcgacaggagtttgcacacacgtacggtccacggaggagctaccacacacacgtacaaatcaacacgcacgctggcaccgatcccgaccgaggcaggcaggagcagggcacggccggtggctcggtcagttggtacctgttgtgttgcagtcgaagcaggtgtggttgcggccgatctccgtgatcctgtcgtagccgtgcctgaagacgccgaggccgaagaggacgccgacgaggaggacgatgaccaggatcaccagcaggtagcaccccacccactccttggtgcacctgagcttgcacatggctctcccccggccctggctgccgcctctctatccctctccctctccgggaccgggaggagggggttcttatcggaggagggaaatatgctaggcgagtgcctgtcgctcgcccggtcgcccctgtcccttcggcggtatggcgacggtatcgggcagagctgtgctgtgctgtgtgtgtgtcccccgccggagtgatgatgatgtgccttttgcctttgtgccaggccggaacctc

SEQ ID NO: 19142 - DNA, 2017 bp, Zea mays
  misc_feature (21)..(21): n is a, c, g, or t
  misc_feature (27)..(27): n is a, c, g, or t
  misc_feature (30)..(31): n is a, c, g, or t
  misc_feature (34)..(36): n is a, c, g, or t
  misc_feature (42)..(43): n is a, c, g, or t
aaagctggagctccccgttgnggcggntgnncgnnnttcggnnggcctcgggggtgagcacgagaccattacctagaacatcctaatcgaaaagagagaagggagaggcgagggagctcaccaggagagaggggcctgtgtgagcattgagcaaagcaaacgaagcagtacatacatctctcgctcgcagaggccccccccgaggccggccggctccatgcaacaagggaggacgacgagcggtggcggtgggcgatgatgatgatgatgatggcgggggagcacgtgctggccgctctgggcaccctgctgctggcctcgctcctgaccctggtgctgaaccacttcctgcccttgcttctgaaccccaaggcccccaggggaagcttcgggtggccgctcctcggcgagacgctcaggttcctcacgccgcacgcctccaacacgctgggcggcttcctcgaggatcactgctccaggtatgggcgggtgttcaagtcccacctgttctgcaccccgacggtggtgtcctgcgaccaggacctcaaccacttcatcctgcagaacgaggagcggctgttccagtgcagctacccgaggccgatccatggcatcctgggcaagtcctccatgctcgtcgtcctgggcgaggaccacaagcgcctcaggaacctcgccctcgccctcgtcacctccaccaagctcaagcccagctacctaggcgacatcgagaagatcgcgctgcacgtcgtcggcgcatggcgacggcacggcggcgtcagggtcgtcgcattctgcgaggaggcaagaaagttcgcattcagtgtgatagtgaagcaggtgctggggctgtcgccagaggagccggtcactgcaaggatactcgaggacttcctggccttcatgaagggcctcatctccttccccctctacatcccagggaccccatatgccaaggctgtccgggcgagagagaggatatccagcactgtgaagggcatcatcaaggagcggaggagcgctgggtcatggaacaagcagggcgacttccttgacgtgctgctgtcaagcaacgagctatctgacgaggagaaagtgagctttgtgctggactccctgctgggagggtatgagaccacctcgctcctcatctccatggtcgtttatttccttggccagtctgctcaagatctggacctggttaagagggagcacgacagcataagatccaacaaaggcaaggaggagtgcttgacttcagaagactacaagaagatggaatatacccaacaagtcatcaacgaggcgctgagatgcggcaacatcgtcaagttcgtccaccggaaggcgctgaaagacgtcaaatacaaagagtatctgattccatctggctggaaggtcctaccggtcttcactgccgttcatctgaacccctcacttcatggagacgcgcagcagtttcagccctgtaggtgggagggcacaagccaagggacaagcaagaggtttacaccgttcggtggtggcccccggctctgcccaggatcagagctcgctaaagtggagactgctttcttcctccatcaccttgtcctcaattatagatggagaattgatggcgatgacattccaatggcatacccgtatgtggagtttcagagaggtctgccaatagaaatcgagccaacgtcccctgaatcttgactgtcctggagctacagccatcagttatcacaccagagagaaaaggggaaggtgcatggagtatacatgaatggtcagtgacagatctcacaagtgaaggaacactgagggcgcgtgctagtagctagcatatgaggcagctgagactgtaatttaatgtacatggtgtagatatattttgtccatggcaattgcttgaagtggctgattcacttcaccctgtaaaacattctccagtggtttcaactgctatcctataaaaaagaagggcccctgtgtttagtaaaaaaaaaaaaaaaaagaaggaacggaa

SEQ ID NO: 19143 - DNA, 1913 bp, Zea mays
aaagagagaagggagaggcgagggagctcaccaggagagaggggcctgtgcgtgagcattgagcaaagcaaaggaagcagtacatacatacatatttctctcgctcgctcgcagagaggcccggccggccggctccatgcaacaagggaggacgacgagcggtggcggtgggcgatgatgatgatgatgatggcgggggagcacgtgctggccgctctgggcaccctactgctggcctcgctcctgaccctggtgctgaaccacttcctgcccttgcttctgaaccccaaggcccccaggggaagcttcgggtggccgctcctcggcgagacgctcaggttcctcacgccgcacgcctccaacacgctgggcggcttcctcgaggatcactgctccaggtatgggcgggtgttcaagtcccacctgttctgcaccccgacggtggtgtcctgcgaccaggacctcaaccacttcatcctgcagaacgaggagcggctgttccagtgcagctacccgaggccgatccatggcatcctgggcaagtcctccatgctcgtcgtcctgggcgaggaccacaagcgcctcaggaacctggccctcgccctcgtcacctccaccaagctcaagcccagctacctaggcgacatcgagaagatcgcgctgcacgtcgtcggcgcatggcgacggcacggcagcagcggcggcgtcagggtcgtcgcattctgcgaggaggcaagaaagttcgcattcagtgtgatagtgaagcaggtgctggggctgtcgccagaggagccggtcactgcaaggatactggaggacttcctggccttcatgaagggactcatctccttccccctctacatcccagggaccccatatgccaaggctgtccgggcgagagagaggatatccagcactgtgaagggcatcatcaaggagcggaggagcgctgggtcatggaacaagcagggcgacttccttgacgtgctgctgtcaagcaacgagctatctgacgaggagaaagtgagctttgtgctggactccctgctgggagggtatgagaccacctcgctcctcatctccatggtcgtttatttccttggccagtctgctcaagatctggacctggttaagagggagcacgacagcataagatccaacaaaggcaaggaggagtgcttgacttcagaagactacaagaagatggaatatacccaacaagtcatcaacgaggcgctgagatgcggcaacatcgtcaagttcgtccaccggaaggcgctgaaagacgtcaaatacaaagagtatctgattccatctggctggaaggtcctaccggtcttcactgccgttcatctgaacccctcacttcatggagacgcgcagcagtttcagccctgtaggtgggagggcacaagccaagggacaagcaagaggtttacaccgttcggtggtggcccccggctctgcccaggatcagagctcgctaaagtggagactgctttcttcctccatcaccttgtcctcaattatagatggagaattgatggcgatgacattccaatggcatacccgtatgtggagtttcagagaggtctgccaatagaaatcgagccaacgtcccctgaatcttgactgtcctggagctacagccatcagttatcacaccagagagaaaaggggaaggtgcatggagtatacatgaatggtcagtgacagatctcacaagtgaaggaacactgagggcgcgtgctagtagctagcatatgaggcagctgagactgtaatttaatgtacatggtgtagatatattttgtccatggcaattgcttgaagtggctgattcacttcaccctgtaaaacattctccagtggtttcaactgctatcctataaaaaagaagggcccctgtgttt

SEQ ID NO: 19144 - DNA, 1222 bp, Zea mays
ttgggaccctcccggccggggtgacgcccgtctgtctccactctacagttgtgccgcctcgtctctctcctctctgctgcgcccccctatcgtgcgtgattctatccaggattctagggttcgttcgcctcgtctcgcgatggacaagggcagcgtcgtcgtgcccccggcccctgccgccgccgccgcgaagaaggccaagcgcttcgagatcaagaagtggaacgccgtctctctctgggcctgggacatcgtggtggacaactgcgccatctgccgcaaccacatcatggacctttgcatcgagtgccaggcgaaccaggcgagcgccaccagcgaggagtgcaccgtcgcttggggaatttgcaaccatgcattccacttccactgtatcagccgttggctaaagacccgtcaagtgtgccctcttgacaacagtgagtgggagttccagaagtatggtcactagagagaatggcttcggcgtggaattgcttcatgtttctcgtcgtttagcagtagtggttactgaatagattctggtgaacatgctatggatctgtaacgtttctgaagttctgccttacttgaagctgtaggcgaatactctggttatgccatattcgtccttcggggcgctgttgaacagctcttcctcacatgaaggtgtagacgaattactcagtttgcagaaattaattggtaattgtgggctataggctataacaaaaaaaaaaaaaaaatttccctatgcggacaaaaaaaaaaaaacctccggctaacaggccccatcattgcgccccctcttcccgcgggtcgcctggtgttgtaaacaggcttcctcccccctcccaagtcgaatggcgcggtataacaccgcatcttaacctgtatgttttgtgccgcagaatttaaaactggcctcaccctggtgggggctatttagcgcttcatttgccctcggttgtatagaattacactcaaccttttatttgctatcaccgttctaaaccctccaaaggaggcgggcccctgctaaccctctctttccgccgtccattgcgacgcatccaaatattccgggcgggctctatatcggctgtcgctgctctttacaccctgcgggtgttcggtgagcacgtcctcttgggtatctgcccaacttatgacgcgcttctggacggacgttccgcgctgtgtgtcaggaggcgcggcaacatca

SEQ ID NO: 19145 - DNA, 3866 bp, Zea mays
tgcccaaacgctactttacaacccctaggcccaatcgtgggtccggaggccaagcaatagtgttgatctgacattgctaatttcattgtcgttgcacaagatgccctcgggcaacacactacactccttcgacattccgcgcccagatcgctaggtcgagggtgccccatgggggcatcttgaccttgcgtaggtcaaggtgaggcttggaactagatagggtgactaacgctgacaaggatctcgacttctaggaggcctttttcgttgtggccgtcatcttcagaaggtatagctgatttggcctccaggcaggctgtcaaaactcggcgccgtgatatcaccgccgtcgcaccaaagccacaagggtccaatcccctcagggcttggttagggggaaatgaagatgattggaggagattaaattcctttgtagtcaaaatttaaataggagatttaatccccttgcaactgaacatgccttcaagtagactttcaccctcccccgacaatattggcggggccgtcatctatgatctactacggtgacgatgcaatttactgatggattgtcaacacttatgatctattagtactctgaatgtttcatggaccataatctatgaaagtttgaataagagattgaatctttattatcgacgtatatccaacacatatcccatcataacgaaagttatttattagtccaaagtgtcactgaatcaggcgtccaccagaccacacaagacgacacggcactgttgagcagagactagagtgagagagtagcagccggtgcagggctggcttggcagattgggatcccctcccctccctcctcccacccccttgccttgagctgggggttcgttcaggaagctgatctgagagctcgcgaccgcaaccacaaccaacccaaaaagctgcagcagatccatccttctcacccgaaacaatcgatcccctcttatagacttcgcctgcctccaacccttaatcttcagctatggattcagccgccgcgcgacccgacgaggaggaggcgcgccgccgccggagcaccgactgcatctacttcctcgcctccccgttgacctgcaaaaagggaagtgaatgcgagtaccgtcatagcgatgctgcgaggatgaatcccagggactgctggtattggttccatggcaactgcgcaaatcctaaatgctcctttaggcacccgccattagacaacatggccggagcaccaacgactccacgtccagctcaacagtctgtaccccatcaagcttcagcttctgttccagctcagccccagggatctgttcctgccactgccaagcagggtgttccatgctattactttcagaagggcatgtgcacgaaaggggacaggtgtgcctttctgcatgcgccccggtctgctggaaaccctgctccacagcctccggccaaggtcttcaccacccctgccttgcagcctaatctccatccaccgttgaacaactcgtggacaaaacccaacttgagtgctcctgcagtagccgtagttgacaagtcaaaggccagcacttatcatgatggtaaaccgcttcatcacaaggaaaatctgacgagtaggaccgaaaacccatcaagagtagtttatcagaatcacagtagttcttatgcacagcccggtgcaccaaagcgttaccagcctcagccttcagcccgagatggcttaaccgacaatggtatggaggctggcgaatttgcgagagaaccatccgccggttcttgtgtaactgccggttttaatggtgctggagggatgacgaggcaaacacatggtggctatgaaccagaaaggtcatacagaaattcagcagagaggtcttcgtcagagaaaaggattccccagagagagcatatcccctctgtggctgccggcagttcggatctgcgccataggctactgaagcaaagaaagtccaataataattcaaggtcggctgaagccctgggcaggcatgatacacatcttgaggatgagcgcaatgaccaacatcgtccgcgaggtgaacagcaggatggcctctcacggtctcgactgcatgatagaataagactacctggggagacagcgtttgacagtcttgggtcacggtcagaggagtgggatagagggtctagagccagattgtcgccaccaaaatcctcagatcttcgagggaggcttcatgaaaggctaaagggtagattgggtgaggagataccgggtagcagtgcaaaaggtttggcagtgaaggcaagtagcagtgaggatactgaatcactgaactttgctggtccaaagagccttgcagagttgaaggcaaagaaaggtgtcggcaggtcaggagaagatgccgtcgtcaagggcttaggttcttctcgtatgacttcagaaatagtttggagcagggaggctgcttcgtttgaaggtccaaagcccctaagtgccatactgaagagaaaaagagagccagcttctgaaatccccgctgcccagcctggcatcacacaggaagcagataactacgccgcaggagctgaagaagaaatccaaaccctagcaaatgacacggttggggagaacatggaggggattggagaagaagaggaggaagaggaagctttccatcctgaagatgatgtggcgtacgacgataacgccaatgaagctgcagtggcccaagagctggatgagtatgaagacgcagatgcggcagcacaagactatgacgatgaagctgcagctgcccaagaggtggaggagcatcaagacggagaggcagcagcagaagactacgactatgaggaggcagacgtcaacgccgaggaagagaatgagtaccaggactaccaagacgaggacgacgacgatttggaggatggggacgacgattttgcacgaaaagtgagcgtgatgatctcctgatagcgacagaaagcggttcattccccacaaagtgtttatctcctttggcgcgaggtactttttagttcactgcgcaaaagacagagactaatataggtgggagaagagagatagaagaatggacattgttgagaaaatgagctcctccatccatcggagagctcgcttgttgacctgtctgtctgtactgtactactcacgcaaatgtgatgcggcttctctatagactcctgcatgtatttttagttgacatgagaacagtactgtatccgtaaaaaaaaaaaaaaaaaaatttttttgaagaaaacatattgctgcctggtagaagatacatctacagttcattctacacgaacccttgcctccagatgtacagtacagtctgtttattcgatgtctatttgtttgtgaacagcacataactagctagtttacacaataatagaacacagtagaagtgaatactgcgctacattaacagcaagcactgctctcttgtttctgacatccatcatctctaggcttgctgactgcaatataaaacatcgcccagcacgctcttcacctagctaaaaacccttgcaaaatatctaccagactcgtcttgctccacaaccaaccaactagcccagaccacaaccctgcaatagtaatttccttctcaggtccgtccaaatccccgatctgatgttaccacgcaatgcaaaaccagtagatgtcacacctcccttgctagtctttgcacttaatgccatcccctctcactgaggttaccaccaacccacattgaaaaggtctacaaagatacaaatattaggtcacgggaacaaaaaaaaaaaagcctcaccagctttagagcatgaaaacgttggtggcggagcatagaaagacatgaaaatgactactcgac

SEQ ID NO: 19146 - DNA, 1779 bp, Zea mays
aaacgcgatagcaaccggcaacggcaagcaaccatctgggcactcggctctcccccctcccacgctctgctctccgcagcaagccagcaaacagtctcccgtgccacctcagcccgctgcctgcgaccttctcccttcactcccctcgccgacggagcaaacggcgatcggaagtcgagcgccgtcacctgagggacagatggcggcggcggaggggcaggtgaggcgggacatgtgggggcaggagtatcggacgtcatccgccgacccgacctgcgccctcgccgccgcgcacgccgcgcaatcagtcgcccccagggaccccgcgggggccgccgccttcctcaacgccgccgcggacaacctcgggaaagcaacggagtacgagagggccgttttcgggacgctctccgtgctggtgggcgagaagagggacgaggaggtggcgatcgagcggcacttcgagcttctcgagcaattccccagggatctcctgtctctcaagagagcgcagctcatctgcttctatatgggaaagccagatttgtccctgaaattcgttcaacaagttttgccaaagaatcaagatcagaatttcatatatggcatgcttgccttccctttgcttgagcttggacggatggatgaagctgagagagctgctcgaagaggcttggctataaacaagaatgacttctggtcacagcataatttgtgccatgtttttcagcaggaatgtcgtttcagagaagctactgagttcatggaatcatgttctccgtcatgggaggcatgcacatcatttctgttaactcacaactggtggcatgtagctgtttgttacttagaagctgagtcccctttgtgtaaagttctggagatatatgatcacaacatcatgaaggaacttgagaaaagttattgtgagacagcagaggtgtatttgaatggtctagggttgctgctgcgattattcatacgcggtcatatagattcagctaaagagaggttaacgacattgctagatgcactaaagaatgagtctacatggcatgtggaatggctccttgacttgcttatattgtgggcactatcaagtatgggtgagctaaaaagtgcacataatatgttggaatcattgaagtcaagggtacgtttaatggacaggaatcggcagcaagcgatgcagaaggcaatcaagctggcggaggctgcttatgaatatgggaaaggagatcacatgaaagtctatgacactctgggtccagactttgatgcgcttggttataaaatgattggtgcatcagatgaacaagtggatgtcttcaatgaagtttggtacactgttctaataaatgctggagaaacttccaaagcaattgagattcttggcaaacaaattaggaaacgagagggtgcacctttcttgtggcgcttgctggagaaatcatactcattggctggcagaagcgcagatgcttcagtagcatctaaaaaggcaaatgctctgcaatcctcttacttccattagctcatatcttgttgaataatgaatagccttgtttctggaaggtcttgtaacttttattttactgatggaagttaccagtatgcaccataggaagtctacagtcagtatatataccgcataatcaacagtttcagaatactggaacatgtgccgtgtatcaatatgtgcgtacatggaagttttatgttcagtaaccttatgggtatagatatgacatatgtcaaattgtcgcaaaaaaaaaaaaaaaa

SEQ ID NO: 19147 - DNA, 4241 bp, Zea mays
tcaccatcacttggcattgtgacgacgacttttctttgccgaatataaggtggcagtcggcaaagcatttgccgagtgcccaaaaaaaaaatactcgacaaaaagtcgttatcgatgtatgagacttctttattgagagtcacacttggcaaagacttcgccgagtgttttccagattttaccgagtgcctgaagcactcgacaaagccgatgtgtccggtctaaacactattgcattagtccatgtaacagttgagattattatttgatcaagagtctgatagtccgggtagtatctttgtagatgaaaattttattgtgtctcggtttgcaacaaaccgtgttttgatcatgtttttttgtgaagccatctgcgtgttcagacggaccctaatgctgcagtttgaaatgaaaaacagcacatcctaaaaaaggataaagaaaaggaaagtttcggtggatcaaccaaatttcttcattcatactctattctggcaagtaattttgtaccaaaggataaaggtatgtacaccagagaatattccaagtaaattcaaatttgtcaatgtgtgaaatgttctctctattattggaaactgttagccgttttccctcttctagatacggaatttttactatgcacctagacgcagtttacatatatatactttgttcaccaaaacagctccattcacactgtcgtttatgtctaatttggcaagtacttttgcatcgaggatacacgcatccataccagggtgtatgtcaagcaaatccaaagtcgatcacatagaatattttctctattttaacttataagttgttttgcattttttagaaataaaatttttattatatatttattgtatatatatatatacatagttccatagcaaagctatgcacctatttttttattattatagatttattttagatatatatatgctcgtattgtatatccatttcggcattttgaggtgttcacatatgcatgaatcttgccaaaaaaaattcagtcatttaataagtagaaccaaaaagattcttcctccggatatggcagttaccgtagaattagctgtgtcatgtgaatccagcaccagagatccggtttataagcctcataagacgctttggtccagtagtacagtgaacggtgcaaactagatatctctagatcatcggaacggaggttattgcattgcattgcatccatccagcgcgcacagagaaaatggagttggtcgtgctaatcgtcggcgctggcccagccggactggcgacggcggcatgcctgagccagcgctcgatcccgtacctgatcgttgagcgcgaggactgcagcgcgtcgctgtggcgctaccgtacctacgaccgcgtgaagctccacctgtccaaggagttcagctgcctgccgtacatgccgcacgaggaagacaccccgacctacatccccaaggcggagttcctcaagtacttggactgctaccgcgagcatttcggcatcaagcccaggtactgcacttccgtcgtgtcggcagcatacgatgagggagccggccgctgggtcgtcgccgcacgtgacacggtcgagggcacggagatccggtacgcggccaggttcctggttgtggccaccggcgagaatggagcggggaggattccggagatccagggcctggagagcttctgcggggaggctatccactcctcgacctacaagtctggaagaagctatgccgggagaagggttctggtggttggtgctggaaattccgggatggagatcgcctatgatcttgcaaaccatggtgccgacacctcgattgttgttcgcagtccggtatgtatattttgtttactaatgtataaattcatcgattaaattagtccaagtagcttattatgtcatgcataatttaaccttataaaggaattatatgatctatgtagttacataatactagtaaaatgccagctagctggggaggtacacgtactcaatgccgccgttctcgcgcatctcggcgcgctgatgagagccagcgcacccgccgccgccggttggggaaggtgctcgccgtgccgtcgacctcgcgccatccttattgccgatgaaataatttcttgcgttaaggatttcgacatcgtttatgcccattctcacaccatcacatgtggccacatctccctcgtcccttcgagcagcgatcgcttgttggtgactctccatcgcctccttgtctagcgttgttcccacgccgatgctggtccgctccactgcagttccacaacctccgactatccatcgcgctcgaagtcggaagatcagggagcacagcaggcaggtcgtgccagctggtgcgtcacagctagcctagtaggacaccaagctagcttgtcttctttcgcttgaccacccagcgccgtcgtcagctcacgtcggctctacatgggccgtggagctcccgtgcttcaccgccctcatcacacgttgtggatttggcacaggctcatcttgggccgtggaacctggtgcagccaccatcattggtgtcgttgagggagattgtgtgtgtgtgggtggggcctggggggtgctggggcgggggtgagggcgctggtgttcgtcgaggcgaagcggccgaggggctggggcggtggtgacatggatggtccatgcaaggcgtgtgaggatgagggatgccaaaaaaaacactgactgtggatgtgattgattaagagataaggtaaatgaaacgatccggagcgttggttttagtggtgggatttgattggggtaaattgttatgtgtacttagtgatgttttaactgatggattatataaatgtatagaaatgtgtaataaatataacaccatgcgtgtattatgtggtggaatgtaggtacacataatgcccaaggagctgatccgtctcggaatgacatttgtccaatacatgccagttacaatagttgaccttttcttagtgaagctagccgatttcatatttggtgatctatcaaattatggcatcgtacggcctggagttggccccctacaactcaaatccaaaacaggtagatcttctgtaattgatgttgggacagcagggttgattaagaaaggcgtcgtgaaggtaaaaattctgtttcaacaaatcttggtaataataagcgtgctcgaatcgaacgtgtgcaataactttcttaccatatccaaaatgtggtgtctcctgctaggtgttcaagaggatttcgaagatcactggaaacaaagttcagttcgaatgcgggaaggactgcgaattcgatgccatcgtgtttgcaacaggttacaagagcagtgcgaatctttggctcaaggtatttgaactgtgtctcatgtcaagtttcgtaatacatacatacgcagctgccatatggcacgccggcttttaatttctcacaatttctttcgtatggcacaggcagacgacaagtgcatggtgaatagtgacggacgtccaaacacatgtcgtcccaatatttggaaaggagaaaatggcctctatttctctggttttaggaggatgggattggctggtatttgcatggatgcttataatattgccaatgaaatcgtatctgtctactgaagatttcttgcttggccttttaagtctagttaaatctatattaggtcttggttatccgcggttcattgcatcaagaaatcagtagtagtgcatgcattggcttgtatgtcaacacattgtcctaagattgactgtctgtaaacggtgccttttatgcataacaatagctctcagttgtttagagtatttcttggtagctgatgttgagcatgcaatactagaattcggctctttgccaagtgtcaaatgatttgtcgagtgttttttcggagactcggtaaagaatctttttgccgagtaccaagcaaaaaaccctcggtaaaaaaaaatactcgacaaagaaaatctttgtctcttagccgagtgttttatttttgacactcggcaaaaagtttctttgccgagtgtttttttccacactagaccaaagacaattgaaaaatcacattttcaagcagtaaattaattcaaatggaaaagttttcaactataaatttgtataactcatcaagatgtacaatttatattttgatcatttcttcatatgacaaaataaaagtaaatttcttcataaaacctatatcttcgcgtagtttatg

SEQ ID NO: 19148 - DNA, 1485 bp, Zea mays
ctgcagtttgaaatgaaaaacagcacatcctaaaaaaggataaagaaaaggaaagtttcggtggatcaaccaaatttcttcattcatactctattctggcaagtaattttgtaccaaaggataaaggtatgtacaccagagaatattccaagtaaattcaaatttgtcaatgtgtgaaatgttctctctattattggaaactgttagccgttttccctcttctagatacggaatttttactatgcacctagacgcagtttacatatatatactttgttcaccaaaacagctccattcatactgtcgtttatgtctaatttggcaagtaattttgcatcgaggataaacgcatccataccagggtgtatttcaagcaaatccaaaatcgataacatagaatattttctctattttaacttataagttgttttgcattttttagaaataaattttttattatatatttattgtgtatatatatatacatagttccatagcaaagctatgcacctatttttttattattatagatttattttagatatatatatgctcgtattgtatatccatttcgaaattttgaggtgttcacatatgcatgaatcttgccaaaaaaaataatgagtcatttaataagtagaaccaaaaagattcttcctccggatatggcagttaccgtagaattagctgtgtcatgtgaatccagcaccagagatccggtttataagcctcataggacgctttggtccagtagtgaacggtgcaaactagatatctctagatcccgtacctgatcgttgcattgcattgcatccatccagcgctcacagagaaaatggagttggtcgtgctaatcgtcggcgctggcccagccggactggcgacggcggcatgcctgagccagcgctcgatcccgtacctgatcgttgagcgcgaggactgcagcccggcgctgtggcgctaccgcacctacgaccgcgtgaagctccacctgtccaaggagttcagctgcctgccgtacatgccgcacgaggaagacaccccgacctacatccccaaggcggagttcctcaagtacttggactgctaccgcgagcatttcggcatcaagcccaggtactgcacttccgtcgtgtcggcagcatacgatgaggggaccggccgctgggtcgtcgccgcacgtgacacggtcgagggcacggagatcaggtacgcggccaggttcctggttgtggccaccggcgagaatggagcggggaggattccggagatccagggcctggagagcttctgcggggaggctatccactcctcgacctacaagtctggaagaagctatgccgggagaagggttctggtggttggtgctggaaattccgggatggagatcgcctatgatcttgcaaaccataggtgccgaccacctcgaattgttgttcgcagtccggtatgtatatttggtttactaaatgtataaattcatcg

SEQ ID NO: 19149 - DNA, 4179 bp, Zea mays
  misc_feature (1146)..(1146): n is a, c, g, or t
  misc_feature (3878)..(3879): n is a, c, g, or t
  misc_feature (3924)..(3924): n is a, c, g, or t
  misc_feature (3945)..(3945): n is a, c, g, or t
  misc_feature (4081)..(4081): n is a, c, g, or t
caacttcgtagttgaaaacttttttatttgaattaatttatagcttcaaaatgtgatttgaaagttgactttgcctagtgtaaaaaacactcgacaaataacttttttgccgagtgttttttttacacttgtcaaagaagttttttgtctagtgtcgaatggctgaaaaaatatttagtaaaacaattaacactaggcaaacaaccaaattccgatagtgatgcttctcgtgtgacgtttaaagaagcagagacagtgtgttgctctaatttatatagtgtgttgctctaatttatatatgggtatataagttttagagatttatcgatgatcatgtcatgcattctaatttgtttcaggtggtgtctggacactgaagtctgtctccaacaataccgcgggcgcggatgcacatcggtgttgtttgcgagacgtgcccatcgcgcaaattggatgtgcttccagcagcttgcacatcgttcagcggtatgcatgctgagaaggaaagttggctcccgcgtcggtgggcagcaggtgagcttccgcgttgcatgcaccgaggaagacgacgactgtacaggttgtgcgagcttgtgttccttgccgccgggacaagcccgtccctcggctgttccaatgacgacctctggcaatcgacgcagagtcttccccggccacggcatacttcaggcgacgctacgaccaagaacacgagctggcagaggtttagcgccctcaagaactccgaacacttggctcctgctaccgattctaacaagccctagcatggtacgcgtcgccaccccgggttcttcgagaaatcgacggaacttaagcacaaattttcaatagtaagtgtcaagttcttcacgcactcagtgctctcacagcttccccaccgcaccggcacggctactcccaaatcctgatccttgccttcactacaacgccaccattgttgctctgttgatgccctcactttagggcttattcctctcaacccatatgaacatggatatatgaattgaatgagtttaaattctaaacaaattaaaatcttttatattgttttaatcttatctggatatccacgtaagatatgaataactgaacaaggcaattcaagaatctatggtttgtcccacnaaccaattggttggtgcattccccatttatcgagttgtcaaatcatagtgaccacagtagtacttcaatttgttccacggttcactattaaagataacatgtacatcaatgttaccatttatgcgctaactgaagaattttgcctcaccgactagtgtgacatgttatgtaattttttcgatattcagaactcttaaaaccacgatatttgagtggtgacatttgtttggtttgaggtcaaagtagaatgaagcgaagcgacactgttctcttaatttttaggatcacatcatcactaaaaaattacttcggtgtttatctcgctctcacacgactctcacgtaaatactataaaaactgtgaacgctctttttatcccttcttatacatccaaccagcacaacacacctaagagaggggatgcctttcgtgcttatcagttaaccactgctgtcatgcgaatgagtacctgattctgctgtgaaggagaaggacgagagcattcgcgtagtggaagagcagggcaccacattgaggcgcgttctctgttggccaagcttctgctcctgaacttaacatgatctacaagacccgcggcataatcttacagagtagatatatcgtatattaaatacaaactaaactaggccattattcacagctcgatccatcaacatgccctggctccactccaccctacctaccgtctcctactctcctccaacacacagcaggtcgaccagtcgtcgtccggccgtcagtactcagcagcatacatgccgccggtgatggagccgaacacaatgtcttccagatcgaacgtgtcgtcgtaccccaagtgcgccacgcccgagaggccgccgccgccgaaccagtgctgctgctgctgctgcagctggaggccagacgtcacgtcgccctggtccgggccgggcgtggcggtccgcaccgcctcggccgtggcagcggagctccccgccggggtgaggctgctaagcacctcctccagctccagctcctgctcccgctcgccgccgccgccgccgccctccagctgcctcgggggctccgcaggcagcacggcgcccttgtgtccggcctgccggttgctggcgtttccggtggtggtggtggtgctggccgtggtggcgttggccgccgcgaagctgatgaggcgggaccccgcgtggagctcgtcgtcggctgcggtggccgggtcccggcaggtgtgcgcgccgatgtaggtgaccgtgtaggcgtccgggtcgtcgtcgcggcgctgcacctgccgctgcgccgcgcactgctggtcgtgcttgtgcgtgcaccggaagtaggccctgcgccgacgccgagcatcatcgacggaaatcagtacttctggttgggcatattcggttctactatgatggatcgtcgatcgatcgatctcgatcgatgaacaatgattggctctggaggggtggaaacgtactttgggtgcttgcagttctggatctccttctgcccgtacttgcgccacgcgtgtccgtcctccagatccctcacgctcttcgtcacaaccgacgatggctgggctctgcaacacgtacgtacgtacgccgccgcagaatttaaccagtgggtttaaatcagagatgaagaaaagccgaaaaggacatagcgaagccgcttcgctcacctcctccgacacgcggcggccctcttgcccgctccgccagcggccttcctcttgccggtgcaggtgacctcgctctgcacctcgagtgaccggtcctgcacgccatatccctcctcctcagcggcggcggccgcggccttggccgtctggatggtgagggatatggcgtgcaggatccggtccacgaggcggctggcctcgggcgactcccggagcagcgccttcagctgcgtggcgtactcccggcccttgaccatgtcctccatcacccgcgcgtacggcggcggcggcggcgccatggccacagcagccgagccccagaaagcgagaacggatgatcgcaattcacgtccacagctcagtgatggctcacttgcgcgcgcgcgcactcctccaatcctggcggcagcaaccagctcagagctcacaaggaaggaatcagtcgaggttgaggcaggtgccggcatttatggatgcactgcagacgggcagccccgctcttgtccacggtagatggcgtccacggaggagcgccagccgtggttttctacgccgcgggcccggtgaaatttaagcttttgttactagtcgggtaggcatgtgccgcgccagcctggctctggctctggcttggcgaggggggaaccatcctggaacgagagggagagggtagcaagtggggacggggacggggacgagtggacgacgacacgcaggtgacgtctgggacgcgacgtcaccatggtgatgctctagctccactgcctgcgctgcgcctcgcgcggatgaagcgcaaatgcaattgggtccagatacgagaaggcttgttgatggcgactctacctgtggctctttcgtcctaccgcggggaccgaagcttcctaactttcaccacaggaagttatcttgattggggaataatctgttaagagttaattcaatggtgatctcatccttgtgaaaagacacccgttcaggaaaaggtacaatcattcggcgccagcatacatgaagcaaaggacttcgggaaatagagataacaagtgattanntgtctgttagaaaagatgtctattagtgaaaagttgtgactcttnctctttctctctctgtaatcnacgaaggggtacaaagacaccccttcactatgtataaatatgtacaagatcaatggaaagtgatcacgaattttcattctctgttcacacaactgtttacatttaatacgttatcagcacatagactcaaccaccnagttttggacggaggaaacatcacggaacagaagaacagaagaacgcgaagaaaggaaaccacgcggaacagaagaacacgtgaagaagattttgagg

SEQ ID NO: 19150 - DNA, 1459 bp, Zea mays
cctgaacttaacatgatctacaagacccgcggcataatcttacagagtagatatatcgtatattaaatacaaactaaactaggccattattcacagctcgatccatcaacatgccctggctccactccaccctacctaccgtctcctactctcctccaacacacagcaggtcgaccagtcgtcgtccggccgtcagtactcagcagcatacatgccgccggtgatggagccgaacacaatgtcttccagatcgaacgtgtcgtcgtaccccaagtgcgccacgcccgagaggccgccgccgccgaaccagtgctgctgctgctgctgcagctggaggccagacgtcacgtcgccctggtccgggccgggcgtggcggtccgcaccgcctcggccgtggcagcggagctccccgccggggtgaggctgctaagcacctcctccagctccagctcctgctcccgctcgccgccgccgccgccgccctccagctgcctcgggggctccgcaggcagcacggcgcccttgtgtccggcctgccggttgctggcgtttccggtggtggtggtggtgctggccgtggtggcgttggccgccgcgaagctgatgaggcgggaccccgcgtggagctcgtcgtcggctgcggtggccgggtcccggcaggtgtgcgcgccgatgtaggtgaccgtgtaggcgtccgggtcgtcgtcgcggcgctgcacctgccgctgcgccgcgcactgctggtcgtgcttgtgcgtgcaccggaagtaggcctttgggtgcttgcagttctggatctccttctgcccgtacttgcgccacgcgtgtccgtcctccagatccctcacgctcttcgtcacaaccgacgatggctgggctctcctccgacacgcggcggccctcttgcccgctccgccagcggccttcctcttgccggtgcaggtgacctcgctctgcacctcggacgcctcctcctcctcctcctcctcctcagcggcggcggccgcggccttggccgtctggatggtgagggatatggcgtgcaggatccggtccacgaggcggctggcctcgggcgactcccggagcagcgcctgcagctgcgtggcgtactcccggcccttgaccatgtcctccatcacccgcgcgtacggcggcggcggcggcgccatggccacagcagccgagccccagaaagcgagaacggatgatcgcaattcacgtccacagctcagtgatggctcactcgcgcgcgcgcgcactcctccaatcctggcggcagcaaccagctgagagctcacaaggaaggaatcagtcgaggttgaggcaggtgccggcatttatggatgcactgcagacgggcagccccgctcttgtccacggtagatggcgtccacggaggagcgccagccgtggttttctttttcgattaggatgttctaggtaatggtctcgtgc

SEQ ID NO: 19151 - DNA, 841 bp, Zea mays
  misc_feature (709)..(718): n is a, c, g, or t
  misc_feature (722)..(722): n is a, c, g, or t
  misc_feature (814)..(814): n is a, c, g, or t
ctcgaggccggccgcattgggtcctccaggccggccgggcggcgcacagacacaggtactagtactaccatatcatgtgacgtgcatgcggctgtgatgcacaccaacccagccatggccaaggcagctcctcctctcctcgccgccggcagccgcactgccatcacagcgcagcagccatcgtcgaggaaaggcgccgctggcgccggtttgttctgcagtcgcgtcatcgtcagcaagcgcgccagggtaacagcgaagctcggagacggagagctgaagcctgcaggcaagcggaagttcatcaccaaggaagaggagccagaacagtactggcagaccgcgggggagagggagggcgagaaccccatgatgacacccctgccctacatcatcatcttcggcatgtccacccccttcgtcatcctcgccatcgccttcgccaatggctggatcaaggtccctgtgcgatgaccgtaacgcgatcagccagcctggatcatagatgctgactcgtcaacctgcatcttatccagcgtgtgtcctgcgactttgtaccttcatatatagagacaagagttcttgcgtgtgagcataattgcatgatcgcgtggtgtatgtaacccgaaactgtttaccttttcgcaaaaacttcagtcttcattcactgttcaaaaaaaaaaaaaaaaaaaaacgccccctagggccnnnnnnnnnncttngccattatccgaagttccgaacccacgccaagccccagggtccgaccgcagaaccgacccaaaatgtcgcccgcctcttcatgctcccgcgngggtggttctcctccccgttcccagcc

SEQ ID NO: 19152 - DNA, 826 bp, Zea mays
gcccgccgctcgccccgggcatcactcgccttatccacccgtcctgttcctgaacaccgtgacacacagacacaggtactagtactaccatatcatgtgacgtgcatgcggctgtgatgcacaccaacccagccatggccaaggcagctcctcctctcctcgccgccggcagccgcactgccatcacagcgcagcagccatcgtcgaggaaaggcgccgctggcgcaggtttgttctgcagtcgcgtcatcgtcagcaagcgcgccagggtaacagcgaagctcggagacggagagctgaagcctgcaggcaagcggaagttcatcaccaaggaagaggagccagaacagtactggcagaccgcgggggagagggagggcgagaaccccatgatgacacccctgccctacatcatcatcttcggcatgtccacccccttcgtcatcctcgccatcgccttcgccaatggctggatcaaggtccctgtgcgatgaccgtaacgcgaaagccagtctggatcatagatgctgactcgtcagcctgcatctcatccagcgtgtgtcctgcgagtttgtaccttcatatatagagacaggagttcttgcttgtgagcataattgcatgatcgtgtggtgtatgtaacccgaaactgtttaaattttcgcaaaaacttcagtcttcaggcattgttccgattcaaaaaaccgaaaaagtgccctggtatcaatcttcagttatgagaaggtttgtatcatctgcagttgttgtagaatcatcacaggcagaactacaacttgcttttaaaaaaaaaaaaaaaagggcccta

SEQ ID NO: 19153 - DNA, 779 bp, Zea mays
  misc_feature (744)..(752): n is a, c, g, or t
cactcctaagggcgattgggttcctcgaggccggccgggtcgccttatccacccgtcctgctcctgccggccgggacacacgggtactagtagtactaccatatcatgtgacgtgcatgcggctgtgatgcacaccaacccagccatggccaaggcagctcctcctctcctcgccgccggcagccgcactgccatcacagcgcagcagccatcgtcgaggaaaggcgccgctggcaccggtttgttctgcagtcgcgccatcgtcagcaagcgcaccagggtaacagcgaagctcggagacggagagctgaagcctgcaggcaagcggaagttcatcaccaaggaagaggagccagaacagtactggcagaccgcgggggagagggagggggagaaccccatgatgacacccctgccctacatcatcatcttcggcatgtccacccccttcgtcatcctcgccatcgccttcgccaatggctggatcaaggtccctgtgcgatgaccgtaacgcgatcagccagcctggatcatagatgctgactcgtcagcctgcatctcatccagcgtgtgtcctgcgactttgtaccttcatatatagagacaagagttcttgcgtgtgagcataattgcatgatcgcgtggtgtatgtaacccgaaactgtttaccttttcgcaacaacttcaatcttcactcttaaaaaaaaaaaaaaaaaaggcccggcccgggccggggcccggtannnnnnnnngaaaaaaaaaaaaaaaaacccgcggcc

SEQ ID NO: 19154 - DNA, 1813 bp, Zea mays
atggcgctatcagccgttacgattgggttggacgtgcccttgccgaccgagcctttcgttctatcctcgccgccgccgtcgccgtcgccgccgtctcgtatccctcggagattctccattcccgcctctccggccgccgcagattaccaaatacggtgaaccgtgtggtccagtggaattttgcacctcattgtactttgaaggcaaataaagccattctccaatctgaaggcgaaacaaggagtgcacatctttgttgtagagggcaaagtttgctcagctgctgctggacattggagagcgcagtggtggttgtacgcctgaaaggaattctttgtaaatttcccctatatctggttctgttatcatcattattttccttgcgttagacaataatgtcggagaacgaattagcagtaataaaaccagaggtacatctcctgttgcacttcctgttaattagagattaaatgttgcattcttatcttgattgcatcatttgggcctaaatcaactaatcaagtttattggtgaactctgacaggcattgaaaacttatatttggcttcagtgctttgatggctccatacaacaagtggaggaagaagttgcgatgttctgccctatgatatgtctggaaatagtgaaaaatgggacaggatcatctaagaatcatgctatagtactaccagaaagagttagtccggcaagtttgagtttgattcttaattattgtcgctttcatcaggtccctgggcgctcaaacaaggagcggaagtcatttgatgaaaagtttgtccggatagacacagaaaaactctgcaagttggcttccgcagcccttggtctgcagttaaggccactagttgatcttacttgtggagcgcttgctcgaatcattggaggaaagacacccgatgaagttagagatattttccatttaccagatgacttaacagaggaagagaaactagagccactaaaaaatgtaaatgatgatcctacgattcgattattgaaccgattgtatgcaaagaagcggaaagaactgcaggaacgccagaaactaaaggatgtccaaacacaagagcaaaaagatgagagatctttggatgaattactttgttttataaatggacatggagattccagaggtgggaaagcgtctaagaataagaaaaggaataaaagaaggaaagatcaagttaagaatcccacaaaagcggactctgaacctgtaaataaggagggagcttcctgtgtggttccgtgcaaagaagatagtaataacctctctaggcatccttgccaaagtccaaatttgcaagatgatgttgagtaccccttcgacaatgctgaccttgatgatggacttgatcctgcaatgagggaagagcttgatagagaagtggcggaatttgagatgaagctgaaattagcttggtctgaaagaatggttctgggacaggatcaaccaatggaatcggatgttgatacgcggtggtaatggttctatgacagcggattctctgttagttttttttttcgcgtagaattttcttgatgaggtcttcttttgctgttagagtgggcagaaaaccttagctggaaggagttttgttcgagagatacaggatgacattgcgaggtgcaatagtcatgttctgtgatttgtatgtaaccctgctcttcaagagagtagtgtccaaccgtatgttaccccaaaaaaagggtggagtgactggaaaccggaagttttgaatctatgtatgttcattaattttgacaggaactaagaaaaaaaaaaaaaaaa

SEQ ID NO: 19155 - DNA, 884 bp, Zea mays
gcacgagcccgggctctcgtccccggcctagaggatctcgttcccggccgtctgccgctcgggcctcacccgtcgccgtcgtccccctcccggtcccggccttccaaatcgtcagcgcagggcgcaggcgcgcagccgcacacgcttgcccgcgccgcccagcagctcccccatagccgtcgcgccgtcccggccctccaagattctgattggtgttttgctggaaccatgtccagtccgtggagccctatgagtatggaggaagacgaagagatccaagagctcgatgccgaggagcagcaggacggtgagcagccgcagcagggtgatgggctgcagcaggggtccacagctgaagcaagggcacaacaaaccggaaagaaacgcgcaagatcagtggccatctcgtctactaagtctgaggcaaagataaaggtcgaggaaagtgcaccaggagctgcgacaggagtgattctgtctcttcgtgaaagtttacaggactgtaaacaaagccttgcatcctgccaggtggaacttgaagctgcaaaatcagaaattgagaagtggcattcagcatttcagagcattccagctgtaccttctggtaccagtccagatcctgtttcagtggtatcttacctcagtaacctgaagtcatcagaggaatcattgaaggagcagctggagaaagcgaagaaaagagaggcagcttttatagtaacatttgcaaaacgagagcaggagattgcagaactgaagtctgcagttagagattttaaaacacaattaaggccaccgtcaatgcagacaagaagattgttgcttgatccagcattcatgaggtatttcacgctttaaaatcttgtggaggagaaagagaaaaa

SEQ ID NO: 19156 - DNA, 1664 bp, Zea mays
  misc_feature (972)..(972): n is a, c, g, or t
gaactatataaattatattttgcttaattatgtgctcaataaatttttgcaataaaacatcttgttccaacactcgctcgtatcgtttgcttgcatggcatggcgcgcggtcagtagcgatcgttgcagccccaacaacaggcgattcgaccgaccggtcggagtggtaggtaccagtcgtgttgggaccgtgctagtcggtgttgaccatcacgttagagtttgggtgggtaccgattaggcccaataccgagtgcttggttctaccgtggtggcatctgattggttgacactattttagctgtttgtacaattattggctttatcatatgaaacgacgtatactatagatattttttagtatgttagagaaatggatcatttcctaatatttttattgtttgttggaccttattaactatgcatattagtcttccatcaacccttagaagcttttcaaagttgaagttggtgaaaaattatttaaggtccaaaacatctcaagaaatgttaaatagtttggctactttgtggattgaaaagattttattggatgagattaatattgatattatcttcaataacttcacatctagacaagctagaacaaatttctatggaaataccatgatatatacttattacttaatataaatattttttagaaacattttagtcccaaatctatagcattatctggtgatgttggaagattttttcgttacgctgaaatatattttttcttctcgacatggaacattttgtggcttacggtgaattgccgaatgcttcacaaagttcgcattttccgcaacctggccttttttaaaatagcatgatagcactgtccaatccataaggcaagacaaattctatttgtatcggctcaggacatgataacaaaagaccccttgattagaactaaattgagttctattggtctagctagttttttttttaagttgttagtgntagccactactaagttaaatgagagtcatgctgttttaaagttgtaagtccgagccactactattttgaatgaatgagaatcatgtgagtaagtcatgcatttcatttatgattatgcatgagtcctccctgggttggtaatacatgagccactcaaaaaagatatcatgtacctatgcacgagaccattacctagaacatcctaatcgaaaagtaagaataagtgtttaaataagcagagcgagaggagatcaagaagggaactcaacttgtaagatattggagtcaaacatcgatgtagcgatgcgacaatctattgtacaatcaatcaaggtgaggctgtatgttagcacccataattcatgatgtcaggattaataattagaatacaaccacaacattcaatattatgagaggagatcatctactgtatcctaaccatctagacttagagatcatcttgaacgtctgttttgaagaggatgcacatttgtttagaaatagtttcgttgcttttgtggcgagagctatgtgttctgtctgtgttgtatgattttaaaagagttgtagattgtactatactagggcgatcaccgtcatgatactgctattagacgtaatgtaatattgtgaattgtattatatataatatttaaaacaaaagattgagaggaacaaaaaaaaaaaaaaaa

SEQ ID NO: 19157 - DNA, 4442 bp, Zea mays
aattcggcacgaggctcacctcctcctctccttttcttcctccctcagcctggcctcaactcccctcccatcccgtcccccgatctcatctcgccggcggcggcgatggcgggcaacgataattggatcaacagctacctcgacgccatcctagacgccggaaaggctgccatcggcggcgaccggccttccctcctcctccgcgagcgcggccatttctcccccgcgcgctacttcgtcgaggaggtcatcaccgggtacgacgagaccgacctctacaagacatggctacgcgcgaacgccatgcggagcccgcaggagaggaacacgcggctcgagaacatgacgtggaggatctggaaccttgcaaggaagaagaaggagttcgagaaagaagaagcttgtcgtatgtcaaaacgccagccagaaactgagaaaacacgagctgatgctactgcagatatgtctgaagatctctttgaaggagaaaaaggagaagatgctggtgatccatctgtcgcatacggggacagcaccacggggagctcacctaaaacaagttcaattgacaagctatacatagtattgatcagtctacatggtctggtccgtggtgagaatatggagcttggccgagattcagatacgggtggccagatcaaatatgtggttgaacttgctaaagcattaagttcatccccaggagtttaccgggttgacctgctaacaagacaaatcttagcaccaaattttgatcgtagttatggtgaacctaaagaattattggtttcaacaagtggtaaaaattataaacaagaaaagggagaaaatagtggtgcatatataattcggataccgtttggtccaaaagacaagtatctagctaaagaacatctatggcctttcattcaagaatttgttgatggtgcactcagccatattgtgaggatgtcaaaagccataggtgaagaaactggccgtgggcatccagtatggcctgctgtgattcatggacattatgccagtgcaggaattgctgctgcgttactttctggagcacttaatcttcctatggcgttcacaggacattttcttgggaaagataaattcgacggcctcctcaaacaagggagacaaactggggaaccggccgggatgacatacaaaataatgtgccgaattgaggccgaggagctatctcttgacgcatctgagattgtcattgcaagcactaggcaagaaatagaagagcagtggaacttgtatgatggttttgaggttatacttgcaagaaagctccgagcaagagttaaacgtggtgctaattgttatggccgttttatgcctcgtatggttataattcctcctggagttgaatttggtcacattattcatgattttgatatggatggcgaagaagagaatccatgcccagcatctgaggatccacctatttggtctcagataatgcgcttctttacaaatcctaggaagcctatgattctagctgttgcccgcccttatcctgagaagaatattactacacttgtaaaggcatttggtgaatgcaggccattaagggagcttgccaatcttacactgataatgggaaaccgtgaagctatatctaagatgcacaatatgagtgctgctgtcttgacatcagtgcttacattgattgacgaatatgacctgtatggtcaagtggcataccccaagcatcataaacactcagaagttcctgacatttatcgtttagctgcaagaacaaagggggcttttgtaaatgtagcttacttcgaacaatttggagttactctgatagaggctgctatgaatggtttgcctataattgcgacaaaaaatggagcccctgttgaaattaatcaggtcctgaacaatggtctccttgttgatccgcacgatcagaatgccattgcggatgcactatataaacttctttctgataaacatctttggtcaaggtgcagagagaatggactgacaaatattcaccaattctcgtggcctgaacattgcaagaattacctgtcaaggatactaactcttggcccaaggtctcctgctattggtaacagagaggagcggagtaatacacctatttcaggaaggaagaatatcattgttatttctgtagactctgttaacaaggaaggtctagtcaggataatcagaaatgctattgaggtcatacataaagaaaacatgtcgggttcaactggttttgtgctgtcaacttccttaacgatatcagaaatacattcactgctactatctggaggcatgcttcccactgattttgatgctttcatctgcaatagtgggagtaacatttactatccttcacattccggagaaacgtcaaacaactccaagattacatttgcattagatcaaaatcaccagtcacatattgagtatcgttggggaggagaaggcctaaggaaatatcttgtgaagtgggccacttcagtggtagaaagaaagggaagaacagagagacaaattatttttgaagatccagagcactcttcggcgtattgtcttgcatttagagtggttaatcccaatcatcttcctcctttaaaggagttgaggaagttgatgagaatccaatctctccgttgcaatgcattatataaccacagcgctaccagattatctgtagtccctatccacgcatcacgctctcaggccctaaggtacctgtgtatacgattggggatagaagtgccaaatgttgcagtcctcgtgggtgaaagcggcgattcagattacgaggaactgctggggggtctccataggaccgttatcctaaagggcgagttcaacatcgccgcaaacaggatccacacggtgaggagataccccctgcaggatgtcgtcgccctcgatagctcaaacatcatcggtgtcgacggctacaccacggatgatctgaggtctgccctgcagcagatgggtatactggcacggtaacaccttccggagcttccgtttccactaccaggtcaacgaagagaaacgagaaaacagacagaatggtgacgaaacaagtgcgaccgtttccatgctcgatgggaatgccgattttgcattgtaggctgtagcggttgtgttcgtgtgtgtgtgcccgcgcgcggtggtggcctattcttgtgctgtgaataactgcccctcctttgtttgtgatatgccaaaattttgaagtgagtacagtacaaccaaacatgttgatgatggaaaaacgaatggagaaaggggaaaaacaaacaaaaatggtttgggacggcagtgttccatggtatggtacgctgttgttgaatgcctgggaaatgggtgattccgctgttcgtcactcgtcccatctggctagtttgttctatgccttctgaaacatgtatcatctggctagttacctggggacatcagatgttctccctgttttgacttgcgattgttgtttcgtaggaagcacattggactcttttgttttagcttgtttcagcttttggctgccaaagctgcagtggactgttacatacttagttttttagtctgtttctataaaatttgatttagtaaaaccatctagaatcaatatgaatatagaatcaaccgagtcgttgcaatagtaggaattcatcgctttctagatcataaaccttatgaacatctttatcttccttcatacgtaatcactatgatatttagatttttctatagctagattttctatatagctagattcttagaaaagcttgtaaaaaaattaaaacctgataagaaaaaaattaaaccaaacaaatccattgccgtgactagaaaaaaaagttaaacccacagcgaaggcacgtgcgtgtgcagacggcgccggcagcacagcacggatccggccgtgcatttcgcacgccatgtcgcattccttcctttccctttgtgctgtgcgaccggcaacgccgcacggaagcagcgaaacactgtttcaacgcaaatgaaatgctggcatgccgccgatgctgtggagcgaacggtcggacgcgtgagcaggcaaggtagaaaaggcaaaaaggtcggtgagtggaaaagccacatggtccaccaacggatagctccggatcacagatactaggatatgtaaataaataaaagaaaagagatgaaaacgcgggtataataaaggaaagcatcgacaaggaaaacaagggacgaaggatccactgcgcacggatgtcgacgcgtgaacgataccaattcaccacagcgagtcgaggcctcgtccaagttacttccaaacgagagagaaccaatgctggacaagcgtgagctatgatgcctctaggaagatccagcgagcaaggcacttacttccccttgcccagcagcagagggacggaatccaacgaagtctcaagggtttt

SEQ ID NO: 19158 - DNA, 910 bp, Zea mays
  misc_feature (1)..(1): n is a, c, g, or t
  misc_feature (728)..(728): n is a, c, g, or t
  misc_feature (858)..(858): n is a, c, g, or t
ngaaataattgcgcgagtgccgcccgacctccgaatttactgatccatccatctccatccccatcccgtgacccgtgcacgccgccgcttcaagtcctaacaagccgcatcgcatcgcatgcgtgtgctgtccgaccgccatctccgcagccggctggcctagctacctcacctcacctcacgcaggcacactgcacacacacccatggtggtggcggcgatgcggcggccgtgcgctgtgccagcgctgctggtggcggcggcgacggcgacgctagtgcttctgctgctgctgtcaccgtcgagcgcgcagccggtgccgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctacggcatcgccgtcgactacggccgcgcgctcgcgctccccggggtctgccgcgtcgccaccccgcccgtctccacctgcacagccctcggatatcacgtccgcgtgggcccagctgcggcgcccatgtcagggtctccctcgcccatgtcaggcatctctcccctccggggagggcccacagttcccaggaacnatcgccgaccgcctcgccgccgtcctcgaccagcaccgcggcgcgccgctcctccgccggcgcgggcagccacctcgtggccctcgccatgctgccgttggccgccgccgtcagcgggatgctctaaggncgacgactccttcgtctccgcatgcattgcgcagctggacattgttgcgtag

SEQ ID NO: 19159 - DNA, 1314 bp, Zea mays
gcccacgtgtagacgctggtaccgcgcgcggcacggcagtactccttggtcagcacccagtcgccaggcccttccttccaacgcaagagagctaggcggcgtgttccgtgccttgccttcccaagcaagcaagcaagctttcataatgtagtattgtagtagtttcattcaattcacgagtcacgacgttcacgagtcacgccagcatcaaagccgtgcgtgagtaggccgatctcttggatgatggaggaggaccagcagatagtcgctggcgtggacgccgcggcccgaggcggcggcggcctgggccgcgcgggagccgtctttctcaccgcgacatgcgccgcagccacctacagcgcggcggcggcaggggacatcccgtccgtggcgttcgcggtcgccagctacggcgcgctcctgcttctgctgcgctccctgcgcgcctacgagctggcgccgccggaggcggctgcacgcagggaagcgctcaggcgcagggtctgggcgctctgcacgctgctcagcgtgatgttcgcgtggaaggttgcgagcgtcgtcgcgacgccgtggccggtcgctgtcggcgtctgggccgcggcggccgtcacatctgccgctgggttcgttctgctgttccgccagcagcagcgtcgccaatgaacgagtgatcggtggatgtgtgttccgtctgtaacttgtaagctccaagagcctcaaatagttacaggcatgggatgggatcgatgcctggcctggttgctagctgctgtacgtatcatctcaaactttctgatggtgatacgcaattcgatcaagtgcctgatcgacgagctttgttttattatttttggcaggttagattgcccgtgcaatgcatgcatgcacgatgatgatgttgtgcatatgttattgaaggttttccgtgtgctggtgctggtgctggcctggtgatacggaggaagaaatgctttcaatctactgtacccggccggtacgttcagatgaattgtgatggcctctgccacaaacctatgtgtacgtattgtatatatgtgcatgacactattttagcctcatatcactagttgattgatatatttctgcgatccaattatgtgttcgttctgcgatccaattatttccttggattcatgcatgctccaggaaccttttaaatccatcatatcactagttgattgatatatttctagttcgagcatattcttcattactattgaagttaagagcttttttttatttttgtagtttttcgtgaacttatttctatccgttttaagttcatcactgtgc

SEQ ID NO: 19160 - DNA, 1642 bp, Zea mays
aaatgggttaaagaaaatatgccagtttcagcggtagagttgctctttgaactgaacgaaaaacggcctcaatatccaagctgcacaaacagggcctcgaacagttggcattggtggtacatgggataaccgccgcagcgacgatcccctgcctccattgctctctcgctgcactccgcgactgcccctcggcccctcccaccaccgcgccatggacagaggcaagagcaccggcactgctgctactacctctgaagccctgtgggtgtcggccaaggagctcttcggcatcgagtcagacagcgacgaggcgcggcgccctgcgacgtcgaagggccccgcccccgcgcgcagcgtgaatgagggtgccagctcctcgggcaccggtaccggcgccgtcggcgcgtcgtcaagcagtccgcccgcggagacgcaggaggtcacgcccttcgaagacgggcagtacgtgcgcctcctcaaccgcggccgcggcgggtacctcttcgccaacgagagcgggcggggcgtctccatcgaccaccgccgccacgtggtcaacacggcgtgggccgtgcaggtcctcgccgcgcgcgtcctcctccgcggcgcttacggccggtacctctccgccacgcgcagacgagcgcgatccgggcacatcggcggctacatcacgcagcgcatcgtcgagtttgcgaacgaccaccacatcgaatgggcggtcagcagggggaagcgcggcagcgtcgtgctcctccatgccttggagggcgtcccgtgtgcgctccgggcgaacgggcggtaccggcggtggaacaaggacgtcacctatgggggcgtcagcttaaacagcatcagctccatgcaggagtgggaggtacaggccatccccatgacagcggagaggccaccgtaccagctgcggccaccaaacgctgcaatccgctggcccgagggctgtcgtgagttggtctctgtcactttcagtcgtgcttggttcgatgacaatggacgcgtcgaacacgggcaatggatgcaaatgtggttgaatgggagaagtctgacagagctgggaaacgtgatagcaaatgtggttgcaaatgtgacagagctgggaaacgtgacagagctgggaacacgggcaatggatgcaaatgtggttgaatcgggtgcccagttcgagaacatgaccctgtatgttcaggctggcgaccttggccggcccatccctctgctcactgacctgcctctaacagatgatccgatcatcatattggcgttcacggtcgattcaccagggtacaatgcgctccggtttccagatcttgccactgagtaaaaagggaaggataggatcaaacagcaattcttcacccggacagaaatgccaatgcctctacaggtttacagcaaatcgaacagttcagagaacgcctgctgtttctgctaaaaccgtcacttctgttccaaaaggacaaaaacggttgcactaatgtactctcttccctccaaacactaggaaatactccgtatgtctttttgttgcggtgttgcactatcttctgtgatagtgttatcttacgatatgatagttcaaataaaggtcaatataatcgttgagggagcaaaaaaaaaaaaaaaa

SEQ ID NO: 19161 - DNA, 1245 bp, Zea mays
gacgagacacatatcgcaacccaagaggttctgaagggttctaaagataaaagaaaggaaacctttgcagaaggcaacactcaggaggaatgcaagtattattcaacacctggaggatgcaaattcggtaaaacttgcaaatacctccaccgtgagggaaatggagggaaaacagaggttgaaaaagctgagctaaactttctaggtcttccactgcgaccaggtgaaaaggagtgcccatactatatgcgcactgggagctgcaaatttgcgactaactgcaagtttcaccacccagatcctactaatgcatcttcaaaagaaccagggttggaacatgagaatggcgatgtaccactgcaaaatgtccaaggatcctctcagcctagccttcagatgtggcctgaccagagagcattgaatgaacagcatgttccttttcttgctccagcaccgtcatacagtggagggatggttccacctcaaggaatgtatccatcttctgattggagtgggtatcatcaggtacctttgaatccatattaccctcccggtgttcctttcccgcattttccagctgcccatatgaatcacccgatgtacaaggctgcagatataccaggacatcaaccaccaccatctgatgagtatcccgagagacctggccaacctgaatgccagcatttcgttaagagcggtttctgtaaatacaggatgaaatgcagatatcaccatccaaggtcgcgccagtctgcaccaccaccagcaggtcttagccccatcggcttgcctatcaaacctgatcaacctgtgtgcacttactatggacgctatggcttctgcaagtatgggccagcctgcatgttcaaccaccccttcaacttcgggcctcccgtgccggcagcaggaccacccctccctgggcagtaccctacgcatggaaacttcgcctagcaggcacgtgacgagcgattttctgagtcgccacgattgcttgtaataacctcctccacctgtaaagtagcgtagacaaaagctgtacgtggttggcagtagacatccagcatgtaggcgcaacgaagttgcatggagatgggtacgttacagttggtattgcaaactttacgctgtacaagttacagtccatacataagctgccatcgcatttaaaatcctggttgctgagcaaaaaaaaaaaaaaaaaactggagagtacttaaaaaaacggccgcgggcccggggttt

SEQ ID NO: 19162 - DNA, 1249 bp, Zea mays
ggcgggagtcatctctctccttttttttttggtttcctcgcgtctttggctccgcggcccggccggcctccagttctcgagacgactcgtctccctctttcataagttcggcagggtaggacggcttcttcctctgcgccttcaccttcgcctgcgctgccggggctcgtcgcatggtttttaaatcgggtttgtaagttttagatctttatgtcaactaccaatctgaggcggcgactccatcatggagacgttgatggaaggaaaaacgagcatgttgacatatccagtgctgattccctcaatgaacctctattagggaagtccaatgatgacaactttggatcagaggtgtatgatcctagaaaacaggatctgtgggatgatgatatgaagaaagaacaactacactggtcatttcttttctcaaacttgattacacaatgggcacaatggttagcaagcattattgtgagctcaggatctatctttggtagattatcccccttctcttcagagaaccaaataaatccagtatatcttagccctttacaggaacaaaggttggatactttaagacacagattgcaaatctcttttgatggctcccgtattgaacatcaagatgccttgaggcaactctggcgtttagcttatcccgctcgtgagattccaccactcaaatctgaattatggaaggagatgggttggcaaggcaacgatccatctactgatttcaggggtggtggactcatatcgttggagaacctcatcttttttgctaggaactaccctaattcatttcagatgcttctgaacaaagtacaagggcagagatcagattgggagtacccttttgcagttgctggtatcaacgtttcattcatgctggtccagatgttggatctgaagtcaagtgttccatcttctaagtatggaattcgtttccttgaattgcttggacgtgatgagaacgcctttgaccacctgtactgtgtggcctttcggttgcttgatgctcagtggcttgtgaaacgtgcctcctatatggaattcaatgaggtcttgaaatcaacaagaactcagctggagcgggaactggttctagatgatgtgctggaggtgaaggacctgccgtcctacactatgctggatgagtaagctaaagccgagctgttgaacttggacgctggagaattgactaagctggtctgatggctaatagttatctagcgtatgctgatgtctg

SEQ ID NO: 19163 - DNA, 1941 bp, Zea mays
gcacgagaccattacctagaacatcctaatcgaaaaattatttcattcttagtttcaggacactcttgatgatatatcagtgttgaaaagagtcttatgaaatagacattgtgattactgattagcctaataagatggaaacggctgcaggtagaagtaacggttgacgggtcgaggaaggcatgaattgtgccaatggcaggcagtaaacaccttccccaataagcttcccttggcccctttataaagccacccctcctccttcgcccaccaacatcagtccacagcaagaaatgaatccttcctctaatcctctcccatggcgcttctccgtccgtcccctagagcctagcttggccgcccacatgcatgcatgcatgcatgagtcaagcacaagcatcgtcttcccatgctactcgcgtgaatatgaatcgatgcttatctcgcatcaatcaatcgacgctcttccgtctcttctatcaatcaacgttctctagtgaaagaaccggcccttgagtggtatatgtattgctgcggcctgcgacgagttgagcagctaagctatgttgctatcttttgtttttatcttcggagatcttttattagcgctatgacaactggacaagtggttgtttgtttgtgctgcagatgctggtgttctaggatgcagtttgattcactagacctgatcccctagactagatggtctggtcttaaggcggtgctcccttcacaccaataaacggtcgatctgatgggtggtacagctgctcgttcatggttcccactgtcccatctcatcagagagagagaagatcgtgagagagcgagagatgcttgagatgggcttgtggtttgcatgaccgaggagctgcctcgtccccttcgttgaccgctgtttggagtgaagggagctctgcatcttgctcccatgactttcttcccagatttatgtttgctattttttttactttgttgtaacttatataagtgaacattttattcaaaaaaaaaaaaaaaaagtagggtatgacggtatgtatgtatgtatatcctgcaaatacagcggatcgtataggctagcaagcaacagcgtctgttcattgtttcattttagcggtgttagcaatacgattgcacagccttccaaacagataaagaacaactgattcgttacaatctgaggagtttgggcgagataggaagcacaaggttgaggaactgggctatacgtagtacattgaagtgaagttgggagtcttgagaagaagaaactgaagaaacatagtagctaggactaggtcactaggagatgggttgccaacttgccattctctgaataaaattctcgatgcccctcctcgccttttgtaccatcggagttcctagtttctatttgcaattctttgttcttggtgctgctgctgctctcaacaagtccaccgggaggtgaaagcttgtggttgtggccgtgcggaggcttgcaaagttccggcgccaggttgggtgcccatgtatttgtaggatgtttttagattaaaacgcggatccatcgctattctagcagtctgcagtatatatgcagtctgaatgtctaattgtttgttcatatcgattgctgccgcatcgcttaaattgattttaccattcatctctgagcaaatcatataccagcatgctatagttttgtttcgaaatttagattaagcttgctacagtagcagcgacttagggcagataaacagatccggagccctcgaaatttcgattgtgtgcgtacggaaatgctggaatcgatggatcttcgaaaatatccttccaacagcgttatcgaactgcaagaaaaaatgatcataagagatgtagcgggtctgtcatagaatgaaaaagacacaacaacacgcactatgccctggctcagacaaaggtaaacctaactct

SEQ ID NO: 19164 - DNA, 1421 bp, Zea mays
  misc_feature (1230)..(1230): n is a, c, g, or t
  misc_feature (1253)..(1254): n is a, c, g, or t
ctctcttcttctcccccgccccctttttcctagcggcacggcaccaggcccgccctggtggcatcttcgtaatttcgcgcctcttctccgccacggcggctgggggtgagaggaggtatgggaaacgccagcggccgcgacgaggacgccgcggctgttgacggcgacggcgccgacgtggaggacggcggaggggactcgtcggagcgcgacttcccatcgtacggtagcggaggagccaaccacgtgcggcgcgcgtgctcagtgggcgtcgtagggggcggcgccgccgccggatcgccacccgggagccccggtcactcgctctcgccgcggatgttcgtgccccagacccctgtacctccactgcaacgggctgctgatgtaaccccagtgttcaaccagatattgatggatgaacaagaagaatacgatggcccccctcaaaaagaaattcctgctttaattgtctggacccttggaggaaagaatgtatatgttgaaggatcatgggataactggaaatcaagaaaagccatgcaaaaatctgggaaagatcattctcttttgctggtactcccagcaggagtttaccgatacagatttgttgtagatggagaaaggagatgtcttcctgatctcccctgtgaaatcgatgcaatgggcaatgcggttaaccttcttgatgttaatgattatgtccctgaaagtgttgagagcgtggcagagtttgagccacctccttctccagactctagctacagtttccaggcacctgaggacaaggacttcgccaaggagcctcctgttcttccatctcaactccatctcggtgttcttaactcacagaactcggaagaaagctgtgcgcggccgcagcacatagtcctcaatcacctcttcatagagaagggctggggcgcccaccctctggtgtctctcggcctaacccacaggttcgagtccaaatatgtaacagtcgtcctgtacaaacccatcgaacgatagcaatagcccgcgcctgaagagcggaagttgacaactcactgtgggagcagcgatgaacagcgccgaagtggtacatgcttgtaaaagcggttgaggtccaggagtattttttttcccgtgcccttagcttgcacaacctgtggtactctggtggttagctgtacatgctgcgctgtcatgatggttggtttgctgttacagagagcaaagcgtccttgatcncgaagaaccgtacgtttgtcgtnngtcgttccttccccatcccatatcaggaatgaaatgtttgtcaaggtgtcactgagaaccgtggaaacccacagaaatgctaggagacagagattaaccatgtgattctagattttgtttgatttgttggtcagaactctaacgatgttgtgctatgaataactcag

SEQ ID NO: 19165 - DNA, 1343 bp, Zea mays
ccacgcgtccgactagttctagatcgcgagcggccgctcgcgatctagaactagaccacgtgcggcgcgcgtgctcggtgggtgtcgtaggtggcggtggaggcgccggatcgccacccgggagtcctggccactcgctctcgccgcggatgttcgtgccccagacccctgtacctccactgcaaagggctgctgatgtaactccagtgttcaaccagatattgatgaatgatcaagaagaagaatatgatggcccccctcaaaaggaaattccttctttaattgtctggacccttggaggaaagaatgtatatgttgaaggatcatgggataactggaaatcaagaaaagccatgcaaaaatctgggaaagatcactctcttttgctggtactcccgtcaggagtttaccgatacagatttgttgtagatggagaaaggagatgccttcctgaccttccctgtgaaactgatgcaatgggcaatgcggttaaccttcttgatgttaatgattttgtcccagaaagtgttgagagcgtggtagaatttgagccaccgctttctccagactctagctacagtttccaggcacctgaggacaaggacttcgccaaggagccacctgctcttccagctcaactccatctcggcgtccttaactcacagaactcggaagaaagctgcgcgcggccgcagcacatagtcctcaatcacctcttcatagagaagggctggggcgcccaccccctggtggctctcggcctaacccacaggttcgagtccaaatatgtaaccctcgtcctgtacaaacccatcgaacgatagcaatagcccgcgcatgaagagcggaagttcaatgcttgacaactcactgcgggagcagcgatgaacagcgccgaggttgtacatgcttgtgaaagtggttgaggttcaggagtattttttttccgtgccctgcttgcagaacctctggtagtctggttgttagctgtacatgctgcgctatcatgatgttggccttctggtttgtttacagagagacaaggcgtccttacaatttttacatgtccgcttgtcgtcgtcgttcctctcccatcccatggcagattggcaggaatgaaatgtgttgaaatccacatgaatgttaggtgccggagatagatcaagggattcctagatttttatttgttttttgactggtcaagaagatgttgttgttatgtactaaactcaagaaatttttacaaatgagatactagtgttctcaggcccggagccattttttttaaaatacaatgcccttatgcaacgcattcatggagtgagatttgccaaattctgcag

SEQ ID NO: 19166 - DNA, 1585 bp, Zea mays
  misc_feature (539)..(539): n is a, c, g, or t
atatacgagcacgagccccgcagcccccgtccccgtcctcttcttcttcccccttcctagcggcacggcaccaggtccgccctggtggcatctccgtaatttcgcgcctcttcgccgccaaggggtggggccgtgggggtggcaagaggaagaggtatgggcaacgccagcggccgcgaggaggacgctgcagctgttgacggcgacggcgccgacgtggaggacggcggaggggactcgtcggtccgctcgtcggagcgcggctttccgccgtacggcagccggaggagccaaccacgtgcagcgcgcgtgctcggtgggtgtcgtaggtggcggtggaggcgccggttcgccacccgggagtcctggccactcgctctcgccgcggatgttcgtgccccagacccctgtacctccactgcaaagggctgctgatgtaactccagtgttcaaccagatattgatgaatgatcaagaagaagaatatgatggcccccctcaaaaggaaattccttctttaattgtctggacccttgganggaaagaatgtatatgttgaaggatcatgggataactggaaatcaagaaaagccatgcaaaaatctgggaaagatcactctcttttgctgatactcccgtcaggagtttaccgatacagatttgttgtggatggagaaaggagatgccttcctgaccttccctgtgaaactgatgcaatgggcaatgcggttaaccttcttgatgttaatgattttgtcccagaaagtgttgagagcgtggtagaatttgagccaccgctttctccagactctagctacagtttccaggcacctgaggacaaggacttcgccaaggagccacctgctcttccagctcaactccatctcggcgtccttaactcacagaactcggaagaaagctgcgcgcggccgcagcacatagtcctcaatcacctcttcatagagaagggctggggcgcccaccccctggtggctctcggcctaacccacaggttcgagtccaaatatgtaaccctcgtcctgtacaaacccatcgaacgatagcaatagcccgcgcatgaagagcggaagttcaatgcttgacaactcactgcgggagcagcgatgaacagcgccgaggttgtacatgcttgtgaaagtggttgaggttcaggagtattttttttttccgtgccctgcttgcagaacctctggtagtctggttgttagctgtacatgctgcgctatcatgatgttggccttctggtttgtttacagagagccaaggcgtccttacaatttttacatgtccgcttgtcgtcgtcgttcctcccccatcccatggcagattggcaggaatgaaatgtgttgaaatccacatgaatgttaggtgccaaagatagatcaagggattcctagatgtttttttgttttttgactggtcaagacgatgttgttgttatgtactaaactcaagaaatttttacaaatgagatactagtgttctctggcccggagccaaaaaaaaaaaaatacaatgcccttatgcaacgcattcatggagtgagatttgccaaattctgcag

SEQ ID NO: 19167 - DNA, 1807 bp, Zea mays
  misc_feature (150)..(150): n is a, c, g, or t
tggtagtaatgatagggatcgggctttctctggcagatcaggagggaggtttgattcaaggaatagctctggtggtcgtggacgaggacgggggcgtggccggggtaactttggcgatgacgataatgctggtggaggttggagtggagnagcccggggcggccccacgccgtcctggaccgataacattggcacaggtggcagtggtggttcttcctggggtggtggtggcggtggtgatgacagcaaccgtggcggtggaggagggggttggggatcagctggtggtggtgctgacaatgctggtggcggaaatggagcctggggagcagctgctggtggctctgatgacccagggttgggtagcgccaaaaaggtcgtcccagcacaggatggtggaaccggctgggggtcagaaggtggcggcggcggtggtggcggaggctggtaactgggctgtgccctgcgttgtagtccagacaacagctactagatgaaaacagtttcctcgttttaactcctgtcctatcgtactgtggacgggagaaatctggcacttataagtcttgcagctgctgcacgtctgcagatgttgcattgcggacagcgttatgtttcagtgcatgtacataaatccaatatgtctggtcacactttcctgctacgaatttgatcctggtgcttcattgttgaggctatccgcaattaggccagtactctaccccatgttggtaagcttttgtgttgaaagtgtaacacgctacattttgtttccctagcttcacataaccccgcttacaagtgtttcaatgttttggcgacccatatgcctttcggtttgtgggcgtttcgatagagtcaggtctggatttcacaactagcatttatgacagcaaaagccggaaggtggcattcgattgtacttgagtcctacaaatgatcgattgaaagttacatgttattataaaaacgaccatggactaggaagcattcttaagaggcatgtacaacctgagaacggttacagttaagatcgatacaattctgagcctctagatcctaaatacaattatgagatattatgtgtgaagtgttgtatatagatagacttttcttttatatttattttaattagccttctagagacatctttaaagacctcatattaaatgaggttgtgcatacccttagcattcatatagacctccgtgtggctactagcgatggatttattaggtaaaatattaggtacataaaaataaaagacaaagatattaggcacatgaaaaacaaaggtaaaaacaaatttaaaatattacacattattacgtagaatttataaaaatacagcaaccgtcaaaattaaaaataatataaattaaaattattatatacaatttagaattcatctacaacaacttaactttgcaacctattggtttggtttatggcaaaaccactatgttttattaaacttcggaagtgacatatttcatattcatgaccatgggttatgtcacacttttaggttaattttgactctggcttttgtccctttaaaactaaaagttaaactaaagggctcgaaccagaaaccgtttttttaaaagcttgctttattacagtgtaaaattgaaagtacacctggaattatttttaacgacttttggatagaattgttcaaaattatatggaaaaacttttagcatttttagcgacctctatcaaacaatttttagcctttttatagctctcagcctacaacaacttttttcatagctcacaacccacaatagcttttttcaca

SEQ ID NO: 19168 - DNA, 2810 bp, Zea mays
gatagactacaccatccatgaagtggtgtttgaaatgggagataagataaaagatatgatagataaaatgctggagacaacccgaggagcttgtcgcaatgtcttctaggaagaggatgtgttgcatatcctggaaacaccaacaaatcatgggcatgatgatacattggcctgacattttgatgcacgaggttttttctctgtaaaagtcgggatgacacgtcttggatgacgagaaggaacgaacctagatccagtagaagggacaaattcagtttggcaccacttatggagtctgtcatgtcctccgaacctgaaatacttcttatgtcatttggctcagaatagcctggctctaaagctgagcattcagctgtgggtgatgaaactgcatactcaatgtccagtttgcaatcaagtgaatgagaatgacaaccactgtttctttaagtgcaaatttgtgaagcagtgttggaccgatctctgtctggaacatgtctgacagatgctgctatataagaattcatcgtgggaagtaattcaggaagtgttgcaggtgaaagtgattcaggatactcgagacctacatgagcacttcatgtgcaatgatgttctgttaatccctagagcttgtaattctattgcacatgagttagctaggttaggaatgagttgggacccaaatgagtattgtgtttcatagagtttgtaaagagtctattgacttgagacttctgatttttagtcttgttccaataacaaggccctagaaccactatttaacataacaaggtccataagtataaaactatttggaaaaaaaaacgtagcccgtaatttccatggacatattcacaaggtcaagtcgctaacgatatgaataaagaagattgttaggagtcttcaattctgaggattgccttgagggtcttcaaactagtccctatgttcataaaagaacacaattatcaattttcgaggcgtccaacgatctaaaatttgaccaaagttataagaaaggcacgagaccattacctagaacatcctaatcgaaaaagattgtaattagcccccaacgcaccagggcccccgtgtcgccctccagcttgggcgactcgggctgccgcaccctctcctcctctctcctctctccagctgcaccgccaccggagtaggccgccgacaaggatgtgcggtcggccaggatggcggcggcggggctcgcggatggcccatgggggaacctcagctggacggatctgcgacggtcgaggaggttctcggcgctggcgcggctttccaggggcggcgaggttctcgtcgcaggggcgcgactggcggagttggcccttggcgtcggcacctcgaggtggttctgtcggagggcttggtggcccgccgcacgcggttttgcgggctaggtggcggatccggaccctcgccagagctagaccagcaacccgatttgggcgggcggtggccgcagtagtgcagtgctgggctcatggtggtgtggagtgtggggtgaccacggcgtgctcctcgtgctggtgtggccgcggcgttgtggggcactaagatattgggctgctgcccgcctacggcggtggcctggcttggtggcggcttggaggtgtttgctgtggtggcggctgtgtgtcctgcggcggcgatgtgccgggccgccgggcaggcttgccgggcgggcgagtggcagcgcatcgtggcatcagcaattcagaagaagggtggtgttgcggctagcggtggtcaccgctcgaggtcgtttctggtggtggcaacgacgatcatcatctgggcaggcagccacatgttcttgcgggtttgttgtgtagatgcacgcagtgaacctcggcggctggccctgcaaggcagtggccattgcggtgagggactgtgtcgaaagacggcgcctgcagcagcgacaacgcgtgataacaaggcttgcagcgaaatgtggcggctagctttgctttgcaggggctatcccggtgcagggcaacgtcggaagacgccgcaagcttcttttgtggcctaccagtgcgatggcggtggtcgtgtgcttgtgtcagagctttggtgatggcttctttgggttgtggggtagttttgcataccttccaaaagtaaatcaagtaacgggtcggtggcaatgaatgaagtgttgcggcggatgtggtgaggcccccacgcgttacgctggtggcgagtaccaattgtggagtccaacggcaaatgtggcaaggcccatgcgcgttgtgttggaacaggagccaaaatccagtggatttcaccctgttggttgggcgagtaccaattgtggagtccaacggcaaatgtggcatggaccatgcgcgttgtgttggaacaggagccaagatccagtggatttcaccctgttggttgtggttgaccggttgaggctgctgcagccctgccgatgattcatagctatgaccagagattcgacgactactttgcacgactttggtgatgacatcggcttggtttgcgcacccatctttctggcagcctggagctgcggcgggtgcttctccttctgcagcgcaggacctgggtatgttcgctgcttttggtctgcagtgggctgggtggtgatggcgaaaaccagccagttgggctgatgatggcgacatctttggcgtgttaattaaccctagttaaggttatgtggacaaataccgactttgcctacgaggggtctcacatccctactactaattaagaatagaacgtggatgctcggcgcggtcatgcccccgcctcgc

SEQ ID NO: 19169 - DNA, 1749 bp, Zea mays
ataacttgagccccattaccaaaatgacaccaaccgattaaactcacagcccaactcctcttctcgccctcgtctgacttcgtttcggacctccccagtttttcccctccggccgccgcacggagaagcagaagccatgcaggccgccgccgcgcgcgcccgccgcctcctcgccttaccggcggcctcggggatccccggaatactctccggaccgatcccagggcgcgcatcatacgccgagggcgttctcctttaccgtctcaatggcgctcccgcttcgccgtcttctccgcagcataccaggggcttctcctcctcctgcttcgcctcccgatcacactgtaacctcccatcgcctaccatagcttctcaatggttgaatgagaaatcagtacactatcacatgacgacagcacacttctcaacggaagcaagtgacatggaccaccctacagaagctgtagaggagatgtaccagaaaatgttgaaatctgttgaagctgagaccatgcctccaaatgcctggttgtggtcaatgattgatagctgctccaataaggaggacatcaaacttctttttcaaattttgcagaaactcagagtatttagactatcaaatcttcgcatcagtgcaaacttcaatgagcatctctgcagaaaagtaactgaggcttgtgctcgtgtaggcgccgttgactatgggttgaaggctttatggaaacataatgtttatggaataacaccaacgattggttctgctcattatctactgcaacatgctaaagagcaaaatgacaacaaactaatggaaaacgtaattcatgtcctatcgagaaatttcttaccgctgcaaccaggcacagctgatatagtcttcagtatctgttataatgctgatagatgggatttactctcaaaatacgcggagagatttgttaaggcaggtgtcaaactgcatcgagctgcatttgacatttggatggactttgctgccaaagttggggattctcaatctatttggcacattaatagtctaagaggcaggtctgtcaaacattatacacttgcaacagggtttgcatgtgcaaaggggtctctgcttgatcggaagccagaaaatgccgctgacacgattaagcttctttacgagcatttgcctgatcagaagaaaccatttgtgaaagatgaactcgagaaacttattgctggatggcctacggaggtggtaaagaggcagaagaaagataagaggaaggcgttggaagaagctttgatgaaggacatcgctacgatggtggactgcctgacaaagtccggcctcgacatccctgtggaactggacaagctttccaccccacagctccaagtggcgtagcaaaagaaggcgcgcggctcgccatacaaccggaacagacttggagtctcgaggaacagcatgcattttggtttggcactgatgcaggcagcgcagcgcagcgcaggacgcagattgaaaatctgtgatagatgaaatcatgtttttgtttctgtttctaatgttgtagtgcaggcccgtgcgtggtgcgccctttctgttgtgcgttgaccgttgaaaatctgtgatagatgaaatcatgtttttatttctgtttctaagaagcaaattgccgtcgtatcttggcacgtgttgtaactgtacccatcctttctccaaggactttctaatctgttattacttttaataatgcattaatagacctagtcgcg

SEQ ID NO: 19170 - DNA, 3666 bp, Zea mays
tacctccatgtggtcacctcactggtacttcacacaatgccaatgcaatgcaccagccgacgaagcaccaacagcacttcaccaaataatatgtatactaccgagtattgactactaattcgcgtgcaccagctaactgaaactaaagtttttacataggagccttcactaagccgatataaagtacaagcaattaacctttttcacaaacaagtaattaagcgaaagttattaagagcgtacataattcttctgtagctgcaaatgacatgcataagtacgccggaccggtgaaaagcgatcaggcaaccgaaagagctagtcagtaaaagatacatgctttaccactggtactgcattaattaatgaaggagctagtgctgaacagtgcggcaaggactcctataaattggctgccgtgccgctaccatccaatccactccactccatcatcccgtgcctcacgagtcacgagtcactccaggtccaggctgagcagcaatggcgccgcgaacgctcggcctcaacgcggccccgctcctccaggtacgtaacgtaactcactgccccgaaactctcaccgcgttcgttcgtggcggccgcgtgcgtgttccttcttcctcctgcgctagctgcgcggttctgctcttcagtactcctcttgtcctgacagatctcatctagctcccagctggaagtttcacgcctttccggccattatgtgcgcatggaggtgctgaaaagaaaagtgccgtctttttgcctcactttccagaatgttttttttttcaattcaagatcagaatttttttccccagtccaccgaaccagatcgttcaggtcatgtatgtggtagcagccagttgttgatctgaagcacactcctgtttcctggaacagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggacttcggcggcgtgggcgacggcaccacttccaacaccgcggcgttccggtccgcggtggaccacctgtcgcagtactcgggcgagggcggcggcggtggcatgctgtacgtgcccgcgggcaagtggctgacgggccccttcaacctgaccagccacttcaccctctacctccaccaagacgccgtcatcctcggctcccaggacgtaggcgagtggccaatcgtggatcccctgccttcttacggaagagggagggacaaggtcggagggaggttcgctagcctcatcggcggatcgaacctgaccgacgtagtcatcactggcagcaacgggacgatcgatgggcagggcgccatgtggtggtccaagttccacaagaaccagctcaagtacacgcgcggctacctcatcgagctgatgcactcggacaccatctacatctccaacctgacgctgctcaactcgccggcgtggaacatccacccagtctacagcagcaacatcgtggtgcaaggcatcaccatcctggcgccgaccaactcgcccaacaccgacggcatcaacccagactcctgctctcacgtccgcatcgaggactgctacatcgtgtcgggcgacgactgcgtggccatcaagagcggctgggacgagtacggcatctcgtacgggatgcccagccagcacatcgtcatccgccgcctcacgtgcgtgtccccgaccagcgccgtcatcgcgctgggcagcgagatgtcgggcggcatccaggacgtgcgcgccgaggacatcacggcgatcaacaccgagtccgccgtgcgcatcaagaccgccgtcggccgcggcgcctacgtcagggacgtgttcgcgcgccggatgacgctcaccaccatgaagcgggtgttctggatgacgggcgactacaagtcccacccggacgacaagtacgaccccaacgccgtccccgttgtcgccaacatcagctaccaggacgtggtggccacgggggtctacaaggaggcggcgcgcctccagggcatccagggcgcaccgttccggggcatctgcgtcgccaacgtcaccgccgacctgtccaagtccaggaagtacccatggaactgcgccgacatcgagggagtgtcggccaacgtcagccccgcgccgtgcgacccgctacagggcgcgcacgacggcgcatgcccgttcccgaccgacacgctgcccatcgaccaggtcacagtgcagcagtgcgcatacgacatcccggccaccaactagcagctcaatcaaggagtgtattcggatgtggatcagccgcctagtacaacttgtagttcaggtccaatgcaagcgactagtagtatcaagtctcatcaacacaataacgacagaatgaatcgggcactagcctagaaagcattcataaactccgagcctgtacaccatctacagcctaaagactgacttgactcatcacctgccgccgaagaacgagaagaagccgcctccgcctcctttcttctcgggcctctcctgctcttcgaccatgaccgccgtcatcgcatctctttccaccaatctccaagtagcctgctccagagcaaggccagcaggcgtgggcgggtcattcagcaccagcggcacgcccctattcgtactccggatcacctccgtgtcctctggcaccacgcctagtaaaggcaacccgagcatttcctgcacgtccagcgctgacatcatgtcctcccccttcaccaggtctggccgcactcggttgacaacgatcttgatgtctttgatgccatcgcactccagcagtcccgcgacacggtcagcatcgcggagagccgtaatgtcgggagtggtaacgagcaccgcctcttctgcgggtgcaatggcagtgacaaacccagcatcaacacctgcaaaacaaaacatcaagcggctgtcgttgacgctgtttgcgggtgggctggtcgagcgtcgtagcgcgtccgcgacccaggtgagggtcttggatccgaacgcgaggggcagcttggagcggggcttggagaggcagaggaggtggaggtcgtggagcgcgcggtggcggacgagcgcctggtcgagtcggcagtctcccgcgaggacgtcggcggcggtgaggtggacgcggttctcgaggccgagcaggaggtcgaggttgcggaggccagcatcggcgtcgacggcgacggctgggaggccgaggcgcgcgagagaggcggcgaggttggcggtggtggtcgtctttccgacgccgcccttgccggaggtgacgaccaccacgcgcggggtcgggcccgagagctcgggcgccgtgcgccccccgtggttgcgcgcggagacggcccgcgtggatgccgccgccggaggagggggcagcgggaggaggcgcggcggcgcgaacgccatcggcggactagggttggctagggttttgttcgggagctgggaccggggagaggtcagtccgagttggaggtggtggtggcggcggccgcgaccatggccgatgctacagtacagtatgtgtgtgccaccgcatttttttggtggaaagggttgaggaggcccacgttcacgaacagaacgggacagactttt

SEQ ID NO: 19171 - DNA, 1804 bp, Zea mays
  misc_feature (1788)..(1789): n is a, c, g, or t
cgggcggccgccagcccggcgggaatccactccactccatcatcccgtgcctcacgagtcacgagtcactccaggtccaggctgagcagcaatggcgccgcgaacgctcggcctcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggacttcggcggcgtgggcgacggcaccacttccaacaccgcggcgttccggtccgcggtggaccacctgtcgcagtactcgggcgagggcggcggcggtggcatgctgtacgtgcccgcgggcaagtggctgacgggccccttcaacctgaccagccacttcaccctctacctccaccaagacgccgtcatcctcggctcccaggacgtaggcgagtggccaatcgtggatcccctgccttcttacggaagagggagggacaaggtcggagggaggttcgctagcctcatcggcggatcgaacctgaccgacgtagtcatcactggcagcaacgggacgatcgatgggcagggcgccatgtggtggtccaagttccacaagaaccagctcaagtacacgcgcggctacctcatcgagctgatgcactcggacaccatctacatctccaacctgacgctgctcaactcgccggcgtggaacatccacccagtctacagcagcaacatcgtggtgcaaggcatcaccatcctggcgccgaccaactcgcccaacaccgacggcatcaacccagactcctgctctcacgtccgcatcgaggactgctacatcgtgtcgggcgacgactgcgtggccatcaagagcggctgggacgagtacggcatctcgtacgggatgcccagccagcacatcgtcatccgccgcctcacgtgcgtgtccccgaccagcgccgtcatcgcgctgggcagcgagatgtcgggcggcatccaggacgtgcgcgccgaggacatcacggcgatcaacaccgagtccgccgtgcgcatcaagaccgccgtcggccgcggcgcctacgtcagggacgtgttcgcgcgccggatgacgctcaccaccatgaagcgggtgttctggatgacgggcgactacaagtcccacccggacgacaagtacgaccccaacgccgtccccgttgtcgccaacatcagctaccaggacgtggtggccacgggggtctacaaggaggcggcgcgcctccagggcatccagggcgcaccgttccggggcatctgcgtcgccaacgtcaccgccgacctgtccaagtccaggaagtacccatggaactgcgccgacatcgagggagtgtcggccaacgtcagccccgcgccgtgcgacccgctacagggcgcgcacgacggcgcatgcccgttcccgaccgacacgctgcccatcgaccaggtcacagtgcagcagtgcgcatacgacatcccggccaccaactagcagctcaatcaaggagtgtattcggatgtggatcagccgcctagtacaacttgtagttcaggtccaatgcaagcgactagtagtatcaagtctcatcaacacaataacgacagaatgaatcgggcactagcctagaaagcattcataaactccgagcctgtccaccaaaaaaaaaaaaaaaaaaaaaaaaaaaaaaaaaaaaaaaaaaaaaaaaaaaaaaaaaaaaaaaaaaaaannaaaaaaaaaaaaaaa

SEQ ID NO: 19172 - DNA, 4999 bp, Zea mays
ggtttttaataataaatttttggagtacctaagatgaatgtccagagacattatattttttgagagtggtacactcaacacttctagtcataaatcatttgtcttctagtcataaatcgtttgtacctgacatgtacatgacattactgaattagtaatacaagttggccttaaaattcatgtagaaaacggtaggctcctctgttgccttctccaaaaaaatgggaagaaacaacccctagaaaattgagcgaagctaatagcccaaaaagagactttcgaggctctctctctcatctttccctctattgtgaaaataggaggtgtgttttcaatcaaatgaggtgattctacctgggcttctcctgaaaatagggagttattctttcatatgagccagagttagaggtgaagccagtgatgcaatagctctaccaaagataccttagagcatttctaacaatggtctcaaattaaattaagtttcatgttgaaatatatgacacgtgtcttaaaatagcttccaacaatgatcctattttataaaattttgataaacacgtataagacccaaatatagtgtctagtactcatctacgacccctatcccgtttttcccatgatcctaccttcccgtgaaacttcatcgtacctagggtaacctagggtgtaggaacgttgcctcgtttggagtgctcgttgctttggccatttcgacccgcgatgatactgctcgttgcttttgcccttgctgcctcgcgatggtactgcacgttgggtctctatgcctgcaggttgcctagcgccttctctactgatgcgaatagcatatgcaactagcggtagtgaatagcagatggcgtggcaaaaaacatttcccaaactatggcaggttaacagattagtaattataggacctattgttggatctaaacaatttgttgggccttaaaattatttaaaatggttcctattttaaaaattaggacccaattttaggactctcacggcttccaaaatctatttttaggagcatctaaaaagttattggaagtagattataaccctttctccgacagtttccctaaaacgaatcaaaaatattttaagctagatcagatcagcattcgtcttatatcgatatctttttacggatgcattttcttattccgcagctttaacgtctgcatagcgaccaaacctatgccgccattaaggtcggtggcggtacatgggcgggagcgaccagcgagggaggatcaaggatcaactatgggcccaagcaacaatagaggcctgaccaacaacggaggtccaatagcagggccgcatgacgacaggttgcgcggccgtgacagcggacaccctgctagtttttgcaaacgagaaagaatttgtgcagaaaaatacacacaaagcagtaaaaaaaaagaaagtttgctcgattttgcatgcgcttgcgtttctagggagcccaaaagttttattttttctagctataaatgagatagtttagggctacgaaaaaattagaggaactttaggatagtgttggagacaagattttgtgttttttccaaaaaaaaaaacttaatttagaagactgcttggatggaaggataacaacaccgtcagagcatctccattagttctccaaaaaatgctccataaactctgatttagtaagttgttaaatatatattgtaaacaaaaactatcttaacatccaacggtccccaattcttaaaccattgaatatttaaattatgttaactcgatggtaaattcattattttcttaatttaaattatttgaagtacatcaattcattattttcttaacttgaattatttaaagtacattatttttacacgggtgggtgcgaatttgatggtgattttatggtgtgattgggctattgagaggtgaacaacttcctaagtttggcgactaaatagtgatattttaaaatttagtataaattaggatctcatttaagaaactgttaacactctaaattaaatatatggaggtttttttttgaacttctggagatgctctcatggtagtggaggattactccttgagtgagctctgagctgcgcagtgcgcacgtccattcgacccacgtgctgacacttgacagtgacagaataatcaattcaaaactgcaaatggctgcgtaaaaaatactaatacagtatgaaagtgaaaatgagccggagaccaagactggggagacagcacagtcacggaatcaaaacacaaaaacgatttttacaaacaaaataaaaaagactttcctaaagagagagaaatgacgacaaaaacaaaagagagacttcaactgggcaggcgccgacggcgacgtgtgggtggtggcggctggtcccaagctcggggcgggcgcgacgcgcgagcaccgcaccgatgccgatgctcctcccaccccctcccctcccctcctcctcatcacccaactactacctcccatcccatccgcgccctccttcggtcctctcccatccgctccgctcgcagcccctccccttgccccccgcgatgtcgtcgtcgtcaccgccgccgcggcccgacgacgacgacggtgcgcaggaggtgggcgccggcgatgggaggtcgctgggctacggcgaggcggagtactgggacgcgcggtacgtggaggagggcggcgcgccgtacgactggtatcaacgctacgacgcgctccgccccttcgtccgctgcttcgcgccgccggcgtcccggatcctcatggttggctgcggctccgcacgtacgcaatccgccccaacccacttccttctagtaaccagtaactctacccatcgtactatcagcaacagtaatagcggacgagcggagttttccttgttgcggcgttgcttcgctttcttccaataatccctcgatgttcccgaaaatagaaagctcaggtcaattttctcctcctcttgttgctcgtaatagtaagcaatctgcgaaatgcgccgatagaattgaaaccactgtttgggtttggccacgcaatagtagtgtctgcagaagtgtcggtgcctaggtggtgatttggttgcgctttttttttgtatctttgcttaattactgtacgtatatcgtcatggggcatgacaacgggacagggtctttctcgcgccacttcttttctgccaagtcgttctcttggtcggtctacgtgttgggcatagtgtttcatctgctgtttactctgaacggaatcctgctgctgctgtggattgctctacggactacagatatgccacttgtgaagcatactggaattgcacgctcttgtttcttgtcactcgtctacgcagcattattgtgtttctttgcttttccttatgttgaacgtggagtcacacatcccgaaccacgaaccagcacttgtctgtatgatttattttaattcgtccaggaaacaacagggttgtacagtcgattgtctcaatgcactctgatcaggctagtcctgtagtacagcaagtttgctttttgttcttgtcaggcaaacctccacactttcatgcttcttcttttccttaatcacattctccgtcctaattaatgcaactaatccaattttcttctctgatgcctgtagtcatgtcggaggatatggtcactgacggctatgtggagatagtgaacattgacatttcgtcggttgtgattgagatgatgagaaagaaatacttcgatgttcctcagctgcaatgtatcctttgactgtttttatcatttccccccaatctattgtccattgatacccttatgaactgcagacttgcgcatggatgttagagatatgagtatgtttccggacgaatcgttcgattgtgcaatcgataaaggtacacttttcctgctatgatgttctgtttgtggccattgctgacccgcatttgaagtaatttcactcacttaactttgttaaattcttagggactctggactcattgatggtaagtaggagtaggtaacattaagtcaccatgtccttttgcttatttctggacttcttcagcaatgccgtcttgctgctttcatagtgtggtgtggatgctcccctcagtgcagctcagatgattttggaagtggacaggttttttagtgtcttgctgcctttctgaagtatcactctgcagtgtcatctgggccaagatatcttgtaaatttcaacagccctgcagccttatcagttatactttttattgcaggcttcttaaaccaggaggaacctttattttggtacgcacttttgtacatttgctctgaaagtagtgctgttggggacaattttgggtctgagttctagattatttctccattcctcttcttagtcatgggcctatgggccttagtcacatacacagcccagcatcaacaatgttgaaaccctggtatgcattttgacccaattttcgtgtgtgaacttgtagataacatatggtgatccatcggtacgaatgcctcatttgaatcaatcagcatgtgactggaaagttgtactttatattctacgtacgtatcaaactttagtttgagtttttaccccttgctttggagacatatatgttgtccaactgacagtaaaatttgtacaatgtggtatgtttccttttccttttgtattgtgatataacagtacaatattgcctttttttcatgtgcaatgcagttgaagtgagaactgagttgttctttctgttttctcatgaatatattgtctgttctgttacataaaatgactaatatgtctaattcatttcacttaactctggggtgctgcaagaaatttacttcaaaagaatgtcatctgttagtagaattagtggtccatagtaccccacagagcgatacaaaaatgaggataaatgatggtacgataagatggaaacagatagctgtgtaaaagcctgctgagtaaaaaaaaagtgaatattttttatgctgg

SEQ ID NO: 19173 - DNA, 1569 bp, Zea mays
gacggcgacgtgtgggtggtggcggctggtcccaagctcggggcgggcgcgacgcggagcaccgcaccgatgccgatgctcctccacaccccctcccctcccctcctcctcatcacccaactactacctcccatcccatccgcgccctccttcggtcctctcccatccgctccgctcgcagcccctcccccttgcccccccgcgatgtcgtcgtcgtcaccgccgccgcggcccgacgacgacgacggtgcgcaggaggtgggcgccggcgatgggaggtcgctgggctacggcgaggcggagtactgggacgcgcggtacgtggaggagggcggcgcgccgtacgactggtatcaacgctacgacgcgctccgccccttcgtccgctgcttcgcgccgccggcgtcccggatcctcatggttggctgcggctccgcactcatgtcggaggatatggtcactgacggctatgtggagatagtgaacattgacatttcgtcggttgtgattgagatgatgagaaagaaatacttcgatgttccgcagctgcaatgtatcctttgactgtttttatcatttaccccaatctattgtccattgatacctttatgaactgcagacttgcgcatggatgttagagatatgagtatgtttccggacgaatcgttcgattgtgcaatcgataaagggactctggactcattgatggtaagtaggagtaggtaacattaagtcaccatgtccttttgcttatttctggacttcttcagcaatgccgtcttgctgctttcatagtgtggtgtggatgctcccctcattgcagctcagatgattttggaagtggacaggttttttagtgtcttgctgcctttctgaagtatcactctgcagtgtcatctgggccaagatatcttgtaaatttcaacagccctgcagccttatcagttatactttttattgcaggcttcttaaaccagcgaggaacctttattttgataacatatggtgatccatcggtacgaatgcctcatttgaatcaatcagcatgtgattggaaagttgtactttacattctaccaagacctgtgttcactggaaagataacgaggcgtgtactggatcctgttccactgaccgagaggggtagactccctgatggatttgtcccagaggatcctgactcccattatgtctatgtctgcaagaagatgcagggattaacaggcacaggttccccaactgtaaaccacatagagaggcaaggggaagaataaacaaataggctgatttcacctcccacaagattagtggattgttatgatttatatacaagatcagatacgtttccaccattgttgtggccatccaaatgtagaagcgtgccattgcatatctaactgatcttgtaaaagttgcaagaatccgggagtcaatgctttgcgcaagagctgtcctttttctttctttcttttctgtatcatcttgggaagcacaacggaattgtttggtacattcgaggaagagatttatttttattacgccccgtttggatcaaaaaaaaaaaaaaaa

SEQ ID NO: 19174 - DNA, 1310 bp, Zea mays
gtggcgcccgggccccacctcggggcgggcgcgacgcgcgagcaccgcaccgatgccgatgctcctcccaccccctcccctcctcctcatcacccaactactacctcccatcccatccgcgccctccttcggtcctctcccatccgctccgctcgcagcccctccccttgcccccgcgatgtcgtcgtcgtcaccgccgccgcggcccgacgacgacgacggtgcgcaggaggtgggcgccggcgatgggaggtcgctgggctacggcgaggcggagtactgggacgcgcggtacgtggaggagggcggcgcgccgtacgactggtatcaacgctacgacgcgctccgccccttcgtccgctgcttcgcgccgccggcgtcccggatcctcatggttggctgcggctccgcactcatgtcggaggatatggtcactgacggctatgtggagatagtgaacattgacatttcgtcggttgtgattgagatgatgagaaagaaatacttcgatgttccgcagctgcaatacttgcgcatggatgttagagatatgagtatgtttccggacgaatcgttcgattgtgcaatcgataaagggactctggactcattgatgtgtggtgtggatgctcccctcagtgcagctcagatgattttggaagtggacaggcttcttaaaccaggaggaacctttattttgataacatatggtgatccatcggtacgaatgcctcatttgaatcaatcggcatgtgattggaaagttgtactttacattctaccaagacctgtgttcactggaaagataacgaggcgtgtactggatcctgttccactgaccgagaggggtagactccctgatggatttgtcccagaggatcctgattcccattatgtctatgtctgcaagaagatgcagggattaacaggcacaggttccccaactgtaaaccacatagagaggcaaggggaagaataaacaaataggctgatttcacctcccacaagattagtggattgttatgatttatatacatgatcagatacgtttccaccattgttatggccatccaaatgtagaagcgtgccattgcatatctaactgatcttgtaaaagttgcaagaatccgggagtaaatgctttgtgcaagagctgtctttttttctttcttcctttcttttctgtatcatcttggaaaacacaacggaattgtttggtacattcgaggaagagatttatttttattattgttcgaagaaagaaaggaattggcgggcgaagtgaaaaaaaaaaaaaaaaaaggccccta

SEQ ID NO: 19175 - DNA, 842 bp, Zea mays
  misc_feature (1)..(1): n is a, c, g, or t
  misc_feature (5)..(5): n is a, c, g, or t
ncggncggaatagcccaatgcgctgaatagcgcagcatcctttcccttcacgccccaccctcggcctcgcttccacccatccgccgcggctcgtctccgtctcccggctcctcggcgtctagctcgtcaacgcgcgcgtccgccgtcggctcctccgaccggcgtcccaccgcaggggaatacagatcgacgatccgctgggcttgcaaacatgtatatccgagtgaagcgcaacaagagtacctacttcattcaatgtgaaccaacagagacagctttgagcatcaaacagaagttgcactcgctgatagatcaacctcctagtagtcagcagttggtcttgtggcctagcagtgatgtgcttgaagactcaaagactttggcagatcaaaaggtggataacgattccattgttgcattggcactaagaaaagatgacggtgagtttgaggaagttttcatcgctaggccggaggatttcatgtcatcatcatgataaagattagtccatcatttctacaaagggaccactgcgcgttcttggagtggaccgtcgctctatgctggttcttctagaatctgggatgtggcttgcttgtccctttgggaggaaaaagaaaatcttttatgtgagatcccaaacaaccgttgtggatgatattaagctttgatttgacgctccaactgatgccgtgcttcttgtacctactggtgtctgtcttggtgttgggatcagagcgcacctaattgtccttttttgtaccagctgttgtatgtgaatccatctgtgccttcatcacctaatgcactcgctgttgctgctggcaaaaaaaaaaaaaaaa
